United States Patent 10,696,975 (GENES AND USES FOR PLANT ENHANCEMENT) - sequence listing, part 13

SEQ ID NO: 56211 - protein, 478 aa, Hyphomonas neptunium ATCC 15444
MALDGTPGTGMNALLAKQKAAHLRDGIPPVQKRIEWLDKSIDLLATHGDALNEAMRADFGHRSKDQSNLTDIAGSIGALKHAKAHVAKWMKTEKRKVEFPLGLLGSKAELQFQPKGVIGVISPWNFPVNLTFTPLAGVFAAGNRCMIKPSEFTEATSELMKELIAKYYSPEECVVVTGGPEVGAEFTKLAFDHILFTGATSVAKHVMRAAADNLVPLTLELGGKSPVVLGRSADLEKAASRIMAGKTLNAGQICLAPDYAFVPKEKTQEFVMAATKAVETMYASGLKDNDDYTSIVNQRHFDRITGYIEDARAKGGQVIEINPKGENFSQQPYHKIAPTLIIDPTDDMKVMQDEIFGPILPIKSYNDAKDAVAYINAHDRPLGLYYFGDDQSEKDFVLNNTTSGGVTVNDVVFHVAQEDLPFGGVGPSGMGSYHGRDGFLEFSHKKAVYSQTKNEILAMMRPPYGDKYRAQVKGRMKK

SEQ ID NO: 56212 - protein, 272 aa, Hyphomonas neptunium ATCC 15444
MPTYPFYQVDAFANQPFEGNQACVMPMEAFLPDDILLKIAAENNVAETAYLVPQADGVWALRWFTPAVEVPLCGHATLASAHVLFDAGGYDADILHFDTVQSGRLSVRRLDDGRLEMDFPSAPIRPVPVTDEIVAALGARPLEAWGGMFYAARFDSPDAVKQLSPDLKALKALGAEGGGWDRGNFGCFALGGDGVEVTSRFFAPGSGIDEDPATGSWHTMLSRILGTHFDLPEAACWQAYPGRGARVDVRLEGDRVKLVGRAVTVIEGQFRL

SEQ ID NO: 56213 - protein, 356 aa, Hyphomonas neptunium ATCC 15444
MSIHPVIMCGGAGTRLWPASDKACPKQFHRLVSNHSVFQETVLRFRAAEDEEVFAAPIIISNAAYIELIETQLAEIGVEACAILLEPEGKNTAAVAALAARFIAGKFPGGLGLLLPSDHYIGQPSVFINAIRKAAETAQKGYITTFGIAVSRPETGFGYIHAGSPLDGPVSTVAAFREKPDSATAASYLAAGDYSWNAGIFLFEADTLLIELEAHAPDILEISGLALSKARHDGNKIFLDPGYFTSIRSTSIDYAIMEKTHRAAVYAPLECAWSDIGTWAMIGDVSDRANSPEAISVASGECLVHAAEGILVALVGVENLIVVADGNRVLITTKERSQDVGKVVQELRARGLDAYL

SEQ ID NO: 56214 - protein, 440 aa, Staphylococcus aureus subsp. aureus Mu50
MSNGKELQKNIGFFSAFAIVMGTVIGSGVFFKISNVTEVTGTAGMALFVWFLGGIITICAGLTAAELAAAIPETGGLTKYIEYTYGDFWGFLSGWAQSFIYFPANVAALSIVFATQLINLFHLSIGSLIPIAIASALSIVLINFLGSKAGGILQSVTLVIKLIPIIVIVIFGIFQSGDITFSLIPTTGNSGNGFFTAIGSGLLATMFAYDGWIHVGNVAGELKNPKRDLPLAISVGIGCIMAVYLLINATFLLTLPIELLAGNLNAASDTSKILFGENGGKIITIGILISVYGTINGYTMTGMRVPYAMAERKLLPFSHLFAKLTKSGAPWFGAIIQLIIAIIMMSMGAFDTITNMLIFVIWLFYCMSFVAVIILRKREPNMERPYKVPLYPIIPLIAILAGSFVLINTLFTQFILAIIGILITALGIPVYYYKKKQKAA

SEQ ID NO: 56215 - protein, 430 aa, Physcomitrella patens subsp. patens
MGDNPSQNQSGMGKRVYQVWKGSNRFFLCGRLVFGPDVRSLGVTVFLIVAPAVCFCVFVGRHLLHHFDNNGGIAIVAVTVINTAYVLVLLLLTSGRDPGIIPRNTHPPEPEEDFDPSTSPADWGGQTPRLRLPRTKDVTVNGVVVKTKYCDTCMLYRPPRCSHCSICNNCVLRFDHHCPWVGQCIGQRNYRFFFMFVSSTSLLCVYVFAMCALYIKILMDEGGRTVLKALSKSPASIVLMAYTFICVWFVGGLTVFHLYLIGTNQTTYENFRYRYESKENPYNRGCLLNFNEIFCFKIPPSKNRFRSRVQEVTPGSMGITQQSRDMGEMHGSSAGKAPDVEQGYKPTWPHAEDMVGEGGELEMAGGRVSTGSECGMEMKDSFDPRPFEQGRPAVAHPRRSSWGRKSGSWEISPDILAMSTGVLITARRPT

SEQ ID NO: 56216 - protein, 486 aa, Ashbya gossypii ATCC 10895
MESVKMQKRGSSPMSSPRKKRKHLVSTLNKHYKSINKLDDYRQLYISDSRMDIFVWGTGSMCELGLGPLAKNKEVKRPRLNPLLQREKAGIVSFAVGGMHCLALDSDNNVWSWGTNDSGALGRDTSGAAEQLRDMDAAESSDDEDGDLNELEATPTMLPRDSLPLDTQKVVQLAATDNLSCVLFENGDVYAWGTFRCNEGILGFYQDAIESQRSPWKLPSFSGSRIVQMAPGKDHILFLDEHGVVYAWGNGQQYQLGRKIMERSRLRTLDPRAFGLDGVKYIASGENHSFALADDGRLFAWGLNQFGQCGISNEVEDGAMVTVPTEVLLPPDVKVESIAAGEHHSIVLTQDGDLYTFGRLDMFEVGISAEDYPESTYKDVHGKARSVPVPTKLKGLPKFKAIAAGSHHSLAVARNGIIYSWGFGETYAVGLGPAGEDVEVPTRIKNTATQHESIVFVGCGGQFSVAGGIELSDEEAEKRAKEMGDE

SEQ ID NO: 56217 - protein, 69 aa, Zea mays
MADWGPVIVATVLFVLLTPGLLCTLPGRGRVAEFGSMHTSGLSILIHAVLYFALVTIFLIAVGVHVYTG

SEQ ID NO: 56218 - protein, 753 aa, Magnaporthe grisea 70-15
MGPPLDDVVAGMPSALIHAQKIPPANLVADETRFEITSYPSLTQVTKTPATPGQVDFVVVLQVHQSRAHDKWQVAVSTSALHSSVWTDSVLASSSAENVPIYLQASDDKSVRKLHFTASISVESAVRFTLKFRESPDDPWRFVRDELQLEDGIIVPDHPDSLPDDIHDVIEGLSRHVTIRQAVSQSPATCLWQLDAPIAGVGSSDESALSEVGLGLPWGRHLLRWFALARTWAPWIAPCHGKAKFDLDRDAVMCSFLNDQGKHCVLLAVTGTDHVLTGLRSNDAGKVVLRIRSDNLAETAAKVIVAVGETSKHKHIQHVAVWHALLGYWGGIAPGGPIANSYKTVEVVREEAKRRGFPLGGPMTVIAKEDVNRFYDDFYRFLASTGVDGVKTDAQFVIDMWIGAGARRELSDAYLDAWTIASLRHFSNRAISCMSMTPHIMFHSQLPRKRPAIPLRNSDDFTPAIPASHPWHVWTNAHNGLLTQYFNILPDWDMFQTSHDYSGFHAAARCVSGGPIYITDVPGEHDKALISEMTGVTPRGKTVIFRTSAHGKSIDQYIGYTDDALLKVGTYHGGANSGTSMLGIFNVALRPLTDIIPLARFPGTRPQRTYVVRSHGSGRVSPPIEPGTSASMLAVSLGVRGYDILSAFPLSCFTSRSGVDVQVANLGLLGKMSGAAAVVSSDIQQAEGSGRILVHTRVKALGVLGIYVSRLPDMSIARDMFATIHGSVMPEETVNEVELKFYIGLGNIDSESS

SEQ ID NO: 56219 - protein, 557 aa, Kineococcus radiotolerans SRS30216
MRELTGVGVGTGAAVGAAVVLAPAARPPADEPAATDPATAGADVRAAFDAVADALRARADRAGGTTADVLRATALMAADPGLLAEVDRRLGLGTGPATAVDEAVETFCDLLAASGPYLAERVTDLRDVRDRVVARVLGLPEPGVPDLTGPSVVVARDLAPADTAALDLTRVVGIVTELGGPTSHTAIIAAQFDIPCVVRVAGALDLPDGAELALDARAGTVTLHPGVELRSAVGARRAARAELARSAGGPGRTADGVAVQLLANVGTLEDAERAAALDVEGVGLFRTEVLFLERTTAPTLEEQAEVYARVLRAFGERKVVVRTLDAGADKPLAFVEAAAEENPALGVRGLRTARRHPALLDTQLGALAAAARASGTQPWVMAPMVATAQEAAGFAARARAAGLNRVGAMVEVPAAALRAPQLLAAGLDFVSVGTNDLTQYAMAADRLAGDLAELLDPWQPAVLQLVGLTGSAGAARGAPVGVCGEAARDPLLALVLVGLGVTSLSMAPAAVPAVRSALARTDAATCRAMAAAALAADSPAGARDAAAGLADPGVLAL

SEQ ID NO: 56220 - protein, 436 aa, Thermoplasma acidophilum DSM 1728
MSGKADPLEIAKEAKPSQANNEVEEDPFEIALKQLRKAAKVLNLDEQALEILSSPQKILQVSLPVKMDDGKVKVFTGFRVRHNIARGPAKGGIRFHPQETLSTVKALSMWMTWKCAIADIPYGGAKGGIICDPSTMSQGELERLSRAYIRAIADFIGPDVDVPAPDVNTNPQIMAWMLDEYENIVRHNAPNVITGKPLEVGGSLGRFDSTGKGGMFVLREGAKKIGLDLSKARVAVQGFGNVGQFAVKFVEEMFGAKVVAVSDIKGGIYSENGFKFDDLLAWSKKIGSVVGFPGSKPITNEELLESDVDVLIPAAIEEQITARNADKIKAKIILELANGPTTPEADEILYKKGKLVLPDVLSNSGGVIVSYFEWVQNNYGEYWSTEEVTNKLDVKITKAARQVLETMDKYHVDPRTAAYVIAVKKVADAMKVRGWY

SEQ ID NO: 56221 - protein, 300 aa, Prochlorococcus marinus str. MIT 9312
MTEAISNISDFEEYLKNAKKVVEEALDFSLGPENPEILRESMRYSLLAGGKRIRPILCLASCSLAGGEPSLAVPTAVAIEMIHTMSLIHDDLPAMDNDDLRRGRPTNHKVYGDAIAILAGDALLTRAFEMVSLRSPGVDPTRLLNVIGELSLVAGAPGLVGGQVVDLECEGKEVDLETLEYIHLHKTGALLKACVRTGAMIAGANEETLQALTTYAEGIGLAFQIIDDILDLTSSSEKLGKTAGKDLLADKTTYPKLLGMEESKKRAFDLVENAKKAIKPWGADAKYLISLADFITNRDR

SEQ ID NO: 56222 - protein, 507 aa, Prochlorococcus marinus str. MIT 9312
MPSTLSNPLRLGLRQERVISPQCLVIFGASGDLTHRKLIPALFELYLQRRIPSEFGIVGCARRPWTDNEFREKMKVKLSTQISGKEKEWEQFSNYLFYEPVDLQQSDHVVRLSKRLNKIDKRQATHGNRTFYLSVSPNFYASGCKALKIAGLLDDPKKSRLVIEKPFGRDYSSAKKLNKIVQSCAEESQIYRIDHYLGKETVQNILVMRFANTIFEPIWNRNYISSVQITSSETVGVEDRAGYYESSGALRDMLQNHMTQMLAVTAMEPPGKFEPEAIRNEKAKVLQASKLADENEPWNCCIRGQYGEGGNISNLLKGYRQEDGVNCNSTTETYIATKVFVDNWRWQGVPFYLRTGKRLPKRLGEIVLTFKDVPVHLFESTIINPAPNQLILRIQPNEGATFNFEVKSPGSGMKSRPVEMEFSYDESFGEPSDEGYVRLLADAMLSDPTLFTRSDEVEAAWKLYTPLIELMDNSPWKLPIYNYESMTWGPPESDQLLSKDNIFWRRP

SEQ ID NO: 56223 - protein, 405 aa, Fulvimarina pelagi HTCC2506
MEDYYKIRRLPPYVFEEVNRLKAAARAKGADIIDLGMGNPDLPTPAFIVDKLCEVARDPRAHRYSASRGINGLRKAQAAFYERRFNVKLDPNRQVVATLGSKEGFANMAQAITAPGDVILCPNPTYPIHAFGFIMSGGTIRSLPAKPDEDFLRAMERAVVHSIPKPIAVVLNFPGNPTAFTATREFYKDVVDFAKKHEIIVLSDLAYSEIYFDDVPPPSILEVEGAMDVAVEFTSMSKSYSMPGWRIGFAVGNERLCAALGRVKSYLDYGAFTPVQVAAATAINQGDKAVAEIRQVYKKRRDVLVDSFGRAGWDVPPPPSTMFAWVPLPAAYKHMGSLEFSKLLVEEADVAVAPGVGFGEHGDDHVRIALVENEHRIRQAARNLKRFLASDEGEGQKVVPMRARA

SEQ ID NO: 56224 - protein, 182 aa, Silicibacter pomeroyi DSS-3
MKTGASLPNVIFHTRVRDEAVGGPNPYRWQDMTTAAYFAGKRVVLFSLPGAFTPTCSTYQLPGFENGFADFQNQGIDAIYCMSVNDSFVMNKWAEAQGLKNVTVIPDGSGEFTRKMGMLVDKDNLGFGFRSWRYAAIVNDGKIEAWFEEPGLMDNCPEDPYGVTSPETVLNWLVAANSEVAA

SEQ ID NO: 56225 - protein, 176 aa, Bordetella petrii
MSLDRVSSGKQLPEDFNVIIEIPMNADPVKYEVDKDTGAVFVDRFMLTAMHYPCNYGYIPQTLSDDGDPADVLVVTPFPIQVGAVVRCRALGVLEMDDEAGGDAKLLAVPVDKLYPPYRHIKSYEDLPAEDIGRIQHFFEHYKDLEKGKWVKVKGWKGVQAAQEEIVRSAERYSKS

SEQ ID NO: 56226 - protein, 318 aa, Glycine max
MAAASGMPEEETAMFPDKSVHPRLDVYVWDMDETLVLLNSLLKSSYAEAFNGLKDVQKGVEIGRTWENLILQICDDYFFYEQIENYNKPFLDALAQYDDGRDLSDYDFNEDELVSPHDDANKRKLAYRHRVIAQKYLQGLRNILDNKTIKLWDELYDKTDEYTDRWLSSARTFLKECSGEDKDAVYSIAFANTSSNSTNAKHVNVLVTSGSLVPSLVKCMLFHLDSLITHGNVYSSWEVGKIQCFRWIKERFNHPNVRFCVIGDGWEECEAAEIMRWPFVKIDPRPGKLHRFPGLTLTTISHYFSVVYGRPDNENGEE

SEQ ID NO: 56227 - protein, 394 aa, Methanosarcina acetivorans C2A
MKAVVYKGPRNVDVEEVKKPEIEKPTDVIIKVTSSGICGSDLHLYDGHGPDGLGTILGHEPMGVVEEVGDAVELVKPGDRVVIPFNVACGSCLNCIRGLTNMCLTMNPDAAIANYGYPGAGPYAGGQAEYLRVPYGDWACLKLPGEPGDEFEDDFVMLADIFPTAYYAAELAKVKTGKTVAVFGAGPVGLLAAYSSMLMGASEVYVVDKSDKRLKLAESIGAVPINFTDGDPVEMIMQIRQNNKNLMSSLRPGEEKVLGVDCAIDAVGYQALDRNNSEEFKPNQVLMDIARIIAPGGSIGVIGVYSPDPAGKDENEKQGYLTLPWAELWFKGVSIGTGPTPVKQMHGFLRNLIFNGKAKPSFIVSDRISIDEAPEAYKQFDKRDDVVKPIIKFH

SEQ ID NO: 56228 - protein, 453 aa, Synechococcus sp. WH 7805
MDQNFDLVVIGAGSGGLAAAKRASAYGARVALVEGDKVGGTCVIRGCVPKKLLVYGSQVSEHLADAPSYGVDVPPATINTHVLLKAVRAEVDRLNALHVNLLEKAGVTLIQGWGRFEDDHRIAVSSKPGGEALKVLNAGRILIAVGGRPRRPAIPGAELGWVSDDMFLLDRFPDHVVVVGAGFIACEFACILRGLGIAVTQLVRSDGLLRGFDRELAAAVQEGMIEKGVDLRLSTSPAAIEGAPGDLVLITDQGDRIPAGGVLLATGRQPFLQGLNLEAAGLRSDGRKLAVDADQRTSTSHIFAVGDVTDRICLTPVAVDEGRAFADTEFGGRPRQVNHDLVASAVFSQPELATVGLSEEAAISRLGADAVVIQRARFRSMAQALPKRGPRTLLKLVIEADTDKVLGCHMVGDHAAEIIQMAAIAVGMGATKADFDRTMALHPTVSEEFVTMA

SEQ ID NO: 56229 - protein, 485 aa, Cryptococcus neoformans var. neoformans JEC21
MMHASKHKMGFSDFRDAILIQPPSFKKKKEYVLEELLGRGGFGKVVKALWAPPEREPKEVALKIINKKLVKGNEQAVLDEISVLKHLDHPNIVHVWDDFESRDKYYIAFELAVGGELFDRISERGKFTERDAVECIRQVLQATAYLHEHNVAHRDLKPENILYKTRDADSPLVIADFGIAKHLETPDQECSEAAGSFGYAAPEVLLGKPHGMKVDCWSIGIIAYTLLCGYPPFRSDDRNGLLQEMTRGRIMFHDRYWSKVSRTAKDFVKDMLETDPKKRSTAADALNHPWLTSGQATETDLSAAIRDNFDAKRKWKSALRIIQASNRIRSASRSRSPSLSTSPPSTANTANPSPNSALFVPEVPHVLTPLSMTDEDPMSDEHYYFSADDQGHTEEEEEAKVMTRGGKKKAGSMPVGSGSGVTTGTVTPYTTGNEGSNTPKPTIKVIDGNGELRPEETDMQTPPATAPVGAGMMGSIRGMMGKLSL

SEQ ID NO: 56230 - protein, 519 aa, Silicibacter pomeroyi DSS-3
MSQTSHDRLLIIDFGSQVTQLIARRLRELNVYCEIHPYQNVTMDFVREMAPRAVIFSGGPDSVTREGSPRAPQEIFDYGVPILGICYGQQTMMTQLGGRVESGHGTAEFGRAYVTPKGTLDILDGWFTDGREQVWMSHGDHVAEIAPGFEVYGTSPGAPFAITADTSRHFYAVQFHPEVHHTPNGAKLYENFVRLAGFKGDWTMGAYREEMIRTIREQVGDKKVICGLSGGVDSSVAAILIHEAIGDQLTCVFVDHGLLRKNEATEVVGMFRDNYNIQLIHADESDLFLGELDGQSDPETKRKIIGKLFIDVFQKHADTIEGAEFLAQGTLYPDVIESVSFSGGPSVTIKSHHNVGGLPEKMGLKLVEPLRELFKDEVRALGRELGLPQSFIGRHPFPGPGLAIRCPGEITREKLEILREADAIYIDQIRKHGLYDEIWQAFVAILPVRTVGVMGDGRTYDYACALRAVTSVDGMTADYYPFTHEFLGETATRIINEVKGINRCTYDITSKPPGTIEWE

SEQ ID NO: 56231 - protein, 466 aa, Arthrobacter sp.
MNQEGKLQKGLKIRHLTMIAFGGSIGAGLFVGSGAIIQMTGPAAVFTALMAGILVILIMRMLGEMVVAKPSLGSFSDYAREALGNWAGFTVSWLYWYFWVIVIAVEAIAGAAILKDWLFPNVSLWVLNLILLIALTITNIFSVKAYGEFEYWFSLIKIVAITLFLTLGGAYIFGLFPGIPMHLSNLTAHGGFIPNGAGIVFIAVATIIFSFVGSEIVTIAAAESAESEKAVVRAVNSVIVRIMTFYVGSVFIIVAVVPWNDAKALTNPYVSALKLMGMPGADMIMNLVVVTAVLSCLNSGIYTASRMLFALGDKGDAPKWMMHVTKTGVPLKAILTCTIFGFISVIMAFVSPETVFQFLLNSSGAIALFVYLLIAVSQLKLRKTIERETPERLKLRMWAYPYLTIATIIAMLMIITTMAFNASTRSQFILSLLSSAIVVAIYFIKTNLSKKQSLDTSIVNPENIKS

SEQ ID NO: 56232 - protein, 334 aa, Colwellia psychrerythraea 34H
MKIKVGINGFGRIGRFVFRAAVERDDIEVVGINDLMDIEYMAYMLKYDSTHGRFKGTVDVVDGKLIVNGNPVRVTAERNPENLQWNDIDVDVVVEATGLFLTDETARKHITAGAKQVVLSAPSKDDTPMFVCGVNLNEYKGQEIVSNASCTTNCLAPIAKVLNDNWGIQDGLMTTVHATTATQKTVDSPSTKDWRGGRGAGQNIIPSTTGAAKAVGKVIPALNGKLTGMAFRVPTPDVSVVDLTVNLIKPATYAEICQAMSAAAEGELNGILGYTEDAVVSNDFIGETCTSVFDAKAGIALTDTFVKVVSWYDNEIGYSNKVLDLVAFISQYEK

SEQ ID NO: 56233 - protein, 232 aa, Cryptococcus neoformans var. neoformans JEC21
MSGLALPKASNAGPSSSSSKPEGIQTLDGEGSLATRPPQKAIASVPEITAVDGLVPTLQNIVATVNLDCRLDLKTIALHARNAEYNPRRFAAVVMRIRDPRTTALIFASGKMVVTGAKSEDDSRLASRKYARIIQKLGFEAKFAEFKIQNMVGSCDVKFPIRLEGLAFSHGAFSSYEPELFPGLIYRMLKPKVVILIFVSGKIVLTGAKVREEIYMAFNQIYSVLLEFRKTT

SEQ ID NO: 56234 - protein, 450 aa, Zea mays
LDDDGRPRRKGTFWTASAHIITAVIGSGVLSLAWAIAQLGWVAGPAALLLFAFVTYYTATLLAECYRTGDPDTGKRNYTYMDAVRSNLGGTKVLLCGVIQYANLVGVAIGYTIASSISMKAVRRAGCFHVHGHGDPCRSSSTPYMILFGLVQILFSQIPDFDEIWWLSIVAAVMSFTYSSIGLSLGIVQTISNGGFMGSLTSISFGAGVSSTQKVWHTLQAFGDIAFAYSFSNILIEIQDTIKAPPPSESKVMQKATCVSVATTTIFYMLCGCMGYAAFGDNAPDNLLTGFGFYEPFWLLDVANVAIVVHLVGAYQVFCQPIFAFVERRAAAAWPDSAFISRELRVGPFALSLFRLTWRSSFVCVTTVVAMLLPFFGDVVGLLGAVSFWPLTVYFPVEMYIKHRRVPRGSTRWICLQTLSVTCLLVSIAAAAGSIADVIDALKVYRPFSG

SEQ ID NO: 56235 - protein, 197 aa, Oryza sativa Japonica Group
MDSEHWISRLAAAKRFYAAQLGHADRAGMEEVDMDEEVRPEFACPYCYEDHDVVSLCAHLEEEHPFEPHAAPCPICSDKIAKDMLNHITVQHGYLFKVLLGGGGHRSNNSSNTTNISADPLLSSFGLSFPTSDTEETSKPPISIPDDASVIKETPAQPWDSSIDSSLTREEREQKRKQASVRATFVQDLLLTTLFGD

SEQ ID NO: 56236 - protein, 330 aa, Synechocystis sp. PCC 6803
MVIMEAKSNYPKTMSFANADTPPQVVVLGAGAWGSSLAYVLNNNDIPTQVWSRRSPQSLESMVAGADVIVSAVSIKGVPSVAARLEAMDLQRRTILVTATKGLDPETMTTPSQIWQAALPSQPIAVLSGPNLSKEIDQGLPAATVVASSDQAAAEEIQTIFAADNFRVYTNNDPLGTELGGTLKNVMAIAVGVCEGLGLGTNAKSALITRALPEITRVGLHFGAQPDTFWGLAGLGDLLATCSSMLSRNYRVGYGLSKGQSLEEILANLGGTAEGVNTTDVLIKIANREKIAVPITRQVYRLLHGKITPPQAVEALMERELKAEFEDFDL

SEQ ID NO: 56237 - protein, 121 aa, Clostridium perfringens
MTKEQIIEAIKEMSVLELNELVKACEEEFGVSAAAPVAVVGGAAAGAATEEKSEFDVVLTNAGANKIKVIKAVRELTGLGLKEAKEIVDGAPKTLKEAVAKEEAEDMKAKLAEVGAEVELK

SEQ ID NO: 56238 - protein, 411 aa, Candidatus Protochlamydia amoebophila UWE25
MVKRNVHLTKLQSGYLFPEINRRKNEFLKKHPSAQLINLGIGDTTQPIPLYISEAMQNFAKQLASEKTYRGYGTEQGSILLREAIAEQYYQGKIDPQEVFVSDGSKCDVGRLQILFGSDATIAVQNPTYPAYVDTGVINGQASFFQTSTKQYQRITYMSCLPENNFFPDLANLPKTDLIYFCSPNNPTGSAATNEQLRELVQFAKKRQSIIIFDAAYASFVRSSHIPRSIYEIEGAKEVAIEVGSFSKMIGFTGVRLGWSVVPKQLRFEDGHSVQQDWERIVCTFFNGASNIAQAGGLAALQKEGLQAIDELSSYYMKNSNILKKAFEECGYKVYGGENVPYLWVHFPQLTSWEAFEILLKQSQLVSVPGSGFGSAGEGFLRFSAFGKQSDITVALPRIKHALLKIKPTVY

SEQ ID NO: 56239 - protein, 428 aa, Vibrio cholerae
MLQATIERLQGLPIAEPIVISNEDHRFIVAEQIRRYGKKSRIILEPAGRNTAPAIALAAFTAIEQEDDPVLLVLAADHFVKNKSAFQAAISQAAQQAEAGKLATFGIVPTTPETGYGYIHRGEEVTQGTYEINSFVEKPQLNIAEQYLASGEYYWNSGCFMFKASVFLNELKQHSPEIYRQCELAMQGLSHDYDFIRVGVEEFLKCPDDSIDYAVMEHTKLGVVVSMDAGWSDVGSWSALWEVSDKDADGNVCQGDAILSGTSNCYIYAPNKLVAAVGLKDIVVVETKDAVLVADKNQVQEVKKIVEHLKAENRAEYREHRERYRPWGKSDAIDKGERYKVNRITVEPGKKQSLQMHYHRAEHWVVVSGTAKVTCEGNVKVITENQSLYIPIGTNHMIENPGKIPLELIEIQSGSYLNEDDVVRFEDK

SEQ ID NO: 56240 - protein, 551 aa, Vitis vinifera
MIFPSISVRAPLNPITPSVLKPPPKPSLFRVKPVHCSNHRQNPNAVDKSVKLTTHLIHPITVATELVNKKHGKKNSGDEERRESSSQVGSRQMLGLCGFGYGVQGFRCFPWLALNFHMAHNLRLDPSMMQIVQNIGNLPMVAKPLFGILSDAFYIGGAHRIPYIFLGAFLQILSWGALSLIPVAGEALATLMLCVLLSNLGASITEVAQDALVAEYGQKHRKGGLQSYAFMAVAAGGILGNLFGGYFLQNTQTNTMFLVFAILLLFQVAVSLTTKEDSLGLPQPVDENLVGKSIFEGVREQFSNLVTTISEDGICRPLAWVVASIAMVPILSGPIFCYQTQCLCLDPSTIGMSRVVSQLMLLSATVLYNQFWKRIPMRKLIGTVQILYASSLLLDLVLVRQINLSLGIPNQVFALCFSGVAETIAQFKLLPFSVLFASLCPSGCEGSLTSFLASAFCLSSIFSGVFGAGLASLIGITGGDYSSLPVGILIQFLAALVPLGWMHLVPMVDPTAEKERKKGTSKRSRRNRRVGRVALDSIYVYRREREYEEQR

SEQ ID NO: 56241 - protein, 477 aa, Thermoplasma acidophilum DSM 1728
MIIIDLSDVIMAKSLRRNVLNFREVMFQGIAASAPAGAAVATMTGSAAFALGSLPLAAAVAFVIVFLNALIIRRISNHVAGPGGYYDYIKRGFGSGVGSFSGWIYILYQIAALAFISLSIAVFVPALLSYIYGITVPSYLWIPLLIASAGFGYVISFLGIKGSLRYVSVMGSLEIAVVVFIGLFIVFSHPSANTVSVFTLKYDSYGVSGIALGVLFMYTAFSGFGGMTPLGEEAKNAKKMIGNAVLLSSIVLGVFFVFAAYAFTIGWGPANMESYANNLVPGIKLAQVDIGIWAAILITVFYINSILTDNVTFSNSVARITLSMSRDGILPSSLSKVHDTRRTPHLAGLVMVSAAVVMGFLSVEFLGPFGGFLFTGVLSTLAALLVHMIANLSLPAILKKSDQRIGVSNIALPVLVTGILAYVFYGTFISISLPVITASASFGAWVIFSIIYSYLKGRSAKITWSEANEDRMEVPDD

SEQ ID NO: 56242 - protein, 322 aa, Oryza sativa Indica Group
MASTDADADAVAVELLPFIRVYVSGRVERLLGTDTVAASLDEPTGVASKDVTVDPATNLSVRLYLPPAVAAGERLPILVYFHGGGFMVESATSPTYHRYLNALASRARVVAVSVEYRLAPEHPLPAAYDDSWAALAWAVATAAAPGAVDPEPWLAAHGDASRVFIAGDSAGANIAHNVAMRAAAAPLPGGAGITGVLLMHPYFWDASNTMGPALEDRIRREWRFMCGSPDVRVDDPRLSPTVQQGAPSLAALPCRRVMVAVAGDDFLAGKGRAYHAALVASRWHGEAELVDTPGEDHVFHLTRPGTAAAAKMMDLVVDFVTR

SEQ ID NO: 56243 - protein, 274 aa, Oryza sativa Indica Group
MAAAAAAGAGADEEVDFEFFPIIRRYKGGRVERFMNIPPLPAGTDPATGVTSKDVVVDPAVGLWARLFLPPGGGAPQGKLPVVVYYHGGAYVVGSAADPFTHSYLNGLVAEAGILAVALEYRLAPEHHLPAAYDDSWEGLRGLLVVHPYFGGAADICAEGTTGKAEKAKADEFWRFIYPGSPGLDDPLSNPFSDAAGGISAARVAADRVLVCVAEKDSLRDRGVWYYESLKASGYAGEVDLLESMGEGHVFYCMDPRCERAREMQARILSFLRK

SEQ ID NO: 56244 - protein, 358 aa, Flavobacteria bacterium BBFL7
MSNFHNITLSHVYKETDDTTVIAFDVPQELKEEFKYRPGQFLTLRAIINGEDLRRSYSLCSSPLDNEWKVAVKEIFEGKFSTYVNRELKSGDVLQVAAPSGDFGIESYGENKAKNYIAFAAGSGITPMLSIIKTHLAQEPNAKFKLFYLNRTVKSIIFKEEIEALKNKYLSRFEVFYFLSREHRDIPLFNGRFDQEKLQTLTQTLINAPHTDHAFICGPEEMIFLIRDELVAAGMKKENVHFELFVSGLSEEDKARAAAALEQKVDGVDVTIIDGSKEFHFVLGDDFDNVLDGAIGAGADLPYACKGGVCSTCKCKVVEGSVAMKVNYALTDEEVEKGFVLSCVSVPTSKKLVVDYDV

SEQ ID NO: 56245 - protein, 772 aa, Oryza sativa Indica Group
MKFGLPSRLFRLMASSSSGDGGFSRPSSTDEGPMPIYSWPDKQRPRVCILGGGFGGLYTALSLESLVWPNDKKPQVMLVDQSDRFVFKPMLYELLSGEVDVWEIAPSFTELLKNTSVQFVKDSVKLLRPSDHFRRDSGGSCTARLVLALGAEAKIDVVPGSAEYAIPFTTLDDALKVESQLKMLERRRFGKNSPDIQVAIVGLGYSGVELAATISERLKNKGIVQAINVQTTICPSAPPGNRDAALKVLESRNIQLFLGYFVNCIREASASEDSSSMVTDAKEVNGDHKKLLLELQPAQRGIQSQVLEADMVLWTVGSTSQIPRLQPPDAPYVIPLNGRGQVETEETLQVKGHPRTFAIGDSAALRDPSGKLLPATAQVAFQQADFAGWNLWAAINDRPLLPFRFQNLGEMMTLGRSDAAITASFIEGLTLEGPLGHAARKIVYCLRMPTDEHRVKVGISWFTKTAVDSLASLQNAVANSFPSPDPATNRSPSAMDPDSEVAFDFQPYLCQYKSGRVFRPGGDPTVPAGTDPVTRVVSRDIHAGAARARVYLPPGAAVSTEKLPVVVYFHGGGFVTGSPARPSTHAYLNDLVARAGAIGVSVYYRLAPENPLPAAYEDAWAAVRWAATRGDGADPWLLDHADLSRLFLAGCSAGANIAHNMAVRCGGGGALPDGVTLRGLVVVHPYFTGKEAVGAEAAYGPDVREFFERTCADVLLKERGLWYHRELKASGYGGEVELFESKGVGHAFHFVGMAGSDQAVELLERNVEFIKK

SEQ ID NO: 56246 - protein, 293 aa, Kineococcus radiotolerans SRS30216
MNEELREVAVAVALAAGELVSAGRPDRVEVASTKSSPTDVVTAMDTASEQLLRTELARVRPEDGFLGEEGGHRPGRSGLTWVVDPIDGTVNYLYGLRAYAVSVAVVRAADPAARPDPATWTVLAGAVVDPSQGETWSAALGGGARLTDARGTRALTAPTGPELGQALVATGFGYDARRRAEQAAVVARLLPRVRDLRRVGAASLDLCSVAAGRVDAYYERGLKPWDLAAGALVAAEAGAVVTDFTGAAAGGHGLVAASRDLHPHLLRALADAGAGDPGVGDPGVDDPGTDDGA

SEQ ID NO: 56247 - protein, 331 aa, Prochlorococcus marinus str. MIT 9312
MTSFITAVQNKESNFNLTNSRLRLVSGTTNPKLAEEIASYLGIENVPLISKRFADGELYVQIQQSIRGCDVFLIQPTSAPVNDSLMELMIMVDACKRASARQITAVIPYFGYARADRKTSGRESITAKLTANLLEKSGVDRVLAMDLHSAQIQGYFDIPCDHIYGSPVLIDYLESLNLEEVVVVSPDVGGVSRARAFAKLMKDAPLAIIDKRRSAHNIAESLTVIGEVKGKTAILIDDMIDTGGTICSGAHLLKKEGANRIFACASHAVFSPPSYERLSTKDLFEQVIVTNSIPVIVKDDFPQLKVLSVANMLGEAIWRIHEESSVSSMFR

SEQ ID NO: 56248 - protein, 316 aa, Guillardia theta
EKGDFCALLASIQSACKIISRAVHRAGVDELHGALEHVNIQGEVVKRLDVLSNDTLIHFLCNSGQLCVATSEETEDIIRPPDYLTGEFVVTFDPLDGSSNIDAGVNVGTIFGIYRRISDSGPDGRQPGNIQDAFQPPKNLIAAGYTMYGASTILVLATEQGVNGFTLDTGIGEFIMTHPEIKLPTRGKTYSINEGNSASWDKSTTEFIAYCKSEDESKKCYSLRYIGTMVGDVHRTLCYGGIFMYPADARAKNGKLRLLYECGPMGYIVEKAGGRATTGKMQIRDIQPVELHERAPIFLGSKLDVEQVEAIYAKNS

SEQ ID NO: 56249 - protein, 140 aa, Arabidopsis thaliana
MLGEFKHYKTRLAHGGIPQEVQNLLLEYGVEIFAEMLVEGLSRIKRCTDEGRVLMSLDLQVLINGLQHFVPTKVKPKLQIVETFIKAYYLPETEYVHWARAHPEYTKAQVVGLVNLVATMKGWKRKTRLEVIEKIESASM

SEQ ID NO: 56250 - protein, 496 aa, Arabidopsis thaliana
MVDSVTGSSCDPQDGGLLPGSIPPCTISAEESDGSGTSSSVQLASNIAIDESRNSEDRVSSSESPWYYLRKESAAFVSETLQRGRRNLWQLTTSRASSTSIHQFLKNYEDLSIFILAGEAFCGFEVVDFREKLKGVCENYFTAFHRQSMHALKMVLEKETWTKLSPDTVQAINFAGLVGDGAPLIISSRSASGSSRFPHSDKPSNSIDPSGNRSGFSYWLKSGNPFSAKLTHYREDQDYSSINGEDHEGNDSIHDDVVNPKIRDIKRINGGSPVSEDENEDLLADFIDEDSQLPRRSFTRSQSRTSSSHFSTNDDLTAQTGSSLCLLRSMDKYARLMQKLEIVNAEFFKGICQLFGVFFYFVFQVFGQENTNSGGKGVSDSFNHRLKSCLSRISQECEQWIKPHVSSSPSSSLAFPNTVHSLADVTPASPLNTSGHLSGVSFSLKERCAAVDTVSLVARVLHKSKAHLQSMLMSRNGSLVEDFFGQLVCTSSDLIF

SEQ ID NO: 56251 - protein, 456 aa, Magnaporthe grisea 70-15
MHPPAPRNGHQPHHPNGDATSNGHPAPNMEQLYVVPDHGPCPPNRTLFEAFEWYLPAQHNHWRRLADRIPSLAALGVTDLWIPPACKGAWYTSNGYDVYDLYDLGEFDQRGARQTKWGSKEELLRLVDVANRHGVGVLFDAVLNHMTGADETERVLAVNVDTNGRGDTYSPLRWTAEHFTGVDYDQASKTNGIWKFLGKEWAPDVDGEFGNYDFLMCTDIDHSHPEVRRNFFHWVQWLASQMRLGGLRLDAVKHISASFMRDFVGLVQNTVGRDWLLLGEYWSGDVKALLGYLEQLDHRISLVDVPLVESFSRISRGEQPDLRRVFENTLAAIKPNNAVQTGQTLELWAYGTEAAYFCGKGAETCVGFTRFGHPARSGGAGLAVVANTGFERAARRMCVGSRHAGERWTDLLRQVWGVVVVDAAGYAEFPVGPRGVSVWVHEMAEGRDVVEGLTSL

SEQ ID NO: 56252 - protein, 1997 aa, Oryza sativa Japonica Group
MEELFMQVFERRDWVKAQVQEQVVSYSESLACAILAAGRRPPPWLLPALDSVPARGNNTKMSSIDLAHMRNENSLHHAQSQTYQRVKPKTHEFGGCKPGGLHIVNYAGEIDQSQICVSESVVQEFNIAHSLNEGLPSTSPVEVPHSVMSSLLQEDTSQPVESNLQGIPHSVSSPLPEQITMGVSETDSLTGMTCMASQLPENVSLLSLKSIALEGPDSVFTPLSQKEIADAGDTVSLMEPIAKTESVAGLISMASPQFDNDRLQTNLLEGPDSVPTSLSQADARHTAETDSVEILDQEEDTDTPREYSFPDKRVDENLKILEHQSSECHVRSPPCDGSSLRPDYLANAICEAPKMLSTPQENMLGDEQQGSECHVLSPPCDGSSLQPDYLASTVCEAPKMLSTLQEKCFEAQSEAYDVYVRNDMNGSVIPERFSTESAEKLLRSHDGTECKIFSFDIAMEIDSDSCETVSDKQALATQPSAQHLLHSSRCGEITSKKSDAQSNNSHQGRSVADVIQVQGNSSFEGIEINCQSDHALYSLCSTMSTSMDCQPDILDKMENRADMSGKPQHPVHHLDRLGSSECISLDLERRIVTSNWKSSVSYKVHTSVDSSSQRTMSSLSDIIHFNSLRMKSLSSSSSSLSGNVATVPQDSLPNCSDILSDGDGEYTRKTNNCSVYPGADVKYVAVDDQILNHTDYVSSGCEVLNPENHPSSTPPSTFPSYASSDQQSQQACASNCSNKELGEKCIHDDPGQPVSDGHIPLQNGDNCADFDETVEVHQSCGIPIPANSPTIKERVLEAYRDSTKWVNLSSNLSSKCKINSKITSPLRSKYESLTARFEKLLGPASLVEVEPKWHYPSYDTKMMGVFGNQEDCEIPLTPSFGKYSLQKPSGVCYTSNCTGSITDLACFQIDEDSSTSEASRKYMDVGRLDLPTTTASSRESDHQAHLIIDQAMQNPKENRAPSIRKEVKVTQSLHDRESKGRILGNQNEIHKSEVNLDKGWKPSNIVTSMTSFIPLVKQKQRPTTVCVKRDVRVKALEVAEAVKRREQKKQNEREMRKAAAELERERVKQEREQKLKQMEQKKKTDARKRQWEDDGRKEKEKKKKFIEEPRKQQKQLGERMHAGNSREDASQKDPDDTEIRKNTVRVVINQLLSDEKTESFPILVTSGSNNVKAVVADGNSGSSGHQIHGRLSDDADKSYEMSPYEDSDEEDGGDLEHKEKVRRRQKHIPPWTRKEILDEILLSNRTLDPREIFERKCSFSLSDGFFITIYLVICTLPCLSVWTKLNQEKQLLGISFCLCSSLGSGACDIIQKLLASHSGGLHIATIDLSSCFASNWEYSPATVNSRKSELNFPFLLLTSSRFGSAKLLNLFVLQPPPPPPSNCPTPHRKPLLSSCFPQIVVSSQQLEQSSHGFLGLPRRRKWSELFSRFAVVQAILTIMSVEAVKQIVPAHLVKPAVDPVHAKASKAGKDGRSDLIAKEILEEQKPAHRRQESSESILDKGPSNVGSDSGVLDVPLTPKGDSGELKEIQGLDCNGNQEKKTAQKSSTSESFASAKVSDGTNGLRKTCGSGKVSDTADSTESGKSSMCRPSTSSNVSDESSCSSLSSSTTKPHKGSDSRWEAIRMIRSKDGILGLSHFRLLKKLGCGDIGSVYLSELSGTRSYFAMKVMDKGSLASRKKLLRAQTEREILQSLDHPFLPTLYTHFETDKFSCLVMEFCPGGDLHTLRQRQPGKHFSEQAAKFYVAEVLLALEYLHMLGIIYRDLKPENVLVREDGHIMLSDFDLSLRCAVSPTVVKSANPGPDALQRNNQAYCVQPACIQPSCIQPSCVAPTTCFGPRFFSSKSKSKSKKEKKSKPEVVNQISPLPELIAEPTDARSMSFVGTHEYLAPEIIKGEGHGSAPLRFPESPMVSFSARDLIRGLLVKDPQHRLAYKRGATEIKQHPFFEGVNWALIRCASPPEIPKPVELERPPKPAPATEKVAPAANQKGSDNYLEFEFF

SEQ ID NO: 56253 - protein, 531 aa, Bordetella petrii
MHHQRILILDYGSQVTQLIARRVREAGVYSEIHPGDVDDAFVRDQAGQGLKGIILSGSHASAYAEDSLRVPAAVFELGVPVLGICYGMQSMAQQLGGTVSFSDHREFGYAEVRAHGHTRLLDGLADFTTPEGHGMLKVWMSHGDKVTALPPGFKVMASTPSCPIAGMADETRNFYAVQFHPEVTHTVQGKAMLARFVNEICGCQGDWNMPDYVSEAVARIREQVGSDEVILGLSGGVDSSVAAALIHKAIGDQLTCVFVDHGLLRLDEGKQVMQTFAENMGVKIIHVDATEQFMGKLAGQADPEAKRKIIGREFVEVFQAEAGKLKSAKWLAQGTIYPDVIESAGAKTGKATSIKSHHNVGGLPDTLNLQLLEPLRELFKDEVRELGVALGLPPQMVYRHPFPGPGLGVRILGEVKQEFADLLRRADAIFIDELRSTIDETSGKSWYDLTSQAFAVFLPVKSVGVMGDGRTYEYVVALRAVQTFDFMTADWAPLPHALLARVSSRIINEVRGINRVVYDVSSKPPATIEWE

SEQ ID NO: 56254 - protein, 248 aa, Glycine max
CFDLILLQNGTTEEVKKIVTTLNEAKVPGEDVVEVVVSPPFVFLPVVKSLLRPDFHVSAQNCWVRKGGAYTGEVSAEMLVNLGIPWVIIGHSERRQLLNESNEFVGDKVAYALQQGLKVIACIGETLEQREAGTTTAVVSEQTKAIAAKISNWDNVVLAYEPVWAIGTGKVATPAQAQEVHADLRKWVHDNVSAEVAASVRIIYGGSVNGGNCKELAAQPDVDGFLVGGASLKPEFVDIINAATVKKN

SEQ ID NO: 56255 - protein, 272 aa, Glycine max
  misc_feature (34)..(34): Xaa can be any naturally occurring amino acid
APPPPTDGERILGLGDLGCQGMGIPVGKLSLYTXALGGVRPSACLPITIDVGTNNEKLLNDELYIGLKQRRATGQEYAELMHEFMTAVKQTYGEKVLIQFEDFANHNAFDLLEKYRSTHLVFNDDIQGTASVVLAGLVAALKLVGGNLADHRFLFLGAGEAGTGIAELIALETSKQTNAPLEEVRKNIWLVDSKGLIVSSRKDSLQHFKKPWAHEHEPVRNLVDAVNKIKPTVLIGTSGQGRTFTKEVIEAMAAINKRPIILSLCNPRDSQS

SEQ ID NO: 56256 - protein, 379 aa, Methanosarcina mazei Go1
MSYDIYSQVQMMKAVLGLEDGTVIKGTGFGAEGTACGELVFTTQFTGYEEALTDPSYKGQILMFTYPLIGNYGVSGERFQSDNIHAEGLVVREACKKPYHYKSTRSIHKFLEDEGKPGIEGVDTRMLTIGAREHGTMRAALITGSDDGEEAVDMARNFPQVTDEELIARVTCKEPRFIPGAAGAWKGSGKPKHAVVVDLGIKRNIINNLHKRGIDLTLVPATTKPEEIAGYEPDMLFISNGPGDPEKATDAINAVKAFAGTIPVAGICFGHQIISLAMGARTYKLKFGHRGGNQPVKDLIENKIFISSQNHGYAVDADSLEGTGLYVKYLNANDKTVEGVSHKDLDIFSVQFHPEAQAGPLDTEETFFGKVVKVLGGGL

SEQ ID NO: 56257 - protein, 502 aa, Pseudomonas aeruginosa PAO1
MAKAIPQLIDGEWRGSRSRELVEVTDPATQDVLALAPKATADEIEQAIASAQRAFETWREVPAPERARLMLRYQHLLKEHHDELGELLARETGKNLADAKGDVWRGIEVVEHAANVASLMMGETVENVAREIDTASWIQPLGVCAGITPFNFPAMIPLWMFPLAIACGNTFVLKPSEQDPLTPNRLAELFLEAGAPKGVLQVIHGGREQVDALLTHPDIRAISFVGSVAVGQHVYRTGTAHLKRVQAFAGAKNHMVILPDANKAQVLGNLVGASCGAAGQRCMAISAAVFVGAAREWIPELAERMAVLRPGHWQDPDAAYGPLISPQARQRVLRLIAEGKAEGAECLLDGSQCQVEGYPNGNWLGPTLFRAVTPKMGLYREEIFGPVLACLEVESLEEAIALVNANPYGNGTSLFTRSGGAARRYQHAVQVGQVGINVPIPVPLPFFSFTGWKGSFYGDLHAYGKQAVRFYTETKTVTSRWFDDEPTTDESSAGPNMTIHLK

SEQ ID NO: 56258 - protein, 372 aa, Synechococcus sp. WH 5701
MIRSRAAVAWAAGQPLEITEIEVAPPAAGEVLLRVVASGVCHTDAFTLSGQDPEGLFPAVLGHEGGAIVEEVGADVTSVAVGDHVIPLYTPECRACSFCLSGKTNLCQAIRGTQGRGLMPDGTSRFSSAGRLIHHYMGTSTFSEYTVVPEIAVARISKEAPLEKVCLLGCGVTTGIGAVLNTAKVEPGSTVAVFGLGGIGLAVIIGAVMAGASRIIGIDTNPEKFAIARQLGASDCLDPGAFDAPIQEVVIDLTDGGVDYSFECIGNVQVMRAALECCHKGWGESTIIGVAGAGQEIATRPFQLVTGRVWRGSAFGGVRGRTELPGYVERFQSGEIPLDTFITHTMPLEEINRAFELMHAGQSIRSVIHFNR

SEQ ID NO: 56259 - protein, 467 aa, Synechocystis sp. PCC 6803
MVHKKIDLNQLSEAESLLTPTYAARGLANSVSKYEMPETEMLPAIAYNLIHDELGLDGNSRLNLATFVTTWMEPEARQLMADTFDKNMIDKDEYPQTAEIELRCVNILSRLWNAPASAEATGCSTIGSSEAAMLGGMAMKWKWRQRRQAAGKPGDRPNLVMGINVQVCWEKFCRYWEVEPRFVPMEGDRYHISPEEAVKLIDENTIGVIGILGSTFDGSYEPIEALNDALETLNQRTGWQVPLHIDAASGGFIAPFLDPDLRWDFRLPWVKSINTSGHKYGLVYPGVGWIIWRDKEELPEELIFHCNYLGGDLPNFALNFSRPGNQVVAQYYNFLRLGKEGYRKIQQTCRDTALYLSGKIAQLGPFELLTDGGDIPVFAWRLKDEVLANTCYTLYDMADKLRERGWLVPAYRMPKNREDLVVQRIVVKEGFSRDMADLLLADMERAIAYFASQPDHKPKQEGSHFSH

SEQ ID NO: 56260 - protein, 559 aa, Synechococcus sp. WH 5701
MAPLRFLGGPSTDKFSLGSRFVKPARMTTLPDYSFHEPQVQWQRFCDLLWHHDDLGIWVDVSRMELNQAHLEALEPAFDRAFTAMQALEAGAIANPDEGRQVGHYWLRTPDLAPDPEAAAHIKAEVERIDAFGQQVIGGACPAPSGTPFTDVLWIGIGGSGLGPLLILRALKEEGLGLPFHFFDNVDPQGMSRTLSALGERLLTTLVVVVSKSGGTPEPRLGMEQARARLEALGGSWAQQAVAVTMVGSQLDQRAEAEGWLARFDMFDWVGGRTSITSAVGLLPAALIGADLHGFLEGAARMDAATRAANLRENPAALMAAAWHVAGGGAGGRDMVVLPYRDRLEVFSRYLQQLVMESLGKRLDRDGREVHQGIAVYGNKGSTDQHAYVQQLRDGVDNFFVTFIEALDDPADVAPVDGDYPGDFLDGFLQGTRSALTEGGRQSLSISLRRFDARSLGALVALFERAVGLYGELVNVNAYDQPGVEAGKKAAATILDLQGRVEALLADGQARSVAAIGEELQLPSPEAAFWILRHLCGNDRGFSAEGDWGDPAGLVFRKV

SEQ ID NO: 56261 - protein, 293 aa, Gibberella zeae PH-1
MPREAEPSLSEKTFLAQALNEGLRLDGRKFDEFRPLEITFGDEYGVAEVKYGKTRVLAKVSAEVTVPYTDRPFDGVFTITSELSPMVAPSYEVNRPSLEEVLLSRLLEKTIRRSGALDTESLCLIAGKKCWSIRVDLHVLAHDGNLTDAACVAVIAALRHFRKPDSSIEGETLTIYTPAEREPVPLSWLHSPFCVTYSFYGEDGSQVLVDTNWLEEKMRVSHCTYSLNKHGEISQISKLGGKALDAPLFIQCAQGALNRSKDLSNIVDNKLAEDAKRRDKGGLMAELTAENDR

SEQ ID NO: 56262 - protein, 360 aa, Methanosarcina mazei Go1
MNTVFFYLQVSIKNLHDSIKNLRVSIKNLYVSIKGAGITAFLQTVKYERFEEKILMDFISNLFGRDKNQSFLEASKQGQTENVEKLLRSNKVDVNYQDAYGKTALISAADKGYRDVIGLLIESGPNLDLQDENGNTALISAAKIERGDIIDLLVKNGADLNFQDENGETALKFAVKVGYKNIADQLIDAGTDLNIQDENGETALICAADRAHRDIAELLIKAGADLNIQDNSGKTALVAATKIGHKGIVELLVNAGADLNLQDKNGNTALIYAADRGYRDIVNLLIEGGASLNIPDEAGLTALMFSAQTGRKDIVELLIKAGADINIEDKNNKTAADLAAEVGFEEIVDLLTSVRTYSSS

SEQ ID NO: 56263 - protein, 475 aa, Methanosarcina mazei Go1
MEGERFLNHRTPEELEKWKNTGKTEGSEDSMKELETEFNSFEQEVGLLDTVGPKAREIIGQDCNMVSACVSRPYPLVVDRAKGSVVRDIDGKEYIDFVAGIAVMNAGYSNPEVQAAISAQLEKMVHCGYGDFFAEPPLKLAKKLRDLSGYSKVFYCNSGAESIEAAMKLSLWKTKRQNFISFYNAFHGRTLGALSLTCSKVRHKEHFPTIRTVHTDYAYCYRCPLNLDYPSCGIECAKQIENLVFRRELSPEDTAAVFVEPIQGEGGYIVPPVEFHKEVRRICTDNDVLLVADEVQTGCFRTGPFLAMENFEVRADITCLAKALGSGLPIGAMLADNELMDWPPGVHSNTFGGNLLSSAAALASLEFLEKENTENHVREMGAHIRHRLRELQENFPCIGDVRGLGLMTGVEIVKPDKSIDPVRRDKIIREAFKDGVLLLPCGDSVIRFSPPLVMTDEEADLGLDKFEKALKKAVR

SEQ ID NO: 56264 - protein, 319 aa, Zea mays
  misc_feature (268)..(268): Xaa can be any naturally occurring amino acid
  misc_feature (283)..(283): Xaa can be any naturally occurring amino acid
MMGGFLSRVLLLAFGYAYPAYECYKTVELNKPQIEQLIFWCQYWLPFYSEAKVLFFVYLWYPKTKGTTYVYGTFFKPYISQHENEIDRNLLELRARATDMVVLYFHKAASVGQNTFFDVLKYVAAQSPSRKSRLHPHQEPQQQQPQVQVELQQQPQVQVELQQPQPQKQAAPVMRRGASIAARQAAMAQQSLETIPVPSSPKIKRQTSGRPGSVASTKPAAAASTPKPGGSPKKGEVKPAVDPVQTPATSADSPKSEPSAPPLSETEXVDNMAIDDVSGDAAXGAEELDPALEETPMDETIRVTRAKLRSARHRGFCWE

SEQ ID NO: 56265 - protein, 305 aa, Vaccinium corymbosum
MGSIASAVTHEFPPYFRVYNDGRVERFKVPADYSPPSVDPETGVESKDVVISEETGVKVRIFLPKINCLDQTKLPLLVHYHGGAFCVGSSLDVVTTRLLNLQTSVANVVTVSVDYRLAPEHPLPIAYDDSWSALQWIATHLNGKGPELWLNEHVDFGRVFLTGDSVGANIAQHMAVRLGVTGLDGFRVRGAVMVHPYFAASEPDKMIQCLYPGSSGTDSDPRLNPKADPDLEKMGCEKVLVFVAEKDWFKPRGVEYCETLNKSEWKGTVELVENEGENHVFHVPNPACEKALLLMQKLASFVNQG

SEQ ID NO: 56266 - protein, 570 aa, Zea mays
MAGGGVEDVYGEDRATEEQLITPWAFSVASGYTLLRDPRHNKGLAFSEAERDAHYLRGLLPPALASQELQEKKLMQNLRRYEQPLHRYIAMMDLQERNERLFYKLLIDNVEELLPVVYTPTVGEACQKYGSIYRRPQGLYISLRDKGKILEVLKNWPERSIQVIVVTDGERILGLGDLGCQGMGIPVGKLSLYTALGGVRPSACLPITIDVGTNNEALLKDEFYIGLRQRRATGEEYHELLEEFMTAVKQNYGEKVLTQFEDFANHNAFDLLEKYRESHLVFNDDIQGTASVVLAGLLAALKVVGGTLADHTYLFLGAGEAGTGIAELIALEMSKHTGSPIEECRPKIWLMDSKGLIVASRKDSLQAFKKPWAHEHEPVATLLEAVQSLKPTVLIGTSGKGGTFTKEVVEAMASQNEKPVIFALSNPTSHSECTAEQAYTWTKGRAVFASGSPFDSVELDGKVLVPGQSNNAYIFPGFGLGVVISGAIRVRDDMLLAASEALAEQVTEEHFAKGLIFPPFTNIRAISARIAAKVAAKAYELGLASRLPRPDDLVKYAESCMYTPIYRSYR

SEQ ID NO: 56267 - protein, 506 aa, Rubrobacter xylanophilus DSM 9941
MIVVLDFGGQYAQLIARRVREARVFSELLPYDTPLEEIRRRDPEGIILSGGPNSVYERGAPRVDAALFDLGVPVLGICYGMQLMALTLGGEVGAVQIREYGRSKLEVRGHGELFSGTPDEQTVWTSHGDAVLAAPPGFRVTARTPSVPILAFEEPSRGLYGVQFHPEVRHTEYGMEILKNFLFEACGCAPDWTPVNIVTEAVERVREQVGASRAICALSGGVDSATAAMLVHRAIGDKLTCVFVDHGLLRQNEAEQVVEAFRREAGLPLVHVDARERFLDRLAGVTDPEAKRKIVGEEFIRVFEEEAGKIRDARFLVQGTLYSDVIESGTRDAARIKSHHNVGGLPEVMDLELVEPLRNLFKDEVRVVAAELGMPERLVWRQPFPGPGLAIRIIGEVTAERLEILRKADAVLQDEIRSAGYYRRLWQSFAVLPAVHSVGVMGDARTYAYPIVIRAVTSDDAMTADWARLPYDLLERISNRIINEVPGVNRVALDITSKPPGTIEWE

SEQ ID NO: 56268 - protein, 316 aa, Malus pumila
MAATTSPEVLLEVFPYLRVLKDGTIDRLAGTQVAPPGLDPETGVLSKDIVVLPQTGVSARLYRPITAKPGTKLPLVVYLHGGAFCISSAADPCYHTSLNNLVAEANAIAVSVNYRLAPEYPLPTAYEDCWAALNWVFNCGEDRDSWVKDDVDFGRVFLVGDSAGANIAHHLAFKDSDPDPKLKIAGIGMVNPYFWGKEPIGGEVGDLVRKSMVDTWWNFVCPSEKGGDDPLINPFLDGAPGLEGLACGKVLVMVAEKDILRDRGRLYYEELVKSKWGGRKELIETQGEDHDFHIFNPNCDKAKILIRDLGKFINQD

SEQ ID NO: 56269 - protein, 491 aa, Xanthobacter autotrophicus Py2
MVARVVAVEPFDIIVFGATGDLARRKLLPALFERDLAGQMPDEARIIGVSRRPMERAAFQDFARDAVEMSDGIEDARPARLAHFLDRLDYVAVDAQSDAGWADLARLLDEGRDHVRVLYLAVGPDLFDPICARIGEHGIVTDKTRVVVEKPVGKDLASALKVNAAVGKVFREEAVFRIDHYLGKETVQNLMALRFANALFEPVWNNAHIDHVQITVAESIGTAGRAGYYDTAGALRDMVQNHILQLLCLVAMEPPVSLDADAVRDEKLKVLKALTPITEANAAQLTVRGQYRAGASSGGAVPGYLEELGSSTSETETFVALKAEIGNWRWSGVPFYLRTGKRLASRVSEIVVAFRPIPHSVFDAQAGPIVANRLVMRLQPDEGVKLWLMIKDPGPGGMRLQHVPLDMSFASVFGVRNADAYERLIMDVVRGNQTLFMRRDEVEAAWNWIDPILDAWRTSRELPKPYTAGTWGPSAAIALIERDGRTWTDDA

SEQ ID NO: 56270 - protein, 534 aa, Synechococcus sp. WH 7805
MTPFHGASTGMNDTCFDLLVIGGGASGACVAYEGVRRGLRVALLESHDLGGGTSCRSTKLLHGGVRYLELAFKTADTAQLRLVREALLERGHWLQQAPFLAKRLELALPTGGVIGQAYYRLGLGLYDALSGRSGIGSSRLLSSQQLRHALPALRDDITRGVAYSDGQFDDARLNLLMALTAEQAGAVVRTRTRVVALETDSSGRLCGAISESTGGQSERWQARVVVNATGIHSDTIRRMADPSCEKRMLTSRGIHLVLKQTLCPEGIGLLLPSTDDGRVLFMLPFFGRTLVGTTDTPCPQEQASSPSENEVKYLLDYVQRWFPALNNIDVGSCWAGGRPLLKPAGADVNSSRVVREHEVETLACGLVSVMGGKWTTCRPMAIDTLQAVEQQLGHALQAPGMLPLIGSAPDSLQTPALLQSQEASLESLLPDTPQRQQQIAHLLGNHGLAATHLVSSWSDDDRQPLSDVIPVCRGELRHAITHEHARSVTDLLCRRTRLAMVDQQDAERLRPEVSELLAQAGHGSADAGVLDLSR

SEQ ID NO: 56271 - protein, 567 aa, Zea mays
  misc_feature (47)..(47): Xaa can be any naturally occurring amino acid
MVSESNRGGADRTTAAGEERGQLLFDVPEIRFTKLFINGSFVDAVSXRTFETRDPRTGGVIASVAEADKEDVDLAVRAARAAFDHGEWPRMSGSERGRIMARLADLVEERADELAALESLDAGKHPAVTRAVDVGNAAGSLRYFAGAADKIHGETLKMPGQFQGHTLREPLGVAGVIIPWNFPSTMFAVKVAPALAAGCALVVKPAEQTPLSALYLAQLAKQAGVPDGVINVVPGFGPTAGAALASHMDVDMVSFTGSTEVGRLIMKASAESNLKPVYLELGGKSPLIVFDDADLDMAVELAVGASFFNKGEACVAASRVYVQERVYDRFEERLAERMRSWVVGDPFSDPSADQGPQVDKAQYERVLSYIDHGKREGATLLTGGRPCGPEGKGYYIEPTVFTNVKEDMIIAKEEIFGPVMCLMKFKTVEEAIARANDTRYGLGAGVVTRDLDVANRVVRSVRAGVVWVNCYFAMGSDCPFGGRKMSGFGKDEGMHALDKYLAVKCLALLITLLPALFFVLPRMPQPAHDRRREAAARATTRIYWQAVDQMVACALVLTALLATYIYH

SEQ ID NO: 56272 - protein, 279 aa, Brassica napus
  misc_feature (254)..(254): Xaa can be any naturally occurring amino acid
  misc_feature (266)..(266): Xaa can be any naturally occurring amino acid
VEHSSKRHRGAKDDETIVRDDRNVLRRSEGSAFSRYNPALNNNKLSGGNLGSNPRHDNNCQELIKRTEAACDCHSNMNESLPSNHHSRVGSNNVEMSSTTVNNAFTKPGAPKVSPAGSSSAKRSLFQPLPCDHHHSSHNLVHVPERKLPPQYGSSNVYNETIEGNNNNNNTVNYSVNGSGSGSGHGSNDPYGSSNGMNAGGVNMGSENGAGKSGSGDGSGSGSGNVADENKISQREAALTKFRQKRKERCFRKXVRYQSRKKLAEXRPRVRGQFVRKQL

SEQ ID NO: 56273 - protein, 474 aa, Synechococcus sp. WH 7805
MQRSQGTVMVQITGTSPFSATDLEALRAPVVKGTSRPEAWRRLQLDRLHSLVCDHEQEVLDALHQDLAKPPLEGMAEVVSLLQELKLARRNLRRWMRPQSVRVPIVQQPGRAQLIREPLGCVLLIGPWNLPFSLTFWPLVSALAAGNTAVIKPSEQAPATAELIERLVPLHFPSDVVQVVNGDARVAADLVRLRFDHIFFTGGGRIGAKVLEGAAANLTPVTLELGGKNPAVVLAGADLEVTARRLIWGKGFNAGQACVAPDHILVEHSLKGPLLQAMTDQRHALYGTNPLESEHMASLISERHYKRLAGLIKTAKDDGRVLLGGECDETRRRIAPTLISIQNNTDPLMADELFGPLLPVIEIDDFNDAITRIQSQDKPLAIYLFGGDPDEQQRLLRTTSSGTVCFNDVILQAGVPGLAFGGVGASGMGSHHGEAGFRTFSHERSVLKRSFWLDLPQRYPPYTLKPDTFRRLLS

SEQ ID NO: 56274 - protein, 386 aa, Ustilago maydis 521
MFTVPAFRSASSSLAKRPTLASSALKLNRMSVRGLAMPVTNAPTSAYNKQKGSDGKYTVTLIPGDGIGPEVSNAVKEIYHAANVPIKWEEVSVAPFIKDGKQTIPEESIVSIKKNTVALKGPLATPIGKGHVSLNLTLRRTFHLFANVRPCKSIEGFKTAYDNVDTVLIRENTEGEYSGIEHEVVDGVVQSIKLITYEASERVARYAFHHAEQNGRNKVTAVHKAPIMRMSDGMFLHACRQVAKEYPHIAYDEDLLDRACLRIVQDPAPYADRVMVMPNLYGDILSDMCAGLIGGLGLTPSGNIGKDASIFEAVHGSAPDIAGQDKANPTALLLSSIMMLRHMSLFDKADQIENAIFKTIAAGERTGDLGGKLGTRAFTDKIISRL

SEQ ID NO: 56275 - protein, 543 aa, Cytophaga hutchinsonii ATCC 33406
MNYYQQRAALLEHATQVEYGLIVIGGGVTGCGIALDAQSRGIPTLLIEMHDIASGTSSRSTKLIHGGLRYLKQLEFGLVKETGRERAVVHHLAPHITIPEPMLLPIIKGGSMPKWMASMGTLIYDFLAGVKKSERRKVLNKADTLAAEPLLSGLNVTGGIRYYEYRTDDARLTMALACTAKAQGTTVLTYTKVVKLMYQAGEIIGVKVIDRFTDKEYILKSEEVINAAGPWVDSIDEQDADIRKNKLVLTKGVHIVVDFKKFPIQQAVYFDVGDGRMVFAIPREKKTYIGTTDTKYTGDYKEPGIEEADKTYLIGCIRTAFPGVTLTVADIESYWSGLRPLIRQRDSKSPSAISRKDEVFQSATGLLSIAGGKLTGYRKMAERIVDIVAERLKLAYDIDTCQTEFHLLSGGDIAKHGGLDTFIAEMLPVLKAFGLDTNTAARMIRLYGSNIHLYEAELKHIDERLASINLPDWQKAQLQYTIKHEFVCKPADFIVRRTADFYFRRAEAEQYASELIKAMQLLLGWTDQEYALYNEEWLLFLKK

SEQ ID NO: 56276 - protein, 239 aa, Zea mays
MERAASVISSLLGGGGGSGAQAATVKSVLVYPIKSCRGISVPQAPITATGFRWDRQWMLVNSKGRACTQRVEPKLALVEVQMPPEAFAEDWHPTPDDHMVIRAPGMEPLKVPLSVECATISDVSVWEWTGAAYDEGAEAAEWFSTFLGCPTRLVRFNEGVLWAKCSLQGISVSKWGRKDRQGRGSSLGLVRLHRIVPGIIPANQSLYKLEKQSGSESFRPTNPTQTNKALCDTVVLFIC

SEQ ID NO: 56277 - protein, 492 aa, Methanosarcina mazei Go1
MIREYKLLIGGKSVDSSTGETFDDINPATLENLATLQVAGIEDVDRAVEAAEAGFRVWSEVPAPGRAEVLFRAARIMQERKEGLARLMTEEMGKVLPETRGDVQEAIDITIYAAGEGRRMFGETTTSELRDKFCMTVLRPVGVVGMITPWNFPIAIPSWKIMPALIAGNAIVFKPASDTPLLTIKLVEILMEAGLPPGVINIVPGPGGSTGKAIVQHPRIRAISFTGSLDTGKWIMEECAKSMKRVSLELGGKNPVIVMDDANLELALEGVVWGAFGTTGQRCTATSRLILHEKIKDEFIKRLLAKTKSLRVGNGLLPETDVGPVINKAQLEKIEKYVRIGKEEGAAILVGGNRIDPGLPGYFFEPTIFTDVSPEMRIAQEEIFGPVLSIITVSDFDEAIEVANNIKYGLSSAIYTENVRTAFRAIEKLEAGITYVNAPTIGAEVHLPFGGIKGTGNGFREAGTEAIKEFTEVKAVYIDYSGRLQKAQIDTE

SEQ ID NO: 56278 - protein, 395 aa, Silicibacter pomeroyi DSS-3
MRLSRRITGLTGGGSDGWDLFLQARRMIAEGIAVTELTIGEHDTRTHSSILDAMDRSARGGHTGYAMVPGTALLRDTVAARVQERTGQRTTRDNVLITPGGQAALFAAHSAACDPGDTALFVDPYYATYPGTIRGVGALPRAVIARAEDGFQPRPDVIEAEADGAVSLLINSPNNPTGVVYGRETLEGIAKVCQDRDLWLISDEVYDTQIWEGAHLSPRALPGMAERTLVVGSMSKSHAMTGSRCGWIVGPEAAISHLITLATHTTYGVPGFVQDAAVFALGQGRDLEEEIAAPFRRRRDLAWHILAGQNAVRLSPAQGAMYLMLDIRATGLSGEAFATALLETHHIAVMPGESFGKAAAGHVRVAMTVADDAFVKALKTLCHFAAQQASGLPEG

SEQ ID NO: 56279 - protein, 279 aa, Campylobacter coli RM2228
MQKYLEKANVLIEALPYIRKFSSKIILIKYGGSAMENGELKHCVMQDIALLKLVGLKPIIVHGGGKDISKMCEKLGVKSEFNNGLRVSDQATTEVASMVLNYINKNLVHSLQNLGVKAIGLCGKDGGLLECVQKDENLGFVGEIQKVNSSVLQDLLEKDFLPIIAPIGMDENFNTYNINADDAACAIAKVLKAEKLAFLTDTAGLYENFEDKNSLISKISITQAKALVDKIQGGMHVKLKSCIDACESGVKKVHILDGRVKHSLLLEFFTDEGIGTLVG

SEQ ID NO: 56280 - protein, 190 aa, Synechocystis sp. PCC 6803
MPGGINPHSKLCKQALKGVMDANFPIYLTPPDLSPAAFVAANATVVGKVHLGKDCSIWYGAVVRADLEAIIIGEGTNIQDGAILHGDPGIVTVLEDWVTVGHRAVVHAAHIERGSLIGIGATILDNVRIGAGSIIGAGAVVTKDVPPRSLVMGVPAKIIKQVSEGQVQGLLDHGQNYVRLAKAHAAAGLG

SEQ ID NO: 56281 - protein, 324 aa, Polaromonas sp. JS666
MDVRDGFIGSIGNTPLIRLARLSAETGCEILGKAEFLNPGGSVKDRAALYIIQDAERRGALKPGGTVVEGTAGNTGIGLAHICAARGYRCVIVIPETQSQEKMDLLRVLGAEVRPVPAVPYKDPNNYQKIASRLAQEMDNAIWANQFDNLVNRQAHYETTGPEIWRDTAGKVDAFTCSTGTGGTLAGVARFLKEQNPAVRSVLADPYGSALYSFVKTGQLTADGNSITEGIGSSRVTANLEGTPIDDAVRINDQDCVTMVYRLLREEGLFVGGSTGINVAAAAWLARQMGPGHTIVTLLCDRGGLYSSRLFNLAWLMEKGLAPQ

SEQ ID NO: 56282 - protein, 394 aa, Campylobacter coli RM2228
MNYKEQSHIIPTYKRFDIVLESGEGVYLLDDKGKKYLDFSSGIGVCALGYNHAEFNAKIKAQVDKLLHTSNLYYNENIAQAAKHLAKASGLERVFFTNSGAESIEGAMKVARKYAFNKGIKGGNFIAFKHSFHGRTLGALSLTANEKYQKPFKPLISGVKFAKYNDFSSVERLVNEKTCAIILESVQGEGGVNPAQKDFYKALRQLCDEKDILLIADEIQCGMGRSGKFFAYEHSGILPDVMTSAKALGCGLSVGAFVVSEKVAQKSLEAGDHGSTYGGNPLVCAGVNAVFEIFKKEKILENVSKLTPYLEQSLENLIKEFRFCKKRKGLGLMQGLSLDNSIKVAEVIKKCQENSLLLISCGENDLRFLPPLIIEKSHIDEMSEKLRKVFKSFE

SEQ ID NO: 56283 - protein, 179 aa, Campylobacter coli RM2228
MLIRFKDKIPNLGQNVFVAEGAKIIGEVEIGDESSVWFNCVLRGDVNFIKIGKRTNIQDLTTIHVWHREFNEDGSLKDAGFPTYIGDDVTIGHNCVIHACKIGSRVLVGMNAVIMDDAAIGDDSIVGAGSVVTKGKKFPPKSLILGNPAKLIRELSNEEVAFLKQSALNYVEFKNDFLD

SEQ ID NO: 56284 - protein, 722 aa, Colwellia psychrerythraea 34H
MIYQGKSLSAQLLEDGIVEFKFDAQGSVNKFDQATFEEYIAVVAAINNCSEAKGVIVTSGKSTFIVGADITEFLVSFSQPEDALASWAKKASDVFDSFEDIQLPTIAAINGIALGGGCEMTLACDYRVAATTASIGLPEVKLGLMPGFGGTVRLPRLIGFDNAATWMSTGKAFKPAAALAQGAIDAVVEPENLQAAAISMLKLAIDGKLDWRAKRQPKLEALKLSPTELIMSSTTCKGMIAAKAGKHYPAPMVMINTLIASANLDRTGAMAAENTGFAKLAKTDAATAQIGLFMADQVIKGKAKKASKLATKAVNKAAVLGAGIMGGGIAYQSAYKGTPIIMKDINDQALDLGLTTATGILTKQVERGRMNAKKMAGVLNNITPSLSYDSVKDVDIVVEAVVENPKVKGMVLAEVEGVIGEDAILTSNTSTISIDLLAQSVKRPQNFCGMHFFNPVNKMPLVEVIRGKDTSDETVAAVVAYAAKMGKSPIVVNDCPGFYVNRVLFPYFAGFSQLVLEGADFTAIDKVMEKQFGWPMGPAYLLDVVGVDTADHCTGVMSSGFPTRMKKIDNDPVSTLYANERLGQKNGKGFYDHIKDKRGRPMKVPAPVAYELLGQHCADKKDFSSEEIIARMMIPMVNEVVRCLEEGVVDTAAEADMGLIYGVGFPPFRGGAIRYLETLGLDNFIAMADKYTDLGEIYHVTDGLREMAKSGKSYFTTDVKLA

SEQ ID NO: 56285 - protein, 149 aa, Staphylococcus aureus subsp. aureus Mu50
MERTFLMIKPDAVQRNLIGEVISRIERKGLKLVGGKLMQVPMELAETHYGEHQGKPFYNDLISFITSAPVFAMVVEGEDAVNVSRHIIGSTNPSEASPGSIRGDLGLTVGRNIIHGSDSLESAEREINLWFNENEITSYASPRDAWLYE

SEQ ID NO: 56286 - protein, 816 aa, Haemophilus somnus 2336
MRVLKFGGTSLANPQRFLQAAALIEKAHLEEQAAGVLSAPAKITNHLVALSEKAALNQPTDGHFDEAIEIFYNIINGLYAENTHFDLVGTKALIESEFAQIKGLLENIRQAGKVEDAVKATIDCRGEKLSIAMMNAWFEAKGYTVTVINPVEKLLAYGSYLESSVDIAESTKRVDAKSIPAKNIVLMAGFTAGNDKGELVLLGRNGSDYSAACLAACLGASVCEIWTDVDGVYTCDPRLVPDARLLSSLSYREAMELSYFGAKVIHPRTIGPLVEPQIPCLIKNTGNPEGAGSIIDNRENISEGLQVKGITNLDNVAMFNVSGPGMQGMVGMAARVFSAMSKASVSVILITQSSSEYSISFCVPTKAIEKAKAALNAEFEQELVAKDLDPVEVIHDLSIISVVGDGMERSKGIAASFFSALASANISIVAIAQGSSERSISAVVPLNKAIEAVKATHQALFNNRKVVDMFLVGVGGVGGELIEQIKRQSEYLAKKDIEIRVCALANSNKMLLNENGLNLGNWREDLANATQPSDFDVLLSFIKLHHVVNPVFVDCTTAESVAGLYERALKEGFHVITPNKKANTRELDYYNQVRENARKNHRKFLYDTNVGAGLPVIDNLQNLLAAGDDVVSFNGILSGSLSFIFGKLEEGLSLSEATALAREKGFTEPDPRDDLSGQDVARKLLILAREIGLELELSDIEVEGVLPQGFSEGKSADEFMAMLPSLDEEFAERVAKAKSEGKVLRYVGQIEEGKCKVSIVAVDGDAPLYKVKNGENALAFYTRYYQPIPLLLRGYGAGNAVTAAGIFADILRTLKH

SEQ ID NO: 56287 - protein, 602 aa, Porphyromonas gingivalis W83
METKYIVSALKYRPDSFASMVGQEALSATLKSSIVQQKTAHAYLFCGPRGVGKTSCARIFARAINCLERLPDGEACGRCESCKAFDEQRSMNIYELDAASNNSVDDIRLLIEQANVPPQIGKYKIYIIDEVHMLSQQAFNAFLKTLEEPPSYVIFILATTEKHKILPTILSRCQIFDFKRIPPARIEQHLRYVADSEGIKAEAEALAIIATKADGGMRDALSLFDRIARFSEGNITYANTIENLNILDYDYYFRLTDFFLQGDYRSVLIVLDELLAKGFDGQVIVSGLASFFRDLMMAQDASTLPLLEQSEVVIQRYVDMAARCPTSFLYQSLKILNACDQQYRQSNGKRLLLELSLMNIAALFSKGLTAPPPTHGAQHANPVVSGSVSPRPAPAKEQPSVAPSQSSVPPQPSIGEQRRQPETTAPTITEDKPEQTKVVPPTRPMATSTVGSEGRFTLRGIRNKQEQLQNNIQEVRTEMTESFDEEQLQLAWIEFAETKLSEEIHLKETMANCLPKLRPGTSAFEVEVLNSRQEEEINNVSARLLSFLADKLCNTTIRMNVRVSESTSLNRVPVSLDEKIERLNQENPLFDELRMRLGLSLV

SEQ ID NO: 56288 - protein, 230 aa, Triticum aestivum
MGGKVLLISSVLVGLVSLSSCRSLGELHEQKTHYGGSPTPTHGSGGGYNPTPTPTYGTTPTPTYGTTPTPSYGTTPTPSYGTTPTPSYGTTPTPSYGTTPSTPSTPSHDVPASPKKHGFIGSCDYWKNHPDAIVAAIGSLGNIGKTFGAACSMIGGKKLGNMHDALSNTRTDGIGALIREGAAAYLNSIVNKKFPFTTQQVKNCIIVAVTSDGAASAQAGVFKKANESHY

SEQ ID NO: 56289 - protein, 483 aa, Pseudomonas putida
MKTKLFINNAWIDSSDQQTFERKHPVSSEVMTESANATVTDAIKAAQAAEEAFKTWKDVGPSERRRLLLKVADVMESKTPKFIEVMAMEVGASALWAGFNVHASANVFREAASLATQIQGETIPTDKAETLSMTLRQPVGPILSIVPWNGTAVLAARAIAYPLVCGNTVVFKGSEFSPATHALITQCVQEAGLPAGVLNYLNSSPDRSPEIADALISAKEIRRINFTGSTRVGSIIAQKAAQHLKRCLLELGGKSPLIVLDDADINAAVKAAVFGSFLFQGQICMSTERLVVDEKIADEFVARFVEKTERLSVGDPCLTGDCIIGPMVSPNSGERINGLFKDAIDKGAKVVCGGMAQGAVMPATILDHVKSDMRIYDEETFGPITVVIRCKGEAEAIRIANDSVYGLSSGVFGRDINRALRVGMSIEYGCVHINGSTVQNEAQAPYGGTKNTGYGRFDGRAVIDEFTELKWLTIEPFEQQYPF

SEQ ID NO: 56290 - protein, 195 aa, Brassica napus
  misc_feature (181)..(181): Xaa can be any naturally occurring amino acid
MPPKRNFRKRPLEEEEEEDEQSKAASSEEEEKRRLALEEVKFLQKLRERKLGIPALSTAQNSTGKGKTAEKAEAEGEKEELVLQDTFAQETAVLIEDPNMVKYVEQELAKKRGKSLEDAEEVENELKRVEDELYKIPDHLKVKKRSSEESSTQWTTGIAEVQLPIEYKLKNIEETEAAKKXLQEKRLMGRAKVGV

SEQ ID NO: 56291 - protein, 387 aa, Ustilago maydis 521
MNALRQLNRAAAPALKQATKSGLVLPNVPQLLRPATTLAAGTPKISKGPTKYGGVYTVTLIPGDGVGVEITDSVKEIFEVMNVPVEWEQFNVSGETHGSESLFKEAMESLKRNKVGLKGILFTPIETGSHNSWNVAMRQQLDIYASLVICKSLPGYPTRHKDVDFAIIRENTEGEYSGLEHSSYPGVVESLKVSTRAKAERISRFAFDFALKNGRKRVTCVHKANIMKLGDGLFLNTFRRVAEEYKSSGIESNDMIVDNTSMQLVSRPQQFDVMVMPNLYGNIVSNIGAALVGGPGTVPGCNIGREFALYEPGCRHVAKDIMGTNAANPAAMILSATMMLRHLGLDTQANQIAESVYKVIADGKVRTADMGGKSKTHEFTQAVLSNL

SEQ ID NO: 56292 - protein, 234 aa, Clostridium thermocellum ATCC 27405
MNGELDYIKRNLYSVMERIEKAAQKSGRSAKDITLVAVTKTVEPERIMKILDEGVVDLGENRVQELTKKYDILNSRKCKWHLIGHLQTNKVKYIVDKVSLIHSVDRIELAREIQKRAESVGKTVDVLVQVNVSGEKSKFGVSVDDAYGLVREISFMPNIRVKGLMTMAPYAENPESVRYVFSKLRDLSIDIGKEKFDNSNMEILSMGMSNDFEIAIEEGANMVRIGTALFGSRS

SEQ ID NO: 56293 - protein, 430 aa, Synechococcus sp. WH 7805
MLLAIKRRLNEFQDSPVNNLMAGLVMSLVLIPEAIGFASVAGFSPETGLYGAIFLTIAIAITGSRVAMITSASGSTAVLMTGLAVHGNSLANNKGIILLLTASFFAGCFQILWGILGAGKLMKFVPKAVVSGFVNALALLIIQAELPQLGFDQLLGLERHQDIGLLPTTAQLPSIWILSAIGIAIVYLAPRLTRLIPAQLISIVVITVISTMLQLKIPKVGDLGSLPEGLHSPMLPWMIQSDQILSTSEILTITLPIAIAISLVGLLETFLTVDYIDTLTDTRTSKKNEAIGQGVANIISSIFGGMAGCALVGESVMNNKNGANSRLSTLSTGIFILIIVVYGKNLLSEIPLAAVVAVMITIALETADSDSIKSIGKKPSIDTLLMVATFLASMATHPHNLAFGVVVGVTTSELYGYFSRRKNSSKSREK

SEQ ID NO: 56294 - protein, 290 aa, Methanococcoides burtonii DSM 6242
MDVKKAVIPAAGLGTRFLPATKSMPKEMLPIIDKPVIHYVVEEAIASGIDDIIFVTGRSKRAIEDYFDESPELQMHLKEHHKDSLLKMVEDISSMVDIHYIRQKEPRGLGDAIMTAKKHISGDPFAVLLGDDIIVNDVPCTKQLIEVFQKYRCSTIAVEEVPREKVSSYGIISGKPIDDSLCILEDIIEKPSVEEAPSNIGAIGRYVFTPEIFDCINKTSTGVGGEIQLTDGIRLLNEQQKVYAYRFAGQRYDTGDKLGYVKAIVDFALKNEEMAPSIREHIKNVLGSGF

SEQ ID NO: 56295 - protein, 456 aa, Methanococcoides burtonii DSM 6242
MWPLSREYYPKQFLKLGKSSLFQDTFLRCLKLSECSDIFVVTNETQKFFVLGQIKELGYDLPVENVLIEPVGKNTLPAIFFGMHEINERFGKSIVGIFSSDHVLDADSMETIADASNLASDYLVTFGVVPSSPHTGYGYIHPGNDIGFGNEVLEFKEKPDGEIAKMYVKQGYLWNSGMFLFDTDIFFEEVRKYEPSMFDAFCGDEGVIRNIVSIYSSLPSISIDYGIMERSNKVAVVKLEHKWSDLGNFDAIYGESDKDDHSNAVYDCDSNFISSNGNLVYSKPDKIVSLIDINDMVVVDTPDALLVCPRKSSQKVKDVVNSLSVEGDERISLHQTVYRPWGTYTILESTERHKIKNITVMPQKKLSYQLHHHRSEHWVVVEGIACVQIEGKHFYLRQGESTFIRPGDKHRLLNPGKLPLEIIEVQLGESVDEDDIVRFDDEYGRVNDSSSVEDRI

SEQ ID NO: 56296 - protein, 498 aa, Synechococcus sp. WH 7805
MAGRFSQQNQRVRPSSKEDQVVLKAREHFERTLIPVRGQLAGSVAALEHPRHDEALNYGEIFLRDNVPVMVYLLTQKRFDIVKQFLSICLDLQSTTYQTRGVFPTSFVEEKGQLIADYGQRSIGRITSVDASLWWPVLCWMYVKSSGDEEFASSQAVQRGVQLLLDLVLHPTFEGTPVLFVPDCAFMIDRPMDVWGAPLEVEVLLYGSLRCCAQIMELGRKHHGSRLLDQRLILTRQWVHDLRQFLLKHYWVTSKTMQVLRRRPTEQYGDNQHQNEFNVQPQVIPDWLQDWLENRGGYLIGNIRTGRPDFRFYSLGNSLGCLFGLLTAPQQRALFRLTLHNRDHLMAEMPMRICHPPMESLEWQNKTGSDPKNWPWSYHNGGHWPSLLWFFGSSILLHERRHPHADVLLMGQMKALLEECYWSHLNQLPRQQWAEYFDGPTGTWVGQQSRTYQTWTIVGFLLLHQFLRVNPDDVLLLDLDEGAVPDPDSIDSPVRHND

SEQ ID NO: 56297 - protein, 388 aa, Pseudomonas aeruginosa
MCRLTTSREAAILSTCNRSELYLEVDHPTADDVLAWLADYHRLTLDELRACAYVHQDEDAVRHMMRVASGLDSMVLGEPQILGQMKSAYAVAREAGTVGPLLGRLFQATFSTAKTVRTETDIGENPVSVAFAAVSLAKQIFSDLHRSQALLIGAGETITLVARHLFEQGVKRIVVANRTLERASLLAEQFGAHAVLLSEIPEELANSDIVISSTASQLPILGKGAVERALKQRKHKPMFMVDIAVPRDIEPEVGELDDVYLYSVDDLHEVVAENLKSRQAAAQAAEELVGSGVAEFMQRLRELAAVDVVRAYRQQAERLRDEELGKAQRQLANGADPAEVMAQLARGLTNKLLHAPSVQMKKMSAEGRIDALALAQELFALDECAPRH

SEQ ID NO: 56298 - protein, 169 aa, Brassica napus
  misc_feature (159)..(159): Xaa can be any naturally occurring amino acid
MGEEEDSVTVDQNSCDGADSSTLPPPPHLSSKVLTLPTVLTLGRVAAVPILVATFYVDCWWGRTATTSLFIAAAITDWLDGYLARKMRLGSVFGAFLDPVADKLMVAATLILLCTKPMDAVVVLGPIPWLVTVPSIAIIGREITMSAVREWAASQNGKXLSKAVAVNSL

SEQ ID NO: 56299 - protein, 327 aa, Colwellia psychrerythraea 34H
MKSVKNSWNSSIKDGEYQRKESQFRNWITTDGSAGITGRGGFQAEAGRYHLYVSLACPWAHRTLIFRQLKGLEDLITVSVVHPDMHENGWSFKHDEESAKLYGTTGDNLYDGKFISEKYLAQDPDYSGVNSVPVLWDKKDKVIVNNESSEIIRMFNSAFNDITGNTLDFYPEHLREKIDHENELVYHKINNGVYKTGFATTQEAYDKNVNELFAALEQIDEKLSKQRYLTGDEITEADWRLWATLVRFDSVYHTHFKCNLKLIKEFSNIYNYMLELFQVPNVAKTVNEAHIKRHYYASHVAINPYGIVPIAHQQDWTAQHNRDKQFS

SEQ ID NO: 56300 - protein, 241 aa, Staphylococcus aureus subsp. aureus Mu50
MADNKANKEQVHRVFQNISKKYDRLNNIISFEQHKVWRKRVMKDMGVRKGTKALDVCCGTGDWTIALSKAVGPTGEVTGIDFSENMLEVGKEKTASMENVKLVHGDAMELPFEDNSFDYVTIGFGLRNVPDYLVALKEMNRVLKPGGMVVCLETSQPTLPVFKQMYALYFKFVMPIFGKLFAKSKEEYEWLQQSTFNFPGKEELKRMFEEAGFINVRVRSFTGGVAAMHLGYKEKDNTKGD

SEQ ID NO: 56301 - protein, 510 aa, Populus suaveolens
MGSGQWMVEKRSGLENDSFRNEHETASESGCLSIIVLGASGDLAKKKTFPALYHLYRQGFLDSNEVHIFGYARTKISDDELRDRIRGYLGKEAEVVSKFLQLIKYVSGSYDTEDGFQLLDKEVLQHEVSKNSAEGSSRRLFYLALPPSVYPSVCRMIRKCCMNKSDLGGWTRIVIEKPFGKDLESAENLSAHIGELFEEAQLFRIDHYLGKELVQNLLVLRFANRFFLPLWNRDNISNVQIVFRENFGTEGRGGYFDEYGIIRDIIQNHLLQILCLVAMEKPVSLKPEYIRDEKVKVLQSVLPIRDEDVVLGQYEGYRDDPTVPDQSNTPTFATVVLRIHNERWEGVPFILKAGKALNSSKAEIRVQFKDVPGDIFQCQKQGRNEFVIRLQPSEAMYMKLTVKQPGLEMSTVQSELDLSYMQRYQGVPIPEAYERLILDTIRGDQQHFVRRDELKAAWEIFTPLLHRIDNGELKPKEYQPGSRGPVEADELLAKAGYVQTHGYIWIPPTL

SEQ ID NO: 56302 - protein, 518 aa, Synechocystis sp. PCC 6803
MNNSTVSSIDITPQDRYNQQLLAHVHPPDWINPSPKDQYDLVVIGAGTAGLVVAAGAAGLGIGLKVALIEKHLMGGDCLNFGCIPSKALISSARVVGVMNNANSLGIKKPDSIEIDFPAVMARMRQIRTGISHHDSAQRFRDLGIDVFLGEGHFVRNNQIEVGGAILNYKKAIIATGAKAVKPNIPGIEEVGFLTNETVFSLTACPDRLGVIGGGPIGCELAQAFQRLGAQVTLFHRGSHLLNKEDPEAAAIVQESLIKDGIELILNAKLERAELTDRGKVLHYRANGDSGTIVVDEILVGAGRAPNVEELNLEAVGVKFDRRGVKVNDYLQTTSPQIYAAGDICMDWKFTHAADAAARIVIKNTLFSPFGLGRSKLSSLTMPWVTYTDPEIAHVGLNETMAEALDIGYKIIKIPFSQVDRAIAADETEGFLKIIHVANSDEILGATIVASHAGEMISEITTAIVNKIGLSKLAGVIHPYPTQAEAIKKAADTYRRTLLTNNTKNLLKLLTKFPSKLF

SEQ ID NO: 56303 - protein, 215 aa, Kluyveromyces marxianus
MDQEQERGISRLWRAFRTVKEMVRDRGYFITQEEIDLSLEDFKVKYCDSMGKPQRKMMSFQSNPTEESIEKFPEMGSLWVEFCDEASVGVKTMKNFVVHITEKNFQTGIFIYQSGITPSANKILPTAAPAVIETFPEASLVVNITHHELVPKHIRLSDAEKKELLKRYRLKESQLPRIQRMDPVALYLGLKRGEVIKIIRKSETSGRYASYRICL

SEQ ID NO: 56304 - protein, 261 aa, Hyphomonas neptunium ATCC 15444
MTNVIVYEHPLSPYAQKVKISLREKGVPFETRLPEGIGTGATAGGFAKANPRGEVPALIHGDVEIFDSTIILEYIEDVWPDPAMLPKSPADRARVRMIEDVMDTQFEAITWGLGELNFFRRAEGAKKEEMEAKARTQAEAFFKVLEGYLGDREWFNGASFGWGDLSVVPYLNGAAGFDIRPAESSRLGAWAKRANARESVALARRESEASIGGMNQVDQAVKAGLFKRQYRDHRLEWMMKTGGTEIVLKGLEAGNIRFTGP

SEQ ID NO: 56305 - protein, 332 aa, Staphylococcus aureus subsp. aureus Mu50
MTKITVFGMGSFGTALANVLAENGHDVLMWGKNQDAVDELNTCHTNKKYLKYAKLDVNIIATSDMTKAIQFADIYLMALPTKAMREVATQINDKLTSKKTFIHVAKGIENGTFKRVSEMIEDSISPEYNAGIGVLSGPSHAEEVVVKQPTTVAASSKDKSVSKLTQDLFMNDYLRVYTNDDLIGVELGGALKNIIAVASGIVAGIGYGDNAKAALMTRGLAEISRLGEKLGADPMTFLGLGGIGDLIVTCISTHSRNFTLGYKLGQGESMDQALSEMNMVVEGIYTTKSVYHLAKEKNVDMPITNALYRVLFENISVKECVKDLMERDKKSE

SEQ ID NO: 56306 - protein, 393 aa, Campylobacter coli RM2228
MKVYLDNNATTMLDPSAYELMLPFLKDMYGNPNSLHQWGSATHPALREAMDKLYAGLGANDLDDIVITSCATESINWVLKGIYFDHILDKERNEVIISSVEHPAVAAAAYFLKSLGVKVIELPVNEEGVSTVEDLRKVISDKTALVSVMWANNETGMIFDIQKMAEITHEFGALFHTDATQAVGKIKVNLNQVGVDFASFSAHKFHGPKGVGGLFIKKGLKLTPLLHGGEHMGGRRSGTLNVPYIVAMGEALRIANTMLDFEDSHIRRLRDKLEDQILALPDTTVVGKREHRVPNTILASIKGVEGEAMLWDLNKNGIAASTGSACASEALESNPIMEAIGAENDLAHTALRLSLSRFNTEEEIDYAAKQIKNATQRLRAISCTYAYNPNNYK

SEQ ID NO: 56307 - protein, 283 aa, Bacteroides fragilis NCTC 9343
MDFKELNNGVKMPIQGFGVFQIPDATECERVVTDALAVGYRLIDTASVYGNERAVGTAIRKSGIPREELFITTKAWISEMGYERTLRALDASLARLGLDYLDLYLIHMPFGDYYGAWRAMEKLYAKGRVRAIGVCNFEPDRLLDLCHNANVIPAVNQIEVHPYTPQTDAIRTMQELGIQAEAWGPLAEGRNGLFTDDILTGIARKYDKSAAQVVLRWHLQRGVVAIPKSVHRQRMQENFNIGDFMLTPEDMAAIASMNTGYNTILDLRAPEEVQRLYGIECPA

SEQ ID NO: 56308 - protein, 581 aa, Magnetococcus sp. MC-1
MTTTKRAFSAQIEPTFSELFTPKLFTTLREGYSLADLRADALAGLTVAIVALPLSMAIAIASGASPAQGLYTAIVGGFLVSALGGSRFQIGGPAGAFIVLVAATVQAHGMDGLILATLLSGLILAILGFFRLGTYIKFIPYPVTVGFTAGIAAIIFASQIKELLGLTLTTSEPGPLLEKLPVLWTSLPSYDSATVTLAVATIGSILILKHYRPHWPGMLLAVVAASLVTLLLDLPIATIGSKFGGIPSSLPTPVLPEFTLAKLQDVLPSALSFALLGSIESLLSAVVADGMTGRRHRSNCELVAQGVANMASALFGGICVTGTIARTATNVRAGAHGPFAGMLHALFLLAFILIAAPLARYIPLASLAGVLAVVAWNMVEKHAFATLIWASRGDAAVLLTTFLLTLFRDLTEAIVVGFALGSVLFIHRMSKTTAIETQTPFVAEDRADNIGNRAPYDQARINDPDVVIYRISGVFFFGAAASIGSVLDRIADTHRALIIDFSSVPFLDSTAANTIEGLAHKAKRRNVKVCLIGTTHELRRDLFALGIKPPMVHYARELSCALRVLKAKKTEPTEVVSTPLD

SEQ ID NO: 56309 - protein, 322 aa, Staphylococcus aureus subsp. aureus Mu50
MKHLLVIHTGGTISMSQDQSNKVVTNDINPISMHQDVINQYAQIDELNPFNVPSPHMTIQHVKQLKDIILEAVTNKYYDGFVITHGTDTLEETAFLLDLILGIEQPVVITGAMRSSNEIGSDGLYNYISAIRVASDEKARHKGVMVVFNDEIHTARNVTKTHTSNTNTFQSPNHGPLGVLTKDRVQFHHMPYRQQALENVNDKLNVPLVKAYMGMPGDIFSFYSREGIDGMVIEALGQGNIPPSALEGIQQLVSLNIPIVLVSRSFNGIVSPTYAYDGGGYQLAQQGFIFSNGSNGPKARLKLLVALSNNLDKAEIKSYFEL

SEQ ID NO: 56310 - protein, 797 aa, Gibberella zeae PH-1
MATAKARGKLPETETIDLTQQPSAFKPYAGAKKLVIKNLRAPTNRDSQVAEYYKRTEKELDSALESIFAGRTPDVPLERLYRGVEDVCRKGDPAKVYQMLNERVDAHLQRIILPKIQKNGRASNLDTLKITLEEWKTWNKQTILIRSTFSFLDRTYLLRENYPSINDMAIGKFRKMAFSSQAHSYKSPVGAKLVAGICELIENDRRGGDQTEPTLLKDSIMMLYVLGVYVKHFEPFFLEQSQRYFKEFGEAWSTSSLKDYILVCEKLLKKEDYRCIQFNLDSTTEKQLMDSAHSLLIGNYSEKLLNGGSLGKLLADREVESMKALYDLLRLSGIQKKMKAPWGEYIRTAGAAIVGDKEKGDEMVLRLLELRRSLDLMIRDAFNKDEDFLWAMRESFGKFMNDRKVASCWETGTSKIGEMIAKYIDMLLRGGLKSLPKELLSDLKDRETAQKEGQASTGDEDAELDRQLDQALELFRFIEGKDAFEAFYKKDLARRLLMGRSASQDAERNMLTKLRGECGANFTQNLEQMFKDQELGKDEMESYKQWCQGSADRKAPLDLSVMILSAAAWPTYPDVRLNLPDEVATQIERFDKYYKNKHTGRVLTWKHSLAHCSVNARFAKAPKELLVSAYQAVVLMMFNSIPDGGFLAYEQIATGTGLQGGDLNRTLQSLACGKARVLTKHPKGRDVKPTDTFTFNKTFTDPKYRVKINQIQLKETKEENKATHERIVQDRRFETQAAIVRIMKSRKSMGHSELVAEVINLTKKRGSIDTSAIKKEIESLIEKDYIEREGNAYVYLA

SEQ ID NO: 56311 - protein, 305 aa, Staphylococcus aureus subsp. aureus COL
MFQKLSIFATKSFLVWMLVAAVIGFIFPQHVATLGKWVPYLLGIVMLGMGLTITPNDFKMVFKAPRAVIIGVCLQFSIMPTLAFIIAKSFHLPPDIAVGVILVGCCPGGTSSNVMSYLAKANVALSVSITTVSTLLAPFVTPALIYLFANEWLEVSFVSMLWSVVQVVLIPIALGIVLQIINRKIAEKASTALPIISVVAISLILAIVVGGSKHQILTTGLLIFLVVILHNVLGYTIGYWLARLLKLDRQDQKAVSIEVGMQNSGLAVSLAALHFNPIAAVPGAVFSFIHNITGPILAKYWSKKL

SEQ ID NO: 56312 - protein, 112 aa, Bifidobacterium breve
LEVTKVEGNNVHTKVVVAGPVSSHKGINLPGVAVSLPALTEKDEADLRWAIRTGADIIAMSFVRFATDIDRAHEIMDEEGRRIPIVAKIEKPQALENLEEIVKTFDGIMVAA

SEQ ID NO: 56313 - protein, 605 aa, Magnetococcus sp. MC-1
MGVMSSYVVLARKWRPRRFEDLIGQEHTVQALRHALEQGRIPHAFLFTGIRGIGKTTLSRLLAMCLNCGTGVTANPCGACDSCRAIVRGEHPDVFEVDAASRTKVEQMRELLDGVAYTPSLSRYKIYILDEVHMLSASSFNALLKTLEEPPTHVKFIFATTEVRKILPTILSRCQRYDLRRLDRDGLARYLAHVLDVEQIAYDQEGLAAISHAADGSVRDALSLLDQAIAHGGGRVDYTHVSGLLGLTDRQAVVALFADLCRGRLLEMLERAAYFHRDGVEPVVLLNDLLDITHQVTRELAVGVGDAAQALSEHEGLKEVWPKLGLEHLQMLYQVLLRGREDLQMARLPRQALEMLLLRAAHLRPVPPLKQLVESLQRQAGVEPGERQASPAVKKFDAPGVGQSEVAPTVHFAPKSAALEAPQAVQAPQVKRAKKQPTVLAPEPQPPVVPPDWPAVPPLQEEPTVVSPTPPATVESWEKLIEAARIKFPLLAQKMESHLSLLSYTGGSGPHDPPCMEVMIAHAFAGEPSKVHKNLMDLLVSLKLPNGVVHIRKSSDGTRPDTEAEKQKKAQDAYQNALTREVADDPLIQEIERRFEAKIIHVEPV

SEQ ID NO: 56314 - protein, 112 aa, Bifidobacterium catenulatum
LEVTKVEGNNVYTKVIVAGPVSSHKGINLPGVAVSLPALTEKDEADLRWAIRTGADIIAMSFVRFATDIDRAHEIMDEEGRRIPVVAKIEKPQALENLEEIVKAFDGIMVAR

SEQ ID NO: 56315 - protein, 450 aa, Magnetospirillum magnetotacticum MS-1
MKFLVRNLISDIERVSNIQVYGQIAAVQGMLLEAGGVQRTISVGDRCNVVARDGRRVICEVVGFRQGRALLMPYSPIEGIGLGCRTEVQDAEPVVYPDRGWLGRVINGFGEPVDGLGPLPGGDIAYPVKAQPPSAHSRTRVSGKIDLGLRSVNAFLTCCRGQRMGIFAGSGVGKSSIMSMMARNTSADIAVLGLIGERGREAREFIEDDLGPEGMKRSVVVVSTSDESPLLRRQAAYMTLTVAEYFRDQGLDVLCMMDSVTRFAMAQREISLSAGEPPASKGYTPTVFAELPRLLERAGPGTGKGSITGLFTVLVDADDHNEPIADAVRGILDGHIVLDRSIAERGRYPAINILRSVSRTMPGCNNQQENDLVRRARALLSTYEDMAELIRLGAYRRGTDPKVDEAIHYYPAIEAFLGQLKTESTNLQTCYAQLAEVLGMPFDGDGMGRK

SEQ ID NO: 56316 - protein, 293 aa, Oryza sativa Japonica Group
MLRRNTRLRREYLYRKSLEGKERQHYEKKRRLREALDEGKPIPTELRNEELALRREIDLEDKDSAVPRSLIDDEYAGAALREPKILLTTSRNPSAPLTQFVKELKVVFPNSQRMNRGGQVISEIVESCRSHDITDLVLVHEHRGQPDGLIVCHLPFGPTAYFGLLNVVTRHDIKDRKAMGKMSEAYPHLILDNFTTKTGERTANIVKHLFPVPKPDSKRIITFANRDDYISFRHHVYEKHGGPKSLDLKEVGPRFELRLYQIKRGTVDQAEAQNEFVLRPYMNTAKKQKSLGA

SEQ ID NO: 56317 - protein, 643 aa, Kineococcus radiotolerans SRS30216
MGLLETIKGPQDLKSLPAEELPALAEEVRAFLVDAVSRTGGHLGPNLGVVELTIALHRVFDSPRDRLVLDTGHQSYVHKLLTGRQDFSRLREAGGLAGYPSRAESEHDVVENSHASTSLSWADGLAKAFELRGESQGEHGRRVVAVIGDGALTGGMAWEALNNIADAQRPVIVVVNDNERSYAPTTGGMASHLATLRTTREYEKLLDWGKQSLKRGGTPGRLAHATLHGVKKGLKDIVAPQGLFEDLGLKYVGPVDGHDTEAVEHALRRARSFGGPVIVHVITQKGRGYQPALADDADRFHAVGVIDPETGEAQATSGSSWTSVFADEVLAIADERPDVVGVTAAMRAPVGLEPFARAHPERVFDVGIAEQHAVTSAAGMAAGGLHPVVAVYATFLNRAFDQLLLDVGLHRAGVTLVLDRAGVTGPDGPSHHGVWDLGLCRLVPGLRLAAPRDAATLRAELREAVDVDDAPTVLRFSKGKVPAAIPAIARTGHADVLEGPAWAQGDDVLLVAVGALVTRALDVAARLRAHGVGVTVVDPRWVVPVDEALVDLARSHRHVAVLEDGGEVGGVGWALAAGLRERDDATPVHGFALPQRFLDVGARDALLDEAGLAPQDVARALVEAVARTGQPERPGPSAAVPPR

SEQ ID NO: 56318 - protein, 467 aa, Colwellia psychrerythraea 34H
MKDFSKYNTKELWNNDLKHNMHPFTDFSSFKKEGSLIMAESEGAYVFDTDGRKYLDGIAGLWCVNIGYGNEEMGQAMLDQTRRIPYYSSFGHLTTPPAVELSTKLASLAPKSLSHVFYGTGGSMSNDTAVRMVHFYFNRIGKPNKKQIITRTDGYHGSTYLSMTLTGVEYDHIGFDLAPDLVHRVSAPNVYRRPAGMTVPEYCDFLVNEVEQKILSIGPENVAMFVAEPIAGAGGVLVPPEGYHQRVAAVCKKYGVFILSDEVVTAFGRLGEMFSSEKIFGFTPDIITCAKGLTSGYIPLSANMISDEIYDVISVPQAEGASFTHGFTYSGHPVSCAVGLKNIEIMERMDLCGHVREVGKYFENQLIEKLSNLPLVGDVRGSHFMMCIESVANKETKELLDPNIAIGNRIADKCQAVGLLVRPLAHKNILSPPLTLSVAEVDFIVSTLHKAIIDVQDDLVKEGLWHG

SEQ ID NO: 56319 - protein, 681 aa, Volvox carteri
MALRFCPTAAPPRGCGTPIQHPVLLLPHKALLPYSTAASRQAARPARVCVTAYAKLADGSARRMQSEEVRRAKEVAQAALAKESPADWVDRFGSEPRKGADILVQCLEREGVDNVFAYPGGASMEIHQALTRSDRITNVLCRHEQGEIFAAEGYAKASGRVGVCIATSGPGATNLVTGLADAMMDSIPLVAITGQVPRRMIGTDAFQETPIVEVTRAITKHNYLVLDIKDLPRVIKEAFYLARTGRPGPVLVDVPKDIQQQLAVPDWDSPMSITGYISRLPPPVEESQMIPVLRAIQSASKPVIYYGGGCLDARDELREFAARTGIPLASTFMGLGVVPAEDPNHLQMLGMHGTVAANYAVDQADLLVALGVRFDDRVTGRLDAFASRARIVHVDIDAAEISKNKTAHVPVCGDVKQALRHLNRMLEAEPLSDRFVAWRAELAAKRAEFPLRYPQRDDAIVPQYAIQVLGEETKGEVIITTGVGQHQMWAAQWYPYKEPRRWISSGGLGSMGFGLPAALGAAVAFDGKQGREKRIVVDIDGDGSFLMNVQELATVFIEKLDVKVMILNNQHLGMVVQWEDRFYKANRAHTYLGKREAEWHATGDEEDIYPNFVGMARSFGVPSMRVIRKEDLRGAIRTMLDTPGPYLLEVMVPHIEHVLPMIPGGATFKDIITEGDGSVKY

SEQ ID NO: 56320 - protein, 285 aa, Zea mays
MSGGPAAVSFLTNIAKAAAGLGAAASLLSASLYTVDGGERAVVFDRFRGVLPDTVGEGTHFIVPWLQKPYIFDIRTRPHNFSSNSGTKDLQMVNLTLRLLSRPDVVNLPTIFTSLGLEYDDKVLPSIGNEVLKAVVAQFNADQLLTDRPHVSALVRDSLIKRAREFNIILDDVAITHLSYGADFSQAVEKKQVAQQEAERSKFLVAKAEQERRAAIVRAEGESESARLISEATAIAGTGLIELRRIEAAKEIAAELARSPNVAYIPSGDNGKMLLGLNAAGFGGR

SEQ ID NO: 56321 - protein, 400 aa, Rubrobacter xylanophilus DSM 9941
MEGRCRPKQRRKVSPMQNKYRLMSPGPTPIPPEVSAAGALPIIHHRTPEFGEVFTRVNENLKRVFLTENDIFTYASSGTGAFEGALQNLFSPGDKVLVVNNGNFGGRWAKMGRAFGLEVTELTYEWGQKADNEEVAEALAADPQIKGAVCVLSETSTGTVNDIRGFAKATENVLTIVDAVSGLGCCELRTDEWGVDVVVAGSQKALMTPPGLGFVSVSERAWKAHEESRMPRYYFDWTAAKKAYRKDPPQTPWTPAVSVILQLDLALRQILEEGLENVLERHVLLGRAARAGVKGMGLRLFGPDEDMNAAVTAAWVPEGVDGKQLVRMVFREHGIQVAGGQGPMEGRIFRIGHCGYFDAYDIIATVAALELALESLGYPVELGRGVGAAQRVFSKSGVAA

SEQ ID NO: 56322 - protein, 486 aa, Pseudomonas putida
MKEIKHFINGAFVGSASGRTFEDINPSNGQVIGHVHEAGRAEVDAAVKAARAALKGPWGKLSVAERAEILHRVADGITARFDEFLEAECLDTGKPKSLASHIDIPRGAANFKVFADLLKNVANEAFEMATPDGAGAINYAVRRPKGVIGVISPWNLPLLLMTWKVGPALACGNTVVVKPSEETPLTATLLGEVMQAAGVPAGVYNVVHGFGGDSAGAFLTEHPDVDAYTFTGETGTGEVIMRAAAKGVRQVSLELGGKNAGIVFADCDMDKAIEGTLRSAFANCGQVCLGTERVYVERPIFDEFVARLKAGAESLMIGPPDDASSNFGPLVSLKHREKVLSYYQQAVDDGGSVITGGGVPDMPAHLAGGAWVQPTIWTGLSDDSAVVTEEIFGPCCHIRPFDTEEEAIELANSLPYGLASAIWTENGSRAHRVAGQIEAGIVWVNSWFLRDLRTAFGGSKQSGIGREGGVHSLEFYTELKNICVKL

SEQ ID NO: 56323 - protein, 231 aa, Fulvimarina pelagi HTCC2506
MSDAKSLKRKAAEAAFAELDEGLNIGIGTGSTAEEFVRVLAEHVEADFEMTGVTTSERTETLCRELGVPTKTLDEIPILDVTVDGADEIDGDLRLIKGGGGALLREKIVAFSSAKMIVIADASKKVETLGAFPLPIEVNGFGLMSTFMAIRRVAETLDLTGDIVLRKNGDQPFITDGGHLILDASFGRIPDPEALSAALRSIPGIVEHGLFIKLASVAILASEDGIERLEA

SEQ ID NO: 56324 - protein, 550 aa, Rhodococcus sp. RHA1
MTATTAQLLTETTPWLRLSEHSEEIDRSHLRALFASDPDRVDEFTVTAGDLHIDYSKHLITRRTRELLLDLARSVDVEGNRDAMLHGEHINTTENRAVLHTALRLPRDASLSVDGQDIVTDVHETLEKMGVFTERLRDGRWRGATGKKITTVVNIGIGGSDLGPVMVYRALRHYADAGISLRFVSNLDPADLTDNLRGLDPAATLFIVTSKTFSTLETLTNATAARRWLVSALGEDAVTKHFVAVSTNAQPVAEFGIAPENIFGFWDWVGGRYSVGSAIGLSVMAAIGRERFTELLDGFHTIDEHFRTAPPESNAPLLLGMLGVWYSSFRGAQSRAVLPYSNDLVRFPAYLQQLTMESNGKSVHTDGSPVRCDTGEIFWGEPGTNGQHAFFQLLHQGTRLVPADFIGFAQSTDDLPTMSGTGSMHDLLMANFFAQSKVLAFGKTRKEIAAESASADLIPHKVMPGNRPSTTILAPRLTPSTLGQLIALYEHQVFVQGVVWGIDSFDQWGVELGKVQALALAPAVAGEAAPCTGDTSTDALIRTYRRLRHP

SEQ ID NO: 56325 - protein, 168 aa, Psychrobacter arcticus 273-4
MIMIKIGQGIDVHAFHNNGQQQQYVVLAGVPIEHTHSLLAHSDGDVVLHALADALLGALALGDIGQHFPDTDAANAGLDSRVLLRYVYGKVLAAGYMLGNADITVMCERPKLAVHNLAMRANIASDLQTDVSNISVKATTTEKLGFTGRQEGIMANAVVLLVPNTSGV

SEQ ID NO: 56326 - protein, 297 aa, Methanococcoides burtonii DSM 6242
MDEKIEDIEEIIGKYMQAGEILSTVRSEAKEKVKIGTTLLEVADFVEQRTIELGGLPAFPCNISRNDEAAHATPLIGDETVFAEDVVKLDLGVHIDGYIADSAITVDLTNENSDLVKASEAALYAAIDIIKNGINTAEIGAVIEDTITGHGFKPIANLTGHGVGQYLAHVPPSIPNRHIGQGVTIKTGDIFAIEPFATDGAGKVADGTLTEIFQVIGHKPIRLPAVRKVLKELEQYKTLPFARRWLKSDKLDYSLMQLEKAGIITSYPVLKDVGGGLVSQTEHTVIVTDDGCKVTTK

SEQ ID NO: 56327 - protein, 312 aa, Actinidia arguta
EYLPIVLNPDRTITRIYELPRTPASPDPSSSLPVLSKDVPINPKHNTSVRIFLPRKALDNSSPTTKKLPVIVYFHGGGFILFNADSSVFQDICVDLAVQARAMIVSVDYRLAPEHRLPAAYDDGVDALHWIRTSDDEWLRDFADLSNCFLMGSSAGGNIAYHAGLRAAAAVDDLAPLKIQGMVLHQPYFGGSDRTPSEMRSVDDPLLPLFVNHLMWELSLPIGADRDHEYCNLTVSSESESIETFKLLGWKVIVTGCDGDPLIDRQMELVKVLEKKGVRTIALFDEGGFHGVEFRDPTRMKAFLEFLIPCLN

SEQ ID NO: 56328 - protein, 379 aa, Magnaporthe grisea 70-15
MSAEAGSSSDQSVTQKTPKTVRAVFHDAVGKVSVRHVPFPELKEPEDAIVRITTSAICGSDLHNYRGFYGPENYPYRAGHEAMGVVHKIGPAVDSLKVGDRVVIAFPDDHPIRTENTTVPDIDFFFDPEFGLQTEYARVPFADSSLIPIPNRLPDKEWLFLGDIFTTGWMVLNGAGFEAGDSVAVFGAGPVGLMAAYSACIRGASRIYVVDHVQQRLDKAREIGPGVVPIDFTKPGQSASEQILALDGGGVNRAVDCVGQECLNRELVVQQDYVLRECVAVTAAGGGVGVAGVHILGAVLADPAKMAPTLSRLVDAGRARPGFIVDEGPFDLDEAPELYRRFNEQKIIKVLFKGAPRPEEWEEWEKDEVLEDFKKVNGH

SEQ ID NO: 56329 - protein, 188 aa, Glycine max
MGEFTIQISNDLVNQLVDDAVPKKKTRKTRRKVARETEKPQSNETIKPDSAVTPGWPVQSPLFLPATLPVQPVHSELEGIQSVLQESERVLERLQKQEENMLQEVTQKAKDLHDKEYKLPNPKPEPCMAERLATLSCYKEHIKDPLKCASLVTGFADCLRRFGRLGDKRVILRSGLKGNSCVPNANNY

SEQ ID NO: 56330 - protein, 369 aa, Rhodococcus sp. RHA1
MKTKAAALTGVHRDWEVLEFDLDDPGPGEVLVQMKVAGLCHSDKHAKFGGMTYPLVGGHEGAGVVEAVGDGVSRVSIGDHVAVSWIPSCGTCRWCASGQSNLCDLGANMVTGELANGGFRFHRDGTDIGAMAATGTFSQFSVVDQRSVVKVDPTIPFEWVSLVTCGVATGWGSVVNAGEVKAGDTVAVYGCGGIGSNAVRAAVGANAGLVAAIDPVESKLEFAKQSGADFVYTSAEEAHADLWERTYGVGADVTVVTVGVVTSEVVRAAFELTRKGGTVVLTGVSDDVMENTIELPGGILTLFQKRIVGSLYGHCNPLVDIPRLLRMAQAGKLVLDDLVTRRYALEDINQGFDDMLAGHNIRGLIVHDH

SEQ ID NO: 56331 - protein, 188 aa, Pichia angusta
MSSTEKRLLKEYRAVKKELTEKRSPIHDTGIVDLHPLEDGLFRWSAVIRGPDQSPFEDALWKLEIDIPTNYPLDPPKIKFVVFGEEKIRQLQRKTSSGARKVCYKMPHPNVNFKTGEICLDILQQKWSPAWTLQSALVAIVVLLANPEPLSPLNIDMANLLKCDDTTAYKDLVHYYIAKYSAYESNDV

SEQ ID NO: 56332 - protein, 584 aa, Colwellia psychrerythraea 34H
MSNNFTKVENPVLIVEGKQADNERLKAESDYLRGTIKDDLQDRMTGGFTSDNFQLIRTHGMYQQDDRDIRAERQKQKLEPLHNVMLRARLPGGIINPTQWLAIDKFADDYTSYGSIRLTTRQTFQFHGVLKPNIKLMHQTLNSVGLDSIATAGDVNRNVLCTSNPVESALHQEAYEWATKISEHLLPKTRAYAEIWLDEEKVETTEADEIEPILGSNYLPRKFKTTVVIPPNNDIDVHANDLNFVAISEGGELIGFNVLVGGGLAMTHGDKATYPRCADDFGFIPKEHTLAIAAAVVTTQRDWGNRVNRKNAKTKYTLDRVGVDTFKAEVERRAGIKFSESRSYEFTHRGDSFGWVEGIDGKNHLTLFIENGRILDFNGANSDSKALKTGMREIAKIHKGDFRLTANQNLIVAGVSAEDKTIIEQLAREHGLINDGVSNQRKSSMACVAFPTCPLAMAEAERYLPGLVDDVEAILEKNGLKDDSIILRVTGCPNGCGRAMLAEIGLVGKGPGKYNMYLGSDLAGSRVPKLYKENVDEAGVLSEIDALSARWSAERNDGEAFGDFVIRAGIVEQVIVSFRDFHHA

SEQ ID NO: 56333 - protein, 391 aa, Colwellia psychrerythraea 34H
MSEKLDLNEIRQEITLLDQDLLALFAKRRALTLNVAKSKVQQIRPIRDQQREQELLIRLIKHGKTLGLDAHYVTSVFQTIIEDSVLNQQAFLQSLANPDIQVPTVSVAFLGDKGSYSFLASHRYFSRRAEKIIESGCQSFYDILQQVESGQVDYGMLPIENTSSGSINEVYDLLQHTNLSIVGEITQPIEHCLLTSVNTSLDKIKTIYAHGQPFAQCSNFLDKQSNIRIEYCDSTADAMAKVAELQDDTIAVIGSEEGGQLYQLHALEQSIANQTENHSRFILVARKSVDVAEQIPAKTAIILSTGQKAGALVECLLVLKDKGINMCKLESRPIQGRPWEEMFYIDVEANLKSFALQEAINDITPHTNFIKVLGCYPIEHISPTSVPSGEI

SEQ ID NO: 56334 - protein, 640 aa, Synechocystis sp. PCC 6803
MHISELTHPNELKGLSIRELEEVSRQIREKHLQTVATSGGHLGPGLGVVELTVALYSTLDLDKDRVIWDVGHQAYPHKMLTGRYHDFHTLRQKDGVAGYLKRSESRFDHFGAGHASTSISAGLGMALARDAKGEDFKVVSIIGDGALTGGMALEAINHAGHLPHTRLMVILNDNEMSISPNVGAISRYLNKVRLSSPMQFLTDNLEEQIKHLPFVGDSLTPEMERVKEGMKRLVVPKVGAVIEELGFKYFGPIDGHSLQELIDTFKQAEKVPGPVFVHVSTTKGKGYDLAEKDQVGYHAQSPFNLSTGKAYPSSKPKPPSYSKVFAHTLTTLAKENPNIVGITAAMATGTGLDKLQAKLPKQYVDVGIAEQHAVTLAAGMACEGIRPVVAIYSTFLQRGYDQIIHDVCIQKLPVFFCLDRAGIVGADGPTHQGMYDIAYLRCIPNLVLMAPKDEAELQQMLVTGVNYTGGAIAMRYPRGNGIGVPLMEEGWEPLEIGKAEILRSGDDVLLLGYGSMVYPALQTAELLHEHGIEATVVNARFVKPLDTELILPLAERIGKVVTMEEGCLMGGFGSAVAEALMDNNVLVPLKRLGVPDILVDHATPEQSTVDLGLTPAQMAQNIMASLFKTETESVVAPGVS

SEQ ID NO: 56335 - protein, 311 aa, Methanosarcina mazei Go1
MLKKFTSLFPLWAVLLSAVAYLYPEYFAPHNNLIVPFLSLIMLGMGVTLSVDSFLEVLKRPHVVLLGTLMQYTLMPLAAWAVSIALNLPADLMAGVILLGCCPGGTASNVICYLAKGDVALSIVLTSVSTMIAFLATPFLTWLFIGQTVEVDVTGMLVSVINIVVLPVALGLAINYFFESRIKAVRDVFPAISAAAIVIIIAIIIGTNSENLEQSGPLVLLAVILHNGLGLAGGYGAAKALKFSEKEARTIAIEVGMQNSGLSVALAIKHFTAAAALPGAIFSIWHNLSGAFLAGHWSKETEFDRDKHEIS

SEQ ID NO: 56336 - protein, 373 aa, Picea sitchensis
MATCRSAPTQTLLPIHFYSSISHQTCNYQCIINHNFCRNYCPPWGRASLQYYMKRGSNRLPVLRRQSERRYSVNRVRAAGDSDEVMKPPFNVLITGSSKGIGYALAKEFLSAGDNVIICSRSDDLVQAAIENLRGEFGDQRVWGTTCDVRDGENVRALVDFAKNTIQYVDIWINNAGSNAYSYKPLVETGDEALMEVVTTNTLGTMICCREAIMMMMSQPRGGHIFNIDGAGADGSPTPRFAAYGATKRSLVHLTKSLQAELRMQGIKKVAVHNLSPGMVTTDLLMSGSNTKQAKFFINVLAEPADTVAKFLVPRVRAVSGKESFKPTYIRFLNGFKAYSQIFVVSVFLIGCKCMFNRLLPNCNVFQTLANVW

SEQ ID NO: 56337 - protein, 110 aa, Bifidobacterium longum bv. Infantis
VTKVEGNNVHTKVVVAGPVSSHKGINLPGVAVSLPALTEKDENDLRWAIQTGADIIAMSFVRFATDIDRAHEIMDEEGRRIPIVAKIEKPQAVENLEDIVKVFDGIMVAR

SEQ ID NO: 56338 - protein, 234 aa, Methanosarcina mazei Go1
MTERNTSTDSPEKRAAGIAAAGLVSSGMVVGLGTGSTVAYTIKELGRRVKEEGLDILGVVTSYQSEMLAIDAGIRLTTLSQDPELDIAIDGADQIDSNLYTIKGGGAAHTREKIVSVSAKRFVVVADDSKTSTQLDKPVPVEVLPFAKEPAVNRIRKLGGEPRLRSAVKKDGPVITDNGNFVLDVEFGVIKDPEALALQLSAVPGVVEHGIFSNVDELYIGKKDGSVKIISRQK

SEQ ID NO: 56339 - protein, 200 aa, Salmonella enterica subsp. arizonae serovar 62:z4,z23:--
MVLVTRQAPDFTAAAVLGNGEIVDKFNFKQHTNGKTTVLFFWPMDFTFVCPSELIAFDKRYEEFQKRGVEVVGVSFDSEFVHNAWRNTPVDKGGIGPVKYAMVADVKREIQKAYGIEHPDEGVALRGSFLIDANGIVRHQVVNDLPLGRNIDEMLRMVDALQFHEEHGDVCPAQWEKGKEGMNASPDGVAKYLAENISSL

SEQ ID NO: 56340 - protein, 112 aa, Bifidobacterium animalis subsp. lactis
LEVTKVEGNNVHTKVVVAGPVSSHKGINLPGVAVSLPALTEKDENDLRWAIQTGADIIAMSFVRFATDIDRAHEIMDEEGRRIPIVAKIEKPQAVENLEDIVKVFDGIMVAR

SEQ ID NO: 56341 - protein, 179 aa, Haemophilus somnus 2336
MNKLELIKSSIKSIPNHPKEGIIFRDITSLTEVPEAFQATIDLIIERYKSKGITKVIGTESRGFIFGAPVALALNVPFILVRKPGKLPRETIAQSYQLEYGQDTLEMHVSSIQAGDNVLVIDDLLATGGTIEATVKLVERLQGQVKHAAFVISLPDLGGEVRLRELGVEPFTLVEFSGH

SEQ ID NO: 56342 - protein, 510 aa, Salmonella enterica subsp. arizonae serovar 62:z4,z23:--
MVDANGSDGDPGDYLGSLGGSTGDFQRSLKSLTYVYTTGLNAPWFFIVLIGLKLMESNNKLKRGLSTRHIRFMALGSAIGTGLFYGSADAIKMAGPSVLLAYIIGGVAAYIIMRALGEMSVHNPAASSFSRYAQENLGPLAGYITGWTYCFEILIVAIADVTAFGIYMGVWFPAVPHWVWVLSVVLIICAINLMSVKIFGELEFWFSFFKVATIIIMIAAGIGIIVWGIGNGGQPTGIHNLWSNGGFFSNGWLGMIMSLQMVMFAYGGIEIIGITAGEAKDPEKSIPRAINSVPMRILVFYVGTLFVIMSIYPWNQVGTDGSPFVLTFQHMGITFAASILNFVVLTASLSAINSDVFGVGRMLHGMAEQGSAPKIFAKTSRRGIPWVTVLVMTIALLFAVYLNYIMPENVFLVIASLATFATVWVWIMILLSQIAFRRRLPLEEVKALKFKVPGGVATTIAGLIFLVFIIALIGYHPDTRISLYVGFAWIVLLLIGWTFKRRRDRRLAQA

SEQ ID NO: 56343 - protein, 108 aa, Bifidobacterium longum
KVEGNNVYTKVVVAGPVSSHKGINLPGVAVSLPALTEKDEADLRWAIRTGADIIAMSFVRFATDIDRAHEIMDEEGRRIPIIAKIEKPQALENLEEIVKTFDGIMVAR

SEQ ID NO: 56344 - protein, 667 aa, Haemophilus somnus 2336
MSYQVLARKWRPKTFSEVVGQEHILTALSNGLCENRLHHAYLFSGTRGVGKTSIARLFAKGLNCIRGVTAEPCGECEHCKAIEEGRFIDLIEIDAASRTKVEDTRELLDNVQYKPTQGRYKVYLIDEVHMLSRHSFNALLKTLEEPPEYVKFLLATTDPQKLPITILSRCMQFHLKALSEKQIAQHLEFILQQENIPFEYPALEKLATAAQGSIRDSLSLTDQAIAMGNANVSLDTVSIMLGLLDDNQPIDILYALQQGNGEMLMKAIQAVAEKGADWDKLLVTLAEKLHQIAMLQLLPQQINEENSLGFLAKHITPEDVQFFYQVIVSGRKELASAPNHRIGAEMILLRSLAFHPKFISPSSAAPIEQSAVQKSQNIVQPPLVEMPVVSVAEQLPSQNLIRKPTIADKVDTKLSTTALSALEALEQLSQPSDHSDSEKKNSPIDNIYDISLRENTENISALPVLNVVPKDVDNALKTVTVIDKSDHRSDEIQEDSAENYRWEWRNPEMAVEEKAIRPSEIKQAILEQASPELIQRIIATAQERDDWTRIIEQLPLRGMTKDMALNTVLLNQSGDQIVLSLMSDKQHLLDRCHKELKQALSDFYQRDIQLLITPTDDKNLATPLYYQNLVYQEFNEQAKKALQEDNSLKLLEKEFAATLDLDSVRPI

SEQ ID NO: 56345 - protein, 388 aa, Magnetococcus sp. MC-1
MNIHEYQAKEIIAKFGVNVPRGRVAYTPQEAEMAAKELDSEVFVVKAQIHAGGRGKAGGVKVVKTTDAVREEASRMLGLTLVTHQTGPEGKEVKRLYVEEGCDIARELYLGIVIDRATSRVTFMASTEGGMEIEEVAEKSPEKILREVVDPAVGLVAFQARNLAFGLGLEGKQINKAVQLMSGLYNAFMETDASLMEINPLVITGAGDVIALDCKMNFDANALYRQKAIEELRDFDEENPKEIEASKHELNYIALDGNIGCMVNGAGLAMATMDIIKIKGGAPANFLDVGGGATTERVTEAFKLILSDENVKAVLVNIFGGIMRCDVIANGVVEAAKQVNLNVPLIVRLEGTNVEKGKEILANSGLPIISADNLDDAATKAVASLKEG

SEQ ID NO: 56346 - protein, 456 aa, Gibberella zeae PH-1
MSGSEPFPLLNTANDQLHQRHQATSSVSVSNTTATQDAINNARKRRKSSALGGEIRGDTGAPAFASSRASLDATSDGRKRLSKRRRARGLIARAKQTMIKHTWVLPAILLTLFLVGYAFNPTESNPIHNFIFLSYKLPQDDLSAPAQYGKGRWDLAFVSFYTIVLSFTREFIMQELLSPLARYYGLSRGKKARFMEQVYTAIYFGVLGPVGLWVMSHTPVWYFNTYGMYDGFPHLTNLAPVKFYYLFQAAYWSQQAIVLLLGMEKPRKDFKELVGHHIVTLGLIALSYRFHFTYIGLAVYTTHDISDFFLATSKTLNYIDSPLVGPYFGVFMMAWIYLRHYLNLKIIWSLFTEFETVGPFELNWETQQYKCRIAQVITASLLCALQALNLFWLFCIARIAWRFVSQNDLQDDRSEDEDDGEIEDDEVASPSSKANGSTNGHANGHANGKTAADMKN

SEQ ID NO: 56347 - protein, 110 aa, Bifidobacterium adolescentis
VTKVEGNNVYTKVVVAGPVSSHKGINLPGVAVSLPALTEKDEEDLRWAIRTGADIIAMSFVRFATDIDRAHEIMDEEGRRIPVVAKIEKPQALENLEEIVKAFDGIMVAR

SEQ ID NO: 56348 - protein, 111 aa, Bifidobacterium angulatum
EVTKVEGNNVHTKVVVAGPVSSHKGINLPGVAVSLPALTEKDEEDLRWAIRTGADIIAMSFVRFATDIDRAHEIMDEEGRRIPVVAKIEKPQALENLEEIVKAFDGIMVAR

SEQ ID NO: 56349 - protein, 531 aa, Magnetospirillum magnetotacticum MS-1
MLNSPMARRGMVTSPHHLASQAGLAVLREGGTAIEAAIATAAMLGVVYPHMTGLGGDAFWLIAEPGKPPVSIDGSGAAGAKVDLELYRKAGHKRIPTRGPLAANTVAGAVSSWQLALDVSGHWGGRLPLRRLFEDAVFAAREGFAVTGHQAAATLRGLNDLKREPGFAETFLAKRKAPVPGAMLRLPALADTLERLANAGLDDFYRGEVARAVAAGLQAAGSPLRAEDMARHRGMRRRPLSLNLPCGHLFNTAPPTQGLASLILLGLYQRLEVAEADGFDHIHGLVEAAKLAYRIRDAHVTDPARMSIHATTYLSDGILDRMAWEIDKAKASPLPGAGAEGDTVWLGVIDGQGRAVSFIQSLFHAFGSGVVLPEVGLVWQNRGCSFSLDPEHRNALEPRRRPFHTLSPGLARLKDGRTMVYGTMGGDAQPLVQAEVFTRVALYGQGLQQAVSAPRWCLARALDGSAAPAGIQVESRVDPQVIRRLEEVGHSVQMVGDWNSLLGHAGAVLRRADGLLEGAADPRADGVVAAF

SEQ ID NO: 56350 - protein, 397 aa, Oryza sativa Indica Group
MSNPESNPPPPSATSCPPPGSAAHAGHAPLCRSCGAPTTTPVPPPWSASSDSPPPAYRPIRMPAINAPTNTAAIVLSPVPQPLPVPPASPPFAFQVPAKRITSPDDIARFHDSVHGRHFLGFVAALSASVHGRKLSDPLPSPPSPVVSALLELISALSAFVASTPPLPHNSRYGNPAFRLWHEKLSDSANQLIAPIMATAGSPDLAGAEAELAPYLLDSFGNATRIDYGTGHETNFAAFLYCLARLGLITEADYPAVVLRVFAAYLDLMRTLQDTYLLEPAGSHGVWGLDDYHFLPFIFGAAQLIDHKYMKPKSIHNPDILDNFSKEYMYLACVAYVKKVKKGPFAEHSPMLDDISGVPHWKKVNSGLLKMYKAEVLEKVPIMQHFLFGSLIKWYGS

SEQ ID NO: 56351 - protein, 149 aa, Kineococcus radiotolerans SRS30216
MTADTPQTSQGPSTKTYNVTKTDAEWRAELDPMAYHVLRQAGTERPFTGEYEDTTTEGVYACRACGAELFTSAEKFASHCGWPSFFDPKDSAAVELLVDDSLGMRRTEVRCANCGSHLGHVFEGEGYPTPTDQRYCINSVSLSLRPTSA

SEQ ID NO: 56352 - protein, 228 aa, Staphylococcus aureus subsp. aureus COL
MKDVKALKLMTLNDVLSQINGDMTLGIGTGSTMELLLPQMAQLIKERGYNITGVCTSNKIAFLAKELGIKICEINDVDHIDLAIDGADEVDPSLNIIKGGGGALFREKVIDEMASRFVVVVDETKIVQYLGETFKLPVEVDKFNWYQILRKIESYADIKVERRVNEDVAFITDNGNYILDCKLPKGIDPYKFHEYLIHLTGVFETGYFLDMADQVIVGTQEGVKILEK

SEQ ID NO: 56353 - protein, 391 aa, Rubrobacter xylanophilus DSM 9941
MGEPVPEVVVSGRGASRVRAGHPWVYRSDLLRAAGEAGDVVRVEDRRGRFLGYAFYNPRSEIALRVAERREGVGIDGAWFGSRLRAALEYRAGLGIDGDAYRLLHAEADGVPGLVADVYGEHVVLQVGSAAVERRLELVVRALAELLSPAGVLLRGDAGSRRREGLRRTVAVLHGKVPEAVVVREGPVRYRVPLWRGQKTGAFLDQRENRLAAGRHARGRVLDVFSYGGGFALHAARRAASVEAVDSSAAALEQARENARLNGLGNLSFVEANAFDLLRARSDAGEAYDTVILDPPAFARTRRDLPRAARAYKEINLRAMKLLAPGGVLVTCSCSYHLSREAMEGVLRSAAADAGRSLRVLEWRGQAADHPEVLNIPETRYLKCAVLERLC

SEQ ID NO: 56354 - protein, 405 aa, Arabidopsis thaliana
MAAALQTNIRTVKVPATFRAVSKQSLAPFRVRCAVASPGKKRYTITLLPGDGIGPEVVSIAKNVLQQAGSLEGVEFNFREMPIGGAALDLVGVPLPEETISAAKESDAVLLGAIGGYKWDNNEKHLRPEKGLLQIRAALKVFANLRPATVLPQLVDASTLKREVAEGVDLMVVRELTGGIYFGEPRGIKTNENGEEVGFNTEVYAAHEIDRIARVAFETARKRRGKLCSVDKANVLEASILWRKRVTALASEYPDVELSHMYVDNAAMQLVRDPKQFDTIVTNNIFGDILSDEASMITGSIGMLPSASLSDSGPGLFEPIHGSAPDIAGQDKANPLATILSAAMLLKYGLGEEKAAKRIEDAVLVALNNGFRTGDIYSAGTKLVGCKEMGEEVLKSVDSQVPASV

SEQ ID NO: 56355 - protein, 499 aa, Arabidopsis thaliana
MYRTAASRAKALKGILNHNFRASRYASSSAVATSSSSSSWLSGGYSSSLPSMNIPLAGVSLPPPLSDHVEPSKLKTTTLPNGLTIATEMSPNPAASIGLYVDCGSIYETPQFRGATHLLERMAFKSTLNRSHFRLVREIEAIGGNTSASASREQMGYTIDALKTYVPEMVEVLIDSVRNPAFLDWEVNEELRKVKVEIGEFATNPMGFLLEAVHSAGYSGALANPLYAPESAITGLTGEVLENFVFENYTASRMVLAASGVDHEELLKVVEPLLSDLPNVPRPAEPKSQYVGGDFRQHTGGEATHFALAFEVPGWNNEKEAIIATVLQMLMGGGGSFSAGGPGKGMHSWLYLRLLNQHQQFQSCTAFTSVFNNTGLFGIYGCTSPEFASQGIELVASEMNAVADGKVNQKHLDRAKAATKSAILMNLESRMIAAEDIGRQILTYGERKPVDQFLKTVDQLTLKDIADFTSKVITKPLTMATFGDVLNVPSYDSVSKRFR

SEQ ID NO: 56356 - protein, 375 aa, Methanococcoides burtonii DSM 6242
MAQYKIPVLPGDGIGPEIITEGKKVIDAAGEKFGFDVDWIEYPQGADHYLETGELISEDTLKELSAYDAIYLGSIGDDRIAPGVLEKGILLAARFYFDQYINLRPIKLLEGVWCPLKDKTPADIDFTVVRENTEDFYIGIGGRAKTGASKDLLEVSRTLYSAKFGLDIETDSEEIAYQIGMISKEGTQRVIDYSFDLAEKSDKHVSSVDKANVLSDIYGFWREEFNTIAAKHPDVKTDLNYVDAITMWFVKNPEWFDIVVTPNMFGDIITDLGAMVQGGLGLAPGGNINPNGTSMFEPIHGSAPKYKGLNKVNPIATIWAGSMLIEQLGEKEAADAIVSAIEKNILEAKVQTYDMGGSSTTSDVGSDIARILLEM

SEQ ID NO: 56357 - protein, 184 aa, Salmonella enterica subsp. enterica serovar Typhi str. CT18
MSDTLRPYKDLFPEIGQRVMIDTSSVVIGDVRLADDVGIWPLVVIRGDVNYVAIGARTNIQDGSVLHVTHKSPSNPHGNPLIIGEDVTVGHKVMLHGCTIGNRVLVGMGSIVLDGAIIEDDVMIGAGSLVPQHKRLESGYLYLGSPVKQIRPLSDAERSGLQYSANNYVKWKDDYLSQDNHIQP

SEQ ID NO: 56358 - protein, 823 aa, Glycine max
MSAEPDHSASKGKVKLDNDPSGAEKRDENEVATAILKKKKKPNSLIVTDATTDDNSILALSNNTMETLQLFRGDTVLVKGKKRKDTVLIVLADDDLDDGSVRMNRVVRHNLRVKLGDVVTVNPCPDIKYAKRIAVLPMADTIEGLTGSLFDVFLAPYFREAYRPLRQGDLFTARAAMRTVEFKVVEIDPPEYGIVAQDTVIHCEGEPIQREDEEGNLNEVGYDDIGGCRKQMAQVRELVELPLRHPQLFKSIGIKPPRGILMYGPPGTGKTLMARAVANETGAFFFLINGPEIMSKMAGESESNLRKAFEEAEKNSPAIIFIDEIDSIAPKREKTNGEVERRVVSQLLTLMDGMKARSNVVVMAATNRPNSIDPALRRFGRFDREVDIGIPDPTGRLEILQIHTKNMKLADEVDLETIAAETHGYVGSDIASLCSEAAMQQIREKMDLIDLDEDTIDAEVLDSLGVTQENFRFALGVSNPSALREVAVVEVPNVRWEDIGGLEDVKRELVESVQYPVDHPEKFLKFGLSPSRGVLFYGPPGTGKTLLAKAVANECAANFISVKGPELLSMWFGESESNIRDIFDKARAAAPCVVFLDELDSIAKSRGGSQGDAGGASDRVVNQLLTEMDGMTSKKNVFVIGATNRPEQLDNALCRPGRLDTLVYVPLPDQPGRESILKAQLRKTPVAKDVDLSYIASKTHGFSGADLGFITQRAVKLAIKESISLAIEKQKEREAAEGDDTKMDEDVDEEDPVPELTKRHFEEAMSMARRSVTDTEIRRYEAFAQSMKNSAGGSAFFRFPEGGAEGAAAEAQQNGAGEEDLYD

SEQ ID NO: 56359 - protein, 494 aa, Mentha x gracilis
MELNLLLVIIILVATYTVSLLNKQWRKPKSQQKQPPKLPVIGHLHLLWGGLPPQHLLRSIAREYGPVAHVQLGEVYSVVLSSAEAAKQAMKVLDPNFADRFDSVGSRIMWYDNDDIIFSPYNDHWHQMRKICVSELLSPKNVRSFGFIRQEEIERLIRVMKQSEGAPVDVTEEVSKMSCFVVCRAAFGSVLKDQGSLAELVKESLAMASGFELKDLYPSSWLLNLLSFNNYRLKRMRRRLDHVLDGFLEEHRVKKNGEFGGEDIVDVLFRMQKDSNIKIPITSNGIKGFIFNTFSAGAEASSTTISWALSELMRNPAKMAKVQAEVREALKGKTSVDLSEMQELKYMRSVVKETLRLHPPFPLIPRQSREECEINGFYIPARTRILINAWSIGRDPLYWEDPDTFRPERFDEVSRDFMGNDFEFIPFGAGQRICPGLHFGLANVEIPLAQLLYHFDWKLPQGMTDADLYVAGTPGLSGPRKKNVFLVPTIHKSR

SEQ ID NO: 56360 - protein, 660 aa, Streptococcus pneumoniae
MFASKNERKVHYSIRKFSIGVASVAVASLFMGSVVHATEKKVTTQVATSSNKANKSQTEYMKAAKQVDEYITKKLQLDRREHIQNVGLLTKLGVIKTEYLHRLSVSKEKSEAELPSEIKAKLDAAFELFKKDTLPTEPGKKVAEAEKKVEEAKKKAEDQKEKDLRNYPTNTYKTLELDIAESDVEVKKAELELVKEEAKESRDEKKINQAKAKVENKKAEATRLKNIKTDREKAEEAKRRADAKLQEANVATSEQDKSKRRANREVLGELATPDKKENDAKSSDSSVGEETLPSPSLKPEKKVAEAEKKVEEAKKKAEDQKEEDRRNYPTNTYKTLELEIAESDVEVKKAELELVKEEAKEPRNEEKVKQAKAEVESKKAEATRLEKIKTDRKKAEEEAKRKAAEEDKVKEKPAEQPQPAPAPKAAPAPKPENPAEQPKAEKPADQQAEEDYARRSEEEYNRLTQQQPPKTEKPAQPSTPKTGWKQENGMWYFYNTDGSMATGWLQNNGSWYYLNSNGAMATGWLQNNGSWYYLNANGSMATGWLQNNGSWYYLNANGSMATGWLQYNGSWYYLNANGSMATGWLQYNGSWYYLNANGDMATGWVKDGDTWYYLEASGAMKASQWFKVSDKWYYVNGSGALAVNTTVDGYGVNANGEWVN

SEQ ID NO: 56361 - protein, 629 aa, Ustilago maydis 521
MPPVSASKAKRQAEKAAKAAAKGEKSSKSSSKSGTTNGTSETPMTNLSTNTSVEELNMKKLAIATERNASGVITSDKQSRDIHIDNFTMSFHGRLLIDTATINLNYGQRYGLLGDNGSGKTTFLAALAARDVEIPEHIDIHIVSGEAEPSDVNAVDYIVQSAKDKVAKLEKEIEDLSVADEIDEVTLEMKYEELEELDPSTFETKAGMILHGLGFSPEMMKKPTKDMSGGWRMRVTLAKALFIKPHLLLLDEPTNHLDLEAVVWLEAYLSTYNHILVLTSHSADFMDSVCTNILDLTPQKKFLTYGGNYSTYVRTKEENETNQMKAYAKQQEEIAHIKKFIASAGTYANLVKQAKSKQKIIDKMEAAGLIEPVWMPKPLRFNFEDVRKMPPPIIAFSDVAFSYSGKKEDYLYQDLSFGIDMDSRVAIVGQNGTGKSTLLNLITGALNPVEGTVQRHAGLKLGKYSQHSADQLPYDKSPLEYMESKYKDKFPDKELQFWRGQLGRFGLSGAHQTSPIRTLSDGLRNRVVFSQLAMEQPHILLLDEPTNHLDMGSIDALAQAIKEFEGGVVIVSHDFRLISQVAEDLWEVKDRKIVNLSKMDVSIQDYKKKLAKNSAEAIERAKLFAKGKA

SEQ ID NO: 56362 - protein, 433 aa, Daucus carota
MASKAVITQRHKEAEGKQKNVQAERRNRRVLGDIGNVVKAVDAGKPKNPIKTNRPMTRSLCAQLVAKGLPVVGGKDPKDIQLIDDGVVGRKDASVLEAAAVKKKDTDQKTTVTLSCEEEIKPKSSGRKSRPDYSEKTEKAFTSILSARSKAACGLINKPQNEIIANIDASDVDDELAAVEYVDDIYKYYKLTEGDGQVHDYMPSQTDINSKMRSILIDWLVEVHRKFELMPESLYLTINIVDRYLSMKIVPRRELQLVGVGSMLIACKYEEIWAPEVNDFIAISDNAYNREQVLLMEKSILAKLEWYLTVPTPYVFLVRYIKSSVPSDPEMENMTFFLAELGLTHYTTVMTYCPSVIAASAVYAARCTLKKSPFWTETLKHYTGYSEDQLRDCAKLLVSYHAALSESKLKAVYKKFARPEKGVVALVPPLKLI

SEQ ID NO: 56363 - protein, 456 aa, Daucus carota
MASTRPVVQQNHREEAAPVAGGGGKQKKMAAEGRNRRALGDIGNLVTARGGIDAVKPLPQVSRPITRSFCAQLLANAQAAAAENNKKQMAIPGDGVLAGKGGKQAALPLPPKAAQKKKVVVESKPEDVIEISSSETEQVKKERPNRKKAIEASSSKNGQTLTSTLTARSKAACGINKKPKEQIVDIDAADATNELAAVEYVEDMYKFYKEAETESQVSDYMDSQPEINQKMRAILVDWLIEVQNKFELSPETLYLTVNIVDRYLATKMVARRELQLLGISAMLLASKYEEIWAPEVNDFVCISDRAYTNQQVLTMEKKVLGRLEWSLTVPTPYVFLVRFIKASLPNEPDVNNMTYFLAELGMMNYATVMYLPSMVAASAVYAARCTLNKTPVWNDTLKLHTGFSEAQLMDCAKLLVGLHSAAAENKLRVIYRKYSNPERGAVAFLPPAKSPGAANN

SEQ ID NO: 56364 - protein, 250 aa, Bacteroides fragilis NCTC 9343
METMNEKVAMVTGASAGIGLASAEAFAKAGATVVLVDINEPKEQAGKLVSEGYKAVAYRCDVSDTRAVKEMIDWTVATYGRLDAALNNAGIQTPQRPMAEITDEEFDRTVAVDLKGVWNCMRYEIIQMLQQGGGAIVNTSSQGGVTGFPGQAAYIACKHAVIGLTRTAAIDYSAKGIRINAVCPGVIRTPMAEELIRRNPDLEKELVRDIPAGRLGKPEEIANAVLWLCSSQASFVDGYALLVDGAFSIH

SEQ ID NO: 56365 - protein, 444 aa, Daucus carota
MASRPVLQQNIEADGGEEAVKQKNMAAGEGRNRRALGDIGNLVTVHGIEGKQQQIPRVIRPVTSFCAQLLANAQAAAENKKQRAVIGDGVVAHKAVHQKKVTVMPKAEDIIVISPDTEEVKKVDRHLNKKKAIEGSSKKKSQTFTSTLTARSKAAAFGITRTPKEQIVDIDAADANNELAAVEYVEDMYKCYKLVEHESRVFDYIDFQPEINEKMRAILVDWLIEVHNKFELMPETLYLTINIVDRYLATKSVARKELQLVGISSMLLASKYDEIWAPEVNDFTKISDNAYTNQQVLVMEKKILSRLEWNLTVPTPYVFLVRFIKASIPSEPAVENMAYFLAELGLMNYATVMYCPSMLAASAVYGARCTLDTAPFWNETLKLHTGFSEQQLMDCARALVRFHSCAAENKLRVIYRKYSLAERGAVALLPPAKALLNVAASPHS

SEQ ID NO: 56366 - protein, 471 aa, Pseudomonas aeruginosa PAO1
MSSVGEQKVQDGSLKRELGERHIRLMALGACIGVGLFLGSAKAIQMAGPAIMISYILGGLAILVIMRALGEMAVHNPVAGSFSQYAKDYLGPLAGFITGWNYWFLWLVTCVAEITAVAVYMGIWFPDVPRWIWALAALASMGTINLIAVRAFGEFEFWFALIKIVTILAMVVVGIGMIAFGFGNDGIATGISNLWAHGGFMPNGIQGVLMSLQMVMFAYLGVEMIGLTAGEARNPTKTIPSAINSVFWRILLFYVGSLFVIMSLYPWNEIGTQGSPFVMTFERMGIKTAAGIINFVVITAALSSCNGGIFSTGRMLYSLAQHRQAPAFFGKASRSGVPRRALILSILALLLGVLLNYLVPEKVFVWVTSIATFGAIWTWAMILLAQLRFRKTLSPAECDKLQYRMWLYPVSSYLALAFLVMVVVLMAFFEDTRIALYIGPPFILLLTVLYYAFNLAPKEPAGTGSVSRAAS

SEQ ID NO: 56367 - protein, 111 aa, Bifidobacterium animalis
EVTKVEGNNVYTKVVVAGPVSSHKGINLPGVAVSLPALTAKDEEDLRWAIRTGADIIAMSFVRFATDIDRAHEIMDEEGRRIPVVAKIEKPQAVENLEDIVKVFDGIMVAR

SEQ ID NO: 56368 - protein, 499 aa, Hyphomonas neptunium ATCC 15444
MLRDISHFVNGAQLPGQRANCLAVMNPATGRQVAQVPVATSSEVDLAVEAASKAFPAWSETTPIRRARIMFRFRDLVEKHQADLARLITEEHGKVHEDAMGEVMRGLEVVEYVTGIPHILTGLASDSVGTGVDCYGLRFPLGVCAGITPFNFPAMVPMWMFPVAIACGNTFVLKPSEKTPSATMLLADLLRDAGLPAGVFNVVHGDKPTVDALLDHPDVEAISFVGSTPVAEAIYARGTAGGKRVQALGGAKNHMVIMPDADIDDVADALMGAAYGSAGERCMAISVAVAVGDEVAERLVPALRARIANLKIGPGNAPQSEMGPLISQPHLDKVTSYVGIGEEEGAQVIVDGRGRGFAETRDGYFIGPTLLDKVDASMRVHREEIFGPVLSLMRCQTLDAAITLLNSHEYGNGAAIFTANGEAARRFTRDVHAGMVGVNVPIPVPVAYHSFGGWKRSLFGDHHMHGQEGVRFFTRLKTISTRWPKLNSASSQFAMPTLD

SEQ ID NO: 56369 - protein, 455 aa, Daucus carota
MASRPAVLQQNREAAGGAVKPKNMAGGEVRNRRALGDIGNLVTVRGIDGKKQPIPQASRPVTRSFCAQLLANAQAVEKNKKQRAIVGDGALEVKHVTKAAVPKAVVHQKKVNVKPKTEDVTVISPDTEVEDKKVDKNLDKKKATEGSSKEKKGQAFTSTLTARSKAACGLTKKPKVQIVDIDAADANNELAAVEYVEDMYKFYKLVENETMVFDYTHSQPEFNEKMRAILVDWLIEVHNKFDLMPETLYLTINIIDRYLARKTVPRKELQLLGISSMLTASKYEEIWAPEVNDFTKISDNAYTSQQVLVMEKKILGGLEWNLTVPTPYVFLVRFIKASLPNEPAVENMTYFLAELGILNYATILYCPSMIAASAVYGARCTLNKTPFWNDTLTLHTGFSEPQLMECAKALVRFHSCAAENKLKAIHKKYSNAERGAVALLPPAKALLTVAAAAPH

SEQ ID NO: 56370 - protein, 681 aa, Magnetococcus sp. MC-1
MGDFNAVALVLSIIAGGAAIVWAYQKRAWILTLPAGNEKMQAISGAIEEGAHAYLKRQYETITYVGMVLFVLVAFTLDWLTAVGFAIGAILSGMAGYFGMSISVKANVRTAEQARKGLDQALQVAFNGGAITGMLVVGLGLLGVTLFVAYLLLSADATHTMSQALKPLMGLAFGGSLISIFARLGGGIFTKGADVGADLVGKVEAGIPEDDPRNPAVIADNVGDNVGDCAGMAADLFETYAVTVVATILLGVLLMPTFGNVVIYPLTLGAASIVGSIVGVRFVHSTPGMSNVMPALYKGLGVAAAVSALLFLPVTVWLMAGNPLGISSGSLYLSALIGIVLTGAMVGITEYYTGTEFSPVQRIAKASETGHATNIISGLGISMKATAAPVIAVCVAIYASHALAGLYGIAIAATAMLSMTGIIVALDAYGPITDNAGGIAEMAQMPEEVRAITDPLDAVGNTTKAVTKGYAIGSAGLAALVLFADYTHELSHFTKDVTFDLSNHMVIIGLFLGGLLPYLFAAMGMEAVGRAAGSVVVEVRRQFHEIPGIMEGSHKPDYSRAVDLLTQAAIKEMVIPSLLPVLAPILVGVLLGPQALGGLLMGTIITGIFVAISMTTGGGAWDNAKKYIEDGHCGGKNSEAHKASVTGDTVGDPYKDTAGPAVNPMIKIANIVALMIVGMIV

SEQ ID NO: 56371 - protein, 360 aa, Campylobacter coli RM2228
MPADLNDYFNKKNGNSNNNNNRQNFNFKAPEFNFKGFGKFSPFVYGVIIIVLFLIIAKPFMVINSGEMGIKSTTGRYDPNPLEPGLHFFIPFIQKITTIDTRVRQINYASIEGSNENLTSGSGVINKNSISVLDSRGLPVSIDVTVQYRLNPLQVPQTIATWSLNWENKIIDPVVRDVVRSVVGKYTAEELPTNRNAIATQIEEGIRKTIEAQPNEPVELRAVQLREIILPLKVKEQIERVQIAKQEAERTKYEVERANQEALKKAALAEGEANATIISAKGKAMAVKIEADAQAYSNKEIANSLNTPLLNLKQIETQKEFNEALKVNQDAKIFLTPGGAVPNIWVDTKDAKKQSSTNMN

SEQ ID NO: 56372 - protein, 421 aa, Magnetococcus sp. MC-1
MTETAPFMGVGWLCRLSSCMNGPSMEEFHRIKRLPPYVFAVVNELKYKARNRGEDIIDFGMGNPDQPTPKHITDKLIEAVQDGRNHRYSLSRGIGGLRRAVCAYYKRRFGVDLDPESEAIVTIGSKEGLSSLAMAITEPGMNVIVPSPTYPIHEYSFLIAGAHIQRVKISRDNDFIEDMKVAVRNHWPRAQVLVVNFPSNPTAQVVELDFYQKVIDFAKEHNIWVISDVAYAEICFDGYKAPSILQIPGAKDIAVEFYSLSKTYNMPGWRVGFCVGNPHLIKALSRIKSYLDYGMFQPIQIAATVALNGPQDCVAEINEIYRQRRNVLIDGLARAGWAIERPKASMFVWAEIPDEFKAMGSLEFSKLLLKEAKVAVSPGVGFGVYGDDHVRIALIENEHRTRQALRSMRRFLSAGSDVAGD

SEQ ID NO: 56373 - protein, 111 aa, Bifidobacterium longum
EVTKVEGNNVYTKVVVAGPVSSHKGINLPGVAVSLPALTEKDEADLRWAIRTGADIIAMSFVRFATDIDRAHEIMDEEGRRIPIIAKIEKPQALENLEEIVKTFDGIMVAR

SEQ ID NO: 56374 - protein, 478 aa, Zea mays
MASMAYIAACTAALAIFVALLLWAYRWSHPKSRGMLPPGSMGIPLLGETMQFFAPNPTYDVSPFVKERVKRYGSIFKTSIVGRQVVVSADPDMNYFVFQQEGKLFESWYPDTFTEIFGRDNVGSLHGFMYKYLKTLVLRLYGQENLKAVLLAETDAACRGSLASWAAQPSVELKEGLSTMIFDLTAKKLIGYEPSKSSESLRKNFVAFIRGLISFPVNIPGTAYHECMEGRKNAMKVLKRMMKERMADPERRCEDFFDHVIQELRREKPLLTETIALDLMFVLLFASFETTALALTLGVKLLTDNPKVVDALREEHDAIAKNRKDPDAPVTWAEYRSMTFTNQVIMEMVRLANIVPGIFRKALQDVEIKGYTIPAGWGVMVCPPAVHLNPDIYEDPLAFNPWRWQGKPEITGGTKHFMAFGGGLRFCVGTDLSRVLMATFIHSLVTKYSWRTVKGGNIVRTPGLGFPDGFHIQLFPRN

SEQ ID NO: 56375 - protein, 111 aa, Bifidobacterium pseudolongum
EVTKVEGNNVHTKVVVAGPVSSHKGINLPGVAVSLPALTEKDENDLRWAIQTGADIIAMSFVRFATDIDRAHEIMDEEGRRIPIVAKIEKPQAVENLEDIVKVFDGIMVAR

SEQ ID NO: 56376 - protein, 111 aa, Bifidobacterium thermophilum
EVTKVEGNNVYTKVVVAGPVSSHKGINLPGVAVSLPALTEKDEADLRWAIRTGADIIAMSFVRFATDIDRAHEIMDEEGRRIPIVAKIEKPQAVANLEDIVKTFDGIMVAR

SEQ ID NO: 56377 - protein, 156 aa, Haemophilus influenzae
NRTNTPVLVDGKDVMPEVNTVLAKMKDFCQRIISGEWKGYTGKAITDVVNIGIGGSDLGPYMVTEALRPYKNHLNMHFVSNVDGTHIAETLKKVNPETTLFLVASKTFTTQETMTNAQSARDWLLKAAKDESAVAKHFAALSTNAKDVEKFGIDTN

SEQ ID NO: 56378 - protein, 350 aa, Pisum sativum
MVASSQKILVTGSAGFIGTHTVVQLLNNGFNVSIIDNFDNSVMEAVERVREVVGSNLSQNLEFTLGDLRNKDDLEKLFSKSKFDAVIHFAGLKAVGESVENPRRYFDNNLVGTINLYEVMAKHNCKKMVFSSSATVYGQPEKIPCVEDFKLQAMNPYGRTKLFLEEIARDIQKAEPEWRIVLLRYFNPVGAHESGKLGEDPRGIPNNLMPYIQQVAVGRLPELNVYGHDYPTRDGSAIRDYIHVMDLADGHIAALRKLFTSENIGCTAYNLGTGRGSSVLEMVAAFEKASGKKIALKLCPRRPGDATEVYASTAKAEKELGWKAKYGVEEMCRDQWNWAKNNPWGYSGKP

SEQ ID NO: 56379 - protein, 269 aa, Salmonella enterica subsp. arizonae serovar 62:z4,z23:--
MEKKIGFIGCGNMGKAILGGLIASGQVLPGQIWVYTPSPDKVAALHDQYGINAAQNAQEVAQIADIVFGAVKPGIMVKVLSEISSSLNKDSLVVSIAAGVTLDQLARALGHDRKIIRAMPNTPSLVNAGMTSVTPNALVTPEDTADVLNIFRCFGEAEVIAEPMIHPVVGVSGSSPAYVFMFIEAMADAAVLGGMPRAQAYKFAAQAVMGTAKMVLETGKHPGELKDMVCSPGGTTIEAVRVLEERGFRAAVIEAMTKCMEKSEALSKS

SEQ ID NO: 56380 - protein, 289 aa, Kineococcus radiotolerans SRS30216
MTRRTSVSAMTVPTILLNDGREIPQLGFGVFQIEPGDTAQAVKTALDLGYRHIDTAQMYGNEAEVAQGIADSGVPRDEIWVTSKLNNGFHEPDAARKAVDDSVEKLRGPIDLYLIHWPLPTLYGGDFVSTWKVLEEARAAGKLRSIGVSNFQVNHLQRLAQEATVVPAVNQIEVHPYFGNEEVRRHCGEHQIGVEAWSPIAQGKVLDDPTVTAVANRLGKSPAQVVLRWHVERGDIVFPKSVTPSRMEENFALFDFELTEEDLALISALDKGEAGRTGPNPDTFDYVPS

SEQ ID NO: 56381 - protein, 497 aa, Mentha x gracilis
MELQISSAIIILVATFVASLLIKQWRKSESQQNLPPGPPKLPLVGHLHLLWGKLPQHAMADMAKKYGPVTHVQLGEVFSVVLSSREATKEAMKLLDPACADRFESIGTRIMWYDNDDIIFSPYSDHWRQMRKICVSELLSARNVRSFGFIRQDEMSRLLRHLQSSAGETVDMTERIATLTCSIICRAAFGAIINDHEELVELVKDSLSMASGFELADLFPSSKLLNLLCWNKSKLWRMRRRVDTILEAIVEEHKLKKSGEFGGEDIIDVLFRMQKDSQIKVPITTNAIKAFIFDTFSAGTETSSTTTLWVMAELMRNPAVMAKAQAEVRAALKGKTSVDVDDVQELKYMKSVVKETMRMHPPIPLIPRSCREECEVNGYKIPNKARIMINVWSMGRNPLYWEKPETFWPERFDQVSRDFMGSDFEFIPFGAGRRICPGLNFGLANVEVPLAQLLYHFDWKLAEGMKPSDMDMSEAEGLTGIRKNNLLLVPTPYNPSS

SEQ ID NO: 56382 - protein, 478 aa, Legionella pneumophila str. Lens
MTTPLYPIILAGGSGTRLWPLSRQNFPKQFLKLNGELSLIQQTMKRAMGLPGNQTIIVSNDAHYFICQDQLQDFNAQTTYLLEPCARNTAPAIACAAHYLANTVGKDAVMLVLPSDHWIADDEIWLAAMLEGGQFASENNAIVTFGIKPDSPKTGYGYIEAGTTLSSDIKQVLSFREKPDAHTAAQFVSKGNYFWNSGMFICRAGVYLEELEQFETDIYQFSQQALTLAQHHHDFLRLDLDCFSQCKEESIDYAIMEKTDKAVVIPISIQWSDLGCWTAVADANKQDEQGNTLIGNVIAQDSHNCLINSEELLVTTVGIQDQIIVATSDAVLVADKRYSQQVKDLVHSLRKDHPHLTQDHQRVPRPWGYYEVLAEGTSFKVKRLMVKPGAKLSLQTHQHRAEHWVIVGGEAEVVNGNNTFRLSKNQSTYIPKNALHRLSNPHNEPLYVIEVQSGSYLGEDDIKRFDDIYLRKEVELAE

SEQ ID NO: 56383 - protein, 398 aa, Triticum aestivum
SVWMSHGDEVVRLPEGFEVVARSVQGAIAAIEHREKRFYGLQYHPEVTHSPQGMETLRHFLFDVCGIKADWKMQDVLDEEIKTIKSMVGPDEHVICALSGGVDSTVAATLVHNAIGDRLHCVFVDNGLLRYKEKERVMSTFNSDLHLPVTCIDASEKFLTELKGVKDPEMKRKIIGREFIVVFDEFAHMLEQKIGKRPEYLVQGTLYPDVIESCPPPGSGRTHSHTIKSHHNVGGLPKDMKLKLIEPLKLLFKDEVRKLGSILNVPESFLKRHPFPGPGLAVRVIGDVTAGNALEVLRQVDEIFIQSIKDAGIYDEIWQAFAVFLPVQTVGVQGDQRTHSHVVALRAITSEDGMTANWYDFERPFLVDVVKKICNNVRGVNRVVLDVTSKPPATVEWE

SEQ ID NO: 56384 - protein, 332 aa, Actinidia eriantha
MASGDTKEVATDLLPLLRHYKDGTVERFIASPYIPPSPLDPATGVSSKDVTISPLVSARLYLPASATQKLPVLVYFHGGGFCIESAFSLFNHRYVNALASESNAVAVSVEYRLAPENPLPAAYDDSWAALQWVAYHSVDRGTDDKSQQRDSWLAEHADFDRLFIGGDSAGANIVHHLAIRAGSEPLPGDLKILGAFLAQPYFWGSDPVGSESPDLHTEENLIQRIWTCVYPSAPGGIDNPAINPFSPDAPSVAALGCARLLVCVSGEDELRERGIRYLEEVKRSGWRGEKIELFEVEGEGHAFHFFGFGSENAKRMITRLASFVSQTRLASL

SEQ ID NO: 56385 - protein, 335 aa, Brassica napus
MEKYDRVVKKKDETPIDANEIRITSMGRARNYITYAMTLLQEKGSTEVVFKAMGRAINKTVNIVELIKRRIPDLHQNTSIGSTDITDTWEPKEEGLLPIETTRHVSMITITLSTKELNTSSIGYQCPIPVELVKPLGDIDYEGGEGSPGGRGRGRGRGRGRGRGGRGNAYVNVEYEDGGYERNQSYGGRGRGRGGRGRSSRGGRGRGGYNGPQNEYDAPQDGGYGYDAPPHEHRGYDDRGGYGRRGGYNGGPQGRGGYDGPRRRGGYYDGPQRRGGYDGHQGRGGGYEGPPQGRDDYDDAPRRGRGRGGRGRGGGRGGGGGFNNRADGPPVQAVA

SEQ ID NO: 56386 - protein, 506 aa, Brassica napus
MTSVNVKLLYHYVITNLFNLCFFPLTAIVAGKAYRLTIDDLHHLYYSYLQHNLITIAPLFAFTVFGSVLYIATRPKPVYLVEYSCYLPPTHCRSSISKVMDIFYQVRKADPSRNGTCDDSSWLDFLRKIQERSGLGDETHGPEGLLQVPPRKTFAAAREETEQVIIGALENLFKNTNVNPKDIGILVVNSSMFNPTPSLSAMVVNTFKLRSNVRSFNLGGMGCSAGVIAIDLAKDLLHVHKNTYALVVSTENITYNIYAGDNRSMMVSNCLFRVGGAAILLSNKPGDRRRSKYELVHTVRTHTGADDKSFRCVQQGDDENGKIGVSLSKDITDVAGRTVKKNIATLGPLILPLSEKLLFFVTFMGKKLFKDKIKHYYVPDFKLAIDHFCIHAGGRAVIDVLEKNLALAPIDVEASRSTLHRFGNTSSSSIWYELAYIEAKGRMKKGNKVWQIALGSGFKCNSAVWVALNNVKASTNSPWEHCIDRYPVKIDSDSGKSETRVQNGRS

SEQ ID NO: 56387 - protein, 506 aa, Wolbachia endosymbiont of Drosophila melanogaster
MNIKSVVLCILDGWGNGIENNKYNAISNANPPCWQYISSNYPKCSLSACGADVGLPGGQIGNSEVGHMNIGSGRVVIQSLQRINQEIGTIENNVNLQSFINDLKSKNGVCHIMGLVSDGGVHSHQKHISTLANKISQHGIKVVIHAFLDGRDTLPNSGKKCIQEFTKSIKGNDTRIATVSGRYYAMDRDNRWKRTIEAYEAIAFAKAPCHDNAVSLIENNYQNNITDEFIRPAVIGDYQGIKPEDGVLLANFRADRMIQLASILLGKTDYAKVAKFSSILSMMKYKEDLKIPYIFPPTSFADTLGQTIEDNKLRQLRIAETEKYAHVTFFFNCGKEEPFSGEERILIPSPKVQTYDLQPEMSAFELTEKLVEKIHSQEFALIVVNYANPDMVGHTGNIKAAEKAVLAVDDCLAKVLNAVKKSSNTALIVTADHGNVECMFDEENNTPHTAHTLNKVPFIVSCDNLKLRDGRLSDIAPTILQLLGIKKPNEMTGSSLISCITLCHSS

SEQ ID NO: 56388 - protein, 298 aa, Mycobacterium smegmatis str. MC2 155
MSIPHTAVVPAAGLGTRFLPATKTVPKELLPVVDTPGIELVAAEAAEAGAERLVIVTSEGKDGVVAHFVQDLVLEGTLEARGKKTMLEKVRRAPALIKVESVVQAEPLGLGHAVSCVESVLAADEDAISVLLPDDLVLPTGVLETMSKVRAKRGGSVLCAIEVPGDKISAYGVFDVETVPDAANPNVLRVKGMVEKPRPEDAPSHFAAAGRYVLDRAIFDALRRVPRGTGGEIQLTDAIALLIEEDHPVHVVVHRGARHDLGNPGGYLKAAVDFALERDDYGPELRQWLVERLGLAEK

SEQ ID NO: 56389 - protein, 745 aa, Mycobacterium smegmatis str. MC2 155
MSQGFDDEFGGADQYDTPLSHLRLTARLNTSALDSRRGVVRLHPEVLAALGIREWDAVALTGTRTTAAVAGVAGPGVPAGTALLDDVTLSNAGVRENAAVLVSPVTVYGARSVTVSGSRLATQSISPATLRMALLGKVMTVGDTVSLLPRDLGPGTSTSAATSALASSVGITWTSELLTVTAVDPPGTVSVQPNSVVSWGTGTPEDPAPPPTGRHTVSPQRSEQPVSFDDVKVTHPQAVKLDEWLRLSLDEPELLKTLGATPHLGVLVSGPAGVGKATMVRAVCASRRVVELDGPEVGALQVDERLRSVTSAVAAVTESGGVLFIADVDALLPAGNEMRPPEPVATLILAELRKAVATPGVAFIATSAVPENVDARLRAPEVCDRELGLSLPDATARRSLLEMLLRGVPSEDLDLGDIADHTPGFVVADLAAVVREGALRAAARASSSDDDPVLRHADLEGALTVIRPLSRSASEEVSVGSVTLDDVGDMVETKRALTEAVLWPLQHPDTFSRLGIDPPRGVLLYGPPGCGKTFVVRALASSGRLSVHAVKGSELMDKWVGSSEKAVRELFARARDSAPSLVFLDEIDALAPRRGQNFDSGVTDKVVASLLTELDGIEPLRDVVVLGATNRPDLIDPALLRPGRLERLVFVEPPDAAARRDILRTAGKSIPLADDVDLDSLADDLDGYSAADCVALLRESAMTAMRRSIDAADVTAADVAKARETVRPSLDPAQVESLREFAEKR

SEQ ID NO: 56390 - protein, 327 aa, Prochlorococcus marinus subsp. marinus str. CCMP1375
MTAATAQNIKSSLNTDRLKLISGTSNPILAKEISSYIGIEDVPVVSKRFADGELYVQIQQSIRGCDVFLIQPTCAPVNDSLMELMIMVDACKRASARQVTAVIPYFGYARADRKTAGRESITAKLTANLLVSSGVDRVLAMDLHSAQIQGYFDIPCDHIYGSPVLIDYLSTKNLDEIVVVSPDVGGVARARAFAKQMKDSPLAIIDKRRAAHNVAQSLTVIGDVANKTAILIDDMIDTGGTICAGAELLRKEGAKRVIACASHAVFSPPAYSRLSADDLFEEVVVTNSIPVPTSQYFEQLKVLSVANMLGEAIWRVHEESSISSMFR

SEQ ID NO: 56391 - protein, 436 aa, Pseudomonas aeruginosa
  misc_feature (1)..(1): Xaa can be any naturally occurring amino acid
  misc_feature (173)..(173): Xaa can be any naturally occurring amino acid
  misc_feature (208)..(208): Xaa can be any naturally occurring amino acid
  misc_feature (242)..(242): Xaa can be any naturally occurring amino acid
  misc_feature (258)..(258): Xaa can be any naturally occurring amino acid
  misc_feature (289)..(289): Xaa can be any naturally occurring amino acid
  misc_feature (294)..(294): Xaa can be any naturally occurring amino acid
  misc_feature (341)..(341): Xaa can be any naturally occurring amino acid
  misc_feature (423)..(423): Xaa can be any naturally occurring amino acid
XRISIFGLGYVGAVCAGCLSARGHEVIGVDVSSTKIDLINQGKSPIVEPGLEALLQQGRQTGRLSGTTDFKKAVLDSDVSFICVGTPSKKNGDLDLGYIETVCREIGFAIREKSERHTVVVRSTVLPGTVNNVVIPLIEDCSGKKAGVDFGVGTNPEFLRESTAIKDYDFPPXTVIGELDKQTGDLLEEIYRELDAPIIRKTVEVAEXIKYTCNVWHAAKVTFANEIGNIAKAVGVDGREVXDVICQDHKLNLSRYYXRPGFAFGGSCLPKDVRALTYRASQLDVEHPXLGSLXRSNSNQVQKAFDLITSHDTRKVGLLGLSFKAGTDDLRESPLVELAEXLIGKGYELRIFDRNVEYARVHGANKEYIESKIPHVSSLLVSDLDEVVASSDVLVLGNGDELFVDLVNKTPSGKKLVDLVGFXPHTTTAQAEGICW

SEQ ID NO: 56392 - protein, 627 aa, Clostridium thermocellum ATCC 27405
MDSINFPDDIKKLNLEQLKQLAGEIRSFLIEKVSKTGGHLASNLGVVELTLALHRVFNTPEDKIIWDVGHQCYVHKIITGRKDRFDTIRKLGGLSGFPKSAESEYDAFNTGHSSTSISAALGIAKARDLRKEKYSVVAVIGDGALTGGMAFEALNDAGRSPNNLIVVLNDNEMSISKNVGGLSVYLSKIRTEPFYFKVKEDIDIILNKIPAIGKSAVKALGRVKGTIKYMIMPGIVFEELGFKYLGPIDGHNIAELENVLTRAKNTKGPVLVHVCTQKGRGYTYAEKNPAVFHGISPFEVETGEVIANKVPGYSDVFGSEIVRIAEKEERVVALTAAMPHGTGLIKFSKRFPERFFDVGIAEQHAVTFGAGLAKNGMIPVIALYSSFLQRAYDQVVHDVALQNLHVVFAIDRAGIVGEDGETHQGIYDISFLRHIPNMTILAPCDYNELAKMLEYAVLEHSGPIAIRYPRGAGPEKLFDTPDIKLGQSLLISEGNDVTIAAVGNKVEVAMKVAEKLKETGLSADVIYCRFIKPLDSNTIINSVLKTKRLVTIEDNTVEGGFGSRVLETINQKGINVTTRMFGYPDAFIPHGSIKELVHMYRLDPDSIFNDVLKLINKSKVKEFRAIR

SEQ ID NO: 56393 - protein, 295 aa, Clostridium thermocellum ATCC 27405
MEFKQQLEKYADIVNEYLDRCIVQNELPEKSLYSAMRYSLMAGGKRLRPVLSLAVCDMLGGSVEQVLPFACAVEMIHTYSLIHDDLPAMDNDDFRRGRPTNHKVYGEALAILAGDGLLNLAFEIMLENIIKNGDMERKSKAAAVIAKAAGMNGMIAGQVIDLESEGKQVDNEILNRMHRLKTGALIKAPVVSAAILCGADADDIQKLDEFAENLGLAFQIKDDILDVEGSSEKLGKKVGSDADNNKSTYVTVYGLEKSKEILSDVTKKAVDALEKFGEKADFLRSLAKYLLEREN

SEQ ID NO: 56394 - protein, 397 aa, Chlorobium tepidum TLS
MQKKTLSDISLQGKRVLMRVDFNVPLDQDRNITDEKRIVEALPSIRKVIDNGGRLILMSHLGRPKGKVNPAFSLSPVAKRLSELLDCPVTMAGDCIGTEVMQQVLALQDGDVLMLENLRFHPEEEANDPDFARELASLGEIYVNDAFGTAHRAHASTEGITHFMQTAVAGYLIEKELRYLGTALNDAQRPFVAILGGAKISGKIDVLESLFEKVDTVLVGGAMVFTFFKAQGLDVGNSLVEENKLELAVSLLEKAKAKNVRLLLPEDVVVAGEISADAPSRVEPVSAISAGMIGLDIGPATIETYRKEILDAKTVLWNGPMGVFEIDQFARGTFAVAQALADATAEGAITIIGGGDSAAAIAKAGLSDKVTHVSTGGGASLEFLEGKELPGIAALND

SEQ ID NO: 56395 - protein, 622 aa, Arabidopsis thaliana
MIPSQCILRAFTRISPSKYIRDTSFRSYPSRFSSCINQYRNADSDRIIRPTNAVPFCTDRQSSVTAQVVSEARSHSASTTCANDTTLDQIYTKNGLNVKPLVVERLKRDEKDEEAVNEDEEGVKRDGFEGVKCNDVEEEAWRLLRDSIVTYCDSPVGTVAAKDPTDTTPSNYDQVFIRDFVPSALAFLLKGESEIVRNFLLHTLQLQSWEKTVDCYSPGQGLMPASFKVRTLPLEEDKFEEVLDPDFGEAAIGRVAPVDSGLWWIILLRAYGKITGDYSLQERIDVQTGIKMIANLCLADGFDMFPTLLVTDGSCMIDRRMGIHGHPLEIQALFYSALRSSREMITVNDSSKNIIKTISNRLSALSFHIRENYWVDKNKINEIYRYKTEEYSMDATNKFNIYPEQVSPWLMDWVPESPDSGFLIGNLQPAHMDFRFFTLGNLWSIISSLGTPKQNQAILNLVEEKWDDLVGHMPLKICYPALESSEWHIITGSDPKNTPWSYHNGGSWPTLLWQFTLACIKMGRPELAEKAVTLAEKRLQADRWPEYYDTRDGKFIGKQSRLYQTWTIAGFLTSKQLLQNPEIASSLFWEEDLELLESCVCVLTKSGRKKCSRAAAKSQILI

SEQ ID NO: 56396 - protein, 271 aa, Staphylococcus aureus subsp. aureus Mu50
MKLVFYGAGNMAQAIFTGIINSSNLDANDIYLTNKSNEQALKAFAEKLGVNYSYDDATLLKDADYVFLGTKPHDFDALATRIKPHITKDNCFISIMAGIPIDYIKQQLECQNPVARIMPNTNAQVGHSVTGISFSNNFDPKSKDEINDLVKAFGSVIEVSEDHLHQVTAITGSGPAFLYHVFEQYVKAGTKLGLEKEQVEESIRNLIIGTSKMIERSDLSMAQLRKNITSKGGTTQAGLDTLSQYDLVSIFEDCLNAAVDRSIELSNVEDQ

SEQ ID NO: 56397 - protein, 112 aa, Bifidobacterium longum bv. Suis
LEVTKVEGNNVYTKVVVAGPVSSHKGINLPGVAVSLPALTEKDEEDLRWAIRTGADIIAMSFVRFATDIDRAHEIMDEEGRRIPVVAKIEKPQALENLEEIVKAFDGIMVAR

SEQ ID NO: 56398 - protein, 156 aa, Haemophilus influenzae
NRTNTPVLVDGKDVMPEINAVLAKMKDFCQRIISGEWKGYTGKAITDVVNIGIGGSDLGPYMVTEALRPYKNHLNMHFVSNVDGTHIAETLKKVNPETTLFLVASKTFTTQETMTNAQSARDWLLKAAKDESAVAKHFAALSTNAKDVEKFGIDTN

SEQ ID NO: 56399 - protein, 494 aa, Staphylococcus aureus subsp. aureus Mu50
MSTKNKHIPCLITIFGATGDLSHRKLFPSIFHLYQQDNLDEHIAIIGIGRRDITNDDFRNQVKSSIQKHVKDTNKIDAFMEHVFYHRHDVSNEESYQELLDFSNELDSQFELKGNRLFYLAMAPQFFGVISDYLKSSGLTDTKGFKRLVIEKPFGSDLKSAEALNNQIRKSFKEEEIYRIDHYLGKDMVQNIEVLRFANAMFEPLWNNKYISNIQVTSSEILGVEDRGGYYESSGALKDMVQNHMLQMVALLAMEAPISLNSEDIRAEKVKVLKSLRHFQSEDVKKNFVRGQYGEGYIDGKQVKAYRDEDRVADDSNTPTFVSGKLTIDNFRWAGVPFYIRTGKRMKSKTIQVVVEFKEVPMNLYYETDKLLDSNLLVINIQPNEGVSLHLNAKKNTQGIETEPVQLSYSMSAQDKMNTVDAYENLLFDCLKGDATNFTHWEELKSTWKFVDAIQDEWNMVDPEFPNYESGTNGPLESDLLLARDGNHWWDDIQ

SEQ ID NO: 56400 - protein, 112 aa, Bifidobacterium longum bv. Suis
LEVTKVEGNNVYTKVVVAGPVSSHKGINLPGVAVSLPALTEKDEADLRWAIQTGADIIAMSFVRFATDIDRAHEITDEEGRRIPVVAKIEKPQALENLEEIVKAFDGIMVAR

SEQ ID NO: 56401 - protein, 169 aa, Brassica napus
RSAMSSPLAKAIFSIDGVVRVFFGSDFVTVTKSDDVTWDFLKPEVFAVVMDFYSSGQPLFLDSQAAAAKDTAVNDDDSETVAMIKELLETRIRPSVQDDGGDIEYCGFDTETGIVKLRMQGACSGCPSSSVTLKSGIENMLMHYISEVKGVEQEFDGEEEEGTSSGPVE

SEQ ID NO: 56402 - protein, 686 aa, Arabidopsis thaliana
  misc_feature (54)..(54): Xaa can be any naturally occurring amino acid
AATPPNSNSSSSCNRTFGGISIPFPFGIGGKDCYLNSWYEVVCNSTTSGSCKTXNREVVNISLPKSDFFSPYGVVHIKGPVTSLGCSSNISQGLQKTLPDLNITGRGSPYFLTDENRLVAVGCGTKALMTDIESEILGCESSCKDTKSNEVGNSLCNGYKCCQARLPVERPQAVGVNIESNNDTRGEGCKAAFLTSMKYFPSNITKPEWFQADGYAVVELGWYFDTSDSRFRNPLGCTNLTRSSGSYFLTDICLCRYGYFSRMSYRSCYCGSGYRGNPYIRGGCIDIDECEVPNKCGEDTCVNMAGRYSCVPKITKPAKLAHVLRGIFGLYKFIRKRRRIIRSMKFFKRNGGLLLKQQLTTKDGSVEMSKIFSSRELEKATDNFSIDRVLGQGGQGTVYKRMLVDGSIVAVKRSKVVDEDKMEEFINEIVLLSQINHRNIVKLLGCCLETEVPILVYEYIPNGDLFKRLHDEYDDYMMTWEVRLRIAVEIAGALSYMHSAASFPIFHRDIKTTNILLDEKYRAKISDFGTSRSVATDQTHLTTLVAGTFGYMDPEYFLSSQYTHKSDVYSFGVVLVELITGEKPMSRVRSEEGIGLATYFLEAMKENRAVDIIDIRIKDESKQVMAVAKLARRCLNRKGNKRPNMREVSIKLERIRSSPKDLDVHTENEEEEEEDQLMEINRIYDS

SEQ ID NO: 56403 - protein, 432 aa, Colwellia psychrerythraea 34H
MSKISKILAREIMDSRGNPTVEADVYLESGAFGRAAAPSGASTGSREALELRDGDKARYLGKGVLKAVAAINVNIQAALIGQSALDQANIDQIMIDLDGTENKEQFGANAILAVSLANAKAAANEKKVQLFEHIADLNGTPGVYSLPLPMMNIINGGEHADNNVDIQEFMVQPVGAKSFREALRMGAEIFHALKKVLSSKGMSTSVGDEGGFAPNLESNADALAVIKVAVEAAGYELGKDVTLAMDCAASEFYDADKGIYDLTGEGKQFTANEFSDFLGELCKEYPIVSIEDGLDESDWDGFKYQTDLLGDKVQIVGDDLFVTNTKILARGIENGIGNSILIKFNQIGTLTETLAAIKMAKDAGFTAVISHRSGETEDATIADLAVGTAAGQIKTGSLCRSDRVSKYNQLLRIEEFLGDKAIFNGLSEVKGQ

SEQ ID NO: 56404 - protein, 497 aa, Mycobacterium smegmatis str. MC2 155
MSTVIQHWRDGKVFAGSSTATAPVTNPATGAVTGEVALASVEDARAVIDSAAAAFPAWRDTSLAKRTQVLFAFRELLNARKEEVAAIITAEHGKVLSDALGEVTRGLEVVEFACGIPHLLKGGFTENASTKVDVYSISQPLGPVGIISPFNFPAMVPMWFFPIAIAAGNTVVVKPSEKDPSASLWMAELWKEAGLPDGVFNVLQGDKTAVDELLTNPKIKGVSFVGSTPIAKYVYATGTAAGKRVQALGGAKNHAVVLPDADLDLAADAMVNAGFGSAGERCMAISACVAVGPVADELVAKIAERAATIKTGDGTKDSDMGPLVTKAHRDKVASYIDAGEAAGAKVVLDGRTVIANGEEDGFWLGPTLLDNVTPEMSVYTDEIFGPVLSVVRVETYDEALELINNNPYGNGTAIFTNDGGAARRFQNEVEVGMVGINVPIPVPMAYYSFGGWKASLFGDTHAHGIQGVHFFTRTKAVTSRWLDPSHGGINLGFPQNK

SEQ ID NO: 56405 - protein, 361 aa, Arabidopsis thaliana
MALEEEEESQNAPFCVLDGLFCEEESEFHEQVDLCDESVEKFPFLNLGLSDHDMLWDDDELSTLISKQEPCLYDEILDDEFLVLCREKALDWIFKVKSHYGFNSLTALLAVNYFDRFITSRKFQTDKPWMSQLTALACLSLAAKVEEIRVPFLLDFQVEEARYVFEAKTIQRMELLVLSTLDWRMHPVTPISFFDHIIRRYSFKSHHQLEFLSRCESLLLSIIPDSRFLSFSPSVLATAIMVSVIRDLKMCDEAVYQSQLMTLLKVDSEKVNKCYELVLDHSPSKKRMMNWMQQPASPIGVFDASFSSDSSNESWVVSASASVSSSPSSEPLLKRRRVQEQQMRLSSINRMFFDVLSSSPR

SEQ ID NO: 56406 - protein, 511 aa, Mycobacterium smegmatis str. MC2 155
MTVTTFRPSDVATLTNPDAASDVADLSMFIAGEAVSAADGATFDSYEPRSGRVWARLPRANSTDIDRAVRAARAAFEGPWGAVSPADRGRFLMKIAAVVDRHRDQLTVIESRDNGKPVREVRAEIDAVVRYFEYFAGVCQTTVGETHPQAATAFSYTRREPVGVVGAIVPWNSPLLMLAWKLSPALAGGNTIILKPAEETSVSAVVFAQLIAEVGLPDGVFNVVTGIGEEAGAALVAHPDVDKIAFTGSTEVGKQIAATAASDLKLVTFELGGKSPTVIFDDADLDAAVHRTAYGIFSAAGQTCQAASRIFVQDTIHDEFLDRFAALARRIRVGDPLSERTQMGAQISAQHRERIAGYVASGIQEGANLVCGGTQPTEAPLAQGYYYSPTILDGVNRDMRMIREEIFGPVTGVMSFTDEADAVAKANDTEYGLAGSVWTRDVSRAHRVAASIAAGLIWVNTTRTINHLVPFGGYKQSGYGREGGQAVMEHYTRIKSVWVDMQDDLPNWYAD

SEQ ID NO: 56407 - protein, 413 aa, Oryza sativa Japonica Group
MNGASSGGGGGAGAGGDGPLVYQRWKGNNVFVLQGRFIFGPDARSLYVTMFLIIAPASIFCLFVAKELMNNFSYGLGLPVMISAVVFTAYDLSLLLLTSGRDPGIIPRNAHPPEPEGLDGNAEVGSNQTPPMRLPRVKDVVVNGITVKTKYCDTCMLYRPPRCSHCSICNNCVERFDHHCPWVGQCIGLRNYRFFYMFVFSTTLLCLYVFGFCWVYIVKIRNSEQITIWKAMAKTPASIALLVYTFIAVWFVGGLSVFHLYLMSTNQTTYENFRYRYDQRANPYNRGVMENIKDIFFSAIPASKNNFRARVPVPQEQGLRPRPTNGFMSPNMGRAVGDIEMGRKPVAWDEPRMAADIGDLGAGLGNLLEDKDGRFRSASPDLSRDALAIGGLDDQGSSVMNPGRTSWGVEAGR

SEQ ID NO: 56408 - protein, 203 aa, Mycobacterium smegmatis str. MC2 155
MSVQQHRLLLLRHGETEWSASGRHTGRTDLDLTEAGREQAKLAAEPLAELQLRDPLVFSSPRRRALVTAELAGLTVAEELPLLAEWDYGNYEGLTTAQIRETEPDWLVWKHGCPGGESVEEVGERADRAVALALEYLEDRDVVFVGHGHFSRAVLARWVELPVTHGIRISMVPASIGVCGFEHGVRQISALGLTGHPNPCLPQ

SEQ ID NO: 56409 - protein, 250 aa, Glycine max
MPIRNIAVGRPEEATHPDTLKAALAEFISTFIFVFAGSGSGIAYNKLTDNGAATPAGLISASIAHAFALFVAVSVGANISGGHVNPAVTFGAFVGGNITFLRGIVYVIAQLLGSIVASLLLAFVTASTVPAFGLSAGVGVGNALVLEIVMTFGLVYTVYATAIDPKKGNLGIIAPIAIGFIVGANILLGGAFSGAAMNPAVTFGPAVVSWTWTNHWIYWAGPLIGGGIAGLVYEVVFISHTHEQLPTTDY

SEQ ID NO: 56410 - protein, 354 aa, Cyamopsis tetragonoloba
MVSSRMASGETILVTGGAGFIGSHTVVQLLKQGFHVSIIDNLYNSVIDAVHRVRLLVGPLLSSNLHFHHGDLRNIHDLDILFSKTKFDAVIHFAGLKGVGESVLNPSNYYDNNLVATINLFQVMSKFNCKKLVISSSATVYGQPDQIPCVEDSNLHAMNPYGRSKLFVEEVARDIQRAEAEWRIILLRYFNPVGAHESGQIGEDPRGLPNNLMPYIQQVAVARLPELNIYGHDYPTKDGTAIRDYIHVMDLADGHIAALRKLFTTDNIGCTAYNLGTGRGTSVLEMVAAFEKASGKKIPIKMCPRRPGDATAVYASTEKAEKELGWKAKYGVEEMCRDQWKWASNNPWGYQGKH

SEQ ID NO: 56411 - protein, 203 aa, Triticum aestivum
DKGTIELAGTNGETTTQGFDDLGKRCAKYYEAGARFAKWRAVLKIGATEPSQLSIDQNAQGLARYAIICQENGLVPIVEPEILVDGPHDIDRCAYVTEIVPAAVPAIVFLSGGQSEEEATLNLNAMNKLQTKKPWNLSFSFGRALQQSTLKAWSGKTENEEKARAAFLVRCKANSEATLGTYKGDATLAEGASESLHVKDYKY

SEQ ID NO: 56412 - protein, 506 aa, Prochlorococcus marinus subsp. marinus str. CCMP1375
MIPTTNPLRVGLRQERVISPQCLIIFGASGDLTHRKLVPALFKLFKQRRLPSEFALLGCARRPWSDIEFRKKMSVSLKDEIKLNPNEWEEFITRLFYEPVNLERPEDLVKLGTRLEEIDRIKATHANRTFYLSVAPKFYASGCKALADAGLLKDPRRSRVVIEKPFGRDYRSAQSLNRIVQNCALESQIFRIDHYLGKETVQNILVLRFANTIFEPIWNRNYISNVQITSAETVGVEDRAGYYESSGALRDMVQNHLTQMLAITAMEPPGHFDPEAIRNEKAKVLQAAHLANELEPWECCVRGQYSKGGSKKRPLIGYRDEPGVNPNSTTETYVAMKLFINNWRWQGVPFYIRTGKRLAKRTSEVVLTFREAPVHLFDAAGGTPTSNQLVLRIQPDEGAEFKFDVKSPGSGMRSRPVEMEFSYDESFGEPSDEGYVRLLADAMLGDPTLFTRSDEVEAAWRLYTPLLEIIEDSPWQLPTYPYESRTWGPSEADALLAKDQLLWRRP

SEQ ID NO: 56413 - protein, 383 aa, Cryptococcus neoformans var. neoformans JEC21
MSTEGQVITCKAAIAWEAGKPLSIETVEVAPPKDGEVRIKILYTGLCHTDAYTLSGNDPEGAFPVILGHEGGGIVESVGEGVDNVKVGDHVVPLYTAECRECKFCKSGKTNLCGRVRTTQGKGVMPDGTTRFKCKGQDILHFMGCSTFAQYTVVSKFSVVAINPKAPLKTSCLLGCGITTGYGAATKSPGIEGSNVAIFGVGCVGLSVLQGAKAKGCKRIFAIDTNPKKKEWAVKFGATDFINPKDLPEGKTIVDYLIEETDGGLDFTFDATGNVGVMRNALEACHKGWGVCTIIGVAPAGAEISTRPFQLVTGRVWKGSAFGGVKGRTELPGIVEDYLAGKLWVNEFVTHNETLEGINKGFDDMHAGDCIRCVVDMGFNEAP

SEQ ID NO: 56414 - protein, 1144 aa, Arabidopsis thaliana
METAPPSLVSKARTAFNSAAAKAERVFTDLKSDRGMFFLVYANWQCWEQEENEVKTQGWRTAHIRKKQEWQNKLKNLRIGRKEVEDQDKVEDSAMAAPFYDENFYILKAKQEQEAKASDVGCMVESLNAVDANSIPLASVVKQLAVAIEAGKRAKNVKDFVASSGSSSPVRERGGLSLSAVKSLVLGEKEDKLGFDSGDEDKLVSLINALFNVDSGFLSRKIVSDLESPTNRSSFAKDLHAAPPSSFVVKLAEVIGSFTTPRRMALFWCRVVEELRRFWNEEKHIPWIPLDNNPDLKSCLLHQWLQVINCCLARKARNVAASEALDAVMRQASSANEKSDVSESMGSLLYAKSNSGELILRLGVYNQVENLTMLETGEPVYSPITQEGPLLTEDLIRETEELVLRTGSMGAGCSQLLSDMQAFKVIILMNNLITVWYISTHAANPGCILEDFVRWHSPPDWTENGNMSGDDSSPVRGQLSTRMQKEGNLWRELWETAKPLPAVKQAPLFDEDLAVEGILNYLEDIPAAELFEQLFTSLVSLGFVMVEPVLATNDDLSKLFFECKDYVVAICQGGAWTDKLDDLCQVYETVETMLLRPEEVLRSMKQTEESPSSGSETKRRFKRLGFIFRGSKERKQTRVPSETEQKSTEPSPRQSFSSLFDGKSSLFSKRPPRPENRFGAMMLRAVFRRASIRGSSSASGLGKSLQSSRVAVSAQFHSVSATETLVPRGNHAHSFHHRSCPGCPDCSRTIINGYQGTALQRWVRPFSSDSGDVVEAVVPHMGESITDGTLAAFLKKPGDRVEADEAIAQIETDKVTIDIASPASGVIQEFLVKEGDTVEPGNKVARISTSADAVSHVAPSEKAPEKPAPKPSPPAEKPKVESTKVAEKPKAPSPPPPPPSKQSAKEPQLPPKDRERRVPMTRLRKRVATRLKDSQNTFALLTTFNEVDMTNLMKLRSQYKDAFLEKHGVKLGLMSGFIKAAVSALQHQPVVNAVIDGDDIIYRDYVDISIAVGTSKGLVVPVIRDADKMNFADIEKTINGLAKKATEGTISIDEMAGGSFTVSNGGVYGSLISTPIINPPQSAILGMHSIVQRPMVVGGSVVPRPMMYVALTYDHRLIDGREAVYFLRRIKDVVEDPQRLLLDI

SEQ ID NO: 56415 - protein, 856 aa, Ustilago maydis 521
MSQTADSSPRGSNSPSPYPYQRPTGASTIDGIAASARAGPSSCTHLVDTDMHDRSESPADFAARHGAPLARPPPSPSSTSVSDDGVAQPDFADLASIDDADTQTRSVERSFDPSAVRLSRRGTLVPASPTSSNGTWSFQDAPQSTASNLPHEILLHIFQYLVLYPPDLLSCLLVCKSWCLNGVELLWYRPALFKISSLFKLVGVIRKPEQLFPYAQFVRRLNFTLLANQLEDQLFLMMSACTRLERLTLAGCSNITDATLVKVFQNTPQLVAIDLTDVANITDNTLLTLAANCPKAQGINLTGCKNISSHGVAELARNCKRLKRVKLCACENIGDEALLALTEHCPSLLEIDLIHCPKVSDKSLRQMWSRSFQMRELRLAHCNNLTDNAFPSARGTTGVPMLGTSHSQSSRSAIPAASAYTTDSAPTSRGESPSVNMPFDAVRDGVLLTRSASIPNDMAQNRLFEHLRILDLTACTSISDDAVEGIIANVPRLKNLALTKCTRLTDEALYSIAKLGKNLHYLHLGHVSNITDRAVTHLARSCTRLRYIDVACCPNLTDLSITEIANNMPKLRRIGLVKVVNLTDQAIYGLVDRYDSLERIHLSYCENVSVPAIFCVLQRLDRLTHLSLTGVPAFRRPELQAMCRAPPKDFNDHQRQAFCVYSGKGVNDLRKYLQHVYSDEQLAAEFGQLEPRAMNALGGFGEHPGAETAMSQWTAHHAHYAPATFGGGPGAAGIAYAHAQPHAPPQPGAPPLGLVGGAPAPAPIAAGLYHPTAGGIHHAGAGAGITRRRQLTTAEQMYFEQQRQLARYANARRAAQDATLLNRSASTDGANRRGKESGHAVGGKRPVCCSTCHAPR

SEQ ID NO: 56416 - protein, 348 aa, Streptococcus thermophilus LMG 18311
MLNMTKKIVTLSGDGIGPEIMAAGLGVLDKVASKIEFDYDVDAKPFGGAGIDAEGHPLPKATLEAAKSADAILLAAIGGPKYDNAPVRPEQGLLAIRKELNLFANIRPVRIFDALKHLSPLKPERIEGVDFVVVRELTGGIYFGEHILEEDKARDINDYSADEIRRIMRRAFKIAQGRGKKVTSIDKQNVLATSKLWRKVADEVSLEFPDVTLEHQLVDSAAMIMITNPARFDVVVTENLFGDILSDESSVLPGTLGVMPSASHSENGPSLYEPIHGSAPDIAGQGIANPISMILSVAMMLRESFNETEGAELIENAVDKTLNQGILTRDLGGQASTAEMTAAIISNL

SEQ ID NO: 56417 - protein, 300 aa, Prochlorococcus marinus subsp. marinus str. CCMP1375
MAEAVMFPFDFTAYLAKARTRIESALDASLGPERPNQLREAMRYSLLAGGKRLRPILCLAACELTGSDSENAISTAVAIEMIHTMSLIHDDLPSMDNDDLRRGRPTNHKVYGEAIAILAGDALLTRAFEMVALRSPNVPKDRLLKVVGELSLVAGAPGLVGGQVEDLESEGKAVDLDTLEFIHIHKTGALLKASVVCGALIGGADEDLLIALSTYAKGIGLAFQIVDDILDVTASSEVLGKTAGKDLLADKSTYPKLLGLDESRKKAKELIRKSKDVIHPWSDKAAPLLSLADYIINRDR

SEQ ID NO: 56418 - protein, 277 aa, Oryza sativa Japonica Group
MAGGGDELKLLGMWASPFALRAKLALSFKGLSYDYVEEDFKNKSELLLSSNPVHKKVPVLIHNGKPICESQVIVQYIDEVFPDAGVTLLPADPHDRAVARFWASYIDEKLFGAWIPVFRGKTEEEKAEGVKQTFAVAEKLEGALSECCKGKPFFGGDTVGYVDVVLGGFVAWVHAIEEVFGLNQFDAAKTPLLAAWLERFDELDAAKEAMPDIGRLVELEKMRQAQAQAAFLAVRLYLLLFLQPCFISSCCRTVYVSPCVAEVANWVFYNVLRPYCL

SEQ ID NO: 56419 - protein, 124 aa, Brassica napus
  misc_feature (35)..(35): Xaa can be any naturally occurring amino acid
THASTANDVKKIVNTLNDTQVPSHDVIKVVVNPPXVFLPQVNSILRLDFNVTAHNCWVNMGRAFTDEVSGEMLVNFDISWVILGHTDRTALLNETHEFVGYKVAYALTQGLILIACVGETLEQR

SEQ ID NO: 56420 - protein, 651 aa, Ustilago maydis 521
MNVSRSRAVSAGSTAGGASIGGAGVDIPGASTSHASSSLNAPTARTHRERDRNARPKDRHALALRSIRDFLRGRSSYDVLPVSFRLIVLDTKLVVKPALDVMWQAGVVSAPLWQSTPHELLGNSPNQPESESQSQTQMQTQEQEQEQERTQSTNDTEAAHDDGKISPTTRVTADAVVGAKKKLSHKAHQLSGFAGMLTVNDIIHLIQYYYRHSSYDSAAKDVEKFRLERLRDIEQALNVPPPPLLSVHPLRPLFDACQLLIKTHARRLPLLDYDEQTGMETVVSVLTQYRVLKFIAMNCRETSALWRSLRQLNIGTYCQSYRASRAAASGTTSHRGSDASEPGVLKTDNGQSLNMSELNDLGASDEGARRHVDASSASCSAWNGGGIEADGSSAGNAFAPIATATLDTTVFDVVHMFSERGISAVPILDEEGNVVDMYETVDVITLVRTGAYTSLDLTIRQALERRAPDFSGVWTCSPDDSLASIFALLRKRRVHRLLVLEPEAVALKSETSDQTTALDELDSYVDDLVEHQRLRDKKDTQAFCDNLKTPFELRLEKGDPVRRTRGTLVGIVCLSDILRYVIGEHKLDDSVGGIGTGVGVSRATSIASSTPSSQHDDQHQANGTAHLASASTGPDAPQTIPEHEALHLPPQ

SEQ ID NO: 56421 - protein, 230 aa, Streptococcus thermophilus LMG 18311
MVKLVFARHGESEWNKANLFTGWADVDLSEKGTQQAIDAGKLIKEAGIEFDKAYTSVLKRAIKTTNLALEASDQLWVPVEKSWRLNERHYGGLTGKNKAEAAEQFGDEQVHIWRRSYDVLPPKMDRDDEYSAHKDRRYASLDDSVIPDAENLKVTLERALPFWEDKIAPALKDGKNVFVGAHGNSIRALVKHIKKLSDDEIMDVEIPNFPPLVFEFDEKLNVVSEYYLGK

SEQ ID NO: 56422 - protein, 313 aa, Colwellia psychrerythraea 34H
MSKNIALQQLNNFLADDQLNKSELLALIELAINIKQNPADYSQVLAGKSVAMIFEKPSLRTHVSFDMGISKLGGHALYLGQQNGKLGERERVSDYAKNLSCFADAIVARVFSHDSIQGLAEHASVPVINALCDVYHPCQALADFVTLSETYPDLSQVKLAYVGDGNNVSNSLMIMAAILGVDFTLISPEGHEAQADIVEKTKELAQESGCQLTLTNDINAIGKQDVIYTDTWISMGDEDSSKKAEILAKFAPYQVNHDLMEKAQATMVLHCQPAHLEEEITTKLFDSELSKVFQQAENRMWAQNAVLVALFSK

SEQ ID NO: 56423 - protein, 216 aa, Methanosarcina acetivorans C2A
MPVYENTKLILEEIGSTTLVCVTKTIEPERINEAIRAGAPIIGENRVQEYEDKRDDILPCETHLIGHLQTNKVKKAVHLFDVIQSIDSMKIIRDIDRRARDIGKVQKVYLQVNIGNEPQKYGFGPDEIKNAITEIRSLRNVRVEGLMCIPPFVPPEQTRPYFKKMKALFDEMKQENRDNIDIRTLSMGMSGDYRIAIEEGATMVRVGSAIFGKREY

SEQ ID NO: 56424 - protein, 218 aa, Colwellia psychrerythraea 34H
MTQDEMKNAAAIKALEFIENDTIVGVGTGSTVNFFIEALASMKDKIAGAVSSSEESTKRLKAHGIEVFDLNSVDVLDVYVDGADEITRHMSMIKGGGAALTREKIVAAVAKKFICIADDSKQVKVLGNFPLPVEVIPMARSYVARELVKLGGDPVYRQGVTTDNGNVILDVYNLEILDPKALETQINAIVGVVTNGLFALRGADILVLGSKDGIQVIQ

SEQ ID NO: 56425 - protein, 878 aa, Microbispora rosea
MPKYVYDFTEGNKDLKDLLGGKGANLAEMTNIGLPVPPGFTITTEACRHYLQHGGMPDGLAEEIDEHLAALEERMGKRLGQADDPLLVSVRSGAKFSMPGMMETVLNIGLNDDSVVGLAKQSGNDRFAWDSYRRLIQMFGKTVLGIDGELFENAMDELKGERDDTDLEAADLQRLVDTFKRIVRDQTGRDFPADPREQMDLAVRAVFDSWNAPRAILYRRQERIPADLGTAVNVVAMVFGNMGPDSGTGVAFTRDPGSGRQGVYGDYLRNAQGEDVVAGIRNTIPLQELESINPQAYRELLDIMATLERHYRDLCDIEFTIERGKLWMLQTRVGKRTAEAAFRIATQLVDEGLIDMDEAVARVTGDQLAQLMFPRFAATADARRLTTGMNASPGAAVGKAVFSSERAVELAGQGEAVILVRRETNPDDLAGMIAARGVLTSRGGKTSHAAVVARGMGKTCVCGAEELEVDPHARRFTAPGGIVVNEGEVISIDGSTGAVYLGEVPVTASPVARYFEGEPAEDELVRAVDRIMTHADSVRRLAVRANADTPEDAARARRYGAQGIGLCRTEHMFLGERRRLVEDLILAATPEERQAALDALEPLQTEDFTGIFTAMRGLPVTIRLIDPPLHEFLPDLTELAVKVAVAGEAADDRDRRLLEAVKRLHEQNPMLGLRGVRLGLTIPGLFAMQVRAIAAAARRVEDARAEIMIPLVGAVQELEIVREEAERILAEAGVTAAIGTMIEVPRAALTAGQIAEAAEFFSFGTNDLTQMTWGFSRDDVESAFFGQYLDLGVFGVSPFESIDREGVGRLMRIAVEEGRRARPGLKLGICGEHGGDPDSVRFCHEIGLDYVSCSPFRIPVARLEAGRAALTCAASDTR

SEQ ID NO: 56426 - protein, 307 aa, Zea mays
MQKQTGKSGGTGGGTPAKRGRPFGSTTGGGAAAAAAAAAVVDPGAPAALVGPSLQVLSALSDQNNKRIVLALQSGLKSEILWALNALTVLSFKEKDDLRRDATPLAKVPGLLDALLQVIDEWSDISMPKDHTKPPRLRTLGANTTLSGFGQENMEKVYSDTATTSNDQSKAEDSSVTKKRAASFWFDEDGLFNNDDEGRAERQQCAIAASNIIRNFSFMPENEIIMVQHRHCLETIFHCLENQNREDDELITNMLETLVNLAPVLDLRIFSSSKASFIKMTEKGAIHAIMGMLSSSVKPWHCAAAEL

SEQ ID NO: 56427 - protein, 324 aa, Oryza sativa Japonica Group
MDGEEAPPGALNLADYAPAGARTVDCFRRIRKIGEGTYGEVFEAMDIITGERAALKKIKLDDGKEGFPRQILREIKLLKKLDHENIIRLKEIVVSPGTAHGAGGSDDYMYRGDIYMVFEYMDHDLKKVLHHSTPSQVKYYMEQLLKGLHYCHVNNVLHRDIKGANLLISGGGKLLKLADFGLARPFTRDGSFTNHVITLWYRPPELLLGATNYAEAVDIWSVGCIFAEFLLRKPLFPGRTEQEQLSKIFELCGFPNEENWPGVSKLPLYKTIRPTTPTKRRLRDIFHNFDSHAVDLIDRMLILNPTERISAHDALCAAYFITKM

SEQ ID NO: 56428 - protein, 462 aa, Chlorobium tepidum TLS
MQEGKISQIIGPVVDVDFPEGQLPSILDALTVTRQDGSKLVLETQQHLGEERVRTIAMEGTDGLVRGMSAVNTGKPIQVPVGGEVLGRMLNVVGDPIDGKGPVPAKKTYSIHRAAPKFDELSTKTEMFETGIKVIDLLEPYSRGGKTGLFGGAGVGKTVLIMELINNIAKQQSGYSVFAGVGERTREGNDLWHEMMESGVIDKTALVFGQMNEPPGARARVALTGLSIAEYFREEEGRDVLLFIDNIFRFTQAGSEVSALLGRMPSAVGYQPTLSTEMGELQDRITSTKKGSVTSVQAIYVPADDLTDPAPATAFTHLDATTVLSRQIAELGIYPAVDPLDSTSRILDPNIVGDDHYNTAQAVKQILQRYKDLQDIIAILGMDELSDEDKLVVARARKVQRFLSQPFFVAEAFTGLAGKYVKLEDTIKGFKEIIDGRHDNLPEAAFYLVGTIEEAVAKAKTL

SEQ ID NO: 56429 - protein, 170 aa, Helicobacter pylori
GSGMHTHVSVWKNNENLFSGETYKGLSELALHFLGGVLHHARGLAAFTNASTNSYKRLIPGYEAPSILTYSANNRSASVRIPYGISKNSARFEFRFPDSSSNPYLAFAAILMAGMDGVKNKIDPGEAMDINLFKLTLDEIREKGIKQMPHTLRRSLEEMLADKQYLKEGQ

SEQ ID NO: 56430 - protein, 384 aa, Acinetobacter sp. ADP1
MQPLSSKLPNQGVTIFSTMTALAQRLNAINLSQGFPDFATPDALIEALCDATRAGFNQYVSGDGWLPLREQVVQQFEQRDQVRLDPVHEITITPGATIAIFAAIQAVIHTGDEVVIFDPSYDSYAPAVRVAGGIPVHLALTAPDFRVDWQQVQDNINARTRMIIVNTPHNPTGTLWTLDDWHHLIELAEKHDLIVLSDEVYEHLVFDGHHHYSALHFSTLRERSFVVGSFGKTFHVTGWKTGYCVASPMLMKLFRQIYQYANFCGNTPAQVALSQYMQQHPEHIQELGSFYQAKRDLFNQGLTQSRFKFQPTHGTYFQTVDYTAIRPDLNDLEMCYFLAEQYGVVAIPLSVFYQQPDPELRLIRFCFAKTEQTLKDATQRLSQC

SEQ ID NO: 56431 - protein, 329 aa, Zea mays
MMGGFLSRVLLLAFGYAYPAYECYKTVELNKPQIEQLIFWCQYWILVALLTVLERFGDFTISWLPFYSEAKVLFFVYLWYPKTKGTTYVYGTFFKPYISQHENEIDRNLLELRARATDMVVLYFHKAASVGQNTFFDVLKYVAAQSPSRKSRLHPHQEPQQQQPQVQVELQQPQPQKQAAPVMRRGASIAARQAAMAQQSLETIPVPSSPKIKRQTSGRPGSVASTKPAAAASTPKPGGSPKKGEVKPAVDPVQTPATSADSPKSEPSAPPLSETEEVDNMAIDEVSGDAAEGAEELDPALEETLMEETIRVTRAKLRRRTATEDSAGN

SEQ ID NO: 56432 - protein, 170 aa, Helicobacter pylori
GSGMHTHVSMWKNNENLFSGEAYKGLSELALHFLGGVLRHARGLAAFTNASTNSYKRLIPGYEAPSILTYSANNRSASVRIPYGISKNSARFEFRFPDSSSNPYLAFGAILMAGIDGIKNKMDPGEAMDINLFKLTLDEIREKGIKQMPHTLRRSLEEMLADKQYLKEGH

SEQ ID NO: 56433 - protein, 232 aa, Zea mays
MPLTRVAADAFGVLTIALFALFAALGLFCIFQSVYFRCRIRRGPSFLPLGYFNGPWVTRIALILITIWWGVVFSVQAILVFVGPRFVREENHDLGRRKIAKYFIRTYTPVGDTSVCTYPLFGTLFLGLVDAFLMSYVSYVGLRVLSLVINKSLRRRVYLLMLSVLCFLPIRVLLLGFSVLLKPGHVAFEGIIFLSFLMMLSCTTVGILLLVYYPVADSLALRDIGQRDIAEM

SEQ ID NO: 56434 - protein, 170 aa, Helicobacter pylori
GSGMHTHVSVWKNNENLFGGETYKGLSELALHFLGGVLRHARGLAAFTNASTNSYKRLIPGYEAPSILTYSANNRSASVRIPYGISKNGARFEFRFPDSSSNPYLAFAAILMAGMDGVKNKIDPGEAMDINLFKLTLDEIREKGIKQMPHTLRRSLEEMLADKQYLKEGQ

SEQ ID NO: 56435 - protein, 322 aa, Kineococcus radiotolerans SRS30216
MAGVHVAVLGSGAWGTAVAGLLAANASSVGLWCRRPELAERIRVSGRNEQYLPGIDLPARVHAGSRVEDVVEGAELVVLAVPLQRLRSLLLRWREVLPAVPVVNLAKGVETSTGLFGSEVVADVLDGRPVLALSGPNLALEIARGQPAATVVACVDAEVAGRVATWCSTPDFHAHPLTDVVGVDVAGAVKNVVALAVGMVEGAGLGANARAAVTTLGLTETAELGRRLGARLETFLGLAGAGDLVATSTSTLSRNHRVGVALGEGLPLAEALVRAGGTAEGVATAPALLRRDPDLPFVRDVVAVLDGQRSPVEAVTRLLTVA

SEQ ID NO: 56436 - protein, 238 aa, Lactobacillus paracollinoides
ESYNIMRNVLGLSVDEMADTFKEWNKGELDSYLIEITADILTRKDDLGADKTKPIVDMILDRGNNKGTGKWSSEDALNVQVPQSVITEAVYARYISMMKNERVAASKVLAAPKAQEEIGDKTEMVEKIREALYFSKIMSYAQGFEQLRFASEAYDWDLQYGELAQIWRAGCIIRARFLQNITDAYDKKPDLTNLLLDDYFKDIAAKYQESTREVVALAVKMGVPVPSFSAAITYYDSY

SEQ ID NO: 56437 - protein, 287 aa, Lactobacillus sp. DSM 20197
PILTQIAAKADQDGKPCVTYIGPNGAGHYVKMVHNGIEYGDEELIDESYNIMRNVLGLSVDEMADTFKEWNKGELDSYLIEITADILTHKDDLGADKTKPIVDMILDRGNNKGTGKWSSEDALNVQVPQSVITEAVYARYISMMKNERVAASKVLAAPKAQEEIGDKTEMVEKIREALYFSKIMSYAQGFEQLRFASEAYDWDLQYGELAQIWRAGCIIRARFLQNITDAYDKKPDLTNLLLDDYFKDIAAKYQESTREVVALAVKMGVPVPSFSAAITYYDSYRSE

SEQ ID NO: 56438 - protein, 189 aa, Oryza sativa
  misc_feature (88)..(88): Xaa can be any naturally occurring amino acid
  misc_feature (117)..(117): Xaa can be any naturally occurring amino acid
MNLPSRILIARSLARCVAALSPQIFLLLLLRRLARGFRTTTGGFGWLIWFGLAMAGRGKAIGSGAAKKAMSRSSKAGLQFPVGRIARXLKAGKYAERVGAGAPVYLAAVLEYLAAEXVLELAGNAARDNKKTRIVPRHIQLAVRNDEELSRLLGTVTIASGGVMPNIHNLLLPKKAGGSAKAAAGDDDN

SEQ ID NO: 56439 - protein, 640 aa, Alkaliphilus metalliredigens QYMF
MIILSCNNITKSFGIDVILKDISFSINTGDKIGLVGINGAGKSTLFKILTGQLAYDDGNLYLGKSKVIGHLEQSDQLDEQNTILAEGLSVFTYLIDMENHLRSLELEIASLGDDPSQSTLLEKTMSQYATLLDDFNRENGYGFRSTVRGVLRGLGFTEDEFEQPIYQLSGGQKTRAALAKLLLSKPDILLLDEPTNHLDIGAVEWLEGFLRDYDGTLLMISHDRYFLDQLVNRVFEIEHQGLKTYTGNYSTFTKKKAQEQEQQHRVYQAHLEEVSRQKDIVRRFRQHGTEKLAKRAHSREKQLEKIEEVEKPQAFQKRAKMRFETQIKSGNDVLTVENLCKSFDEHLLFENLTFDLYRGEKVALIGPNGVGKTTLFKILTEETVPSAGDFKLGHQVHIGYYDQEQRNLHLDKIVIDEIWDEHKKLDQTEVRTLLGSFLFHGDDVFKPVDTLSGGERSRISLLKLILSKSNFLLLDEPTNHLDIDSKEVLEESLVDYDGTVFAISHDRYFLNRVATKVIELSTNGIEVFHGNYDYYIEKKKEQLLMAEPATYQEQTKTHLKDVRRKERDERNRLKQETQQREKIETDILELEERLNALESLMCQEDIYTDPQKSREVHQETLTTKQSLEKLYEEWENSVDN

SEQ ID NO: 56440 - protein, 359 aa, Magnetococcus sp. MC-1
MAKKVLVLPGDGIGQEITAEAVKVLNWAIQNGADITLEEGLIGGTAYDATGTPLPAETITQAKAAQAVLLGAVGGTKWEPLDISVRPEKGLLGIRKALDLYCNLRPAAVYPQLADASTLKKEVVAGIDIMVVRELSSGIYFGQPRGVEDLGDGRKKGFNTLVYTTDEIERIARKAFEAARKRSNRVCSVDKANVLESTELWREVVSDLHKREYADVELSHMYVDNAAMQLIRNPRQFDVIVTTNMFGDILSDAASMLTGSIGMLPSASLGDQFALYEPIHGSAPDIAGKGIANPLATILSVAMMLRYSLELPQLADGVEAAVVTVLDQGLRTADIMQPGMTQVGTAQMGDAVLAALNNA

SEQ ID NO: 56441 - protein, 250 aa, Legionella pneumophila str. Lens
MTNQKQTTHFGFKSVDWNEKEKKVAEVFHSVAKNYDRMNDLMSLGIHHLWKRYTIELSHVRPGQSVLDLAGGSGDLTRLLSQKVGDSGQVILADINAAMLHVGRDRLLDEGLFKNIRYVQGNAQCLPFADNSFHCITMGFGLRNVTDKDEALQSMYRVCKPGGKLMVLEFSTPVFPGLKPVYDWYSFNILPKIGKFVANDEASYQYLAESIRMHPDQETLKAMIERVGFEDCHYHNLSGGIVALHIAYKY

SEQ ID NO: 56442 - protein, 199 aa, Zea mays
  misc_feature (76)..(76): Xaa can be any naturally occurring amino acid
MSTATATLAAARSPAVALLSLRRRAPAAAPIRFPGLRVGSGCRHIAMASAAHSRAPTDPLPKGADLFFRAVISNMXKVNGYGINSLSDFFTDFGYLPREELRFPAKKLRALWFSPPTNDGYSGTGTYGPLPRIFISELLVDELTTQSQRKSKGDQESQISHIDYSFVTKVIVDIGRDPNHTLARVKLMGEGGQFTYILF

SEQ ID NO: 56443 - protein, 518 aa, Vigna unguiculata
MATSLSFSPSLSLNTLFFSKTLPFPRSSFLRRPLSKSLIPIFTRRCTFSVRAESQNGAEPVAVHYDFDLFTIGAGSGGVRAARFAANNGASVAICELPFSTVASETTGGVGGTCVIRGCVPKKLLVYASKFSHEFEESHGFGWSYDSEPKHDWSSLIANKNAELQRLTGIYKNILNNAGVKLIEGHGKIIDAHTVDVNGKQYSAKHILVSVGGRPFIPDIPGKEYAIDSDIALDLPSQPGKIAIVGGGYIALEFAGIFNGLKSDVHLFIRQKKVLRGFDEEIRDFVGEQMSLRGITMNGFSHIMFATGRRPNTKNLGLESAGVKLAKDGSIEVDEYSQTSVPSIWAVGDVTNRINLTPVALMEAGAIVKTLFQDNPTKPDYRTVPSAVFSQPPIGQVGLTEEQAVQQYGDIDIFTADFRPLKSTLSGLPDRVFMKVVVSAKTNKVLGLHMCGEDAPEIIQGFAIAIKAGLTKADFDATVGIHPSAAEEFVTMRTPTRRIRKSQSSEGKSGSVKATAGV

SEQ ID NO: 56444 - protein, 127 aa, Wolbachia endosymbiont of Drosophila melanogaster
MSYNEKILDHYENPRNVGSLDKNDPNVGTGLVGAPSCGDVMKLQIKVNDKGVIEDAKFKTFGCGSAIASSSLLTEMIKGRTISDVTQIKNTQIVEELSLPPVKIHCSVLAEDAIKAAIHDYQSKQKN

SEQ ID NO: 56445 - protein, 163 aa, Mycobacterium smegmatis str. MC2 155
MMLPRVGLGTDVHPIEAGRPCRLLCLEFDDADGCAGHSDGDVAAHALCDALLSAAGLGDLGTIFGTDRPQWRGASGADMIRHVRGLVENAGFVIGNATVQVIGNRPKVGPRREEAQQVLSELVGAPVSVSATTTDGLGLTGRGEGLAAIATALVAAEPVGDAK

SEQ ID NO: 56446 - protein, 289 aa, Legionella pneumophila str. Lens
MSDYLDKTASLTPATKRIVCDKATEYPHTGSYNQVATHGTYLCRRCGLALFRGVSQFSSGCGWPSFDDEIANAVARKPDADGQRTEILCARCDAHLGHVFTGEYMTYKNLRHCVNSASLDFVADNEVLDTEEAILAGGCFWGVEYYLKRIPGVLKVESGYTGGHVSEPSYEQVCSGTSGHYEAVRVVYDAAKTNYHDIVKRFFEIHDPTQANGQGPDLGHQYLSAVFYFNQEQRQEAELLIQLLKKRGYQVVTQLLQTQSFWPAEDYHQDYYFKHHKIPYCHKSVDRFG

SEQ ID NO: 56447 - protein, 295 aa, Wolbachia endosymbiont of Drosophila melanogaster
MNKRRNLLNISDLTVDDVENITKLANQYLKKEVANSHILENKTVINLFFEDSTRTLASFEIAAKSLGANVVTLPIRSSSINKGEDLKDMIKTLNAMNPDYIIIRHKSSGIINTLAKYVNCSLINAGDGSSEHPTQALADYLVISNHKKQIKDLKVVICGDILHSRVARSNIRLLKMFGAEINLVAPPTLICKHFPEVDSVHYSLIEGIKDADVIMLLRLQKERMNNSSSEKEYFYLYGLDSQKLSYAKPDAIVMHPGPINRGIEISSDVADCVILQQVEFGLAIRKAVLHYYRPC

SEQ ID NO: 56448 - protein, 329 aa, Bacillus cereus ATCC 10987
MIDNFWRDLPRPFFVLAPMEDVTDVVFRHVVSEAGRPDVFFTEFTNSDSYCHPEGMKSVRGRLIFTEDEQPMVAHIWGDNPEYFRQMSIGMAELGFKGIDINMGCPVPNVASRGKGSGLILRPDVAAELIQAAKAGGLPVSVKTRLGFKELSEWEDWLTHIFKQDIANLSIHLRTREEMSQVDAHWELIPEIKKLRDRIAPNTLLTINGDIPDRKTGLELAEKYGIDGVMIGRGIFKNPFAFEKEPREHSSKEHLDLLRLQLDLQDQYAEVLPRSITGLHRFFKIYVKGFPGAAELRNQLMSTKSTDEVRTLLNQFEASVSETQGSETV

SEQ ID NO: 56449 - protein, 549 aa, Oryza sativa
MAAAAARRGSSLLSRCLLSRPAAAASPAVPSALRRADGTQGLLPGILQRFSTAAVAEEPISPPVQVNYTQLLIDGKFVDSASGKTFPTLDPRTGELIAHVAEGDAEDINRAVHAARKAFDEGPWPKMTAYERSRILLRFADLIEKHNDEIAALETWDNGKPYAQAAQIEVPMVARLMRYYAGWADKIHGLVVPADGPHHVQVLHEPIGVAGQIIPWNFPLLMFAWKVGPALACGNTVVLKTAEQTPLSALFASKLLHEAGLPDGVVNVVSGFGPTAGAALASHMDVDKIAFTGSTDTGKVVLELAARSNLKSVTLELGGKSPFIIMDDADVDHAVELAHFALFFNQGQCCCAGSRTFVHERIYDEFVEKAKARALKRVVGDPFKNGVEQGPQIDDEQFNKILRYIKYGVDSGANLVTGGDRLGDKGYYIQPTIFSDVQDNMRIAQEEIFGPVQSILKFNDLNEVIKRANASQYGLAAGVFTNNLNTANTLTRALRVGTVWVNCFDVFDAAIPFGGYKQSGIGREKGIDSLKNYLQVKAVVTPIKNAAWL

SEQ ID NO: 56450 - protein, 290 aa, Streptococcus thermophilus LMG 18311
MTKLKKIDAAIRDFYQKKTPPVSSDLIIAILYSVDSGGKRIRPLIFLDLLEGFGLELTPSHFDVAASLEMIHTGSLIHDDLPAMDNDDYRRGRLTNHKKFDEATAILAGDSLFLDPFALVAQTELSAEIRVQLIHALSHASGTFGMVGGQMLDMKGEGLELDLSQLAKIHENKTGKLLTFPFVAAGIVAQQEDRVMENLQEAGRLIGLAFQVRDDILDVTADFESLGKTPGKDVVAGKSTYPALLGLEKSYAILEESLNKAEAIFKDLAEYQGFKQDNIMKIIERLRFHA

SEQ ID NO: 56451 - protein, 170 aa, Ustilago maydis 521
MSSLWIINKAGGLIYQSEHFVHPNAASMRNNGRLSSNEYLVLAGTLHGIHAITAKLNPVLGRKCSGIESLESDHFTIRVMVTSTGKSVGLLVQAQKLKVADKRLEMLFVCNVTGTKFVLVTSPAHPNPSGVLHKCYETYADHVMKNPFYTPEMPVRVETFDKAIETLVKA

SEQ ID NO: 56452 - protein, 175 aa, Triticum aestivum
MAPPVWALWATSVVPFQGLKSTAGLPVSPRFHGGSLGSVSNGGRIRCMQVCPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQWVSFIAFKPPGCEESGKA

SEQ ID NO: 56453 - protein, 248 aa, Burkholderia sp. 383
MYKLVLIRHGESTWNKENRFTGWVDVDLTEQGRNEAYQAGELLKEAGYTFDIAYTSVLKRAIRTLWHVQDKMDLMYLPVVHSWRLNERHYGALSGLNKAETAAKFGDDQVLVWRRSYDTPPPALEATDERAPFNDPRYAKVPREQLPLTECLKDTVARVLPLWNESIAPAVRAGKQVLIAAHGNSLRALIKYLDGISDSDIVGLNIPNGVPLVYELDENLKPIKHYYLGDQDAIAQAQAAVAKQGKAG

SEQ ID NO: 56454 - protein, 443 aa, Vibrio sp. Ex25
MSYVFHRHCHATLPIIDKGEGVYLFDKQGKQYLDACGGAAVSNLGHSHQAVKKAMLEQLERVPFAHTGFFTSDSGERLAELICQYMPEQFNHVYLVSGGSEAVESALKMARQHFVESGKPEKKQFIARQQSYHGNTLGALAVGGNEWRREPFKPILHPSHHIAPCYAYRYQQTHESELDYSLRTANELEAKILELGAENVMAFVAEPIVGATAGAVPATQGYFKRIREICDQYDVLLILDEVMCGVGRSGSFFAFEQEEAEPDLVCMAKGLGAGYQPIGAVVANDRVYQAIADGSGFFQHGHTFMAHPVACAAAVATIETIFQDDLLTAVNQHSVLLRNELTSALAHLPYIGDIRGKGLFVGIELVADKESKSPLSKATLADKRIKQRAMENGLMCYPMGGTIDGVNGHHILLAPPFIVQPHHIDELVGKLSLTLKEVAETWK

SEQ ID NO: 56455 - protein, 170 aa, Helicobacter pylori
GSGMHTHVSVWKNKENLFSGETYKGLSGLALHFLGGVLRHARGLAAFTNASTNSYKRLIPGYEAPSILTYSANNRSASVRIPYGISKNSARFEFRFPDSSSNPYLAFAAILMAGMDGVKNKMDPGEAMDINLFKLTLDEIREKGIKQMPHTLRRSLEEMLADKQYLKEGQ

SEQ ID NO: 56456 - protein, 549 aa, Helianthus tuberosus
MVFDMGLMFEKMGSSTLATSEYSSVVSMNLFVALLCGCIVLGHLLEENRWMNESITALLIGLCTGVVILLISGGTSSHLLVFSEDLFFIYLLPPIIFNAGFQVKKKQFFRNFMTIVLFGAVGTMISFTIISFAAIKIFKKMNIGELELGDYLAIGAIFSATDSVCTLQVLNQDQTPLLYSLVFGEGVVNDATSVVIFNAVQNFDLSRITTAIAFQLLGNFFYLFITSTLLGAGAGLLSAYIIKKLYFGRHSTDREVAIMILMAYLSYMLAELFSLSGILTVFFCGIVMSHYTWHNVTEKSRVTTKHAFATFSFIAELFIFLYVGMDALDIEKWSFVKDSPGTSAEVSAILLGLVLVGRAAFVFPLSFLSNLTKKAQHEKIDFRQQVLIWWAGLMRGAVSMALAYNQFTKEGHTTMPGNAIMITSTITVVLFSTMVFGLITQPLVRLLLPAPKNLNRMISSEPSSPKSFIVPLLGNGQDSIDNMPRPSSLRMLLATPSHTVHYYWRKFDNAFMRPVFGGRGFVPFIPGSPTEQSLHQSAHHLVDEETTGN

SEQ ID NO: 56457 - protein, 479 aa, Polaromonas sp. JS666
MFKNLINGDWVEAPGVTRNINPSDTRDLIGEYAKADAAQTKDAIAAAQAAFPAWSLSTPQQRFDILDAVGSEILARRNELGDLLAREEGKTLPEAIGEVARAGNIFKFFAGEALRPGGEVLPSVRPGVGVEITREPVGVVGIITPWNFPIAIPAWKIAPALAYGNCVVFKPAELVPGSAWALADILSRSGLPKGVFNLVMGPGSQVGATLLDDARIAAITFTGSVGTGKRVAAACVGRMAKFQLEMGGKNPMVVLDDADLGVAVNCAVQSGFFSTGQRCTASSRVIVTEGIHDRFVAAVVEKLRSLKVDDARKTGTDLGPVVDASQLAQNLKYVEIARGEGATLAYGGDALEHNADGQPGFYMRPALFTDTTAGMRINGEEVFGPVVSVLRAKNYDEALHLANDTPFGLAAGIATTSLKYATHFKRHSQAGMVMVNLPTAGVDYHVPFGGRKGSSYGPREQGRYAAEFYTTVKTAYTQA

SEQ ID NO: 56458 - protein, 708 aa, Deinococcus radiodurans R1
MGRHHKQEALPMTQDTPNRVDQSRDGDVFILTINNPPVNAFGPGVPEGLKAGLDAAAADDSVKAVVIIGGGRTFVAGADIKGFGLPREQAPDLRGTVAKLDAFEKPTVAAIHGTALGGGLELALGCTYRVAVKDAQLGLPEVKLGVLPGAGGTQRLPRVVGAQKALEMMLSGNPIKAPAAKELGLVDEIVDGDLLAGAVAFARAHADARPLPRVSERSVEGGSPEVFAAAREGLKKTHRGQHSPSHIVDLAEMAATKPFQEGWDAEADRFVDSLNSPQSRGLRHIFFAEREAGKIRGLSKDTPTTDIKSAGIIGAGTMGGGIAMNFLNVGIPVTIVETSQEALDRGLGVIRKNYENTAKKGRMTQDDVEKRMGLLTPTLKMEDLAGADIIIEAVFENMDVKKDIFTRLDKIAKPGAILASNTSTLDVNEIASVTGRPEQVIGLHFFSPANVMKLLEIVRADKTSDSVLATSLALAKRIKKVGVVVGVCDGFVGNRMVHRYGDEARKIVEEGARPEDVDAAMNALGLPMGPFQMSDMAGLDIGYSIRQHQAKVRGEPEPDGWLDRIVKTGRKGQKTQGGIYDYGEDRKPKPNADVQKLIEDYRAEQGTQSREISQEEITKRLAYSLVNEGAKILEEGIAQRASDIDVIYIYGYGFPAYRGGPMQYASEQGLKNVAADLEKYGQTPAPVLKQLADEGKTFSDYDREHAGA

SEQ ID NO: 56459 - protein, 577 aa, Chlorobium tepidum TLS
MNAESNPILDFATEYVYPAFSELTGTDKIVAFGDHSHKCPIYVPQTPPCTAECPAGEDIRAINRFLNGTDPSDDPLKSAWETATDTNPFPAVMGRICPHPCQSKCNRGVHDESVAINAVEQVLGNYGIEHNLKLKGPGADTGKRVAIIGGGPAGLSAAYQLRRKGHAVTIYDANEKLGGMVLYGIMGYRVDRKVLEAEIGRIIELGVETKMGVTIGKDITLEQLEAEYDAVFIAVGAQKGRALPVPGFEGTPGATNAIDFLKSYEVLGDDIPVGKHVVVIGDGNVAMDVARLALRLGSQATIISGVPREEMACFENEFDDAKNEGTTMHFLTGTVEVLGGASGVTGLRCTKMVKKEKGEEGWNSPIPFLRYKSNGESFEIEADMVVAAIGQATDLSGLGSAASGPWLKVDRNFRIPGREKLFGGGDALKVDLITTAVGHGRKAAYAIDAFLKGEPMPEEPYREITKPHKQDLLYFLHTPQAKRTSIKPEVVVGNHDELLEALTPEQAITESKRCMSCGFCFDCKQCVSFCPQEAITRFRDNPAGEKVYTDYTKCVGCHLCSLVCPCGYIQMGMGDGL

SEQ ID NO: 56460 - protein, 475 aa, Hyphomonas neptunium ATCC 15444
MQNSPPPHAAPSSRPFLRIAESFADAVEPADFPAALLRWRNQRWAAETGLGDLTDAAWIAHFARFSPLPGNLPQPLAMRYHGHQFGTYNPQLGDGRGFLFAQVRDKAGRLLDLGTKGSGQTPWSRQGDGRLTLKGGVREILAASYLEALGVNTSKAFSLIETGEQLSRNDEPSPTRSSVLVRLSHSHVRFGTFQRCAWMEDRESMARLVDYCVAEFYPDADDPDMARKTCKLLENIALKTGRMIGQWMAAGFVHGVMNTDNFNITGETFDFGPWRFLPVSDPNFTAAYFDSQGLYRFGRQPVQGGWALQQLASAMLLLAEADDLAKSLAPYEEAYRNSFAAHTHALLGIKPEGDISADITFLQAFYGWMTESGANWPQTFFDWFGGAASETRAAASPQADLYRAAAFGPVRDILMAREAVRPERLATAYFQKPAPVSLIIEEVEALWSPIAEADDWSGFNAKVSHIEEARVALAL

SEQ ID NO: 56461 - protein, 170 aa, Helicobacter pylori
GSGMHTHVSVWKNNENLFSGETYKGLSEFALHFLGGVLRHARGLAAFTNASTNSYKRLIPGYEAPSILTYSANNRSASVRIPYGISKNSARFEFRFPDSSSNPYLAFAAILMAGMDGVKNKMDPGEAMDINLFKLTLDEIREKGIKQMPHTLRRSLEEMLADKQYLKESQ

SEQ ID NO: 56462 - protein, 908 aa, Saccharomyces cerevisiae YJM789
MAKNNHISASGNSTSGDHRLKEEVLTPTTSASTPHRIFSVDDDPKEIQNDIRYLEGLHEGLKFALHANKSKRSVSSQSPIVHSSNNTLHHHEHQQHLPPTLESLSSKSHSVPDLNTATPSSPKRMHSSIRELPHDDNDDEDANDDSRFIIHDSHGHDLLIDEINCQSPSHLENNDQASNASSTESFTLRERQDAINETHPFGIRIWKPALYKKHRSVQRTAAQDIHETQLKTITWEVTCSNVLWFILFGFPIAILFYSAAIVVFLLGGGGLVTNSAKEYSKCLYKLANYFLWPFGKMVYLLQDEQYLQEDKDEGISMQQFYNWVTSYSNRLVFHQSQAKFQQREDHPAPATESSSLMPPANTTATPLNSNHPSYNSIRHEIPHAAAQRRYFGRGKWSWGRVLFYTIFHLVLQPILAVLSLCLWLLVFTIPMSNVLWQIMYHCRRHPLALGFKYVENSSQSHENEITQQQLNKNILLCTFRAAGWHYYKYTVDGTNVIVVNLISIVFFTIFDFYVLKNFLHWKTWFTYESSIFILCLTSTIPLAFYIGQAVASISAQTSMGVGAVINAFFSTIVEIFLYCVALQQKKGLLVEGSMIGSILGAVLLLPGLSMCGGALNRKTQRYNPASAGVSSALLIFSMIVMFVPTVLYEIYGGYSVNCADGANDRDCTFSHPPLKFNRLFTHVIQPMSISCAIVLFCAYIIGLWFTLRTHAKMIWQLPIADPTSTAPEQQEQNSHDAPNWSRSKSTCILLMSTLLYAIIAEILVSCVDAVLEDIPSLNPKFLGLTIFALVPNTTEFLNAISFAIHGNVALSMEIGSAYALQVCLLQIPSLVIYSIFYTWNVKKSMINIRTQMFPLVFPRWDIFGAMTSVFMFTYLYAEGKSNYFKGSMLILLYIIIVVGFYFQGALSE

SEQ ID NO: 56463 - protein, 170 aa, Helicobacter pylori
GSGMHTHVSVWKNNENLFSGETYKGLSGLALHFLGGVLHHARGLAAFTNASTNSYKRLIPGYEAPSILTYSANNRSASVRIPYGISKNSARFEFRFPDSSSNPYLAFGAILMAGIDGVKNKIDPGEAMDINLFKLTLDEIREKGIKQMPHTLRRSLEEMLADKQYLKEGQ

SEQ ID NO: 56464 - protein, 417 aa, Alkaliphilus metalliredigens QYMF
MSEKTLNPFEIAQQQVKGACDKLGVEDAVYEILKNPMRVMEVAIPVKMDDGSLKSFVGYRSQHNDAVGPFKGGVRFHQDVNRDEVKALSTWMTFKCGVVGVPYGGGKGGITVDPRDLSQGELQRLSRGYARAIAPIIGEKVDIPAPDVGTNGQVMSWFIDEYQKTTGEFAPGVFTGKPVDFYGSLARNEATGFGVAIMARDAAKKIGLSLNGATVAIQGFGNVGSFAAIYMVGMGAKVTAISDHTACIFDENGLDIDALIEYVKGNKQVQGFPGAQKELHRDELFGMDVDILMPCALENQITLKNVNDIKAKIVSEGANGPTTPEADKIMYDKGIIVVPDILANAGGVTVSYFEWVQNLMRYSWSFEEVQEKQEKLMVKSFDDIWTLMHEHNVDMRTAGYMMSIKRIATAMKYRGWY

SEQ ID NO: 56465 - protein, 170 aa, Helicobacter pylori
GSGMHTHVSVWKNNENLFSGETYKGLSEFALHFLGGVLCHARGLAAFTNASTNSYKRLIPGYEAPSILTYSANNRSASVRIPYGISKNSARFEFRFPDSSSNPYLAFAAILMAGMDGVKNKMDPGEAMDINLFKLTLDEIREKGIKQMPHTLRRSLEEMLADKQYLKEGQ

SEQ ID NO: 56466 - protein, 329 aa, Arabidopsis thaliana
MAIRSLPSSSGCSNSSSSSSYSLASTSLSNRLETIFRKASELCTLCDIEACVIYYGPDGELKTWPPEREKVEDIALRYSQLNEALRRKKSVTLYDFLNKKKNKTNLEKKAKIKDNDLKRLSLEPHVSKVRERIRFVESQKHKETKPDHQSLASSSLNNQTQSLNPSQFSLFMYNHGDNILSQIPVSASNFNQDYFSALLEQSELKSQIMKQEVCGYEQNMCMSNNGDATLSQIPLSASNFNQEFSALLQEESGLMQQELCNYDQNMFMNNNNFQHSFVSNTQDHSAPAVQESVNNNYGLMPHVPCGYDQNLFTSDITNNNLLIDNSMFL

SEQ ID NO: 56467 - protein, 389 aa, Nocardia farcinica IFM 10152
MSRESRRSTIPPFYVMDVWKAAAERARTHGDVLVLAAGQPSTPAPAPVLRATKAAIDAELLGYTETFGILPLRRAIAEHHSRTYGYAVDPDDVVVTTGSSGAFTLIFLAAFDAGDTVVVARPGYPAYRNTLTALGCRVVELDCGPDTRFQPTVAMLDALPEPPAGLIVASPANPTGTMIDPAELAALARWCDEHGTLLVSDEIYHGITYGSAGADARTASAWETSRTAVVIGSVSKYFSMTGWRLGWMLAPADLRPALQRLASNMTVCPPAISQYAAVHAFGAEAKAELDGHVGRYATNRRLLLDGLAALGITDLAPADGAFYAYADIGHLTDDSLKWCAELLGQTGVALAPGIDFDTVAGHRFVRFSFAGATAEIEEALARLGRHLAS

SEQ ID NO: 56468 - protein, 401 aa, Prochlorococcus marinus str. AS9601
MTPERLGLLWGITVFAGACARLFSSFTGFPSVVILLLSGLLIGRSGLGLVEPLDLGQGLETIVGLLVCLVLFEGGLNLKLPEGNIRNTVLKISLVRLFISLSAGIFIAHWLAGLSWQVAGIYSAIVLATGPTVVSPLVEQIKLASPLSEVLKAEGLLLEPIGAVLALLLLELTLGDLRGINDVFIALMQRLGGGVLIGLNAGWLLSEILKKIKNEASFGIELQVTLGFIFLVYGICEYFLPESGLPASVASGFIVGKREVIDKERLDNLIGELAQLAITVLFPLLAADVSWGELSPLGWGGFVCVFMLMVIVRPISIWIATMGRDLNLKEKIFLAWLAPRGIVTAAVASLFSIRLEQAGILGAGRLQGLVFLTILMTVGIQGLSAKPLVNRLKLGQKNNFD

SEQ ID NO: 56469 - protein, 1428 aa, Cryptococcus neoformans var. neoformans B-3501A
MSTPTRSRSQSLNDDSSSPSSPTPTIRNTTPARPPTASQVFAAAVAASPGPAPGRAASQPGMDRRQSGQQQQQELGKGRPGRDDPRTAATPSQLRGNYSPARASISSTEDEDYLKPNSPPRTAVPGNTTFESTPRGWGGGSSRGVPQTAFGSSFGSPTAFFSQPAREASSGGTHRVGRGARFANSRDPSQTVTNPGGSSSRSASRARPPLQHHHSILRDSPNLDDDELQDRGAELIKQRQRERKAKRKKLELEQQRRLAEEGTTLETSNPPSGVPGEGFVAQQGGLSRGPVPTSRIRNPSATRRPTSEGNFPYPPSVSDGETPRDGGMSPKEDARAPSVYSSAADEEAEEQLDERVSIVGEIVNDVVEEETGGDVDKCDSDEGEESGQDEGVTMKDRQDAINIEHPFGLPIWKPALYRKSRSVTRNAESALHSIPSAAAERHLLPGNILWTALFGWWLAIACFMAAVLVTGAEALGCGRGGYGKTLRGLAWYIGWPFGKYVEGEGAPDDDHEHDEHVVGDEEQANGNYQALDGASPISKRQRAREVSDSSSSNVTVRHAQDSAPVNAPDSPDATSASTMRANNERHAVSFASGVKGKGRDSVTERSSLLGKNGFRRPKNKRAKKLGQLFYWPGFCLIVAPTMLLVCILCWGFVITIPMAKLTWELLNLLWYRPLEINFRPAPKVPVPTPASSSDNVHDDTNGSGSSTAVGDSPTNFTLKRARLTAGQVAPTSGPTSTVLLCTYRAVGLQYYKYTVGGVNIMFINLLPLVFFTIIDGLLLLPAVERKEHLGRPIAPLLRLLTSQALLFVLALASVIPLSYFIGMAVASISAQSSIGMGAVINATFGSIIEIILYSIALTQGKGRLVEGSIVGSILAGVLLMPGASMCSGAFKRKEQKFNAKSAGVTSTMLIMAIIGTLTPTMFYQTYGSFELHCQDCPSGHPNRTITLPEGGMSLEPGDMWMCDHCYYEHPDPERDPFYQENVKTLMYACAAILLFSYLIGLWFSLRTHAAQIWQNPQQLMKSEEAQAVSEVHPALKSTLAQRITPQALMQHVLPLHKSNNPPATSSANPVIPPVVPVGTNEGSVPATVSPKTGTLRLAPSGLTKDGADHTANITPGHSQQSSHADGIETSRPSPSTSQAFTLPAGYTPYLESIDQVTKSNLTPMRLPGTLTTEDFTRAVAVATVSALRHQGSIVESERKRRHVVGEGPVGVEQGGGVSKEEEGHEKGGGHEAPSWTRGVSAGVLLGCTMLYAIIAEILVDVVDVVLHGSGIDEKFLGLTLFALVPNTTEFMNAMSFALNGNIALSMEIGSAYALQVCLLQIPAMVAFSALYQPEKMGDVIDTFTLIFPRWDVIAIILSIFLLTYTYIEARSNYHRGSILVLAYIVLIMGFYYAPPRAQDDTDHDTIFGQESLESFNAGWTTALTKLWV

SEQ ID NO: 56470 - protein, 247 aa, Mycobacterium smegmatis str. MC2 155
MATLILLRHGESQWNEKNLFTGWVDVDLTDKGRAEAVRGGQLMAEQGVLPDVLYTSLLRRAITTAHLALDAADRLWIPVHRDWRLNERHYGALQGLDKAETKEKYGEEQFMAWRRSYDTPPPPIEKGSKYSQDADPRYADIDGGPLTECLKDVVERFVPYYESAILPDLKAGKTVLIAAHGNSLRALVKYLDGMSDEEVVGLNIPTGIPLRYDLDENLKPVKIGGEYLDPEAAAAGAAAVAAQGAKK

SEQ ID NO: 56471 - protein, 585 aa, Mycobacterium smegmatis str. MC2 155
MAISVQMPALGESVTEGTVTRWLKQEGDTVELDEPLLEVSTDKVDTEIPSPAAGVLTKIVAQEDDTVEIGGELAVIGEAGEASAEAPSEDSAPAPEPEPEPEPEPQQTQPTAAPAESVESAPAESSAPSQGGGSATPILMPELGESVTEGTVTRWLKNVGDKVEVDEPIVEVSTDKVDTEIPSPVAGTLLSITANEDDVVEVGGELAKIGDAGAAAEPKPEPKPEPKAEPKPEPKPEPKPEPKAEPKPEPKPEPKPEPKAEPAPAASSDGSPYVTPLVRKLAAENGIDLSTVKGTGVGGRIRKQDVLAAAEKAKEAKQAPAASPAAAAPAAPAAASATPAPALAHLRGTTQKANRIRQITAKKTRESLQATAQLTQTHEVDMTKIVALRARAKAEFAEREGVNLTFLPFIARAVIDALKIHPNVNASYNEDTKEITYYDAEHLGFAVDTDQGLLSPVIHNAGDLSLGGLARAIADIAARARSGNLKPDELAGGTFTITNIGSQGALFDTPILVPPQAAMLGTGAIVKRPRVIVDEYGNESIGVRSVCYLPLTYDHRLIDGADAGRFLTTIKRRLEEGAFEADLGL

SEQ ID NO: 56472 - protein, 511 aa, Psychrobacter arcticus 273-4
MTDSDQNNQVQTIHPSYDEHNEHNEHNEHNEHNEHNEHNEHEGLSIIKTVADMQSQFLRLQNLSRTQPINDWATRRDQLDNLELMLSDNQQLLANAISADFGYRSESETQFAELFPSFTGISHAKKHGKRWMKAQRVSSSALYMPAHNEILPQPLGVVGIMVPWNYPLFLAIGPMIDALTAGNRIMIKMSEAAPQFAQTFAETISRYFSADMVCVVIGEVEIAAAFSKLPFDHLLYTGSTAVGKKVMAAAAPNLTPVTLELGGKSPVIVLEGANLENAVNRVMMGKTLNAGQTCIAPDYVLIQRQYHDEFVRLAKEWMEKHYPNIESNPDYSRIINAQQFKRVKGYLDSLSGEGIHRLTDAEASIETRLMPPVIVSEPAPESDVMQNEIFAPVLPLMHYDTLDNAIAFINARPRPLALYVFGDNNRDIDKVRTNTVSGGLCINEVIMHVAQHDLPFGGVGDSGTGAYHGKAGFERLSHMKPIFVQSKLNGLNILLPPYGGLFKKAMALFLK

SEQ ID NO: 56473 - protein, 279 aa, Prochlorococcus marinus str. AS9601
MRHFADLLLNKNNSKANDQVPFIQRRRGIEIKSSREINLMKKSSRIVATVLREINDLIKPGMSTKDLDDFAEKRIKSFGAVPSFKGYHGFPSSICSSINNEVVHGIPSKNKIIKNGDLVKIDTGAYLDGFHGDSCISICVGEVSPKAQKLSDVAFKALYAGLSKIKAGNTLLDVAGEIEDVVVKNGFSVVEDYTGHGVGRNLHEEPSVFNFRTKELPNVVLREGMTLAVEPIVNEGTKFCKTLNDRWTVITKDGKLSAQWEHTIVVLKDGIEILTDRDF

SEQ ID NO: 56474 - protein, 172 aa, Streptococcus thermophilus LMG 18311
MKLEDYIATIENYPKEGVTFRDISPLMADGNAYSYAIREIVQYATDKKIDMIVGPEARGFIVGCPVAFELGIGFAPVRKPGKLPRKVISVDYEKEYGVDTLCMHADAIKPGQRVLIVDDLLATGGTVKATIEMIERLGGVVAGCAFLIELDGLNGREAIEGYDAKVLMNFPG

SEQ ID NO: 56475 - protein, 176 aa, Psychrobacter arcticus 273-4
MADFNKILDAGDVDGGIINVVVEIPTGSSHKIEWNRELAVFELDRVDPQIFAKPCNYGFIPQTLDEDGDELDALIITEQPLPTGIFLKAKVIGVMKFVDDGEVDDKIVVVPADDRDTGNAYNSLADLPKQLINQLEFHFSHYKDLKKPGTTVVESWGDVEEAKEVIKESIQRWKDL

SEQ ID NO: 56476 - protein, 295 aa, Psychrobacter arcticus 273-4
MANPSKKAISKAVQDKNIIITGASSGIGERTAFLLSECGAHVILLARTEEKLKAVKEGIEELGGRASYYPCDLTNMDEIETVSAQILADFGHVDVLINNAGRSIRRSVHESTERFHDFVRTMDVNYFGAVKIILGFLPTMIERQTGQIVNISSIGVLANSPRFAAYVASKSALDAFSRCLAAEVKGDNVTITNIFMPLVRTPMIEPTKLYRYMPALMPDEAAMMVAKAIVHKPNSIASNMGKFASATYSLAPAINVGIQSMGYRIFPSTRAGLTTDKKPNLAQRAFARILPGEYH

SEQ ID NO: 56477 - protein, 158 aa, Streptococcus thermophilus
MRRMLTAKLQNRSGVLNRFTGVLSRRQVNIESISVEQRKILMFHVLQFIIDVNSHNEVEQIIKQLNRQIDVIRIRDITDVPHLEREVILVKVSAPTSKRAEILAIIQPFRASVVDVAPSSITIQMTGDAEKSEALLRVIRPYGIKNIARTGATGFTRD

SEQ ID NO: 56478 - protein, 202 aa, Brassica napus
  misc_feature (182)..(182): Xaa can be any naturally occurring amino acid
MTNYGSIPTSSHPSPPIDLEYISRAKHRIKSGLATRRPWKTMFDLQSTNLPHGFFDAISRIKTNLVYFRANYAVVVLLVLFLSLVYHPTSLLVLAVLVVFWIFLYFLRDEPLVVFRHQIDDRTVMICLSVLTIVMLLFTHATANVLGAVATAVVLVLVHAAVRRSDNLYLDEEAAAATEASXGLTSYPSTNKPICYFLLLFM

SEQ ID NO: 56479 - protein, 351 aa, Gordonia sp. TY-5
MKALVFHGPGQKAWEDVPDPKLSEPTDVIVKMDTTTICGTDLHILKGDVPAVTPGRILGHEGVGTITEVGDAVTTLAVGDQVILSCISSCGKCSFCKQGVYSHCLGSEGTSGIGWIFGHLIDGTQAEYVRVPYAENSVHKLPSAVSPEQGTLLSDILPTGHEIGVRHGAVKPGDVVAVIGTGPVGLAAIATAGLYGPSRVIAVDIDANRVEQARRFGATDGVVSTSSGWREEILAMTDGLGVDVAIEAVGIPDTFQMCLDIVRPAGHVANVGVHGKPVELPIQDLWISNIVMSMGLVNTNTLGTLLKLVAQRRIDPEPFISHRFGLGEIIDAYDVFSRAAETKALKVIMSA

SEQ ID NO: 56480 - protein, 373 aa, Acinetobacter sp. ADP1
MPLSHVEALVEDIRAGKMVILMDDEDRENEGDLVMAATHVRPEDINFMITHARGLVCLTLSRERCQQLNLPLMVDHNGAQHATNFTLSIEAAEGITTGISAAERAHTIRTAVAAHAKPSDIVQPGHIFPLMAQPGGVLHRAGHTEAGCDLTRLAGLEPASVICEIINEDGTMARREDLEVFAEKHGLKIGTIADLIHYRMTNEQTVERLGQQTIETDYGSFELYRYREIGNPDIHLALVKGEPKDGVTTVRVHGFNPTRDLLKLKKQDGEPAWNLDRALQSIASAERGVLVWIGQNHLQDLGPALESLTQPKPLKSNAALSHQYQTIGVGAQILRDLGVEKMKLLSSPLRFNALSGFNLEVVEYITADQTIEN

SEQ ID NO: 56481 - protein, 334 aa, Saccharomyces cerevisiae YJM789
MASKTLRVLFLGPKGTYSHQAALQQFQSTSDVEYLPAASIPQCFNQLENDTSIDYSVVPLENSTNGQVVFSYDLLRDRMIKKALSSPAPADTNRITPDIEVMAEQYVPITHCLISPIQLPNGIASLGNFEEIIIHSHPQVWGQVECYLSSMAEKFPQVTFKRVDCSSTSESVNQCIRSSTADCDNILHLAIASETAAQLHKAYIIEHSINDKLGNTTRFLVLKRRENAGDNEVEDTGLPRVNLLTFTTRQDDPGSLVDVLNILKIHSLNMCSINSRPFHLDEHDRNWRYLFFIEYYTEKNTPKNKEKFYEDISDKSKQWCLWGTFPRNERYYHK

SEQ ID NO: 56482 - protein, 507 aa, Gordonia sp. TY-5
MTVYAKPGTEGSVMSFESRYDNWIGGQWTPPVKGQYFENPSPVDGKTFCEVARSTAEDIDLALDAAHKAAPQWGKTSVAERSLVLLRIADRLEENLEKIAVAETWDNGKAVRETLAADIPLAVDHFRYFAGALRAQEGSISEVDEDTVAYHFHEPLGVVGQIIPWNFPILMAVWKLAPALAAGNAVVLKPAEQTPASILYVMSLIADLLPAGVINIVNGFGVEAGKPLASSNRIRKIAFTGETTTGRLIMQYASENLIPVTLELGGKSPNIFFNDVMSADDGFLDRALEGFSMFALNQGEVCTCPSRALIQEDIYDDFIGKAVDRVSKIKQGNPLDTDTMMGAQASNDQFEKISSYLAIGKEEGAKVLIGGEPADLGGDLSGGYYIKPTVFDGHNKMRIFQEEIFGPVLAVTTFKDYADAIHIANDTLYGLGAGVWSRDGATAYRAGREIQAGRVWTNTYHDYPAHAAFGGYKQSGIGRETHLMMLEHYQQTKNLLVGYAQSAKGFF

SEQ ID NO: 56483 - protein, 156 aa, Acinetobacter sp. ADP1
MAIRRIEGLLHLASEGRYAILVGRFNSFVVEHLLEGAIDTLKRHGVSEDNITVAYAPGAWELPIVAKKLAASDKFDAIIALGAVIRGSTPHFDFVAGECAKGLGVVALESSLPVINGVLTTDSIEQAIERSGTKAGNKGSEAALTAIEMVNLLKAI

SEQ ID NO: 56484 - protein, 170 aa, Helicobacter pylori
GSGMHTHVSVWENNENLFSGETYKGLSELALHFLGGVLRHARGLAAFTNASTNSYKRLIPGYEAPSILTYSANNRSASVRIPYGISKNSARFEFRFPDSSSNPYLAFAAILMAGMDGVKNKMDPGEAMDINLFKLTLDEIREKGIKQMPHTLRRSLEEMLADKQYLKEGQ

SEQ ID NO: 56485 - protein, 250 aa, Zea mays
MGRKFFVGGNWKCNGTADQVEKIVKTLNEGNVPSSDVVEVVVSPPYVFLPVVKSQLRQEFQVAAQNCWVKKGGAFTGEISAEMLVNLGVPWVILGHSERRALLGESNEFVGDKVAFALSQGLKVIACVGETLEEREAGSTMDVVAAQTKAIAEKIKDWSNVVLAYEPVWAIGTGKVATPAQAQEVHASLRDWVKINVSPEVSESTRIIYGGSVTAANCKELAAQPDVDGFLVGGASLKPEFIDIINAAAV

SEQ ID NO: 56486 - protein, 405 aa, Coxiella burnetii
MAIEIKVPTLPESVSDATVAKWYKKEGDSISRDENLVDLETDKVMLEVPAPKDGVVEKIVAKEGEVVKADQILALLKEGGSVAKEKEKKDEKETKKEKEKKEEKKDKEKKEKTEEKESDLSPAVRRMVSEKDVDVEEIEGSGKGGRITKKDVEDYLEKQKEKPSEGKEGPADERTEKRVPLSRIRQRVAERLVQVQQEAALLTTFNEINMQLVMELRKKYREEFEKKFKVRLGFMSFFTKAVVEALKRFPMVNASIDGSDIIYHNYYDIGIAIGTERGLIVPILRNAEKMNMADIEKQIREYASRAQEGRLNIEELTGGTFTITNGGTYGSLLSTPIINPPQTAILGMHKIMDRPTVENGEVVVRPIMQVALSYDHRVIDGREAVLFLVTIKELLEDPARMILEC

SEQ ID NO: 56487 - protein, 427 aa, Populus trichocarpa
MPEIEQVSENALFGKYDVGKLLGCGAFAKVYHARDVQTGKSVAIKIINKKKISSPSLIANIKREISIMRKLNHPYIVKLIEVLASKTKIYCVMEYVKGGELFTKIAKGRFSEDLSRKYFRQLISAVGYCHLRGVFHRDLKPENLLLDENGNLKVSDFGLSAVRDQTQLDGLLHTLCGTPAYVAPEILAKKGYDGAKIDVWSCGVILFVLAAGYLPFNDPNLMAMYKKIYKGEFRCPKWMSTDLKRFLSRLLDTNPETRITIDEILKDPWFKKGKHKEINFYDEEFNKDDGRKDEELASTSLNAFDIISFSSGLNLSGMFDDSYNVVDDGERFVSTESPEDLVKRVEEFAKEERLRVRRRKEWGLEMEGQDGNLMLSVEIRRLTDTLFVVEAKRNGGDAGCYKEIWKNKLKPVIFNGLISTNSVVNDD

SEQ ID NO: 56488 - protein, 252 aa, Prunus persica
MPIRNIAVGRPEEAYHPDALRAGLAEFISTLIFVFAGEGSGMAFAKLTHGAATTPAGLVAAALAHGFGLFVAVSVSANISGGHVNPAVTFGAFVGGNISLLRGILYWIAQLLGSAVACGLLRFAPNYQTTSAFALSEGVGVWNAFVFEIVMTFGLVYTVYATAIDPKRGSVGTIAPIAIGFVVGANILAGGAFDGASMNPAVSFGPALVSWNWHNHWIYWAGPLIGGGLAGLIYEFVFIGNSSHEPLPTADY

SEQ ID NO: 56489 - protein, 346 aa, Picea sitchensis
MLNARTLRTWITSALGSEAVAKHMVAVSTNLKLVKEFGIDPQNAFAFWDWVGGRYSVCSAVGVLPLSLQYGFPIVSKFLEGARSVDNHFHTTPFEKNIPVLLGLLSVWNVSFLGYPARAILPYTQALEKFAPHIQQLSMESNGKGVSIDGVPLNFEAGEIDFGEPGTNGQHSFYQLIHQGRVIPCDFIGIIKSQQPIYLQGEVVSNHDELMSNFFAQPDALACGKTPEELRSEKVSDHLIAHKTFSGNRPSLSILLPSLTAYNVGQLLAMYEHRIAVQGFIWGINSFDQWGVELGKSLASRVRAQLNMSRTEGKPVEGFNHSTAMLIKRYLKENAPIPVDLLPSNV

SEQ ID NO: 56490 - protein, 170 aa, Helicobacter pylori
GSGMHTHVSVWKNNENLFSGETYKGLSELALHFLGGVLHHARGLAAFTNASTNSYKRLIPGYEAPSILTYSANNRSASVRIPYGISKNSTRFEFRFPDSSSNPYLAFAAILMAGMDGVKNKIDPGEAMDINLFKLTLDEIREKGIKQMPHTLRRSLEEMLADKQYLKEGQ

SEQ ID NO: 56491 - protein, 170 aa, Helicobacter pylori
GSGMHTHVSVWKNNENLFSGETYKGLSGLALHFLGGVLRHARGLAAFTNASTNSYKRLIPGYEAPSILTYSANNRSASVRIPYGISKNSARFEFRFPDSSSNPYLAFAAILMAGMDGVKNKMDPGEAMDINLFKLTLDEIREKGIKQMPHTLRRSLEEMLADKQYLKEGH

SEQ ID NO: 56492 - protein, 170 aa, Helicobacter pylori
GSGMHTHVSIWKNNENLFGGETYKGLSEFALHFLGGVLRHARGLAAFTNASTNSYKRLIPGYEAPSILTYSASNRSASVRIPYGISKNSARFEFRFPDSSSNPYLAFGAILMAGIDGIKNKMDPGEAMDINLFKLTLDEIREKGIKQMPHTLRRSLEEMLADKQYLKEGQ

SEQ ID NO: 56493 - protein, 268 aa, Mycobacterium smegmatis str. MC2 155
MSELAGRVAVVTGGASGLGEGLVRRFVAEGAQVMIGDVDKDRGTALAEELGAHTEFLTTDVADQEQVAALVSAGVERFGGLHVMVNNAGVSGTMHRRFLDDDLADFHKVMGVNVLGVMAGTREAARYMADNGGGSILNLTSIGGIQAGGGVMTYRASKAAVIQFTKSAAIELAHHEIRVNAIAPGNIRTAIVAKSASEEDRQRIEEFEANIRAQMRADRPLKREGTVEDVAEAALYFATDRSRYVTGTVLPIDGGTVAGKVIVRKEKR

SEQ ID NO: 56494 - protein, 522 aa, Ipomoea batatas
MAAATIGALSSPYTGGVGERIDGDVSKASFRRLSFASSHLSGDKLMPLPPRRLRSGGKSSEVRTAPFIVSPKAVSDSQNSQTCLDPDASRSVLGIILGGGAGTRLYPLTKKRAKPAVPLGANYRLIDIPVSNCLNSNISKIYVLTQFNSASLIRHLSRAYASNMGGYKNEGFVEVLAAQQSPENPNWFQGTADAVRQYLWLFEEHNVLEFLVLAGDHLYRMDYERFIQAHRETDADITVAALPMDEKRATAFGLMKIDEEGRIIEFAEKPKGEQLKAMKVDTTLFGLDDQRAKEMPYIASMGIYVVSKDVMVNLLRQKFPGANDFGSEVIPGATSIGLRVQAYLFDGYWEDIGTIEAFYNANLGITKKPVPDFSFYDRSAPIYTQPRYLPPSKMLDADVTDSVIGEGCVIKNCKIHHSVVGLRSCISEGAIIEDTLLMGADYYETDADRRLLAAKGSVPIGIGRNSHIKRAIIDKNARIGNDVKIINNDNVQEAARETEGYFIKSGIVTIIKDALIPSGTII

SEQ ID NO: 56495 - protein, 126 aa, Sonchus oleraceus
NDDFRRGKPTNHIVYGEDVAVLAGDALLSFSFEHIAYMATKGVSSDRILRAIGELAKCIGSEGLVAGQVVDICSEGADVGLDHLEFIHLHKTAALLEGSVVLGAIMGGGSDEEIEKLQNLRDRLGF

SEQ ID NO: 56496 - protein, 491 aa, Brassica napus
MASARFLSLLPIVTLSLLLTTTDASSRSLPTSHETTVLDVVSSLQQTQQILSIDPTRSSLTTTTAAKESIPVFLNSSSPLSLELHSRDTLVASQHKNYKSLVLSRLERDSSRVASIIAKVKLAVEGADSETHYQPEELTTPVISGASQGSGEYFSRLGVGTPAKEMYMVLDTGSDINWIQCKPCSSCYQQSDPIFDPSSSSTYKSLTCSAPQCASLRASACRSDKCLYQVRYGDGSFTVGEYATDTVTFGSSGKVDNVALGCGRDNEGLFTGAAGLLGLGGGALSMTSQIKAKSFSYCLVDRDSGKSSSLDFNSVQVGAGDATAPLLRNSKIDTFYYVGLSGFSVGGQQVSIPSSVFAVDASGAGGVILDCGTAVTRLQTQAYNSLRDAFVKLTANLKKGTSSISLFDTCYDFSSLSTVKVPTVAFHFTGGKSIDLPAKNYLIPVDDAGTFCFAFAPTSSSLSIIGNVQQQGTRITYDLANNLIGLSANQC

SEQ ID NO: 56497 - protein, 523 aa, Ipomoea batatas
MAAAIGAPKLAPYTCTAERNDGSARRAARFKSLSFASSNLSGDKLGSLVSRRCSRSGGKSSERRNAPIIVSPKAVSDSQNSQTCLDPDASRSVLGIILGGGAGTRLYPLTKKRAKPAVPLGANYRLIDIPVSNCLNSNVSKIYVLTQFNSASLIRHLSRAYASNMGGYKNEGFVEVLAAQQSPENPNWFQGTADAVRQYLWLFEEHNVLEFLVLAGDHLYRMDYERFIQAHRETDADITVAALPMDEKRATAFGLMKIDEEGRIIEFAEKPKGEQLKAMKVDTTIFGLDDQRAKELPFIASMGIYVISKNVMLNLLREKFPGANDFGSEVIPGATSIGMRVQAYLFDGYWEDIGTIEAFYNANLGITKKPVPDFSLYDRSAPIYTQPRYLPPSKMLDADVTDSVIGEGCVIKNCKIHHSVVGVRSCISEGAIIEDSLLMGADYYETDADRRLLAAKGSIPIGIGRNSHIKRAIIDKNARIGDNVKIINSDDVQEAARETDGYFIKSGIVTVIKDALIPSGTVI

SEQ ID NO: 56498 - protein, 126 aa, Lactuca indica var. laciniata
NDDFRRGKPTNHIVYGEDVAVLAGDALLSFSFEHIATATKGVSSDRILRAIGELAKCIGSEGLVAGQVVDVCSEGADVGLDHLEFIHLHKTAALLEGSVVLGAIMGGGSDEEIEKLRKFARSIGLL

SEQ ID NO: 56499 - protein, 429 aa, Nocardia farcinica IFM 10152
MPVATTDATAAGLCAFVDDSPSPFHVCHTVAGELEAAGFTRLSESAAWASGEPGRYYVVRGGSLVAWADRDGSPSAPFRVVGAHTDSPNLRVKQHPDLASAGWQLVGLEPYGGAWLNSWLDRELGLSGRLTVREGNSVRARLVRIDDPILRVPQLAIHLSEDRRGVSLDPQRHVNAVWGVGEKPRSFLAFVAEYAEVDPDAVLGWELMTHDLAPSRLVGRDRDLVSAPRLDNQGTCYAGLRAFLAAVAEPGTAIPVLAMFDHEEVGSQSDRGAQSDLLPAVLERIVLARGGGRAEYLAALAGSVCASGDMAHATHPNYPERHEPAHRIEVNGGPVLKVNQNLRYATDATGAGAFALACAQAEVPLQRYVHRADLPCGSTIGPMTAARTGMPTVDVGAPQLAMHSARELMGAADVGAYAAALAAFLTPDG

SEQ ID NO: 56500 - protein, 267 aa, Prochlorococcus marinus str. AS9601
MSTSFKNVTPTGPGGTATLLIVLSFTGFLLLTQSLFVVPSGQVAVVTTLGKVSGPSRRAGLNFKLPFIQSVYPFDIKTQVQPEKFETLTKDLQVIRATATVKYSVKPNEAGRIFATIASRNSDVYQKIVQPSLLKALKSVFSQYELETIATEFAVISEKVGDTVAQELNSFDYVDVKSLDLTGLEIAEEYRAAIEQKQIAGQQLLRAKTEVEIAEQEALRYETLNRSLDDQVLFKLFLDKWDGSTQVVPGLPGSEGGSPPVIVGGRR

SEQ ID NO: 56501 - protein, 490 aa, Burkholderia sp. 383
MNTTPDLAFDPPLHTRHFIDGAWRASVDGATLPVVDPSTEAVLADVSAGSEADVEHAVQAASRAYPGWKRTTGAMRAALLRAIARGVDARRTRLATLQSLNNGKPLAEAEIDVADVIATFDYYAGLAERLDTDGETEIALPDADHRAWIRREPAGVAALIVPWNFPMVTTAWKLAPALAAGCTVVLKPSEITPLPELELAAIAAEAGLPPGVLNVVTGTGHDVGARLCAHPRVAKVSFTGSTAVGAQVMKTAADTIKGVGLELGGKSSIVVFDDADLDHAVELVTGGGLFNAGQMCSATSRVLVAASLADDLIARLAQRIDATVVGPPFAPGVQMGPLTNRAQYERVQRHIAQGRADGARLVTGGNALDGPGYFIRPALFADVPADSSLWCEEIFGPVLCVRAFDTEDEAIAAANDTEYGLVATVVTRDTARARRVADALEAGVVWINTPQLIYPQTSWGGYKRSSIGRELGPFGLAAFQEIKQVMMPAG

SEQ ID NO: 56502 - protein, 564 aa, Burkholderia sp. 383
MNHPATVSSIAGARKATAAPCHARPRTCGEALVDLLERHGVECVFGIPGVHTVELYRGLAASSIRHVTPRHEQGAGFMADGYARVTGRPGVCFIITGPGMTNIATAMAQAYADSIPMLVISSVNARRELGSGDGRLHELPSQRDVFAGLTAFSHTLLDAADLPQVLARAFAVFASARPRPVHIEIPLDVIVMPAPALSDAPPALPARPAPDANALAAAADLLAHARRPLILAGGGAIHAAAELRELAERLHAPVALTINAKGLLPAGHPLLIGSTQSLPATRAAIRDADVVLAVGTELGETDYDVTFDGGFAIDGRLIRIDIDAQQLMRNARAEIAIAGDSQLALGALSTRLHETPAPTPDAGWGAPRVAAVRAAIAATHDSAAQSQALLIDTIVATLPGAIIAGDSTSPVYVGNFTHDAPAPRSWFNSSTGYGTLGYGLPAAIGAKLAAPARPVVCLIGDGGLQFTLPELASAVEARLPVIVIVWNNHGYGEIRKYMVARDITPVGVDPYTPDFQVLARGFGCAAHTAATPGALAAALRDAAARAIPTVIEIDEATWFGQVQR

SEQ ID NO: 56503 - protein, 183 aa, Triticum aestivum
  misc_feature (70)..(70): Xaa can be any naturally occurring amino acid
  misc_feature (169)..(169): Xaa can be any naturally occurring amino acid
  misc_feature (176)..(176): Xaa can be any naturally occurring amino acid
SFTYSVVGPAVMASSVTTVVPFQGLKSTAGLPVRRLSGSASLSSVSNGGRIRCMQVWPIEGIKRFDILSXLPPLSTEALLKQVDYLIRSKWVPCLEYSKVGFVFREHKSSPGYYDCRYWTMWKLSMFGCTDATHVLNEVEEVKKEYPDAYVRVIGFDNMRQVQCVSFIXAFRPPGXCEESGKV

SEQ ID NO: 56504 - protein, 344 aa, Xanthobacter autotrophicus Py2
MKGLVYRGPGKKALEEVPHPRIEQPTDAVVKILRTTICGSDLHILKGDVPTVKPGTVLGHEGVGVIEEVGQAVSAFRKGDHVLISCISSCGRCEYCKRGMYSHCSVAGWMLGHTIHGTQAEYVRIPFADTSLHRIPDGMDEEALVMLSDILPTGFECGVLNGKVQPGSTVAIVGAGPVGLAALLTAQFYSPAEIIMIDLDDNRLEVALTFGATKTVNSGRENAVERVMALTGGIGVDTAIEAVGIPATFVLCQDIVAPGGTIANVGVHGTKADLHLERLWAHNITLTTRLVDTVTTPMLLKTVQSKKLDPQRLITHRFALADILEAYETFEKAAQTRALKVIIG

SEQ ID NO: 56505 - protein, 158 aa, Zea mays
IVLGLLITALNNPTSARKHRHIYIFDIKKGRMRIRMKVALALGVVAVCVGVGAAVLRKVESLGWLDAVYLAVMSVTTVGYGDQAFQTLAGRLFASAWLLVSTLAVARAFLYLAEMRIDKRHRAMANWVLSRDMTVSEFLAADIDNNGYVTGEETLFIH

SEQ ID NO: 56506 - protein, 415 aa, Psychrobacter arcticus 273-4
MIENYSLFLLVCGIAFVFGALFPILFKRTPISLPMLQLSFGLLMGYFWTSLSFLNPLDNGLIIEKLTEIVVLVSLVGAGIKIDTELSWRLWRPTMRLLLITMPIGIFAMAVLGYYAFGMTIGAAILLGAVLAPTDPVLASSIQVGPPNTGGEDTPRFTLTSEAGLNDGLAFPFVYLAIKIAEAYSEGQRFTGEMLWSWFTHDVLWKIGAGLLVGIVVGKVMAKLVFSKYSRETTMSQGYVVIALTLVAYGLAEYVHSYGFIAVFVAAFAFRRSESEHTYHHKLHDFAAQSEGLLMSLVLVIFGMFLGQGLQAGVELTWRVYIVSFTFLLLIRPLGGFIALSGLNLPRTEKYAISALGIRGIGTLYYLSYALNQGFFNDEDALKLWIVCSIVILSSIFIHGLTAKQLLKMTPKKTY

SEQ ID NO: 56507 - protein, 145 aa, Zea mays
MAAAALREQLNALLSSMFASGLVDEQFQQLQMLQEDGGTPGFVAEVVTLFCDDADRIISELAALLDQPIVDFDKVDAYVHQLKGSSASVGAQKVKFTCMQFRQLCQDKNRDGCIMALAVVRNEFYDLRNKFQTMLQLEQQIQAQQ

SEQ ID NO: 56508 - protein, 378 aa, Pseudomonas aeruginosa UCBPP-PA14
MTKPAILALADGSIFRGEAIGADGQTVGEVVFNTAMTGYQEILTDPSYAQQIVTLTYPHIGNTGTTPEDAEANRVWAAGLIIRDLPLIASNWRSKQSLPDYLKANGTVAIAGIDTRRLTRILREKGSQNGCILAGADATEERALELARAFPGLKGMDLAKEVTTAERYEWRSSVWSLESDSHPEIPAGELPYHVVAYDYGVKLNILRMLVARGCRLTVVPAQTPASEVLALNPDGIFLSNGPGDPEPCDYAIQAIREFLDTEIPVFGICLGHQLLALASGAKTLKMGHGHHGANHPVQDLDSGVVMITSQNHGFAVDESTLPDNLRATHKSLFDGTLQGIERTDKVAFSFQGHPEASPGPHDVAPLFDRFISAMAERR

SEQ ID NO: 56509 - protein, 517 aa, Vibrio sp. Ex25
MTKNIHDQRILILDFGSQYTQLVARRVREIGVYCELWSWDVEEADIREFNPDGIILSGGPESVTEENSPRAPQYVFDSGVPLLGVCYGMQTMAEQLGGKVAGSNEREFGYAQVKVSGECALFKDLEATQDVWMSHGDKVVEIPADFVKVGETDTCPYAAMANEEKKYYGVQFHPEVTHTKGGLQMLENFVLGVCGCERLWTSESIIEDAVARIKEQVGDDEVILGLSGGVDSSVVAMLVHRAIGDKLTCVFVDNGLLRLNEGQQVMDMFGDKFGLNIIKVDAEDRFLEALKGKSDPEEKRKTIGHVFVDVFDEESKKLKNAKWLAQGTIYPDVIESAASKTGKAHVIKSHHNVGGLPDEMEMGLVEPLRELFKDEVRKIGLELGLPYNMLYRHPFPGPGLGVRVLGEIKKEYCDLLRRADAIFIEELHAADLYDKVSQAFTVFLPVRSVGVMGDGRKYDWVVSLRAVETIDFMTAHWAHLPYDFLGKVSNRIINEVDGISRVVYDISGKPPATIEWE

SEQ ID NO: 56510 - protein, 418 aa, Populus trichocarpa
MPEIESVSENALFGKYEVGKLLGCGAFAKVYHARDVQTGKSVAIKIINKKKISNPSLMSNIKREISIMRRLNHPHIVKLIEVLATKTKIYFVIEYVKGGELFAKVAKGRFSEDLSRKYFHQLISAVGYCHSRGIFHRDLKPENLLLDENGSLKVSDFGLSAVTDQIRTDGLLHTLCGTPAYVAPEILAKKGYDGAKVDVWSCGVVLFVLTAGFLPFNDPNLMAMYKKIYKGEFRCPKWMSTDLKRFLSRLLDTNPETRITIDEILKDPWFKKGKHKEINFYDEELNKAVDEKKDEELASTSLNAFDIISFSSGLNLSGLFDDSYNVVDDGERFVSTESPENLMKKVEEFAKEERLRVKRRKEWGLEMEGQNGNLMIAVEVHRLTDTLFVVEAKRSGGDAGCFKETWKNKLKPPNYLLG

SEQ ID NO: 56511 - protein, 304 aa, Mycobacterium bovis AF2122/97
MANASETNVGPMAPRVCVVGSVNMDLTFVVDALPRPGETVLAASLTRTPGGKGANQAVAAARAGAQVQFSGAFGDDPAAAQLRAHLRANAVGLDRTVTVPGPSGTAIIVVDASAENTVLVAPGANAHLTPVPSAVANCDVLLTQLEIPVATALAAARAAQSADAVVMVNASPAGQDRSSLQDLAAIADVVIANEHEANDWPSPPTHFVITLGVRGARYVGADGVFEVPAPTVTPVDTAGAGDVFAGVLAANWPRNPGSPAERLRALRRACAAGVLATLVSGAGDCAPAAAAIDAALRANRHNGS

SEQ ID NO: 56512 - protein, 457 aa, Populus trichocarpa
MATNKTPNNISNQSQSPLLGRYEIGKLLGHGTFAKVYHARNVKTNESVAIKVIDKEKILKVGLMAHIKREISILRRVRHPNIVQLFEVMATKAKIYFVMEYVRGGELFNKVAKGRLKEEVARRYFQQLISAVSFCHARGVFHRDLKPENLLLDENGNLKVSDFGLSAVPDQIRQDGLFHTFCGTPAYVAPEVLAKKGYDAAKVDIWSCGIVLFVLMAGYLPFQDQNIMVMYKKIYKGEFRCPRWFSSELVRLLSKLLDTNPVTRITIPEIMENRWFKKGFKHIKFYIEDDKVCSVQDEDDVGSSSDQSLSESESEFETRRRVTTLPRPASLNAFDIISFSPGFDLSGLFEEGGEGARFVSGAPVTKIISKLEEIAKVVSFTVRKKDCRVSLEGSREGVKGPLTIAAEIFELTPKLVVVEVKKKGGDKGEYEEFCNRELKPGLQKSLSYRCFKYTIGF

SEQ ID NO: 56513 - protein, 275 aa, Oryza sativa Japonica Group
MGSFASPLDAAPAPPTAKPSPPPAPAPANGLVTQEELKRVAAHRAVEMVEPGMTLGLGTGSTAAHALDRLGDLLRSGELAAVAGVPTSLKTEAHAARVGIPMLPLGEAGGIDLSIDGADEVDPELNLVKGRGGSLLREKMIEGSGGRFVVIVDESKLVPRLGCTGAVPVEVVPFGCDHTLGLVRKVFDGLPGFSARLRTVASKDGEGKEEMFVTDNGNYIVEMFFEDGIRGDLNEISDRLLRITGVVEHGMFLGMATSVVVAKKDGTVALLHKKK

SEQ ID NO: 56514 - protein, 164 aa, Candida albicans SC5314
MSSPKVIIVSSDNEKFPVEPKIAEKSILIKNMINDLHPDGLEEDFEIPTPNVRANVLCKVLEWCEHHKNTVFQDDEDEDAKKSVPVEEWDRNFLKVDQEMLYEIILAANYLNIKPLLESGCKMVAEMIKSKSPEELRRTFNIINDFSPEEEAAIRKENEWAEDR

SEQ ID NO: 56515 - protein, 255 aa, Ustilago maydis 521
MLRRRGCYVCGQGKLGSDELSQAAGHESSGCLAPRSSETKQCYNCGGRGHTKTDCPSVNIQQCYACGGKGHIKANCATVDKQKKCFGCGGRGHIKAECATANKPLKCRRCGEANHLAKHCTATMPALKPKPCYTCNQSGHHLAHYRSQSTVHTPAGSLRIPSQTPPPRSLPNHPPNAQNHRVQLSLPTPRFLQRTSLHQHPSNITPIPHRTTPLTCSTDKPDFSFTQPHLTCACLLPKLTPILVSHRAWFVSGQV

SEQ ID NO: 56516 - protein, 457 aa, Populus trichocarpa
MATNKTPNNISNQSQSPLLGRYEIGKLLGHGTFAKVYHARNVKTNESVAIKVIDKEKILKVGLMAHIKREISILRRVRHPNIVQLFEVMATKAKIYFVMEYVRGGELFNKVAKGRLKEEVARRYFQQLISAVSFCHARGVFHRDLKPENLLLDENGNLKVSDFGLSAVPDQIRQDGLFHTFCGTPAYVAPEVLAKKGYDAAKVDIWSCGIVLFVLMAGYLPFQDQNIMVMYKKIYKGEFRCPRWFSSELVRLLSKLLDTNPVTRITIPEIMENRWFKKGFKHIKFYIEDDKVCSVQDEDDVGSSSDQSLSESESEFETRRRVTTLPRPASLNAFDIISFSPGFDLSGLFEEGGEGARFVSGAPVSKIISKLEEIAKVVSFTVRKKDCRVSLEGSREGVKGPLTIAAEIFELTPKLVVVEVKKKGGDKGEYEEFCNRELKPGLQKSLSYRCFKYTIGF

SEQ ID NO: 56517 - protein, 464 aa, Cytophaga hutchinsonii ATCC 33406
MSTKFDVIVIGSGPGGYVAAIRASQLGKKVAVVEKAELGGICLNWGCIPTKALLKSAQVYEYIKHAKEYGINVGNAEADFTAVVKRSRDVAAGMSKGVQFLMKKNKIEIIAGFGKLVKGKQVEVTDDKGNKSLYGADHIILATGGRARELPNVKIDNNKIIGYRKAMVLESKPESMVIMGSGAIGVEFAYFYATMGTKVTIVEYLPNIVPVEDEEISKQLEKEYKKMGINIMTGAAVESVDTAGKGCKVTVKKGDATEVIECDIVLSAVGVATNLEGIGLEDVGVATDKGRVLVDDYYKTNIPGVYAIGDIVKGPALAHVASHEGIICVEKIAGLNPEPMDYGNIPGCTYCTPEIASVGLTEKAAKEKGYELKVGKFPFSASGKASAAGAKEGFVKVIYDAKYGELLGVHMIGANVTEMIAEAVVARKLEATGHEIINAVHPHPTMSEAIMEATAAAYGEVIHL

SEQ ID NO: 56518 - protein, 526 aa, Populus trichocarpa
MATNKKLGNKSNNSQSQSPLLGRYEIGKLLGHGTFAKVYLARNIKTNESVAIKVIDKEKVLKGGLIAHIKREISILRLVRHPYIVQLFEVMATKAKIYFVMEYVRGGELFNKVAKGRLKEEVARKYFQQLISAVSFCHARGVFHRDLKPENLLLDENGNLKVSDFGLSAVSDQIRQDGLFHTFCGTPAYVAPEVLARKGYDAAKVDIWSCGIVLFVLMAGYLPFHDQNVMVMYKKIYKGEFRCPRWFSSELVRLLHKLLDTNPVTRITIPEIMENRWFKKGFKNIKFYIEDDKVCSVEEEEDVGSSSDQSLSESESEFETRRRVTSLPRPASLNAFDIISFSPGFDLSGLFEEGGEGARFVSGAPVSKIISKLEEIAKVVSFTVRKKDCRVSLEGSREGVRGPLTIAAEIFELTPKLVVVEVKKKGGDRGEYEEFCNKELKPGLQKLMQEESEAAAAPKVITTVPVPSGSPQFTIDPFPTDSSQLPVDPFPTDSTQLPINPFPTDSTQLPIDPFPILSSHLPSDSE

SEQ ID NO: 56519 - protein, 333 aa, Acinetobacter sp. ADP1
MQIVKIKMERGRMMALLRFTAFVQKTFALWVVVFAALAFWMPDVFVWLKAYIPWMLGIIMLGMGMTMSLQDFQGILRYPKAVLIGVVAQFVVMPGLAFLLCQLFQLPSEIAIGVILVGCCPGGTASNVITYMARGNIALSVACTSVSTLLAPLLTPAIFYLLASQWIQIDAMSMFVSILQVILFPILIGLLLRRFFARQVNRYIEVMPLISVFAIVAIVAAIIGASKAAILQSGALILAVVMLHNGLGFLIGYWASRWLRLSDYDSKAIAIEVGMQNSGLGVALAAVHFAASPITAVPSAIFSLWHNISGAMLATYWARQSKQKTQQEPRDNF

SEQ ID NO: 56520 - protein, 170 aa, Helicobacter pylori
GSGMHTHVSIWKNNENLFGGETYKGLSEFALHFLGGVLRHARGLAAFTNASTNSYKRLIPGYEAPSILTYSASNRSASVRIPYGISKNSARFEFRFPDSSSNPYLAFGAILMAGIDGVKNKMDPGEAMDINLFKLTLDEIREKGIKQMPHTLRRSLEEMLADKQYLKEGQ

SEQ ID NO: 56521 - protein, 170 aa, Helicobacter pylori
GSGMHTHVSVWKNNENLFSGETYKGLSELALHFLGGVLHHARGLAAFTNASTNSYKRLIPGYEAPSILTYSANNRSASVRIPYGISKNSARFEFRFPDSSSNPYLAFSAILMAGMDGVKNKIDPGEAMDINLFKLTLDEIREKGIKQMPHTLRRSLEEMLADKRYLKEGH

SEQ ID NO: 56522 - protein, 220 aa, Chlorobium tepidum TLS
MHIVDLSYPVTADMPLWPGTPAPNFSDLHTVGRDGFGERWLQLSSHTGTHLDAPAHLFEGAVSLDRLPVDHFIGKGALLDLRDAQPEPLSLDQLLLQRATIESAEFLLLHTGWSRFWGTAAYDRGYPVFAEEAAAWLAGLGLKGVGIDAPSFDDPDSEELPIHRRLLGAGFVLIENLTALDRLGGHEFFLSVLPLPIAGAEACPVRAVALIASFAANQPI

SEQ ID NO: 56523 - protein, 170 aa, Helicobacter pylori
GSGMHTHVSVWKNNENLFSGETYKGLSELALHFLGGVLRHARGLAAFTNASTNSYKRLIPGYEAPSILTYSANNRSASVRIPYGISKNSARFEFRFPDSSSNPYLAFSAILMAGMDGVKNKIDPGEAMDINLFKLTLDEIREKGIKQMPHTLRRSLEEMLADKQYLKEGH

SEQ ID NO: 56524 - protein, 246 aa, Magnaporthe grisea 70-15
MSLWGALPRHEVFGLHVVLICTQPQFTRDVCVDLRAIYASAKHLNTDDPAVKQSMVSSSSLLSSWPKTVLEIPTVFVTACPGIRVKTLASWLPQNAAIVRTMPNTPACIRQGATAAFAGPTVTAIPGAAEAVAALIRHVSPSLCFVPTEDLLDVAASVSGSAPAYIFTLMQAMVEAGVRRGLPPDIAASLVKQSAFGSAGLALQTGQLGCLEKLTSDVCVPGGSTSQAMMVLHEEGFGYNMMTFIL

SEQ ID NO: 56525 - protein, 449 aa, Mycobacterium smegmatis str. MC2 155
MSELHPKLQAVFEEVSHRNGGEKEFHQAVFEVLQSLGPVVEKHPEYADNAIIRRLCEPERQIIFRVPWVDDTGHVQINRGFRVEFNSALGPYKGGLRFHPSVYLGIVKFLGFEQIFKNALTGLPIGGGKGGSDFDPKGRSDAEIMRFCQSFMTELYRHIGEYTDVPAGDIGVGTREIGYLFGQYKRITNRYESGVLTGKGLTWGGSRVRTEATGYGTVFFVDEILQSRGQSFDGKRVVVSGSGNVAIYAIEKVHALGGIVVACSDSGGYVVDEKGIDLDLLKEVKEVQRARIDAYAEARGGATQFVSGGSVWNVACDIALPCATQNEVSGDDARALIESGCRIVAEGANMPCTPEAVKLFDQAGVTFAPGKAVNAGGVATSALEMQQNASRDSWTFDDTEGRLAGIMRRIHDRCLTTADEYDQPGNYVAGANIAGFTQVADAMLALGLI

SEQ ID NO: 56526 - protein, 170 aa, Helicobacter pylori
GSGMHTHVSIWKNNENLFSGEAYKGLSEFALHFLGGVLRHARGLAAFTNASTNSYKRLIPGYEAPSILTYSANNRSASVRIPYGISKNSARFEFRFPDSSSNPYLAFAAILMAGMDGVKNKIDPGEAMDINLFKLTLDEIREKGIKQMPHTLRRSLEEMLADKQYLKESQ

SEQ ID NO: 56527 - protein, 241 aa, Actinobacillus pleuropneumoniae serovar 1 str. 4074
MQGKIALVTGATRGIGKAIAEELAAKGATVIGTATSEKGAESISAYLGEHGKGLVLNVTDADSIEAVLAQIKADFGDIDILVNNAGITRDGLLMRMKEDDWFDIIQTNLTSVYRLSKAVLRPMMKKGGRIVTIGSVVGSMGNPGQTNYCAAKAGLVGFSKSLAKEVASRGITVNVVAPGFIATDMTDELNEDQKQAILSQIPVGQLGSAQDIAKAVAFLASDDAKYITGETIHVNGGLYMN

SEQ ID NO: 56528 - protein, 150 aa, Oryza sativa Japonica Group
MSYAFNKLLPTTHFRQYAQRSRVRKLQYIAELERRVQALQTEGVEVSAEMDFLGQQNIMLDLENKALKQRLESLSQEHLIKRFQQEMFEREIGRLRSLFQQQQQQQHIPQQQGPTHSRSNSRDLDSQFANMSLKHGDPNSGRDAVPGLRI

SEQ ID NO: 56529 - protein, 592 aa, Deinococcus radiodurans R1
MEQTGKQGQNRGEMTGAKALWATLAGHGITTVFGYPGGAIMPVYDALTFYPEVRHILARHEQGAIHAAEGWAKATGEIGVCMATSGPGATNLVTGLADAMLDSVPLLAITGNVAQHLMGTDAFQEADITGITMPITKHNYVVRDVDELPRVIAEAIRIARSGRPGPVLVDIPKDVQLAAFAGDIPTPHTRPQAPEASAESIASARELLRNAKKPVLVMGGGSLDASAELTALAHAWGLPVITTLMGLGAYPASDPLWLGMPGMHGSVAANRAISECDVLLAVGMRFDDRVTGRVSGFAPHAQIIHVELDAAEIGKIVRTHLPIRSDAKTAARQLAEGAEKLELGEWLSQIEEWKGRAVPPQQWGAAYAVGQVTARLRPDDILSSDVGQHQMLAAQLARFEKPRRWLNSGGLGTMGFGFPAAIGAALAEPGVVSMVVAGDGGFQMTAQELATLKMYDIRNVKICIINNSYLGMVRQWQELFHGKRYSEVWLGDSNPDFVKLAGAYDVPAYRASSAEELPAAIDAWLSDPKSSLLEVVVPHEHGVFPMVPAGAALHEMMETEPVRTDISAEATEVNEATWQEMTEQEAEEMNQG

SEQ ID NO: 56530 - protein, 531 aa, Shewanella sp. MR-7
MSADQQTVTPLENFSPKVAQRAVHRVQPELNFWQIFNMCFGFLGIQFGFALQNANVSRIFQTLGASIDDIPILWIAAPLTGLLVQPIIGYLSDNTWGRLGRRRPYFLIGAICTTLAIFVMPHSPTLWIAAGMLWIMDASINIAMEPFRAFVGDNLPPKQRTQGYAMQSFFIGIGAVVASALPYILSNFFAVANTAPAGEIADSVRYAFYFGGAVLFLSVAWTVVSTKEYSPDELAAFHGNADAGIDEQQNRTRTHKNYQFAAIVWMAVGALLTLAVWTQDLDKQLYILTLGIFAFGPLQLYCALRLGKSTPSQRAQLGIVFNVVDDLFHMPKAMHQLAIVQFFSWFALFAMWIYTTSAVTSYHFGSSDVLSKAYNDGADWVGVLFASYNGFSAIAALFIPLLAKRIGIKLTHTFNMLCGGFGLISFYFIKDPSLLWLPMIGVGIAWASILSVPYAMLSGALPPKKMGVYMGIFNFFIVIPQLLAASVLGLILNGLFDGQPIYALITGGVLMLCAGIAVLFVEQPNTQHTQA

SEQ ID NO: 56531 - protein, 340 aa, Zea mays
MGAKRAVLVGINYQGTKAELKGCHNDVARMRRCLVDRFGFDESGIRVLIDDGSAPQPTGANIRRELARLVGDARPGDLLFFHYSGHGIRLPAETGKDDDTGYDECIVPCDMNLITDQDFTELAQKVPSGCLFTIVSDSCHSGGLLDKTKEQIGHSTKQKQKQTQTQTQSRELEERSPSGTSFREFLKDDASPKIKKFMKVMLNKLQQGQHGGIVGFMGALAQEVLKAKLDGKEEEEFDPAMKQHVHSDQEVYAGTTARVPSNGVLISGCQTDQTSADATTPKGVSYGALSNAIQAILAERGTVTNKELVLKARKMLSKQGYTQQPGLYCSDENASAAFIC

SEQ ID NO: 56532 - protein, 462 aa, Shewanella sp. MR-7
MGKLSIKKWLIFSAMLVAVLLAMFPLKQHPALFSYSASVVLITLLFWSTGFIPPFMAGLIFFALATIFKLIDPSALFSGFGSAAVWLIISGFVIGSAISESGLSRRLAALIAPALTMSYPRMIAGLVISAMLLGFVMPSSVGRAVVMLPIGMALAEQLGFSRGSNGRIGIATALALACNMPSLAVLPANIPNMILAGASENLFNVHFGYAEYLFLHFPILGLLKSALIVALVVYLFPAKIDKTQITAAADIEAYDVVKQVKLGVLLIITLLFWITDSWHGINPAWVGLTTAIILLLPKWGIIEPKRFNQSVDFSTVIFVAAALGLGVLVNQSGLGSELGQVFSKYLPLSQGASFLNFMSLSLISTLTGLVATVPGVPTVLTPMAADLANATGFSLPAVLMTQVIGFSTVIFPYQAPPLILAMQLSQESLAHLLKVTLPLALITLLVLMPLDYFWWQLLGWIS

SEQ ID NO: 56533 - protein, 250 aa, Solanum lycopersicum
MVRIAFGSIGDSLSVGSLKAYLAEFIATLLFVFAGVGSAIAFNKLTSGAALDPAGLVAIAVAHAFALFVGVSMAANISGGHLNPAVTLGLAVGGNITILTGLFYWVAQLLGSTVACLLLKYVTNGLAVPTHGVAAGMSGAEGVVMEIVITFALVYTVYATAADPKKGSLGTIAPIAIGFIVGANILAAGPFSGGSMNPARSFGPAVVAGDFSQNWIYWVGPLIGGGLAGFIYGDVFIGCHTPLPTSEDYA

SEQ ID NO: 56534 - protein, 195 aa, Prochlorococcus marinus str. AS9601
MANLNQPPSRVTPNLLHILNAFTDSSNTIINTIVELNSNTINKYELITETGHLKLDRVGYSSLAYPFAYGCIPRTWDEDGDPLDVEIVGVTEPLIPGSIVEARIIGVMKFDDGGEVDDKVIAVLADDKRMDHISSYEDLGDHWLKETKYYWEHYKDLKKPGTCTVNGFFGIEEAVKVIKDCEERYKIEIDPKLVN

SEQ ID NO: 56535 - protein, 122 aa, Arabidopsis thaliana
  misc_feature (22)..(22): Xaa can be any naturally occurring amino acid
  misc_feature (41)..(41): Xaa can be any naturally occurring amino acid
  misc_feature (77)..(77): Xaa can be any naturally occurring amino acid
MAFLYALLRYLWLASSAKATMXVPFNGFKLHPLPFPATRKXANNDITSIKSKGGRVKCMEVWPPIGKKKCENLSYLXDLTDSELAKEVDYLIEKSGFCVELSWRTDLCNVSRVTNPDTMMDG

SEQ ID NO: 56536 - protein, 180 aa, Glycine max
  misc_feature (175)..(175): Xaa can be any naturally occurring amino acid
MAGEADGKTYQVSRMPPAALNERILSSMSQKHVAAHPWHDLEIGPGAPAVFNCVVEIPRGSKVKYELDKATGLIKVDRVLYSSVVYPHNYGFIPRTLCEDNDPMDVLVLMQEQVVPGCFLRARAIGLMPMIDQGEKDDKIIAVCADDPEYRHFRDISELPPHRLQEIRRFFEDYXKNEKQ

SEQ ID NO: 56537 - protein, 474 aa, Salmonella enterica subsp. enterica serovar Paratyphi B str.
MQYQLLINGVLVDGEGERQSVYNPATGEVILEIAEASPAQVDAAVLAADSAFAEWGQTTPKARAECLLKLADSIEQNALEFARLESQNCGKPLHCVINDEIPAIVDVFRFFAGAARCLSGLAAGEYLEGHTSMIRRDPIGVVASIAPWNYPLMMAAWKLAPALAAGNCVVIKPSEITPLTALKLAALAKDIFPPGVLNVLFGRGQTVGDVLTGHEKVRMVSLTGSIATGEHILRHTAPAIKRTHMELGGKAPVIVFDDADLDAVAQGVRTFGFYNAGQDCTAACRIYAQRGIYDALVEKLGNAVSSLKMGTPEDESTELGPLSSLAHLKRVTAAVEEAKALSHIRVITGGSQTEGKGYYFAPTLLADARQEDAIVQREVFGPVVSITVFDDEDQVLRWANDSRYGLASSVWTQDVGRAHRLSARLQYGCTWINTHFMLVSEMPHGGQKQSGYGKDMSLYGLEDYTLVRHIMVKH

SEQ ID NO: 56538 - protein, 192 aa, Apium graveolens var. dulce
GNSIPPIMPIGRGAYGIVCSIMNTETNEMVAIKKIANAFDNYMDAKRTLREIKLLRHLDHENIIALTDVIPPPVRRNFSDVYIATELMDTDLHQIIRSNQVLSEEHCQYFLYQLLRGLKYIHSANIIHRDLKPSNLLLNSNCDLKICDFGLARPNTDDEFMTEYVVTRWYRAPELLLNSSDYTAAIDVWSVG

SEQ ID NO: 56539 - protein, 201 aa, Clostridium thermocellum ATCC 27405
MIENILIIDNYDSFTYNLYQYVGEISPNIEVYRNDKITLEKIEEMNPTHIIISPGPGFPKDAGICIEAIRKFGRYIPILGVCLGHQAIGEAFGGKVVHAKELMHGKASEVEIDRECLIFRNLPEKIRVGRYHSLIVQKEGLPECLKITAVTQDGEIMGLMHKSFPVFGIQFHPESILTPEGKAILKNFINIKRVNIKRVAI

SEQ ID NO: 56540 - protein, 364 aa, Clostridium thermocellum ATCC 27405
MKMGIVGLPNVGKSTLFNAITKAGAESANYPFCTIEPNVGIVAVPDERLNKLAEMYKPEKVTPTTIEFVDIAGLVKGASKGEGLGNKFLSHIREVDAIVHVVRCFEDSNIVHVEGSVDPVRDVETIEMELILADMEVLERRIDRTRKMLKSGDKKYQVELDIYERIMKTFEEGKPVRSMSFSEEEKKIVDQLFLLTSKPVLYAANVSEDDINSDKPNPLVEKLVNYAKNEGSEVMVICAKIEEEIAQLDDEEKAEFLKELGLSESGLDRLIKASYRLLGLISFLTAGPQEVRAWTIVKGTKAPQAAGKIHSDFEKGFIRAEVVAYDDLIKAGSYTIAKEKGLVRSEGKDYVMQDGDVTLFRFNV

SEQ ID NO: 56541 - protein, 141 aa, Vibrio sp. Ex25
MALERTFSIIKPDAVERNLIGEIYNRIEKAGLRIVAAKMVHLTEDQASGFYAEHEGKEFFPPLKEFMTSGPIMVQVLEGENAIARYRELMGKTNPEEAACGTLRADYALSMRHNSVHGSDSPESAAREIEFFFPESEVFSR

SEQ ID NO: 56542 - protein, 490 aa, Bacteroides fragilis NCTC 9343
MLMIFTAENILLIGSILLFVSIVVGKTGYRFGVPALLLFLLVGMLFGSDGLGLQFHNAKIAQFIGMVALSVILFSGGMDTKFKEIRPILSPGIVLSTVGVFLTALFTGLFIWYLSGMSWTNIHFPLITSLLLASTMSSTDSASVFAILRSQKMNLKHNLRPMLELESGSNDPMAYMLTIVLIQFIQSDGMGTGNIIGSFIIQFLVGAAAGYILGKLAILILNKINIDNQSLYPILLLSFVFFTFAITDLLRGNGYLAVYIAGMMVGNHKITFRKEIATFMDGLTWLFQIIMFLMLGLLVNPHEMIEVAVVALLIGVFMIVIGRPLSVFLCLLPFRKITLKSRLFVSWVGLRGAVPIIFATYPVVANVEGSNMIFNIVFFITIVSLIVQGTSVSFVARLLHLSTPLEKTGNDFGVELPEEIDTDLSDMTITMEMLNEADTLKDMNLPKGTLVMIVKRGDEFLIPNGTLKLHVGDKLLLISEKNKQETVKNE

SEQ ID NO: 56543 - protein, 764 aa, Nicotiana tabacum
MGSALLPDLGTQIVIPVCAVIGIVFSSFQWYLVSRVKVSSEHGATSPSSNKNNKNGYGDCLIEEEEGINDHNVVAKCADIQNAISEGATSFLFTEYQYVGIFMIAFAILIFLFLGSVEGFSTSSQPCTYNKEKRCKPALATAIFSTVSFLLGAITSVISGFLGMKIATYANARTTLEARKGVGKACLVQVMGFLLAANGLLVLYIAINLFKLYYGDDWEGLFEAITGYGLGGSSMALFGRVGGGIYTKAADVGADLVGKVERNIPEDDPRNPAVIADNVGDNVGDIAGMGSDLFGSYAESSCAALVVASISSFGIDHDFTAMCYPLLISSMGILVCLITTLFATDFFEIKAVKEIEPALKNQLIISTAIMTVGIAIVTWTCLPSSFTIFNFGTQKVVKNWQLFLCVAVGLWAGLIIGFVTEYYTSNAYSPVQDVADSCSTGAATNVIFGLALGYKSVIIPIFAIAIAIFVSFTFAAMYGIAVAALGMLSTIATGLAIDAYGPISDNAGGIAEMAGMSHRIRERTDALDAAGNTTAAIGKGFAIGSAALVSLALFGAFVSRAGISTVDVLTPQVFIGLIVGAMLPYWFSAMTMKSVGSAALKMVEEVRRQFNTIPGLMEGLAKPDYATCVKISTDASIKEMIPPGALVMLTPLIVGIFFGVETLSGVLAGALVSGVQIAISASNTGGAWDNAKKYIEAGASEHARTLGPKGSEPHKAAVIGDTIGDPLKDTSGPSLNILIKLMAVESLVFAPFFATHGGILFKIF

SEQ ID NO: 56544 - protein, 181 aa, Oryza sativa
MAFFGLFVEEPVGGGFNGPAAAYYLKLSCDTCGEPTTRDVCLVPGPDSCTNLPGIKNQWRYTCYPTCPDSGHVVVRKCKVCSALGSVALLPGHGKALTTSSRTMVMMLQSKGYTPTNFAPGSRWVATKVTGYRCELELTADHFKGYDGTITIPSTSTKFSVEKLKRAEVPTSLLGITPSIS

SEQ ID NO: 56545 - protein, 170 aa, Helicobacter pylori
GSGMHTHVSIWKNNENLFGGETYKGLSEFALHFLGGVLCHARGLAAFTNASTNSYKRLIPGYEAPSILTYSANNRSASVRIPYGISKNSARFEFRFPDSSSNPYLAFAAILMAGMDGVKNKIDPGEAMDINLFKLTLDEIREKGIKQMPHTLRRSLEEMLADKQYLKESH

SEQ ID NO: 56546 - protein, 698 aa, Bradyrhizobium japonicum USDA 110
MSEVVKLERHDEVGIVTVNSPPVNALSAAVRGGILECIKAAVADPAIKGIVLTCAGRTFIAGADITEFGKPPKAPALNDVLSEIENSPKPVVAAIHGTALGGGLEVALACHFRVAVKEAKLGLPEVKLGLLPGAGGTQRLPRAVGPELAVKMIVGGDPIGAAEALKNGLIEEIVEGPASGGEAFVRKLLAEKRPLRRLRDDDSKLAAAKADRSIFTNAVAAMTKKSRGLEAPFAAADAVGYAIDFPFDEGLKKEREGFLKLVASDQSKAQRYAFFAEREAAKIAGVPEGTKSRPVNRVAILGAGTMGGGIAMSFANAGVPVTLIETGEEQLKRGLGIMQKNWEATAARGGIPADAPAKRMALITGVVGIENVGDADLVIEAVFETMAVKKEVFGKLDQFAKPGAVLASNTSYLNIDEIAKSTKRPQDVLGMHFFSPANVMKLCEIVRADKTAPDALVTAVTIARKIAKVPAVVGVCDGFVGNRMLAQRGKQSEKLLFEGALPQQVDAVVTKFGMPMGPFAMGDLAGLDIGWRSRKDRGIKSEIADALCEAGRFGQKTGKGYYKYEAGSRSALPDPEVEKLIDETLARLGRKKRAVSDEEILERMMYPMINEGAKILEEGIAARPSDIDVVWLYGYGWPIYRGGPMFWADTVGLKHIADRLSFYAKETNDPSLEPAPLLKKLAAEGKTFASLAAASKAA

SEQ ID NO: 56547 - protein, 264 aa, Deinococcus radiodurans R1
MQLAIVGVGKLGLSLLTGVIARGVIAPQDIGIIEANAARAQDIAAQTGVQVITPPQLAQVGRIVVSVQPRVFPEVAPWLAQENAGYISTMAGVSAGTIGRRLGTRRVVRVMPNLAATIGRSQTAITGPREAHEAGDIAFAEQLFGAVGQVYELPEHLFNAFTGMSASGPAYVAVVAEALADGGVRMGLPRPLANELAARLLASTGELLLERAHPGLLKDEVASPGGTTIAGLEELEAAGVRGGVMRAVVAATRRGTELGKDQED

SEQ ID NO: 56548 - protein, 535 aa, Deinococcus radiodurans R1
MLRPMTHNPEYPVVRRPAYARRGMVATSQPLAAQAGLSILQAGGNAVDAAVATAAALTVVEPTSNGLGGDAFALVWAGGELHGLNASGAAPAALSLEALPGGEMPKYGWTPVTVPGAVRGWTDLHGRFGRLDFAQVLAPAIRYAREGYPLSPVLAANWARAIRSYWALNLPIFEDWFRTFAPDGFTPRPGALWRSEGHARTLELIAQTGGAAFYEGELAGQIDAHAQATGGLLRGSDLAAHRSEWVKPIHTDWLGHRVYEIPPNGQGIAALVALNVLGAERLPELRDDPAGLHLQIEAMKRGFHDAHSYVADPRHVPVDVEGLLSAANAERHRALLGEQAHDPATHAPSTGGTVYLAAADDEGGMVSMIQSNYMGFGSGVVVPGTGIALHNRGHNFHTDPAHPNALAPGKRPYHTIIPGFLGRADGTPVGPFGVMGGFMQPQGQLQVVVNTVRYGMNPQQALDAPRWQWLQGRTVEVEPALGDQLARALVARGHDVRVQLDPGSFGRGQMIRRDPDTGVLEGGTESRTDGHIALW

SEQ ID NO: 56549 - protein, 285 aa, Glycine max
MAKDLETEIQSGLPHKDYHDPPPAPFYDPAELRKWSFFRALIAEFVATLLFLYVTILTVIGYNHQTATAAEPCSGVGVLGIAWAFGGMIFVLVYCTAGISGGHINPAVTFGLFLARKVSLTRAVGYMVAQVLGAISGVGLVKALQKSYYNRYKGGVNMLADGYSKGTGLGAEIIGTFILVYTVFSATDPKRVARDSHVPVLAPLPIGFAVFMVHLATIPITGTGINPARSLGPAVIFNNEKAWDDQWIFWVGPFIGAALAAFYHQSVLRAQAAKALGSFRSSSNL

SEQ ID NO: 56550 - protein, 511 aa, Oryza sativa Japonica Group
MAIFIGCICSLALLLLCSHVFQLLSDARRPLPPGPRPLPVIGNLLDVAGELPHRSLSRVAQRYGPLVTLRLGTTLAVVASSPATAREVLHRHGASITDRGTPDAWRTDGHETNSIFALPTRHHRWRALRRLGAEQLFSPRRVEKQRPLRRDAVRGLLRHVSELAAASGGGTGTAVVDVGRAAFAAMANLLFGSLFSVGIDAATSCRFRDAAREFALLTLTPNVSEFFPVVAMADLQGLRRRTARHITWMYQLIDGHVERRMRGRETAGALGEKEKDLLDVMLDISEKQEQSDDSLTINRGVIRAFLADLLTAGSETSSAVIEWAMAELQQNPQTMRKLQEELKKVIGSKTYIDEEDINQLPYLQAVIKETHRLHPAIPLLMYKAAVPVEIQGYKIPKETTVVVNTWAIHQNSEVWIEPDKFIPERFLQKEISLSSGSTNMELVPFSAGRRFCLGYPVANRMLHLMLGSLVHQFQWTLPEVVKKNGGVDMAEKFGLTLSMATPLHAIAKNIV

SEQ ID NO: 56551 - protein, 283 aa, Prochlorococcus marinus str. AS9601
MNDSQRVSILSEALPYIQSFSGRKIVIKYGGSVMENDNLKNAFFRDIALLSTVGVCPIVIHGGGPEINNWLRKLEISPKFENGLRITDQKTMEIVEMVLMGRVNKEIVKGINKTGSLAVGISGLDGNLIQSRELGDGSHGLVGEVTKINPEILDPLISKGYIPIISSIGSTLEGISHNINADFVAGEIAAAINAEKLILLTDTQGILKEKDDKNSLVAKTNLKEARDFIDKKIVTAGMIPKTECCIRALAQGVKAAHIIDGQIEHSLLLEIFTNSGIGTMIVA

SEQ ID NO: 56552 - protein, 389 aa, Haemophilus influenzae Rd KW20
MNLHEYQAKQLFEHYGLPVKNGAVCQSVEDVDLVLAQLSGGKWAAKCQVHAGGRGKAGGVKLVQDVEEARAFAEKWLGQRLVTFQTDKLGQPVNQIYFEETCDIDKEFYLSAVVDRTSQKVVFIASSEGGMNIEEVVQNSPHLLHKVTIDPLFGGLPYQGRELAFKLGLSGTQNKQFTDIFMGLSRLFLEKDLSLLEVNPLVLTPQGNLVCLDAKISVDDNALFRHKDLLALQDLTQNDAREAEAEKFQLNYVALEGDIGCMVNGAGLAMGTMDIVKLYGGKPANFLDVGGGATQERVAEAFKIILTDPSVKVILVNIFGGIVRCDLIAEGVIAAVNEVGVRVPVVVRLEGTNAEMGRQILAESDVNILTAQSLQQAAELAVNAAKGEH

SEQ ID NO: 56553 - protein, 486 aa, Zea mays
MSLASSHHLRPSPAGPARRPGCPAPRVALCRPPGASPPYRGRCCTIVAAAAPAAGAGGEAASAPTAAVPAVAPGAAARDYVRSHTISVFVGDESGMINRIAGVFARRGYNIESLAVGLNKDKALFTIVVSGTDMVLNQVIEQLNKLVNVHSVEDLSKEPQVERELMLIKLNVEPDQRPEVMVLFDIFRAKVVDISEKTLTIEVAGDPGKIAAVQRNLRKFGIKEICRTGKIALRREKIGATARLWRFSAPSYPDLIEALPKKPLTSVNKTVNGSFVRPSNAGGDVYPVESYESSANQVLDAHWGVLDDDDATGLCSHTLSILVNDCPGVLNIVTGVFARRGYNIQSLAVGSAEKEGISRITTVVPGTVESIGKLVQQLYKLIDVHEVHDITHSPFAERELMLIKVSVNTAARREILDIAEIFRAKPIDVSDHTVTLQLTGDLDKMVALQRLLEPYGICEVARTGRVALVRESKVDSKYLRGYSLPL

SEQ ID NO: 56554 - protein, 433 aa, Bacillus cereus ATCC 10987
MQPSAPPHLESTETIFSSSITKLVVFICWLAILADGYDLGIYGAVLPKLLEDKSWALSPAHAGTIASYALFGMFIGAILVGTITDLIGRKWTLICCLALFSITMGLAALAPSPELFGLSRFIGGIGLGGVIPTASALTVEYSPKKRQSFIYALMFTGYPLGIVLGAILSMFMLEGFGWRTMFGIGMIPLLLIPFIIRYLPESIQFLLSRNRQKEVDQILNRFEIEFYVKDETHQPSSNMRKRNGFLTLFSKEYRKATLLFWITYIMGMFLIYGLNTWLPQMMRQAGYPLGSSLSFLLMLNITAAIGALFAGAIADRIGAKIVISISYLMAAICIGLLTIKPSVTIIYLLIGLAGIGSVGITQILNAYVTQYFPSHIRATSLGWGLGLGRVGAITGPILVGIIMTMQYDLAWNFYLFSFAGLLAAISVFFIPTK

SEQ ID NO: 56555 - protein, 325 aa, Wolbachia endosymbiont of Drosophila melanogaster
MVRAIQIKKTGGPEVLEFVDKSIGEPKGEEVLVRHTTIGLNRYDLEHRKGTRKIKNLPSVLGVEAVGVIEKLGKKISDGLKVGDRVGYCTAPPGAYCEKRIIHQKYLIKIPDDISDEVAAAVLFKGMTAHYLVNQSYKVRPGAFVLVHGANGGLGQIICQWAKDKKGVVIGSVSSDEKMKIALQSGCTYAINYNDKDFVSKVMEITQNRRVGAVYDPIGYATSKLSFESLGRFGIYVSYGQISGNAPISFSLLSSRSLFATGTSIYHYKHDRFTLVLTTMEIFEMIRKKLLTVRINKKYKFDEIIQAHRDMENRKASGLNIIKIS

SEQ ID NO: 56556 - protein, 89 aa, Glycine max
MALRRFYNEIKGKRVSEVPEHVKPMLSLSYIKKAIQRGFDNYHAKYIETSSPDPIFHVCYGGMIFSYLVALPHERRHLLHAQEHAQQHH

SEQ ID NO: 56557 - protein, 578 aa, Psychrobacter arcticus 273-4
MEIKAPDLGVDSAEVSEIMVAVGDVIAKDDNIILLESDKASVEVPSSAAGKVTKISVAVGDQVSEGMVLIELESETENQDDSQSTEAAVADTQDKSRDTEQEETQKEEQSDKVTAESNTAQPAQQAATATTHALPDLGVDEAQVSEIMVSVGDMVTADQSILLIESDKASVEVPAPQAGKVEKILVQTGDMVANGQDFIVIIGQSSDNTNITSEAKAEDAQSQDPKPAATDEKADASQKADKQVTTAPKQAANATTSASNKLTEAQVNEKMVDVYAGPAVRKLARQLGVDISEVAGSALNARILKEDLFAHVKQSLTTQQASPATATGASRASLPSLPDMSNVEIWGETETQDLTRLQKVSIPQLNYNTYLPQVTQFDLSDITETEQLRSELKGGMKAEGIGLTILAFIVKATAYALTQHPRFNSHLSDDNTQVILRKSVNMGIAVATDDGLIVPVIKNAHEKGIKQIAIEIGELAIKARDKKLSTKDLQGASFTISSQGILGGTAFTPLVNWPQVGILGASEATMQPKWNAAKQAFEPRLMLPLSLSYDHRVINGADAAVFTRYVATLLADPRRILL

SEQ ID NO: 56558 - protein, 489 aa, Arabidopsis thaliana
MGGGNSKEESSSPSSSSWASHQSYPQYGPDSYNYPPPPTYAPAPSPAPAPAPVPAPSPASSYGPQYSQEGYASQPNNPPPPTYAPAPSPASSYGHQYSQEGYASAASQPNYPPPPSQSQVADRKKFDRRYSKISDNYSSLLQVSEALGRAGLESSNLIVGIDFTKSNEWTGAKSFNRKSLHHLSNTPNPYEQAITIIGRTLAAFDEDNLIPCYGFGDASTHDQDVFSFYPEGRFCNGFEEVLARYREIVPQLKLAGPTSFAPIIEMAMTVVEQSSGQYHVLVIIADGQVTRSVDTEHGRLSPQEQKTVDAIVKASTLPLSIVLVGVGDGPWDMMQEFDDNIPARAFDNFQFVNFTEIMSKNKDQSRKETEFALSALMEIPPQYKATIELNLLGVRNGNIPQRIPLPPPVQSGSSFSSSRIPNFEPSVPPYPFESKQMSSADDIQLCPICLSNPKNMAFGCGHQTCCECGPDLKVCPICRAPIQTRIKLY

SEQ ID NO: 56559 - protein, 522 aa, Arabidopsis thaliana
MVVSADCRISLSAPSCIRSSSTGLTRHIKLGSFCNGELMGKKLNLSQLPNIRLRSSTNFSQKRILMSLNSVAGESKVQELETEKRDPRTVASIILGGGAGTRLFPLTKRRAKPAVPIGGAYRLIDVPMSNCINSGINKVYILTQYNSASLNRHLARAYNSNGLGFGDGYVEVLAATQTPGESGKRWFQGTADAVRRFHWLFEDARSKDIEDVLILSGDHLYRMDYMDFIQDHRQSGADISISCIPIDDRRASDFGLMKIDDKGRVISFSEKPKGDDLKAMAVDTTILGLSKEEAEKKPYIASMGVYVFKKEILLNLLRWRFPTANDFGSEIIPFSAKEFYVNAYLFNDYWEDIGTIRSFFEANLALTEHPGAFSFYDAAKPIYTSRRNLPPSKIDNSKLIDSIISHGSFLTNCLIEHSIVGIRSRVGSNVQLKDTVMLGADYYETEAEVAALLAEGNVPIGIGENTKIQECIIDKNARVGKNVIIANSEGIQEADRSSDGFYIRSGITVILKNSVIKDGVVI

SEQ ID NO: 56560 - protein, 639 aa, Streptococcus thermophilus LMG 18311
MIILQGNKIERSFSGDVLFDNINIQVDERDRIALVGRNGAGKSTLLKILVGEEAPTSGEINTKRDLNLSYLAQDSRFESSNTIYEEMLNVFSDLRADEKRLRDMEMKMAELTGEDLNKLMIDYDRLSEDFRQRGGFTYESDIRAILNGFKFDESMWGMPISDLSGGQNTRLALAKMLLEKPELLVLDEPTNHLDIETITWLENYLVNYQGALIIVSHDRYFLDKVATVTLDLTKHSLDRYVGNYSKFMDLKAEKLATEAKNFEKQQKEIAKLEDFVNRNIVRASTTKRAQARRKQLEKIERLDKPTEGQKSANMTFHVDKVSGNVVLTVRNAAIGYDNEILSEPISLDVKKMDAIAIVGPNGVGKTTFIKSVVGKLPFIKGSSTYGANVEVGYYDQTQSALTPSNTVLDELWNDFPTTPEVKIRNRLGAFLFSGDDVKKSVSMLSGGEKARLLLAKLSMENNNFLILDEPTNHLDIDSKEVLENALIDFDGTLLFVSHDRYFINRVATKVMEISEDGATIYLGDYDYYLEKKAELEELARLEAEENQGPEETQVASAGASDYQAQKASQKEIRKLSRRIEQIENELETIEERLGKISIAMLETNDVVELSDLQKELDDLSVNQEALMEEWSDLSEQLES

SEQ ID NO: 56561 - protein, 211 aa, Streptococcus thermophilus LMG 18311
MPKKPIIIGVTGGSGGGKTSVSRAILSNFPDEKIAMIEHDSYYKDQSHLTFEERVSTNYDHPFAFDTDLMIEHINELIAGRPVDIPIYDYTQHTRSNKTYRQEPQDVFIVEGILVLEDKRLRDLMDIKLFVDTDDDIRIIRRIKRDMEERGRSLDSIIDQYNSVVKPMYHQFIEPTKRYADVVIPEGVSNTVAIDLINTKVASILEESKKA

SEQ ID NO: 56562 - protein, 267 aa, Vibrio sp. Ex25
MHPMLNIAIRAARKAGNHIAKSLENTDKVESTLKGTNDFVTNVDKEAEYIIIDTIKQSYPEHCIVAEEQGLIEGKDKDVQWIIDPLDGTTNFVKGYPHFAVSIAVRIKGKTEVACVYDPMQNELFTAQRGAGAQLNSARIRVAQLKDLQGTVLATGFPFKQKQHAESYIKIVGALFTECADFRRSGSAALDLCYVAAGRVDGYFELGLKPWDMAAGELIAREAGAILTDFAGGTEYMKSGNIVASSARGVKSILKHIRENGNSAILK

SEQ ID NO: 56563 - protein, 497 aa, Salmonella enterica subsp. enterica serovar Paratyphi B str.
MKTQTTHAAEQHAAKRRWLNAHEEGYHKAMGNRQVQMIAIGGAIGTGLFLGAGARLQMAGPALALVYLICGIFSFFILRALGELVLHRPSSGSFVSYAREFLGEKAAYVAGWMYFINWAMTGIVDITAVALYMHYWGAFGDVPQWVFALGALTIVGTMNMIGVKWFAEMEFWFALIKVLAIVIFLVVGTIFLGTGQPLEGNATGFHLITDNGGFFPHGLLPALVLIQGVVFAFASIELVGTAAGECKDPQTMVPKAINSVIWRIGLFYVGSVVLLVLLLPWNAYQAGQSPFVTFFSKLGVPYIGSIMNIVVLTAALSSLNSGLYCTGRILRSMSMGGSAPKFMAKMSRQHVPYAGILATLVVYVVGVFLNYLVPSRVFEIVLNFASLGIIASWAFIMVCQMRLRQAIKEGKAADVSFKLPGAPFTSWLTLLFLLSVLVLMAFDYPNGTYTIASLPLIAILLVAGWFGVRRRVAEIHRTAPVTADSTENVVLKEEAAT

SEQ ID NO: 56564 - protein, 477 aa, Streptococcus thermophilus LMG 18311
MAKQYKNYVNGEWKTSENSITIYAPANGEELGSVPAMSQAEVDEVYAAAKAALPAWRALSYAERAAYLHKAADILERDAEKIGQVLSKEISKGLKSAIGEVVRTAEIIHYAAEEGLRLEGEVLEGGAFDAGSKKKIAVVRREPVGLVLAISPFNYPVNLAGSKIAPALIAGDVVAFKPPTQGSISGLLLVEAFVEAGIPAGVLNSITGRGSVIGDYIVEHKAVDFINFTGSTPVGENIGRLAAMRPVMLELGGKDAAIVLEDADLDLTAKNIVAGAFDYSGQRCTAIKRVLVMDSVADELVEKVTALVGNITVGMPEESASVTPLIDTKAADFVQGLIDDAVEQGATAKTELKREGNLIYPAVFDHVTTDMRLAWEEPFGPVLPFIRVSSVEEAIKISNESEFGLQGAVFTQDYPRAFAIAEQLEVGTVHINNKTQRGTDNFPFLGVKGSGAGTQGVKYSIEAMTRVKSTVFDISDY

SEQ ID NO: 56565 - protein, 577 aa, Streptococcus thermophilus LMG 18311
MTKMLKGIAASDGVAVAKAYLLVQPDLSFETVTVEDISAEEARLDAALAASQDELSVIREKAVESLGEEAAAVFDAHLMVLADPEMTGQIKETIRAKQVNAEAALTEVTNMFIAIFEGMDDNPYMQERAADIRDVTKRVLANLLGKKLPNPATIDEESIIVAHDLTPSDTAQLNKKFVKAFVTDIGGRTSHSAIMARTLEIAAVLGINNITELVKDGDILAVSGITGEVVINPTEEQIAEFKAAGEAYAKQKAEWAQLKDAPTVTADGKHFELAANIGTPKDVEGVNDNGAEAVGLYRTEFLYMDSQDFPTEEDQYEAYKAVLEGMNGKPVVVRTMDIGGDKGLPYFDLPKEMNPFLGYRALRISISETGNQMFRTQLRALLRASVHGKLRIMFPMVALLTEFRTAKGILEEEKAKLVAEGVAVADDIEVGIMIEIPAAAMLADQFAKEVDFFSIGTNDLIQYTMAADRMNEQVSYLYQPYNPSILRLINNVIKAAHAEGKWAGMCGEMAGDQTAVPLLVGMGLDEFSMSATSILRTRSLMKKLDTAKMEEYANRALTECSTMEEVLELSKKYVNVD

SEQ ID NO: 56566 - protein, 266 aa, Sphingomonas sp. CHY-1
MTARLEGQVALLTGGATGIGEAVVARFIEEGAKVGVLVRDAAQADLVRTRHGNAVVVIEGDVRNYVDNEKAVVATVAAFGKLDVFVGNVGIWDFMTPLADMEPEKLSETLDEIFGVNVKGYFLGARAAIPELRKTKGSIIFTASTSSFYTGGGGTPYVASKHAVLGLIRQLAWELTPDVRVNGVAPGGTRTPLGGTHAGGTADVHMEDMEGLDAMIAGMTPLARIAEPDDHSGLYALLASRRDSAYMTGTVLLSDGGIGIGKRPGS

SEQ ID NO: 56567 - protein, 338 aa, Pseudomonas putida
MNLNRFKRYPLTFGPSPITPLKRLSEHLGGKVELYAKREDCNSGLAFGGNKTRKLEYLIPEAIEQGCDTLVSIGGIQSNQTRQVAAVAAHLGMKCVLVQENWVNYSDAVYDRVGNIEMSRIMGADVRLDAAGFDIGIRPSWEKAMSDVVERGGKPFPIPAGCSEHPYGGLGFVGFAEEVRQQEKELGFKFDYIVVCSVTGSTQAGMVVGFAADGRSKNVIGVDASAKPEQTKAQILRIARHTAELVELGREITEEDVVLDTRFAYPEYGLPNGGTLEAIRLCGSLEGVLTDPVYEGKSMHGMIEMVRRGEFPDGSKVLYAHLGGAPALNAYSFLFRNG

SEQ ID NO: 56568 - protein, 299 aa, Deinococcus radiodurans R1
MPRHFGAVPGVVPGMAFVNRQELRDAGVHLPTQAGISGSASEGADSIVLSGGYEDDRDEGDVILYTGEGGRDPLTGHQVKPQQLVRGNLALAISHRDGLPLRVTRGHRHSSQFSPQSGYQYAGLYRVDDHWREVGRSGFLIWRFRLTRLENQDAHHAGADPQHPDSQHPERRPTLVQRIVRDTATARAVKALYDHRCQVCGERLETPAGAYAEAAHIRPLGAPHHGPDVAGNILCLCPNHHVLFDFGAFSVGDDLRLLGLPGRLHVHPQHAVDREHLAYHRRHYALQAGLEWGCSVPLT

SEQ ID NO: 56569 - protein, 746 aa, Oryza sativa Japonica Group
MNMSPRIPVVDLEDGWRDVLAGVAKLKCILDGSNVVHFVPDEYMHLYTTVYNMCTQKPPNDYSQVLYDRYKQALDDHIESVVLPSLNEKHGVFLLREIVQRWEKHKLMVRWLRRFFDYLDRYYVTRRSLDSLKDLGWSSFRDLVFDKLKSTVATIMIGMIDDEREGNLIDRPLLKNALDIYVEIGDSQLNYYSDDFEQSFLNGTTDYYSKKAQTWILENSCPEYMLKAEECLQKEKDRVANYLHSTTEPKLFAAALFELIDRRAEEILNKENSGCKVLLCDEKTEDLARMFRLFSRITDGLLPVSKIFKEHVIAEGMSLLKHATDAANSRKDEKKGVVVGLPEQDFVRSVIELHDKYMAYVTNCFQSNSVFHKALKEAFEVICNKDVVGCSSAELFAAYCDSILKRGGSEKLSDEAIDESLEKVVKLLTYLSDKDLFVEFHRKKLGRRLLFDKNTNDEHERILLSKLKQFFGGQFTSKMEGMLKDITLAKEHQSSFEEYVSNNPESNPLIDLNVTVLTTGYWPTYKNSDINLPLEMVKCVEVFKEYYRSDKQHRKLTWIFSLGNCVVIGNFDAKPVEFVLNTYQAALLLLFNEADKLSYSDIVSQLKLSDDDAVRLLHSLSCAKYKILNKEPSNRVISPEDEFEFNSKFTDRMRRIKVPLPQIDEKKKVVDDVNKDRRFAIDASLVRIMKSRKVLGHQQLVAECVEQLSRMFKPDIKIIKRRIEDLISREYLERDSENAQTYKYLA

SEQ ID NO: 56570 - protein, 437 aa, Haemophilus ducreyi 35000HP
MKVSELIDLDQQHIWHPYSSMTDPIPVYPVESANGVKIRLKDGRDLIDGMSSWWAALHGYNHPRLNQAAINQLQKMSHIMFGGLTHEPAVKLCQKLLEILPLSLNKIFFADSGSVAVEVAMKMALQYQQAKASQIGAAKTSRTRAKFATIRAGYHGDTWLAMSVCDPVTGMHGLFNSSLPVQFFLPQPSIKFGEPWQDTAIQPLQDLFEQHANEIAALILEPIVQGAGGMYFYSPVYLQKARELCDQFGILLIFDEIATGFGRTGKLFALEYANVVPDILCLGKALTGGYLTLSAAITTTAVANIICEGEAKCFMHGPTFMANPLACAIAYESINLLLATDWRSNIQRIEQQLTQQLAIAKQFNAVADVRVLGAIGVIEMREPVDLVQLQHYFVEHGIWVRPFGKLVYIMPPFIISEAELTFLTSQLIAVLRKVYNE

SEQ ID NO: 56571 - protein, 742 aa, Cryptococcus neoformans var. neoformans JEC21
MISVRLNEYNLPEGKDEDKVSFDLAELDNLSDWSGWAFYRIAPTWIEARPLDNVSLLSNQLTTHLLLVKRKSQPDHIACVYPISSSSALSNIVNDNGDIKVQLRRAKGNSDAKAAVVIGTASDASQLNCLIGDVVRTARGWLLDVPAKEVVDFKSFPSGGPLDGVGFCTWSSLGEDIRPDRENMSGLFNALTDHNLPIQSFILDDGWLNQKTYEKGDSSPFVSTTGPEEERGTWQLRGLYDFDAWSGLGHDGIKMIVDEATTRLSKIDGVKDTIQVGVWMSLVGGYWDGISPDSPLIAKYKCRPYPASRARLPGISNEPFTVGFLPGGKGTYWLPPPSESLRFWRDWFNYLKSQGVDFLKVDNQGSMSLVDGTEGVECQHAIWENMVKASDEVFGKGKVIHCMSHHESIWGGIQGLGIVTEGEKFVWRNSDDFGLGHKKANAHQQHIFTNLSNSLLTSHLAMILDADMFMSAEQDPVPHAFLRALYPGPLLLSDRPGIHDSRLLGRMISKDKTGIARVIKTQHPAVPLSHRALDIDVIGKGEGSGLYAAAPTEAGVILGVWNVREDNDNGRVVDKLTFTDVKYALNGKDMSSPWLIVESDLEKGGISRTGLLSSSDAVITDIVLERMKAASFWLTPLRPVNKVGVAVLGLTKHFAGLMAVTDVQSNDTRVTAQVNGEGTFGFVVVSSQRPMYTIHVDDQVQDATLALTPSFHGVDKVWLIETEIRANGTRGDGWTVAIDILG

SEQ ID NO: 56572 - protein, 486 aa, Physcomitrella patens subsp. patens
MTGVVESARRLRSRSSSSLSVPTADEVRQTRAAAKRSVMEETSSRPGNSTVHPSKRVGAQPVRKRAALSNISNQHYVIPSGRPMVGLADVKSVDLKASQITRGDENLHSVNRAQPTVKGAHLEAALECEIERDSRSDSEAIASLERRTVQNLYISQEAKDRVKQGTIVREIMPLTLVISRHVGNLFSDKSFSVTPELPGIVAYQDIDNDHSDPQMCSTYATDIYSYLRMAEIKRRPSGNFMESMQQDINPTMRGILVDWLVEVAEEYKLVPDTLYLTVSYIDRYLSLHVVTRQRLQLLGVACMLIAAKYEEICAPQVEEFCYITDNTYCREEVLEMERAVLNVLKFELTTPTTKSFLRRFIRAAQASYKTPTLVLEFLGNYLAELTLLEYGFLPFLPSMIAASAVYLAKITLDSSTCPWDATLQHYTGYRPSELGHCVKAIHELQRNTDSCSLPAVREKYRQHKFKCVATLAPPAVLPEEYFLDRD

SEQ ID NO: 56573 - protein, 147 aa, Brassica napus
TVSEYFLSRAMEVSSNEYEPSERDIVYAEGVTQGNGLACMEFSLTEQSPLSDTYPENPDVLSPPQPKYQLIRVNAKGMNDSCKWVEMFEDVRAVIFCISLSDYDQISITPEGSGTVTFQNKMIQSKELFESMVKHPSFRDTPFILIL

SEQ ID NO: 56574 - protein, 711 aa, Haemophilus influenzae Rd KW20
MSRTIILIPVSTGVGLTSISLGLIHSLEQKGTKVAFMKPVSQPSTGEDKLDRTTSIIRTSTSLETAEPFMLSVAESLIGQNQSDVLLEKIVANHQQLTKNNDIVVVEGLIPTRKHGYANSINYEIAQALDAEIVLVAAPATETPTELKDRVEAAASLFGGKNNPNLLGVVVNKFNAPVDESGRTRPDLAEIFDSFQHNHISETEVNKLFAGSAIKLLACVPWNANLIATRAIDLVKHLGASIINEGEINRRIRGITFCARSLPNMVEHFRAGSLLVASADRPDVLVAAALAASNGIEIGGILLTGGYKIDAQINKLCRPTFEKAKLPIFRIEGNTWQTALSLQSFNLEVPVDDKERIENIKQYISQHFNADFINNLVADSSRLPRLSPPAFRFQLTELARAAKKRIVLPEGDEPRTIKAAVLCAERGIAECVLLADPASVQRVAEAQGVKLGKGITIINPADVRENYVDRLVELRKAKGMTETAAREQLEDTVVLGTMMLEANEVDGLVSGAVHTTANTIRPPMQIIKTAPGSSIVSSIFFMLLPDQVLVYGDCAVNPDPTAEQLAEIAIQSADSAKAFGIDPKVAMISYSTGTSGSGADVEKVKEATRIAKEKRPDLLIDGPLQYDAAVMEDVARSKAPNSPVAGKATVFVFPDLNTGNTTYKAVQRSADLVSIGPMLQGMRKPVNDLSRGALVDDIVYTIALTAIQATQ

SEQ ID NO: 56575 - protein, 332 aa, Bacillus cereus ATCC 10987
MLMTRPNLKGRSFLAEKDFTQEELLYFLDLAAELKEKKKNGIPHHYLEGKNVALLFEKTSTRTRCAFTVACTDLGANPEYLGKSDIQLGKKESVEDTAKVLGRMFDGIEFRGFNHETVESLAQNSGVPVWNGLTDMWHPTQTLADLLTIREHVGKLKNVKLVYVGDGRNNVANSLLVGGAIVGMDVRICTPETLWPAQEVIDLAKKYNEQVMITSNVEEAVANADVIYTDVWVSMGEEEKFAERVKLLKPYQVNMKMIKETGNENVIFLHCLPAFHDVETMYGEEVYEKYGLKEMEVTDEVFRSKHSKVFDQAENRMHTIKAVMAATLGNME

SEQ ID NO: 56576 - protein, 547 aa, Psychrobacter arcticus 273-4
MGSKTIGDATNDTGKDTETEVSNKESGRVLNPEHTEGKNKKERVEQTHEQVNDDIMHHPDLVNPLDDTRIDVKSGFTKDSQRLKSDKHEFEYDAVVLGAGPAGEAAAMKLAKSGKKVVVIDPREQVGGNCTHVGTIPSKALRQSVFNLINFRRDQMFTKAMDYHQVPLNIVLAKARKVILQQVQTHTRFYERNQIEVIHGWANFIDKNTIRIEIDENTFETITFNKAIITVGSRPYRPDILDFDHPRVFDSDKILQMDYVVKKIIIYGAGVIGCEYASIFTGLGYKVDLINNQNQLLSYLDSEISDAIAHDFRQFGVVIRSNEEIDHLETHDDCVILHLKSGKKIKSDAILWSNGRSGNTEGLNLECLGLKANSRGQLKVDDTYCTEVENIYAAGDVIGWPSLASAAYDQGRCAAAFMVGDRDAEPVSSVPTGIYTIPEISCIGKTEQELTDAKVPYEVGQAFFKHLARAQIIGERSGVLKILFHRETLEILGIHCYGNHASEIIHIGQAVMKCNATLEYFVNTTFNYPTMAEAYRVAALNGLNRVF

SEQ ID NO: 56577 - protein, 233 aa, Synechocystis sp. PCC 6803
MAGENRPWTGAEKLTITVLIMACERAKGNSPQLRLGTRGAQRVKCDRVLSPFGCDSFVFRWRKIVDLSRIPAQPKAGLINVLIEIPAGSKNKYEFDKDMNCFALDRVLYSSVQYPYDYGFIPNTLADDGDPLDGMVIMDQPTFPGCVITARPIGMLEMIDGGDRDEKILCVPAKDPRYTYVKSINDLAGHRLDEIAEFFRSYKNLEKKVTEILGWKDVDAVLPLVEECVKNYK

SEQ ID NO: 56578 - protein, 794 aa, Psychrobacter arcticus 273-4
MAAQSTALVINLDQLGKDDIEMVGGKNASLGEMISHLSDLGVSVPGGFATTSNAFNQFLTETGLLDKINSELKTLDVNDVNKLAETGKKIRTWIIEQELPKDLEQAVRESFEEMSDGKEIAVAVRSSATAEDLPDASFAGQQETFLNIRGIDNVLIAIKEVFASLYNDRAISYRVHKGFEHEGVALSAAVQRMVRSETGAAGVMFTLDTESGFDQVVFITSSYGLGEMVVQGAVNPDEFYVSKQLLANGKPAIIRRNLGSKHKKMIYGDEGSTTKSVKVIDVEKQDRMQFSLSTEELTSLAKQAMTIEKHYGQAMDIEWAKDGDTNEIFIVQARPETVKSRQDSNVMERYIIDTTNAKVLCEGRSIGQRIGSGKVRIVSNLNEMDKVQEGDVLVSDMTDPDWEPVMKRASAIITNRGGRTCHAAIIARELGVPAIVGCGNATELLVDGQDVTASCAEGDTGFIYESQIDFEIQTNSVESMPELAFKVMMNVGNPDRAFSFTQMPNEGIGLARLEFIINRMIGVHPKALLNMNSLPREIAQAINERIAGYASPVDFYVDKLVEGISTLAVAFMDQPVIVRMSDFKSNEYANLLGGKLYEPSEENPMLGFRGASRYVSDNFRDCFELECKALKRVRDEMGLTNVEIMIPFVRTVGEAKQVIELLEKNGLKRGENGLRIIMMCELPTNCLLAEEFLEHFDGFSIGSNDLTQLTLGLDRDSGIVSHLFDERDPAVKKLLSMAIDACRKQNKYVGICGQGPSDHPDLAYWLMEQGISSVSLNPDSVLDTWFFLAGEEAK

SEQ ID NO: 56579 - protein, 102 aa, Oryza sativa
  misc_feature (9)..(9): Xaa can be any naturally occurring amino acid
MDEEQLRAXLLRDLDALKQRPDPAAIDRMRERVAGMVTPAAAARSKIKDMSSEVVDSNPYSRLMALQRMGIVDNYERIRDYSIAIVVSTAPAQYCFGTAILA

SEQ ID NO: 56580 - protein, 274 aa, Nostoc punctiforme PCC 73102
MEKQQLIKLLIGDFTWQRLLKSFIFIYIFFAGYIYLRVDSMIFLPRPSSYQDNPKIIKLKSGENTNISATYLLNNQANYTILYVHGNSEDLGDIKEILEKLHAWGFSVFAYDYRGYGTSQEKATENHAYEDINSAYNYLTQNLKIPPERIIVLGRSVGGGSAVNLAMRKPIAGLLIESSFISAFQVIVPFRILPFDKFPNLDNIKKVKCPILVIHGKADDVIPFAHGEKLFNAAISPKLYLWVEEANHNDLFWVAEKKYQKALQEFTTLVKTNQ

SEQ ID NO: 56581 - protein, 391 aa, Streptococcus thermophilus LMG 18311
MAERILMTNGNLKVTDNPIIPFIEGDGVGRDIWKNAQAIFDKAVEVAYGGQRRIEWQEFLAGKKAFDKTGEWLPQETLEAIRESLVAIKGPLETPVGGGIRSLNVALRQELDLYACVRPVRYFEGVASPLKEPEKTDITIFRENTEDIYAGIEWEAGTVDVERVIAFFQTEMNVDKIRFPKSSSIGIKPISIEGSKRLIRSAIDYALKNNLKKVTLVHKGNIQKFTEGGFRKWGYEVAEEEYKEEMLAGRLEVNDIIADNFLQQILLNPEKFDVVALTNLNGDYASDALAAQVGGIGISPGANINYQTGHAIFEATHGTAPDIADQDRANPCSILLSGCMLLEYIGWSEAAELIISAIEKNFKSGIFTADLAFGKRAYSTSGFSNQILSII

SEQ ID NO: 56582 - protein, 388 aa, Wolbachia endosymbiont of Drosophila melanogaster
MDKIIIKKFGGTSLTDLNRVANLIKNDIEKGCNVIVVVSAVAGFTDQMVFQARQISNLSYRQELSEYDVMLSAGEQISCGLLAITLQSIGVNAKSWLAWQLPIVTDDFYSESKIKTIKIERVKRSFAEGYTAAIIAGFQGINDDRITTFGRGGSDISAVAFAVAFGVRTCEIFTDIDGIYTADPRIVPKARKLKFISYDEMLEMSSSGAKILHNRSVQLAMKHNIKVQVLSTFKEVEGTTVLHKRDVLERYLITGITYSTNEALVTFTNLANNLRTLRDIAGANVKIDMIHGSSFVISKFDIDLMEKLLNKNENYAINDNVAKISIIGIGVMSNTEVMHRTLKVLSEKKIEILAITTSEIKISIIVQKECAVALVKDLHTEYELDMQH

SEQ ID NO: 56583 - protein, 297 aa, Salmonella enterica subsp. enterica serovar Paratyphi B str.
MKPQIYHVDAFTSEPFRGNSAGVVLHADTLSDAQMQLIARELRHSETAFLLKSEESDVRIRYFTPTVEVPICGHATVAAHYVRATVLGLGNTTVWQTSLAGRHRVEIHAEHNDYRITLEQGQPSFEPPLVGEIRAAIITALNLTEDDIVPGAPIQVASTGHAKVMILLKPDVDIDALSPNLAALTAISQQIGCNGFFPFQIRPGKNETDGRMFSPAIGIVEDPVTGNANGPMGAWLVQHGLMAHDGKTLQIQGHQGRALGKEGTVDVTVTIRDNQPENVTISGQAVILFHAEWAITF

SEQ ID NO: 56584 - protein, 536 aa, Zea mays
SAPYVAAPAKATLLPVPAMDAVATSDAVLLLAAVAISLLITATFWSRHRRQGEAPSPPSLPLLGHLHLLGNGKPLHHSLAALAIARGTGGAPAPLLSLRLGARRALLVSEHAAAEECFTAHDAALGGRPRLLVGDRLNYGYTTVGWSSHGDHWRALRRFMAVELFAASRLAARAADRRAEVAALVGALVRDAPRAGAAVALRPRLFELVLNVMLRALTGAPGHGGGDVRGLQEIIEETFAVTGVMSVGDFYPALRWVDRLRGVDAALLRLQARRDAFVAGLVHDGRRSHNRKAGGGGGPTDTEKRSTIDELLSLQETDPGYYTDTVIKGIVSILLSAGTDTTALTMEWAMAQLLMHRDAMQKARAEIDANVGTSRLVDESDTTHLPYLQCVVKETLRLCPVGPVIPAHEAMEDCAVGGFRVRRGTMVLVNAWLIHRDPRLWEAPEEFRPERFLDATATVAAPLLPFGLGRRRCPGEGMALRLLSLTLAALLQCFDWEVGGCVDMAEGVGLSMPMAKPLAAVCRPREFVQTVLSAST

SEQ ID NO: 56585 - protein, 336 aa, Pseudomonas plecoglossicida
MNLNRFKRYPLRFDLPYAAKRPSEHLGGKVELYAKREDCNSGLAFGGNKTRNPEARIPEAIEQGCDTLVSIGGIQSNQTRQVAAQAARTWAPNALLVQENWVNYSDAVYNRVGNIKMSRIRGADVRLDSAGFNIGIRPSWEQAMADVRAAGGKPFPIPAGCSEHPYGGLGFVGFAEEVRQQEAELGFKFDYIVVCSVTGSTQAGMVVGFAADGRAQRVIGVDASAKPEQTKAQILRIARHTAKLVDLGREITEKDVVLDTRFAYPRVRPAQRRHAGSHSPVRSFWRACVPDPVYTRPKSMQRDDEMVRRRRIPGRLPKVLYAHLGATYQPSAVAEQ

SEQ ID NO: 56586 - protein, 293 aa, Thiobacillus denitrificans ATCC 25259
MTVHTAAEKAYILSEALPYIQRFYDKTIVIKYGGNAMTERHLMEAFAKDVVLLKLVGMNPVVVHGGGPQIAGLLQRIGKQSEFIQGMRVTDEETLDVVEMVLGGLVNQDIVTLINKHGGRAVGLTGKDGNFIHAKKMLVKSKEKADEMLDIGQVGEITGIDPEIIQVLDARDFIPVVAPLGTDAEGNAYNINADVAAGKIAGVLQAEKVIFMTNTPGVLDKDKKLLTGLTPREISDLIADDTISGGMIPKVGYAVDAVNSGVKTAHIIDGRVEHALLLEVLTPEGVGTLIKRS

SEQ ID NO: 56587 - protein, 574 aa, Prochlorococcus marinus str. MIT 9313
MLRLEHVNKVYPTHEVLKDVTWEIKPGDRIGLVGVNGAGKSTQLKLIAGLEEASSGQIVRQGNPRIAYLQQEFDVDPCRTVREELFQAFGEAAAVVHQQRLVETAMATKRAAEDSVFLDSLIKDLSRLQNCFEALHGYELEARIEKLLPTLHFTSDGADKRVGDYSGGWQMRIALGKILLQDPDLLLLDEPTNHLDVDTIQWLEDYLLKQTAAMVVISHDRTFLDRICTQIVITERGISRTYLGNYTAHLEQKALEEEATQAAFERQQKDLAAQQAYVDRFRASATRSTQAKSREKLLEKVERIEAPVKSVSGPSFRFPDAPRSGRQVAVIEDLSHSYGDKILFLGAHLEVEPGDRIAFIGPNGAGKSTLLRLIMGLEAADDGRASLGEHNVIAGYFEQNQAEALDLQKTVIDTMFEAVPDWTQTQVRSLLGSFCLSNDAVFKNVENLSGGEKARLALALMLVKPCNLLLLDEPTNHLDIPAKQMLEDALQAYEGAVLLVSHDRYFISRVANRIVELRDGELILYRGNYAYFQEKKSEEQAAAAAALALAEKEVKRLANRDRQRKRQARKKGAA

SEQ ID NO: 56588 - protein, 417 aa, Erythrobacter sp. NAP1
MNAPDKSIKATATPADLTLEDVKAAAARIEGSVVKTPMMHSITLSEITGADIWLKFENLQFTAAYKERGALNALLQLTDEQRERGVIAASAGNHSQGLSYHGTRLGVPVTIVMPKTTPTVKVMQTESVGGNVVLHGETFDEANAHARELEIERGLTFVHPFDDPHIAAGQGTVALEMLELKDDFDCLVTPIGGGGLISGMATVAKTLNPDIEMVGVQAGLFPSMFDRFKGESHDCGGDTLAEGIAVKNPGEFTSQVIKERVDDILLVDEPSLEKAVSLLLQIEKTVVEGAGAAGLAAVLENPERFAGKTVGLVLCGGNIDTRLLANVLLRDLARQGRLARLRVTLQDRPGALFKVMRLFDEHNVNIIEIYHQRIFTTLPAKGLITDIECEARDAGQVERLVEALRGAKYQVQVVELN

SEQ ID NO: 56589 - protein, 349 aa, Burkholderia thailandensis E264
MKALVYHGPGRKSLDERPMPELAAPTDVIVRVTRTTICGTDLHILKGDVPSCEPGRIIGHEGVGVVHRAGAAVSTLKEGDRVLISCISSCGQCEYCRRGMYSHCTTGGWILGNRIDGTQAEYVRIPHAQTSLYRIAPGADEEALVMLSDILPTGFECGVLNGRVQPGGTVAIVGAGPIGLAALLTAQFYSPAQIVMIDPDPNRLAVAQRFGATACIDNGQVDAVAEVKALTGGGVDCAIEAVGIPASFELCQQIIAPGGVIANVGVHGVKADLHLETLWDRNITITTRLVDTSSTPMLLKTVGAGRLDPRRLITHRFPLADIEQAYETFGHAANTRALKVIVEVSDISE

SEQ ID NO: 56590 - protein, 268 aa, Acinetobacter sp. ADP1
MMIVPKFGLGTFRLNDQIVIDSVKTALDVGYRAIDTAQIYDNEAQVGQAIQESGIARDQLFLTTKIWVDHLNSEQLIPSLKQSLQKLRTDAVNLTLIHWPAPQKGIDIAAVMQLLLQAKQQGLTEHIGISNFNIAQTKTAIESIGQSHIATNQIELSPYLQNRTLVDFLKAQQIDVTSYMTLAYGKVLHDPVLQDIASEHQASTAQIALAWALQSGYAVIPSSTKREHLISNLKAQEIQLSQQDMQLIAALERNGREVDPAELAPEWD

SEQ ID NO: 56591 - protein, 196 aa, Yarrowia lipolytica CLIB122
MHESSALSKLYNWDCSVVFIILNIYTTMLVLVTTGGTVPFEALIELVLSHESITTLSQLGFSKMRVQYGRGNRHIFTKHHKEGVMSITGFEYTDDLAGEMSRAHLVISHAGTGSVLDALRIGKHPVVVVNSKLMDNHQIEIAEELFRKRHLLVSGDTDSVGFIKALKMHREYLFETLPDPEEGILQRIIEETVSFM

SEQ ID NO: 56592 - protein, 430 aa, Deinococcus radiodurans R1
MVGRPAGVGVEWASMSKHIKVPEQGEKITMQNGKLTVPNRPIIPFVEGDGTGPDIWAASVRVFDAAVEKAYGSERKLEWMEVYAGEKSLEVYGANEWLPQETLTAFRDYLFGIKGPLTTPVGTGIRSINVALRQELDLYACVRPVQYFNGVPSPVKRPEDIDMVIFRENTEDIYAGIEWKAGTDEAEKVRGFLMREMNVTKIRFPDTSSFGVKPVSKEGTERLVRAAIEYAIENGRKSVSLVHKGNIMKFTEGGFRDWGYELAKREFGAVEIDGGPWCQLPNGIVIKDVIADNFLQQILLRPTEYDVIATLNLNGDYISDALAAQVGGIGIAPGANINYVTGHAIFEATHGTAPKYAGKNVINPSSVILSGEMMLRYMGWTEAADLILKGLDATIQQRVVTYDFARGMDDATEVKTSEFADKIIENMRNA

SEQ ID NO: 56593 - protein, 237 aa, Zea mays
MSKTKSVTKGSKATDKVLSKVKDAGVTKASQSPKAKSKDIARKLKAKEEKAARKKKEPTPSSESESDSDEEMKEASSSESESESESEEEKEIKKPAAKATKPAAKKDESSESESESESESESESEDEKPAAKAKSTPAKEESSESESSESESEEEVKKTDKKAAAKEDASSDESDSESESDAEEDSDDSGSSESEEEEAPKKRKAEEEPATNAKKSKTESADNSPNLFVGNLSWNVD

SEQ ID NO: 56594 - protein, 558 aa, Deinococcus radiodurans R1
MTANDGAPAQAQPISSHSVWQGELARLRADQQQVRAGGGAKAQQRQHDKGRLTARERVSKLIDPGTPFDELMTFAGYGMYEDVGGCPSGGTVTGIGQIGGRPWMIIANDATVKAGAFFPITAKKVIRAQTIALENHLPTAYLVDSAGVYLPMQDEIFPDQDDFGRVFYLNARMSAAGIPQIAAIMGNCVAGGAYLPVMCDTLIMTEGSGLYLAGPALVKAAIGQVVDSEDLGGASMHSAIAGTVDYKEKDDDAAINRLRALAELYAPAEPAPFAKRRKETQDAPARDLTELVGFDSAKTYDVRDLIKSLADGGEFHEFKPEYGETIVCGFARAGGYPVAFVANQRTVIKKKLKSGGEPGLRTRIEVGGVIYGDSADKAARFILDANQAGVPLVFLSDVTGFMVGRDSEQEGIIRRGAKLVNAVSNSVVPKITIITGGSFGAGNYAMNGKAYGPRFIFAWPSAKYAVMSGNAAAKTLLDIQLAALKRSGHEPDDEELTRLYDEVKSKYDTELDPRYAAARLWVDEIIEPNDTRARLIRALEACAQNPRQEELRVGVFQV

SEQ ID NO: 56595 - protein, 111 aa, Ipomoea batatas
YFLYQILRGLKYIHSANVIHRDLKPSNLLLNANCDLKICDFGLARPNIENEFMTEYVVTRWYRAPELLLNSSDYTGAIDVWSVGCIYMELMNRKPLFPGKDHVHQMRLLTE

SEQ ID NO: 56596 - protein, 397 aa, Physcomitrella patens subsp. patens
QQRLKHQSLVQVMLQQNQHQPQQQALYHPGLLATIPQMEPLPSGNLPPGFDATSCRSVYVGNIHTKVTEALLAEVFSNIGPLEGCKLIRKEKSSYGFVDYLDHIYAAVALTTLNGRLIFGQPIKVNWAYASGQREDTTGHYNVFVGDLSPEVTDATLFAAFCVYPSCSDARVMWDQRSGRSRGFGFVSFRSQQEAENAISEMTGKWLGTRSIRCNWATKTNSSASADETNNGGHAVGMNDSKSEDRPEGSAGDGPENNPQYTTVYVGNLAHEVNQGELHRWFHCMGAGVIEDVRVQKDKGFGFVRYRTHEEAALAIQAANGRVLCGKSVKCSWGSKPTVPGSSSAPLPPPLPVNPYQAGLMSGVNLGYSAADLLAYQRQLSMTPQGAGRALLPLPHH

SEQ ID NO: 56597 - protein, 405 aa, Physcomitrella patens subsp. patens
SQMEPMASGNLPPGFDATSCRSVYVGNIHSRVTEGLLAEVFASLGPLEGCKLIRKDKSSYGFVDYFDHRSAVAALSTLNGRQMFGQSIKVNWAYASGQREDTTAGHFNVFVGDLSAEVTDATLFAAFCIYPSCSDARVMWDQRSGRSRGFGFVSFRSQQEAESSISEMTGKWLGTRPIRCNWAAKTNNTIQADESKLTTRGLTLCCLADVRSEDRQDSSAGDGPEINSQYTTVYVGNLSQQITQAELHRQFHSLGAGVIEDVRVQKEKGFGFVRYRTHAEAAFAIQAANGRVIWGKSLKCSWGSKPTQPGASSAPLPSPPSVGHYQGIMASGVNLGYGVADILAYQNLTRAGAGRALLPVPHQSLGMGLVQSPALGGPGSRGICDSFQPEVGLMSGTLGQQHIFH

SEQ ID NO: 56598 - protein, 503 aa, Burkholderia sp. 383
MLNESLATTDHAPLRRYEHLYIDGAWVKPIDGELAESIDPATGQPWAIAPMGGPQDIDRAVEAARTAFHGTWRSTPGHVRAALLRRLADLFSAAIPELAIIESRDNGNLVREHRASLTAQVQWYQWFASLADKAQGATIPIDDSVHAFTTRVPIGVVGAIIPWNAPLLATCLKVGAALAAGCTVVVKPAEQTPVSALELARLVHEAGFPPGVFNVVPGYGRTAGAHLVKHPDVNKISFTGASQTAKHMVRDGADNLKRFTFELGGKAPHILFADADLDNAINAATASAWRLTGQSCALGSRVLVERPIYDRVVEAFRTRAKAVRVGLPSIDSNHMGPQSHETQLAKTLSYVDAGKQDGAELVTGGRRITTPELAAGYFVEPTVFAGVTNQMRIAREEIFGPIASLIPFDGEDEAIAIANDTPYGLTAGLWTRDVGRAHRVSNRIDAGMVWVNTYSFLRWSTPYGGFKASGWGRENGIDALDPYLETRTTVISTTGQFPNLYED

SEQ ID NO: 56599 - protein, 360 aa, Papaver somniferum
MGSIRNVDEDIQACRYAMELASASVPVMVLKTAIELDILEIIKKPGPGTQISVSEIVSQIQNLKNPDAPVMLDRMLRLLASYNILTCSLKDGGNDDKVERLYGLAPVCKFLTKNEAGCSMSALLLMNQDKVLMESWYHLKDAILDGGIPFNKAYGVHAFEYHGKDLRFNKVFNKGMSDHTTITMNKILETYKGFEGLNSIVDVGGGVGATVSMIISKYPTIQGINFDLPHVIQDAPSFPGIKHVGGDMFASVPNADAIFMKWILHDWSDEHSVKILKNCYDALPKNGKVIIVECIIPEVSDSSVAGHGVFHLDNIMLAHNPGGKERSLKQFENLAKDTGFTDFQVVCSAYDTYVMEFYKN

SEQ ID NO: 56600 - protein, 124 aa, Solibacter usitatus Ellin6076
MNWSAIGAVFLALAVILGAFGAHGLKDRLDAYSLSVWEKAVFYHFIHAMGVLVVSLLPKTGTFPVAGASLVAWLLTAGILIFSGSLYLLAVTGVHTLGAITPIGGVCFIAAWLLLAYYFIAQRA

SEQ ID NO: 56601 - protein, 532 aa, Cryptococcus neoformans var. neoformans JEC21
MLKMGSEELRPIPAFHNLSEIYNTEETLERERQRWSALVQSFVEEFGGQPNYIIRAPGRVNVLGEHIDYSLFPVLPAAIEQDIIVGIRPTATFPNKISVDLANAVKSYPNAELQLARDQELWSLKVPLPSKAKGWERYVVAVLLECLERFAEQLQDGAAGMEVMVSGTVPEGAGLSSSAAFVVGIIVAFLVANGLQEGVSRVQVVDIAMAAEHRLGLKSGGMDQAASILSVPNSLLHLSFYPSLKPAILPLPSSLTLVITNSMAPHSLADSAPDRYNLRVVENLCATRILLHTFGADAGVLSTTQRGSTGRLWLREALEHWAEDAHMDEETVYRNLLARIVGVLGKEGRDKNGWTKNQMIEESGMTAEDFEATFLAFIPIRATRFYLLQRVQHTLEESLRVCSFKRLCEASVATSDNRVSETGLVKELGALITASHVSMRDLYEATVPEVDDLQALCLQCGSLGSRQTGGGWGGAVISLLPSNRASDFLREVRKMYSLYRGLSVDELDKAAFITVPGSGAGFYPLMEGCKIV

SEQ ID NO: 56602 - protein, 316 aa, Legionella pneumophila str. Lens
MIYPNILATIGHTPVVKINRLGKDLECELYAKCEFFNPGGSVKDRIGYEMVVKAEKEGRIKPGDTLIEPTSGNTGIGIALAGAVLGYKVIITMPEKMSQEKQSVLERLGAIIYRTPTEAAYNDPDSHISLAKKLQAEIPNSHILDQYANPNNPNAHYFGTAQEIIDDFGKDLHMVVAGVGTGGTITGIAKRLKEFNPAIKIIGADPEGSILGGGTEVKSYHVEGIGYDFFPDVLDNTLIDAYIKTNDADSFRTARRLIKEEGLLIGGSCGAAMWAALQAAKSLSKGQKCLVILPDSIRNYMSKFANDEWMKEMGFL

SEQ ID NO: 56603 - protein, 516 aa, Triticum aestivum
MSIMFSQELPIYTALVLLVLPLYYLYSKASCRSKNPAVLPTNWPILHMFPSFVANLHKMNDYFTLVLAGSGHNFRAHGPPGTGMRFFVTCDPANIRHIFTTNYTNFPKGAEFAAIFDIMSGGIFTIDGEPARRQRTKIKSVLSSPRLVARIEAWCRDKVENNLLLLFTHMASTGTSFNMQELMSRLMFDLAAMPLFGVDPGLLSLDMPPMEAAVAMDTVMEVAYFRVVVPASCWKLMRWLNIGPERKLKAAHKVLRVFVMEMTERRMINASSVGNGKQHEGVDIMSSFLDDPYYTEDDMFNALTISYMIAARDTVGTALTWIFYNLSQNPNIVSIIRNELSPIASHKVAAHPDAMVIFEPDETKSLVYLRAVLYETLRLYPPAPLERKMVAANDIMPSGHEVHAGDTILISLHSMGRMEGIWGKDCLNYNPNRWLSEDGNELRYVPSHKFLAFSSGPRMCLGKDIAVMQMKTVIASTLWNFDVEVMEGQCIEPKSSCILEMKKGLIVKLKKREMLH

SEQ ID NO: 56604 - protein, 390 aa, Cryptococcus neoformans var. neoformans JEC21
MTQTSSSSVSVPGEPLKNVLVTGGLGYIGSHVVLSLLMSGRYLPIVIDNAHNAYPQALERCNQIAQSEVGPHAPKPLYHQCDIRNAEEINKVFKQYQSKGGIWAVIHLAALKAVGESSEIPLDYYEVNVGGSISLLKIMQQSQTNNLVFSSSATVYGTPAVIPIPETSEIIPESVYGRTKAITEEVIRDVCRAGAATADNQGLKAISVRYFNPAGAHPSGKLGEEPKGRPGNLLPILAQIAVGRLSSDLKVFGNDYPTRDGTCLRDYLHIMDLAEGHLLALDALAKSEIKTQSSGIFQSIDTKKEGYFRAFNLGRGKGITVLEMINEMKIATGYEYQFEIVERRSGDVPDLTADPRLAQEELGFIARRGLQEMCQDLWRFQSSNVNGYSS

SEQ ID NO: 56605 - protein, 343 aa, Thanatephorus cucumeris
MTVKIGINGFGRIGRIVLRNAIEHGEVDVVAVNDPFIDLDYMVYMFKYDSTHGRFKGEVKVDKEKKQLVINGKNIDVHSERNPGDINWDASGAEYVVESTGVFTTIEKASEHFKKSPSLKKVVISAPSADAPMHVVGVNLDAYDPKGPKISNASCTTNCLAPLAKIIHDEFGIVEGLMTTVHATTATQKTVDGPSAKDWRGGRGAAANIIPSSTGAAKAVGKVIPSLNGKLTGLAFRVPTADVSVVDLVVRLEKSATYDEIKATIKKASEGEYKGIMGYTEDDVVSTDFVGDEHSSIFDAKAGISLNKNFVKLVSWYDNEWGYSRRVVDLIAYVAKKDKEAGC

SEQ ID NO: 56606 - protein, 344 aa, Thanatephorus cucumeris
MTVKIGINGFGRIGRIVLRNAIEHGDVDVVAVNDPFIDLEYMVYMFKYDSTHGRFKGEVKADKDNKQLVINGKNIAVHSERNPGDINWDASGAEYVVESTGVFTTIEKASEHFKKSPSLKKVIISAPSADAPMHVVGVNLDAYDPKGPKVISNASCTTNCLAPLAKVIHDKFGIVEGLMTTVHATTATQKTVDGPSAKDWRGGRGASANIIPSSTGAAKAVGKVIPSLNGKLTGLAFRVPTSNVSFVDLVARLEKPATYDEIKAAIKEASEGPYKGIFGYTEDDVVSTDFVGDQHSSIFDSKAGISLNKKFVKLVSWYDNEWGYSRRVVDLIAYVAKKDKEAGC

SEQ ID NO: 56607 - protein, 292 aa, Phaseolus lunatus
MASFKTAIFSFLLVSIFLSVSVKVCEAQARPPTARGLSYTFYEKTCPKLKSIVRNELKKVFKDDIAQAAGLLRLHFHDCFVQGCDGSVLLDGSASGPSEKDAPPNLTLRAEAFKIIEELRGLLEKSCGRVVSCSDITALAARDAVFLSGGPDYNIPLGRRDGLTFASRQATLDNLPPPSSNTTTILNSLATKNLDPTDVVSLSGGHTIGISHCNSFTNRLYPSQDPVMDQTFGKNLRLTCPTNTTDNTTVLDIRSPNTFDNKYYVDLMNRQGLFTSDQDLYTDKRTKGIVTS

SEQ ID NO: 56608 - protein, 337 aa, Thanatephorus cucumeris
MAVKIGINGFGRIGRIVLRNAILHGDIDVVAVNDPFIALDYMVYMFKYDSTHGRFKGQVEAKDGKLIIEGKPVAVHSERDPSTINWGDAEYVVESTGVFTTVEKASAHFKASPNLKKVVISAPSADAPMYVVGVNLDAYDPKGPKISNASCTTTCLGPLDKVINDEFGIVEGLMTTVHATTATQKTVDGPSAKDWRGGRGAAANIIPSSTGAAKAVGKVIPSLNGKLTGLAFRVPTSDVSVVDLVVRLEKSASYDEIKAALKKASEGEYKGIIGYTEDDVVSTDFVGDEHSSIFDAKAGISLNKNFVKLVSWYDNEWGYSRRVVDLIAHIAKKDAEA

SEQ ID NO: 56609 - protein, 310 aa, Chromobacterium violaceum ATCC 12472
MRIANTITDLIGNTPLVKLNRVTEGVGATVVAKLEFFNPAHSVKDRIAVAMLDAAEQAGKIGPNTVIVEPTSGNTGIGLAMVCAARGYKLVITMPETMSKERRQLLKAYGAELILTPGPDGMGGAIAKAKALVDEFPDTYFMPQQFENPANPEIHRHTTAEEVWNDTDGKVDIFVAGVGTGGTITGVGEVLKARKPGVQIVAVEPDASAVLSGSPKGPHPIQGIGAGFVPAILNTGIYDEIIRVKNEDALQTAREVATKEGILVGISSGAAVWSALQLAKRPENAGKLIVVVIPSFGERYLSTVLFEHLG

SEQ ID NO: 56610 - protein, 592 aa, Arabidopsis thaliana
MAQIPSLENAPLNLKSIRDKSERELVNLLKDVRGTKCLVIDPKLSGSVSLIIPTSKLKELGLELRHLTAEPVQTECTKVVYLVRSQLSFMKFIASHIQNDIAKAIQRDYYVYFVPRRSVACEKILEQEKVHNLVTVKEFPLYMVPLDEDVISFELELSEKDCLVDGDVSSLWHIAKAIHELEFSFGVISKMRAKGKASVRVADILNRMQVEEPVNSNDVGRPEVDTLILLDREVDMVTPMCSQLTYEGLIDEILHISNGAVEVDSSVMGAQQEGKKMKVPLNSSDKLFKETRDLNFEVVVQVLRQKAMTMKEDYTEINSTQTVSELKDFVKKLNSLPEMTRHIHLAQHLTTFTSKQSFNSQLDMEQTLVEAENYDICYEYIEEMIHKQEPLTNVLRLLVLFSVTNSGLPKKQFDYIRMELLHSYGFEHVVTLNNLEKAGLLKKQEFKSNWLTVKRTLKLIVEDTDTSRPNDIAYVYSGYAPLSIRLIQQAIHSGWRPMEDILKLLPGPHLETKRSGFPSSPSVDSLHGASNGVADGRRSIVLVVFIGGVTFAEISALRYLASKEGMAYDLIVATTKIVNGATLIETFMEKLG

SEQ ID NO: 56611 - protein, 512 aa, Streptococcus thermophilus LMG 18311
MSILEVKNLSHGFGDRAIFENVSFRLLKGEHIGLVGANGEGKSTFMSIVTGKLQPDEGKVEWSKYVTAGYLDQHAVLEKGMTVRDVLRTAFDELFKTEERINKIYMSMAEEGTDVDALMEEVGELQDRLETRDFYTLDAKIDEVARALGVMDFGMDTDVTDLSGGQRTKILLAKLLLEKPDILLLDEPTNYLDAEHIAWLKRYLQEYENAFVLISHDIPFLNDVINIVYHVENQDLVRYAGDYDNFQSVYAMKKAQLEAAYERQQKEIADLQDFVNRNKARVATRNMAMSRQKKLDKMEIIELQAEKPKPEFHFKESRTPGRFIFQTKDLVIGYDSPLTKSPLNLTFERNQKVAIVGANGIGKTTLLKSLLGIIQPLEGEVETGDFIDLGYFEQEAEGSRQTPLEAVWDAFPALNQAEVRAALAKCGLTSKHIESQIQVLSGGEQAKVRFCLLMNRENNVLVLDEPTNHLDVDAKDELKRALQAFKGSVLMVCHEPEFYEGWTDIWDFNVLV

SEQ ID NO: 56612 - protein, 305 aa, Pseudoalteromonas tunicata D2
MPQFNDILQQISQQARCCFGQGKVANYIPALADVPAEQFSIAIHTVDGQTFSAGDAHATFSIQSVSKALTLTLAMQHHGDEIWRRVGKEPSGTAFNSLAQLEFETGIPRNPFINAGALVVCDALVSRVSAPVFNMLETARLLSANDKVVINKKVADSEYQHRHRNAAMAHLMKSFNNFDNDVDTVLRAYFSYCAIEMSSIELAKTFSYLANQGVCVQSGRQMLSAKQTQQVNSLLFTSGLYDAAGDFAFRVGIPAKSGVGGGIIGIVPGKFTVCVWSPELNEFGNSVAGLYALELLAEKLHISML

SEQ ID NO: 56613 - protein, 202 aa, Oryza sativa
  misc_feature (29)..(29): Xaa can be any naturally occurring amino acid
HLALLCLQRNRTQWRLATLLKSSFLPKKXSEWGATRQAAAPKPVTVSMVVRAGAYDDELVKTAKTIASPGRGILAMDESNATCGKRLASIGLENTEANRQAYRTLLVTAPGLGQYISGAILFEETLYQSTVDGKKIVDILTEQKIVPGIKVDKGLVPLAGSNNESWCQGLDSLASREATYYQKGARFAKRLTCVSNPNGPSE

SEQ ID NO: 56614 - protein, 495 aa, Prochlorococcus marinus str. MIT 9313
MAGRLNQQNQRVRPNSNEDQVVEQVKEHFERTLIEVGGTVAGSVAALEHQPHNKALNYGEVFLRDNVPVMIYLLTQKRYKEVKQFLSVCLDLQSTTYQTRGVFPTSFVEEQGELIADYGQRSIGRITSVDASLWWPILCWLYVKRSGDKNFGTNQKVQRGVQLMLDLVLHPTFEGTPVLFVQDCSFMIDRPMDVWGAPLEVEVLLYACLRSCIELMELSRKTHVSRLLDQRLLLTRQWVHDLRQFLLKHYWVTSKTMQVLRRRPTEQYGDNQHQNEFNVQPQVVPDWLQDWLENRGGYLIGNIRTGRPDFRFYSLGNSLACLFGLLTAPQQRALFRLVLHNRQHLMAQMPMRICHPPMEGAEWQNKTGSDPKNWPWSYHNGGHWPSLLWFFGASILLHERRHPEADVLLMGEMRALLEECYWSQLNQLPRQKWAEYFDGPTGTWVGQQSRTYQTWTMVGFLLLHHLLRVCPDDVLWLDLDELLPTHEVNATKNPA

SEQ ID NO: 56615 - protein, 472 aa, Erythrobacter sp. NAP1
MASAKDVVKQIKDGDIEWVDLRFTDPKGKWQHLTMAASVMDEDALDDGLMFDGSSIEGWKAINESDMILKPDMDAVYPDPFSETPMLSIFCDIVEPSDGQLYARDPRSTAKRAEAYLASTGIGDTVYVGPEPEFFMFDDVRFEDGYAGSGYRIDDIELPTNTGTDYTELGGGNMGHRPRAKGGYFPVAPVDSAMDIRGEMVSTMMEMGLNMDKHHHEVAAAQHELGITFSTLTKTADQVQVYKYVVQQVAHAYGKTATFMPKPIKDDNGSGMHTHMSIWNDGKPTFAGNEYAGLSETCLHYIGGVIKHAKAINAFTNATTNSYKRLVPGFEAPVLLAYSARNRSASCRIPYGAGEKAKRVEFRFPDAICNPYLAFSALLMAGLDGIENKIHPGDAMDKNLYDLPPAELAEVPTVCGSLREALEALEEDHEFLLKGDVFSMDQIEAYAELKWEEQLRLETTPSPVEFDMYYSS

SEQ ID NO: 56616 - protein, 336 aa, Thiobacillus denitrificans ATCC 25259
MKILVTGAAGFIGMHVAQILLQRGDEVVGIDSLNDYYDPALKLARLEQLKPHPNFRFVRDDISDRMVMEDLFEKGHFDAVINLAAQAGVRYSLKNPHAYVQSNLVGFANLLEGCRHHGVKHFVYASSSSVYGANTKIPFSTHDPVNHPVSLYAASKKANELMAHTYSHLYGLPTTGLRYFTVYGPWGRPDMSPWLFTSAILEGRSIDVFNHGDMMRDFTYIDDIADGTVKVLDRIPQPDPNFDHANPDPASSHAPYRVYNIGNHTPVQLMDFIGTIEKALGQEARKNFLPMQDGDVKMTYADVDDLIRDTGFKPATTLEYGIGKWVEWYRGYKNRS

SEQ ID NO: 56617 - protein, 146 aa, Chlamydomonas reinhardtii
MRAQFARPLGLAHRSTVVKPPSGFCRPLALPVARRRPAFVVCSVSPDTEEQRSPLDAPQEWEAPMPSKRPDIFPEFEKPQRVFLPKPLPGDPEMPDEELEESAKRTTPGDPDPEQKPGEPPEEPEAPAEPGAPEPERKTDIPTVPE

SEQ ID NO: 56618 - protein, 307 aa, Physcomitrella patens subsp. patens
EPLSITDLALPPRHGSDLRVAYQGVPGAYSEAAAAKAYPRCEAVPCEQFEAAFQAVELWLVDRAVLPIENSLGGSIHRNYDLLLRHRLHIVGEVQLAIHHCLLALPGVKKEELLRVVSHPQALAQCEQGLTKLGVAREAVDDTAGAAQFIAAHKLKDTGAVASARAAEIYGLEILVDGLQDDLDNVTRFLMLAREPIIPRTDRPFKTSIVFTLEEGPGVLFKALAVFALREINLTKIESRPQRKRPLRVVDDSNNGSAKYFDYLFYVDFEASMADLRAQNALGHLQEFATFLRVLGSYPMDISPMRA

SEQ ID NO: 56619 - protein, 144 aa, Capsicum annuum
MASVSATMISTSFMPRKPAVTSLKPIPNVGEALFGLKSANGGKVTCMASYKVKLITPDGPIEFDCPDNVYILDQAEEAGHDLPYSCRAGSCSSCAGKIAGGAVDQTDGNFLDDDQLEEGWVLTCVAYPQSDVTIETHKEAELVG

SEQ ID NO: 56620 - protein, 510 aa, Oryza sativa Japonica Group
MERDWEEGIGRGRRDREIGKRRRTRKKRRRGSGEGHLTGRGGWAGRRGDGQRPPGPRTLPIVGNLLDLRGGNLHHKLASLAHAHGPVMTLKLGLVTTVFISSRDAAWEAFAKHDRRLAARTVPDTRRALAHAERSMVWLPSYDPLWKTLRSIAVTHVFSPRSLGVARSARERKVHDMVDSFRRRAGQEVDIGQVLYHGMFDLLANVLLSVDAHPNLRDLMEDIVAILAKPNASDFFPLLRPLDLQGIRHWTAIHMSRVLHILDSIIDCRLAQGTDDQCKDVLDSLLVLMSTGKLSRRDVKILLFDILAAGTETTKITVEWAMAELLRNPNVMATTRAEMKAALGGNGTITEADVVNLPYLQAAVKESMRLHPVAPLLLPHLVVEDGVRIGGYAVSKGTTVIFNSWAIMRDSTAWERPDDFLPDRFLGKTELDLWGKQAKFIPLGSGRRLCPALPMVELVVPFTVASLLHAFEWHLPKGMSAEEVDVTERYTSNDILVMATPLKAVPLIVT

SEQ ID NO: 56621 - protein, 414 aa, Physcomitrella patens subsp. patens
SRVKVEPSVDGARESGAQLPAVTPSPNLAGASGNSVDVKPSVADTIQTSGAYCSREENLKKEEDAGRLKFICLSNDGEDQHMIWLIGLKNIFARQLPNMPKEYIVRLVMDRSHKSMMIIKNNNVVGGITYRPYLSQRFGEIAFCAITADEQVKGYGTRLMNHLKQYARVSDGLTHFLTYADNNAVGYFTKQGFTKEIEMEKERWHGYIKDYDGGTLMECRIDPKLPYIDLPAMIRSQRQASAIDEKIRELSNCHLVYQGLDLPKKEAGVLKRPLRIEDIPGLKEAGWVPDQPPHSRFRLINNPSDGPPSRQALHNFMRSLVKAVTEHADAWPFKEPVDAREVPDYYDIIKDPIDLKTISKRVESEQYYITLEMFASDMKRMFNNARTYNSPETIYYKCTNRYALPIPLLCCLSF

SEQ ID NO: 56622 - protein, 587 aa, alkaliphilic bacterium N10
MQKTAKTSIWQRMRHSAIALSALSLSFGLQASELPQIPPQQINNTMYQAFYWDAYPGLWANLPAMAAPLAERGITSMWLPPAAKGMNGTFSVGYDVYDFWDLGEFYQKGTTATRYGSRQQLQQALAALDQLGIQAYFDVVFNHRMGADAQEHIPGFGLAWTEYHLQGRQAHYTQQNWGYLWHDFDWDWTAFNGSDNQLYPGKWWGNTFHFPYLMGEDVDYNRFEVQQEMKAWGEWIINHVGFSGFRMDAIAHVDTDFTRDWINHVQWATSEDVFFVAEAWVSDINGYLDAVNTPHLRAFDFNLREDFVALSSGSKDMRWWGGLVNSQHRDRAVTFVDNHDTSRAGNPYGMPQVINYKNQAYAYILLREHGVPTVFARDYDEFGMAATLDKLIEARRYFAYGPGHEYSGNTEAVYAYVREGLSNVPGTGLVMLMSGRNWGGQQSFSINSHQANTTFYDYTGNVAGTVTTNAQGYGSFPVNMTESTGWSVWVPQSSGGPQPGSITLRMTKDVGYGYSLFFTGSSPDLTNWGAGIEGTWTSGHVWEVTIPDPGNFEWKTRKGPTGGSGQDWESGGNHNQNNLHPSFNGGF

SEQ ID NO: 56623 - protein, 346 aa, Cryptococcus neoformans var. neoformans JEC21
MKAAQIVGFEAPYKVTDIPKPVPQGNQILLRVKAAGFCHTDEAVKMGYTGSPLPLTGGHEGAGLVEATGGDVTNFTVGDRVAALLFREPCGGCGECKNNSAVFCDNIKMNGFNVDGAFAEYMIVDQRFTLHVPENIDFAQAAAFMCSGATVYNGLKAAKLPPKSVVGIYGIGALGSLGVQFAKAMGHQVIAIDNRPQPLEHIRALGSLSPDLTLSSDHTVEEGLKAIEEMFPEKLLRGVDAMLVTGPQAHEFDYAFKMTAKHGVVVALSCCNQPMIEIDWKDIVLRDIRVVGGFCATIEVTKELLELASMKNVKSKIRTFSLDEVNDLLTVYHQPDMHGKLVVTFD

SEQ ID NO: 56624 - protein, 502 aa, Burkholderia sp. 383
MLVDELHSRKNEVIDPSALRARLRDGALLETRAWLASGWQEGTDGRSFPVTNPATGDILARVASLGAAEVEQAIESSALAQQGWQKRTSHERAKLLRAWFDLILANADDLALIMTSEQGKPLAEARGEITYAASFVEWFAEEAKRVYGDVMPHPQGDKRILVIRQPIGVCAAITPWNFPAAMITRKVAPALAAGCSIIVRPADLTPLTALALAVLAERAGIPAGVLQVVCGPSREIGAVLTASPVVRKLSFTGSTEVGRVLMSQSSGTIKRLSLELGGNAPFIVFDDADLDAAIEGAMASKYRNSGQTCVCANRFLVQAGIHDRFVEALTRRVQALKVGNGIEPGVQQGPLIQKSACDHLNQLIDDAVSKGARIVTGGKGHPLGGTFFEPTVIADATPAMRLAREELFGPVGPVFRFDDEAEAIAMANDTEYGLAAYLYTRDNSRIWRVGEALEYGMVGLNTGVISNEVAPFGGVKQSGLGREGSRYGIEEYLEIKYMCSQV

SEQ ID NO: 56625 - protein, 180 aa, Haemophilus influenzae Rd KW20
MTTQLDLIKSSIKSIPNYPKEGIIFRDITTLLEVPAAFKATIDLIVEQYRDKGITKVLGTESRGFIFGAPVALALGLPFELVRKPKKLPRETISQSYQLEYGQDTLEMHVDAISEGDNVLIIDDLLATGGTVEATVKLVQRLGGAVKHAAFVINLPELGGEKRLNNLGVDCYTLVNFEGH

SEQ ID NO: 56626 - protein, 514 aa, Bacillus cereus ATCC 10987
MSILTVENVSHSYGEKTILYNACFRLLKGEHVGLVGQNGIGKSTLLKILTGELIHDEGNIEWFPHVKVGFLQQHIDLQEGITIEGYLQSAFADLYVIECEMLKIAEEMNGAGEVEKLLVKYGELQTILESSNFYHIHTEVEEVAIGLGLFEIGLKKDVSKLSGGQRTKLLLGKLLLEKADVLLLDEPTNYLDTAHIEWLQSYLRLYEKAYVIISHDELFLNSITNVIFHLEGGKVKRYVGNYEKFVQSYQVQKKQLQSAYVKQQKEISQLETFIQKNKIRKAKQAKSREKVLEKMQRIEKIHPVPRSRFDFNVYEEPVSRILQAEKLRIGYSDPLCPELNLQVKKGEKIAIIGHNGIGKTTMLKTLLGQIKPLSGSISVGERVNPAYFAQEEFASETTPLEKVWAERPDMTKKEVRQALAKCGLKEEHVLKPIRLLSGGEQTKVRLCELIVKKSNVLILDEPTNHLDIETKKALQEALQRYRGTVLLVSHEPSFYEAWITKVWNIEEWNAEQYE

SEQ ID NO: 56627 - protein, 468 aa, Pseudomonas aeruginosa UCBPP-PA14
MNARLHATSPLGDADLVRADQAHYMHGYHVFDDHRVNGSLNIAAGDGAYIYDTAGNRYLDAVGGMWCTNIGLGREEMARTVAEQTRLLAYSNPFCDMANPRAIELCRKLAELAPGDLDHVFLTTGGSTAVDTAIRLMHYYQNCRGKRAKKHVITRINAYHGSTFLGMSLGGKSADRPAEFDFLDERIHHLACPYYYRAPEGVGEAEFLDGLVEEFERKILELGADRVGAFISEPVFGSGGVIVPPAGYHRRMWKLCQRYDVLYISDEVVTSFGRLGHFFASQAVFGVQPDIILTAKGLTSGYQPLGACIFSRRIWEVIAEPDKGRCFSHGFTYSGHPVACAAALKNIEIIEREGLLAHADEVGRYFEERLQSLRDLPIVGDVRGMRFMACVEFVADKASKALFPESLNIGEWVHLRAQKRGLLVRPIVHLNVMSPPLILTREQVDTVVRVLRESIEETVEDLVRAGHR

SEQ ID NO: 56628 - protein, 336 aa, Salmonella enterica subsp. enterica serovar Paratyphi B str.
MKAAVVTQDHQVDVTEKTLRPLRHGEALLKMECCGVCHTDLHVKNGDFGDKTGVILGHEGIGVVAEVGPGVTSLKPGDRASVAWFYEGCGHCEYCNTGNETLCRNVKNAGYTVDGGMAEECIVVADYAVKVPEGLDSAAASSITCAGVTTYKAVKISHIKPGQWIAIYGLGGLGNLALQYAKNVFNAKVIAIDVNDGQLKLAEEMGADLTINSRTEDAAKIVQEKTGGAHAAVVTAVAKAAFNSAVDAVRAGGRVVAVGLPPEAMNLDIPRLVLDGIQVVGSLVGTRQDLTEAFQFAAEGKVVPKVALRPLEDINAIFKEMEQGQIRGRMVIDFRR

SEQ ID NO: 56629 - protein, 274 aa, Erythrobacter sp. NAP1
MTEYQLVENEQTVYRDGTIKLHTQEGFDGMRAAGQLAARILDEVADMVKPGVTTESIDTQIREMMLDAGAVPATLGYRGYTHSSCISINHVICHGIPGPKVLKDGDILNVDVTPLLDGWHGDTSRMFFAGEPSIKAKRLVDVTYECLMLGIEAAQPGARLGDIGAAIEAHAKQFRYGVVREFCGHGLGRLFHDAPEVVHAAKAGTGPELKPGMFFTIEPMINLGKPWAKVLGDGWTAVTRDKSLSAQFEHSIAITEDGNEIFTKSPTGKDQPPY

SEQ ID NO: 56630 - protein, 457 aa, Glycine max
MRVWLGNGQQQCPHETLSLSWKLKQPRPQLQARCTLTKQGQRFLTKLTTSSATADNLIRRFLLASPKSVVLSTLSHLLSPSTSYPHLSSLASQLYTGISQAPWFSWNPTTVAELAALLHSLGHHAQSESLISDASSRLQSRQRDLVLFYGKLIDSHSKRNSHTAFDAAFGYLHNLVRTSSSLHVKRRAYQYMVSGLCLMDRPREAEDLVLGLQPSGFEYKSIVYGYGRLGLFNDMNRVVDEMERNGFAVDTVCYNMVLSTYGIHGEHVEMVRWLRRMSNSGVPFSVRTYNSVSNSCPSITRMTRDLSKLALLSISELKEGLEGGEGMVVRELLLLGSCGILEEVMVWDSSEVKLDLHGFHLASAYLIVLLWLEEMGRRLNDSNYGVPAEFTVVCGLGKHSSVRGESPVRVLVQKMMVKMGSPLKVDRKNNGCFIAKGKAVKNWLSQFNNNKSSFTQH

SEQ ID NO: 56631 - protein, 256 aa, Zea mays
PTRPPNRKRRAAAMDPAAGGAGQQRQNKASAGKKVKKGGGSGGRWPAVKPKKDLQINRLKGTHLLTIPDFFTSAEAKAFIDIAESMGFTHQGSLGPLKGEAYRDNERISVTDPLLAQAIWESGINRIFTDISVSGKVATGLNPNIRFYRYTEGQRFGRHIDESVSLGDGSKTYYTLLIYLSGKGSAKDSSGQALVGGETVFYDQRGGVVAEVAPVQGMALLHLHGAKCMLHEARAVKKNAKSTRLGHNGSGAGKYF

SEQ ID NO: 56632 - protein, 305 aa, Debaryomyces hansenii CBS767
MAKGVEISTNEELYVLESLKQGFRTDGRKLDEIRQPNITLSPNEYGYVEIEWGLTKLAVRVSAEIVVPYEDRPFEGLFMINTEISPMASAQFENGKNSDDEILISRLIEKAIRRSNALDLESLCIVAGSKVWQIRADINFLNYDGGIIDASSLGVMVALQHFKKPDISINGEEIIVHSIDERQPIPLSILHVPICISFLFFNPVGIEENIKGDLNEEISIIDANQQEELIRDGSLVITINKNRDLIQLSKNGGLPIDVMLLMQLAKRAYVIADNLTDKIKELLQADEKERYERMNLKLLEVGADR

SEQ ID NO: 56633 - protein, 666 aa, Magnaporthe grisea
MAPHVPFDTDQVRDKARKDLLYLLEGVRGKKNLVIEKSLAGPIGLIVKVSTLQDYGVDKFFFLESKNASTSQRNVVFIARGECARNAQEIADEIRRLHRESQTGHEFHVFWVPRRTTMSDKLLEEAGVLGDVNISELPLYFFPLERDVLSLELEDSFRDLFLANDPTPNYLLARALMGVQQRHGLFPRIIGKGDNARRVAEMLSRMRQELLAGEDVSDKIGLNPSTTMESVIIIDREVDPVTPLLTQLTYEGLIDEVFEIQHNQAEVDSTVVGVPPQSAAQNNSTNPTANSTGRKRKIQLDSSDKLFDQLRNANFATVGPLLNKIARRLQSDYDSRHATKTTAELKSFVQKLPGYQAEQASLKIHTGLAEEIISHARTDLFRKLLEVEQNLAYGFEPSLEAIEELIACDTPLPKVLRLLCIHSCLSGGILVKDFEFLKRLVLEGYGYQHLLTLHNLEKLQLFLSRTSPLAQMIPMTGASHGATGIKTNYTYLRKQLRLNVEEVNDNDPTDIAYTYCGYAPLSIRLVQCILQKQYLLSITKGGSGAVPAAAGVVGAQGWKGFDDAVKHARGPTFDEVQKGEDKAVKARALLSGSAEKRTVFVVLVGGITFTEIAALRFIAKKEEARLNIVICTTSIISGNKIMAAAIEKESFGKRADSIQTTVEQQA

SEQ ID NO: 56634 - protein, 415 aa, Saccharomyces cerevisiae YJM789
MSVKRSVSEIEIESVQDQPSVAVGSFFKGFRAPSETTFDLYKKKKSEKDEFVLHGENERLEYEGYTDSSSQASNQYVVGLFNPEKKSIQLYKAPVLVSKVVSKSSKNLRGPKIKSKSDTRPSALRNALGEAFGTKKAKKAIADLERNRIDSDKLTDSAIDIVDSVRTASKDLPTRAQLDEITSNDRPTPLANIDATDVEQIYPIESIIPKKELQFIRVSSILKEADKEKKLELFPYQNNSKYVAKKLDSLTQPSQMTKLQLLYYLSLLLGVYENRRVNNKTKLLERLNSPPEILVDGILSRFTVIKPGQFGRSKDRSYFVDPQNEDKILCYILAIIMHLDNFIVEITPLAHELNLKPSKVVSLFRVLGAIVKGATVAQAEAFGIPKSTAASYKIATMKVPFKLPEMTRRGRGPRR

SEQ ID NO: 56635 - protein, 237 aa, Pinus yunnanensis
MAREGERGQVKLLGATLSPFVVRVRIALALKGIDYEFIQEDLKTKSELLLQSNPVYKQIPVLAHNGKPVCESMIIVQYIEEAWDNKAPNLMPKDPYDRAIARFWAAFIDDKLFPYLRAALFGQGEQLQKAVEDSVTNFLLIEEALRTNRCFAGKAYFGGDEIGLIDIALGGMSTFIKAVEKATDSVLIDPEKMPLLTAWMDRFCKSDGVKEVMPDPVKHAEYLCARRASMVSPPTGN

SEQ ID NO: 56636 - protein, 237 aa, Pinus densata
MAREGERGQVKLLGATLSPFVVRVRIALALKGIDYEFIQEDLKTKSELLLQSNPVYKQIPVLVHNGKPVCESMIIVQYIEEAWDNKAPNLMPKDPYDRAIARFWAAFIDDKLFPYLRAALFGQGEQLQKAVEDSVTNFLLIEEALRTNRCFAGKAYFGGDEIGLIDIALGGMSTFIKAVEKATDSVLIDPEKMPLLTAWMDRFCKSDGVKEVMPDPVKHAEYLCARRASMVSPPTAN

SEQ ID NO: 56637 - protein, 509 aa, Aspergillus nidulans FGSC A4
MAELYPSLTQCAIVATAFKILLFPAYKSTDFEVHRNWLAITHSLPVQEWYYEKTSEWTLDYPPFFAVFEWALSQLAQYVDPAMLDVQNLNYDSWQTVYFQRATVILSELVLFYALNRFIRSDPQPTKHLAHAASLSILLSPGLFIIDHIHFQYNGFLYGILVLSIVWARKQSKLLYSGIAFAVLLCLKHIYLYLAPAYFIYLLRAYCLDPKSVFRPRFGNAFKLGLSIITVFGLAFGPFVYWGQLLQLKDRLFPFSRGLCHAYWAPNVWAMYSFTDRILIPFAPKLGLPVNQDALTSVTRGLVGDTSFAILPEISKEYTFVLTLLSLILPLIKLWLRPDYYTFVGALTLCGYASFLFGWHVHEKAILLIIIPFSLIALKDRRYFSAFRPIAVAGHVSLFPLLFTAAEFPLKTVYTLLWLILFLFVFDRIAPVPERPRIFLVDRFSLLYITVSIPLILYTSLVHQLIFGLESSITPSQPLEQRIPSPVTSASHSSLRFWYRMSAKASMTP

SEQ ID NO: 56638 - protein, 316 aa, Burkholderia sp. 383
MALDLHLAGFLESLAGSGAKPLPQSSPEEARGLMQHLARAVRAPEAVVDVHGVEDLTVPGATGSLRARLYRPTQERNLPTVVYLHGGGFVIGDLDTHDNICRELARGANAVVVSVDYRLAPEHPYPAAADDAIAATKWVIANAGELGGSDVVAVAGDSAGGNLAAVVTQQLHADGISLSAQFLIYPAVAQDRAGFPSFKENGEGYFLDLETIAWFERHYVLDGTDREDPRLAPIRAKDLAGLPPAVILTAEFDPLRDEGEAYGRLLHASGVKVDTIRCDGMIHGFFDMGAISPGAQAWIEKGIASFRKVLGGAQHH

SEQ ID NO: 56639 - protein, 478 aa, Haemophilus influenzae Rd KW20
MSKEIKTQVVVLGAGPAGYSAAFRCADLGLETVIVERYSTLGGVCLNVGCIPSKALLHVAKVIEEAKHANKNGIYFSEPRIELDEVRAGKEAVVAKLTGGLAGMAKARKVTVVEGLATFTDSHTLVARDRDGNPTTVKFDNAIIAAGSRPVQLPFIPHEDPRIWDSTDALKLKEVPKKLLIMGGGIIGLEMGTVYNALGSEVEVVEMFDQVIPAADKDVVGIYTKQVEKKFKLMLETKVTAVEAKDDGIYVSMEGKACNDTKRYDAVLVAIGRVPNGKLIDAGKAGVEVDDRGFIHVDKQMRTNVPHIYAIGDIVGQPMLAHKGVHEGHVAAEVIAGQKHYFDPKVIPSIAYTEPEVAWVGKTEKECKQEGLNYEVAKFPWAASGRAIASECSEGMTKLIFDKDTHRVLGGAIVGSNGGELLGEIGLAIEMGCDAEDIALTIHAHPTLHESVGLAAEVFEGSITDLPNAKAKEKIISI

SEQ ID NO: 56640 - protein, 243 aa, Triticum aestivum
IFGFWMLDLANNTVQGPARALLADLSGPDQCNSANAIFCSWMAVGNVLGFSAGASGNWHKWFPFLMTRACCEACGNLKAAFLIAVVFLLFCMAVTLYFAEEIPLEPKDAQQLSDSAPLLNGSRDDHDASSEQTNGGLSNGHADANHVSVNSSADAGSNSNKDDVEAFNDGPGAVLVKILTSMRHLPPGMYSVLLVMALTWLSWFPFFLFDTDWMGREVYHGDPKGNASERKAYDDGVREGAFG

SEQ ID NO: 56641 - protein, 392 aa, Nocardia farcinica IFM 10152
MPSRPATVERLRPFASTIFAEMTELAVRHEAVNLGQGFPDTDGPAGMLEVARRAIADGVNQYPPGRGMPVLRRAIAADRARRYGTEYDPDTEVLVTVGATEAISAALLGLVEPGQEVVLIEPYYDSYAAAVALAGAHRRTAHLVADGDRFVLDLDSLRAAVTPRTRMLVVNSPHNPTGTVLGRADLTAIAELACEHDLLVLTDEVYEHLVYDDNEHISLATLPGMAERTIVVSSAAKTFNVTGWKIGWVCAPAYLVDAVLAAKQFLTFVGGGPFQPAVAHALTEEQEWVARMRESLSDKRIRLSAALAETGFGVRASGGGYFVCADVTPLGTADGLAFCRALPGTLGVAAVPVSVFADDTAAWNHLVRFTFCKQDRTLDEGVRRLRAGARVG

SEQ ID NO: 56642 - protein, 567 aa, Haemophilus influenzae Rd KW20
MSKQIQIPDIGSDEVTVTEVMVNVGDTISVDQSIINVEGDKASMEVPAPEAGVVKEILVKVGDKVSTGTPMLVLEAAGAAPAADEPTAPVADAPTAPVVATAPTASAIVEVNVPDIGGDEVNVTEIMVAVGDTITEEQSLITVEGDKASMEVPAPFGGVVKEILVKSGDKVSTGSLIMRFEVLGAAPAESASAPASTSAPQTAAPATTAQAPQAAAPDTTAQAPQAAAPDTTAQAAQSNNNVSGLSQEQVEASTGYAHATPVIRRLAREFGVNLDKVKGTGRKGRIVKEDIEAYVKTAVKAYESGATAQATGNGVANGAGLGLLPWPKVDFSKFGEIEEVELSRINKISGANLHRNWVIIPHVTHFDKADITDLEAFRKEQNALREKQKLGVKITPVVFIMKAVAKALEAYPRFNSSITEDAQRLILKKYINIGVAVDTPNGLVVPVFKNVNKKGIIELSRELMEVSKKAREGKLTASDMQGGCFTISSLGGIGTTHFAPIVNAPEVAILGVSKSSMEPVWNGKEFAPRLILPMSLSFDHRVIDGADGARFISYLGSVLADLRRLVM

SEQ ID NO: 56643 - protein, 190 aa, Zea mays
MSSPSKRREMDLMKLMMSDYKVEMVNDGMQEFFVEFRGPNEIKASALSCTSDLGGLAALSEGYFAEFNRHLSRRSGSVCLDVINQTWSPMFDLVNVFEVFLPQLLLYPNPSDPLNGDAAALMMRDRPAYEQKVKVLESSVFLSRLSLEYCEKYAKPGDAGVTPEEQSSDEELSEDEDDSGDEEIMGKPDP

SEQ ID NO: 56644 - protein, 509 aa, Solibacter usitatus Ellin6076
MYLRLREHNGPWDMIVIGGGATGAGVAVDASTRGYSVLLLEQSDFGKGTSSRSTKLVHGGVRYLEQGNLSLVMEALKERGLLLRNAPHLVRNLGFVVPNYDWWQAPFYGVGLKVYDLLAGKYGFGSSRILSREETLARLPTIRAEDLRGGVIYFDGQFDDARLLIHLLATAFDHGASLFNHTRVVAAACDGVRVRDEETGEEFDAAARVVINATGAFSDSVRRMADPTAAPIIAPSQGIHLVFDRSFLPGDNAIMVPHTSDGRVMFAIPWHGHTVVGTTDTPVPQASLEPVAMEQEIDFILQTAALYLAKPPFRADVLSVFAGIRPLVKQGDAGRTASLSRDHTIIIEDSGIVTIAGGKWTTYRRMAEDCVNQAATLGGLEERPCVTADLPVHGSHRAADAFGALSVYGSDAPAVRELSGDRLHPALPYTSGEVLWAVRHEMALTVEDVLARRTRALFLNARAAVQMAPQVAALMARELGRDQQWIATQLESFRAVAQHYLIGPASLPD

SEQ ID NO: 56645 - protein, 359 aa, Arabidopsis thaliana
MGKSKKKVLNKSLITHPSTSDDTLQLFDPTSSPTKEKVNWNNVLGISDYLSKQATRVKTLWTGETPKAESVKETMESYFKALLGFLLCCHGSTLGAGPTLSSIVHGSVKQIVDSSFRLFQGSVSLYDGSYEKGEKPSISQLSGAVLEACSSFKKVPTTNLIAIGSAISQVSVIMKDVLNEMKKVKPACPSSEGEASGDDFSPEQIEVAKMVADIVYEAMTVIIVIRVITRMMEKENSNENSVFVESLEKLLKLCQRSGVVIEELGTCVYHPPLKIDKITQTVKILEGNLDEVEAQVEYMKRSSNAFPGVCRKLRDAIKLMEVGLEKRKDLNQILISRQNTLYNALQLLDPTASPMNRCS

SEQ ID NO: 56646 - protein, 394 aa, Haemophilus influenzae Rd KW20
MYLFSATNYKITMAKKDYYEVLGLQKGASEDEIKRAYKRLASKHHPDKNQGSKEAEEKFKEINEAYEVLGDDQKRAAYDQYGHAAFEQGGGAGGFGGGFGGADFGDMFGDIFGDIFGGGGRGRQRVVRGEDLRYDLEISLEEAVKGTTKDIQINTLAHCDSCGGSGAEKGSKVETCPHCHGSGRIRRQQGFFVSESICPTCHGSGKKIEKPCRNCHGEGRVHKKENLSVKIPAGVDTGNQLRLAGKGAAGENGAPAGDLYVVIHVREHNIFERDGSNLYCEVPISFATAALGGEIEVPTLDGRVKLKIPAETQTGKLFRMRGKGVASTRSGYAGDLICRIVVETPVNLTSEQKELLHKLEESLQGKDLSKHAPKSSGFLDGVKKFFDNLGKSDK

SEQ ID NO: 56647 - protein, 487 aa, Pichia anomala
MSDITLGRYLFERLNQVKVQTIFGLPGDFNLSLLDKIYEVEGLRWAGNANELNAAYAADGYSRVKGLSAIITTFGVGELSALNGIAGSYAEHVGVLHIVGVPSISSQAKQLLLHHTLGNGDFTVFHRMSSNISQTTAFIKDINSAPAEIDRCIREAYVFQRPVYLALPANLVDDLVSSDLLSTPIDLSLKPNDPESENEVVSTVLELIKKADNPVILVDACASRHSALAETKDLMDLTQFPTFVTPMGKGAVDEQHPRFGGVYVGTLSKPDVKAQVENADLILSVGALLSDFNTGSFSYSYKTKNIVEFHSDHIKIRNATFPGVQFQSVLQNLNSKIAPVVKGYKPYPVPSLKLTTSPASPETPLTQEWLWTKLSSWLREGDVVITETGTSAFGIVQTRFPSNTTGISQVLWGSIGYSVGAALGAVAGAEEVDKEKRVILFVGDGSLQLTVQEISTMIRWGLTPYIFVLNNAGYTIERLIHGEKSFL

SEQ ID NO: 56648 - protein, 147 aa, Cryptococcus neoformans var. neoformans B-3501A
MLPLSLLTAAQGKPMLVELKNGVTFNGHLVECDTFMNVTLREVYQTSADGERFWKMKEMFIKGNIIKYFRIADNILEQAAEEQDKARAANRARGGARGGRGGPGGARGGRGGPPGRGGPPGRGGGPARGGFNQRGRGGPPRGGPPRP

SEQ ID NO: 56649 - protein, 348 aa, Pichia anomala
MSIPKTQKGVIFYESGGELQYKDIPVPTPKANEILINVKYSGVCHTDLHAWKGDWPLPTKLPLVGGHEGAGVVVAKGANVTNFEIGDYAGIKWLNGSCQSCEYCEKSFESNCPKADLSGYTHDGSFQQYATADAVQAAKIPKDADLAEVAPILCAGVTVYKALKTADLDAGQWVAVSGAGGGLGTLAIQYAKALGLRVLAIDGGDEKGELVKSLGAEVYIDFTKTKDIVKDIIEATNGGPHGVINVSVSEKAIEQSTEYVRPCGTVVLVGLPAGAVARAQVFGAVVKSVSIKGSYVGNRADTREAVDFFTRGLVKSPIKIIGLSELPKVYQLMAEGKILGRYVLDTSK

SEQ ID NO: 56650 - protein, 372 aa, Pichia anomala
MLKTLRFNSNPTLLRYQALRGLATTSIPTTQKASVFETNGGPLEYKDIPVPKPKPNEILVNVKYSGVCHTDLHAWKGDWPLPTKLPLVGGHEGAGIVVAKGDQVKNFEIGDYAGIKWLNGSCMTCEYCQNAFESNCAKADLSGYTHDGSFQQYATADAVQAAQIPKGTDLAQISPILCAGITVYKALKTANLKAGDWVAISGAGGGLGSLAVQYAKAMGYRVLGIDVGADKGELAKSLGAEEYVDFKASKNVVEEIQEKTKGGPQGVINVSVSDAAISQSTQYVRPTGSVVLVGLPPKSVIHSDVFSHVVKSISIKGSYVGNRADSREAIEFFTRSLVHSPIKVVGLSELPKVYELMDQGKILGRYVVDTSK

SEQ ID NO: 56651 - protein, 268 aa, Burkholderia sp. 383
MSKIPAFGLGTFRLKGQVVIDSVRNGLEVGYRAIDTAQIYGNEAEVGEAIAASGVAREDLFLTTKIWVDNYAPDKLVPSLEESLRKLRTDHVDLTLIHWPAPDNGVALDTFMTALADAKAQGLTRRIGISNFNIALTKQAIAAVGKDAIATNQIELSPYLQNRKLVEFLNAEGIHVTSYMTLAYGKVLGDPVIGAIAQRHDATPAQVALAWALQLGYSVIPSSTKRENLASNLLAQSLRLTDEDMAQIAALERNGREVDPAGLAPKWD

SEQ ID NO: 56652 - protein, 361 aa, Burkholderia thailandensis E264
MSDKVYRIAVIPGDGIGVEVMPEGLRALDAVSRRFGLRFEYEPIEWASCGYYAKHGQMMPDDWKAQLSGMDALLFGAVGWPETVPDHVSLWGSLIKFRREFDQYVNLRPARLFDGVPCPLAGRKAGDIDFMIVRENTEGEYSAVGGTMFEGTEREFVVQQAVFTRHGTERVMKFAFELAQRRAKRLTVATKSNGIAISMPWWDARAAEMAARYPDVAWDKQHIDILCARFVMQPDRFDVVVASNLFGDILSDLGPACTGTIGIAPSANLNPERNFPSLFEPVHGSAPDIAGKQVANPIAMIWSAAMMIDFLGEGAGPAREAHDAIVAAIEHVLKHGPRTRDMGGQASTSEVGDAIVARLLG

SEQ ID NO: 56653 - protein, 393 aa, Mycobacterium bovis AF2122/97
MSGEDSIRSFPVPDLGEGLQEVTVTCWSVAVGDDVEINQTLCSVETAKAEVEIPSPYAGRIVELGGAEGDVLKVGAELVRIDTGPTAVAQPNGEGAVPTLVGYGADAAIETSRRTSRPLAAPVVRKLAKELAVDLAALQRGSGAGGVITRADVLAAARGGVGAGPDVRPVHGVHARMAEKMTLSHKEIPTAKASVEVICAELLRLRDWFVSAAPEITPFALTLRLLVIALKHNVILNSTWVDSGEGPQVHVHRGVHLGFGAATERGLLVPVVTDAQDKNTRELASRVAELITGAREGTLTPAELRGSTFTVSNFGALGVDDGVPVINHPEAAILGLGAIKPRPVVVGGEVVARPTMTLTCVFDHRVVDGAQVAQFMCELRDLIESPETALLDL

SEQ ID NO: 56654 - protein, 491 aa, Burkholderia sp. 383
MTNQPTQTGADRPVDMIIFGGGGDLAARKLLPALYMAHLHCNLPPETRIIAVGRRDWGIDGYRKFMDEQSRPFIDEKAFDPAAWSRFLDLFKYVLIDVNAPDDYLRLAEAARGDAIRVFYLSTSPELFTTICDNLSAAHLVDKHSRVVLEKPLGHDLASAKAINDAVGKHFEESQIYRIDHYLGKETVQNLMVLRFGNPIFGPLWQAPSIRSVQITVAESVGVGSRAGFYDHTGALRDMVQNHLLQLLCIVAMEPPVSLDPDAVRDEKLKVLRSLRPMAVADVARDTVRGQYTAGAVDGQPVKGYLEEDNVPADSRAETFVALRAHINNWRWANVPFFLRTGKRLQRRQSEIVIEFADMPFSIIPTGPRHYSNRLVIQLQPEESIQLQMLAKEPGSGMNMVPVSLNLDLQQAIPERRAEAYERLLIDVIRGRLTHFMRRDELEAAWSWVEPILDGWKQLGDRPRLYTAGTFGPAASSALLARDGMSWSEEA

SEQ ID NO: 56655 - protein, 318 aa, Zea mays
MDRYHRVERARNQSTIEENEIRITAQGLIRNYVSYATFLLQERRIKEIVLKAMGQAISKSVAVAEIIKKRAPELHQDTNISSVSITDVWEPIEEGLVPLEMTRHVSMISITLSPRELDKHTPGYQAPAYVEHPRQQQVPPLQRQPRRPSGQQFQQLEYEDSYARGRGRGRGRGRGRGWARGGYGGYGNNQGGYNQGGGYYDNQGGYGGYDDQGGYGGGYGYNQSRYGNYQENGGYNRGRGGGMRGRGNWGYRGGYEGGRGGGYEGGRVGGGYEGGRGGGYEGGRVGGGYEGGRGGGGPGGRGYGGRGRGRMGGGGRAN

SEQ ID NO: 56656 - protein, 189 aa, Nostoc punctiforme PCC 73102
MNFPEINIPGNGKLHARLITSLGEIVVRLEEERTPNTVKNFVGLATGTIDWKDPKTGESGKGTPAYDGVRFHRVIPDFMIQCGDPLSRYLDTASRWGTGGPGYQFEDEFHPELRHTGAGILSMANAGRGTNGSQWFITEAPTPHLDNKHSVFGEVVQGLDIVNKIANVPTTRDRPNQEVVLQKVEIFRQ

SEQ ID NO: 56657 - protein, 493 aa, Candida albicans SC5314
MVALKREAEPRENGKSKKAKTSLATSSFVLHSYSKLPNINEYAKAKSTPLDVFVWGTGSMCELGLGPSAKNKEVKRPRLNPYLTEEKLGGTKIVDFAVGGMHTLALDGKNRIWSWGGNDSGVLGRDTSQAKEVLKDIDGKNGNDDDDDDDDEDGDLNEAESTPALVENLPEGEIVQLAATDNLSAALLSNGDVYAWGCFRCNEGLLGFLRDEIKLQKTPLKIKELKNIVQLAAGKDHLLALDSKGIVYAWGNGQQYQLGRRILERHRYRSLEPQQFGLYNIKYIASGDFHCFAIDHSDNVYAWGLNQYGQCALTGDNGELEDGSVLMKPTLIPELSHKGIKEIAAGEHHTLALTEDGQVYAWGRYDMKEIGIPKDKLPKSTFKDQHGNPRSVPVPTKLEFAVKIKTIGVGSHHSFAVTEDGVVYAWGFAETYGPGLGPSIDDVEKPTRIVNTATKNEDILLIGAGGQFSVSGGVKFEDEEKAEVRLDKYEDLE

SEQ ID NO: 56658 - protein, 682 aa, Arabidopsis thaliana
MEKVELPVHEHPLFIFDRICMDTCKGCSVFGYFYGGYVCNEVGCDTLFHKECVESVPEIKHPSHPQHPLKLNLKCGRFCCSLCISGLQVGYHCSICDFNVHLVCARRPPSSTSSSSSSSPLPTSVDNSKVHQHPLLLSKNVETFLLKEGRNCNMCNTNIKINEKQLCECRLCNILFHLDCVGLIPNVYQTSHPKHPLKFLQYGAPEYAHEKCLLCKKKFKKLSNNYDRVYHCDVCNVTICKDYCMAKPPPVSVVSPTTHEHQLHLVPRLVNFTCNACGTAGDRSPYFCLQCNFMIHRACIDLPRVININRHNHRISYTSLLGHGNWTCGVCRKKVDGFYGAYSCSKCPSYAVHARCATRKDVWYKVELEGTPEEEEIAPFEVVDENLIKHFIHGHNLRLNKDGNHESKFCEACASKINNDPFYGCEQCDFILHETCASLPRKIRHVSNNKPLILSTDTYLKDSPRQRRHCSACFQNFSGFRYETQSRNLFGSATLDVRCSSIYEPFLHESHPHPLYFSLEGDTKCSACDITYSARDMLCCDECEFRLDFRCATLPRKVMNQRYDDHPLYLSYGENKEDGQLWCEVCETKVDPKEWLYTCNLCGIILHISCVVGDFSYHVPGHISSNKIANGVVVPNTSICRPHCSRCSSRCKLPYILQINDFYFCSNKCCGNTRNPRGRNYY

SEQ ID NO: 56659 - protein, 340 aa, Erythrobacter sp. NAP1
MNITQPFGDTLALIGNTPLVRLAGPSEAAGCDIWGKCEFANPGSSVKDRAALYMIRDAEGRGELKPGGTVIEGTAGNTGIGIALVANALGYKTIIVMPDNQSKEKMDTLRALGAELVLVPPTKYADPCHFQHVSRRMAEETEGAIWAGQFDNTANRRAHIEGTAIELWEQTGGKISGFTCAAGTGGTIAGVGMGLKEKNPDIRIALTDPHGAALYNYYAHGELKGEGSSVAEGIGQGRITANLEGAPIDTQFRISDEEGLVWVEHLLRKEGLCLGLSSGINVAGAIELGKQLVADGVENPQVATILCDTGFRYLSTLYNAEWLASKNLPVFDWLTQNQSD

SEQ ID NO: 56660 - protein, 707 aa, Bradyrhizobium japonicum USDA 110
MPMRDTLTSLRYRYWPDHLLGEILSKRWTETAIPVILLLIVGLALSRSIDNFLSPASLADTARQAGEIGFIALGLALVVIVGGIDLSVGSIFALTDFCALYLLDVLGWPVPAVVAATLLCGALLGAVNGVLIGYLRLRAFITTLITLIIYRSAYDLLIQRYSNAIASAFPDIPSWDFIGGGSIFGIPTVALVYIVIAIFGHIFMTRLRPGWHITAIGGSRRSAYNSGIPVRRTIALCYVASGVLTSIGALFFASRLGTVGGDIGVGLEVIVLTATVLGGITLGGGKGSVAKSAVGVLIVLLITNGLTTMNARGGVNRMALAGILLVAAMVDIRWQKNRTRIISKVYVAPTYHALPPPPPTEIGQGGPFEQNDKLRDVELIGLGRIEAPEDVILDRHDNLYAGSRHGDIIRFLAPDYQKMEVFAHIGGQPLGMAFDREDNLYICIGGMGLYRIKPDGTVEKATDETNRSMRSVNDDSRLRLADDLDITDDGLIFFSEATVRYEMDEWPIDGLEARGNGRIICYDTRTGATRTELRGLKFPNGICVASDGQSILFAETFGCSIKRYWFAGPKKGAVEVVMDNLPGYPDNINLASDGNYWLALVGMRSPSLDLAWKMPGFRRRMAKRVPVDEWLFPNINTGCVVKFNEQGKILESFWDLRGENHPMITSMREHRGYLYLGGIANNRIGRYKLDNADPDFVQYDKRWGKLS

SEQ ID NO: 56661 - protein, 352 aa, Triticum aestivum
SRKFDSEHIYSTCVVASDHVRDCKIESSAFPLSRDDTTSGTRYQTENWNNCQFALSNGSAVLNNHSVPQSDLNYGDNDLNFIDWPSIDNFEDVDTLFRGCDSTYGEQQLENTDELSWIPSSDAIYSSDVALQAGFDTSYSDYGMLDDLSAFPCAQDKSLPTADEQFNDNYPFNEQKNVNVYGEQSYHGGAMELLSTDQICNGDGNLDMIGERYSSENALQQLEDRKFSVSSGSQLSSSQNLLKQKHHSDKTSPSNITSDCYSDRNCQFSPSGSFAQRNLMVQKQVANLQPGQLINDEGQLGQQTLTRRASYPCENYEVEKKGFGKQSKDTLGTSALVVGWALCVPPSLGYSV

SEQ ID NO: 56662 - protein, 186 aa, Campylobacter lari RM2100
MTIQISEIAKLPTRFGEFNIQSFKENDKEHLCIFKGKLEKEVNIRIHSECLTGDVLGSLKCDCGEQLDFSLKYIQEHGGMVIYLRQEGRGIGLFNKINAYALQDKGFNTIEANHQLGFKADERSYEIVDFILNHYKITKINLLTNNPEKLSSLKGKVNLRIPILIEANRFNKDYLEIKHTQMGHLN

SEQ ID NO: 56663 - protein, 182 aa, Arabidopsis thaliana
  misc_feature (52)..(52): Xaa can be any naturally occurring amino acid
  misc_feature (123)..(123): Xaa can be any naturally occurring amino acid
  misc_feature (131)..(131): Xaa can be any naturally occurring amino acid
  misc_feature (152)..(152): Xaa can be any naturally occurring amino acid
QWLSSMLSSATMVASPAHATMAAPFNGLKSSAAFPVTRKAINDITSITSNGXRDNCMQVWPPIVKNKIETLSYLPDLTDSKLAKEDDYLIRNKGIPCVAFQLEHRFENREPRNSPLYYDGPDXHMRKLPLXGCPHSDSPLNHEQNGNKEYPXAFIRIIEFHIHPSKSQGIGFLVYKPQDSPA

SEQ ID NO: 56664 - protein, 123 aa, Prochlorococcus marinus str. NATL1A
MSNIMVSSLLKSAIHLDSLIMVDSANQTDGDTAVIDREVQRVRKISPKYKVLLHNDPVNTMDYVVDTLRQVVPQLSEQDALNIMLETHNNGVGLVITCDLEPAEFYSESLKAKGLTSTIELES

SEQ ID NO: 56665 - protein, 461 aa, Burkholderia xenovorans LB400
MTFLKSPPPTPEDVADEYAATISGSSLPKYRIPEASSDRRAVFDLVRDELFMDGNSRQNVATFCTTYADDEVRHLMDLSIDKNMIDKDEYPQTAEIEMRCVHMLADLWHASKAWKTTGCSTTGSSEACMLGGLALKWQWKKRREAQGKPTDKPNFVCGPVQVCWAKFARYFDVEMRQVPLRGEATGLTPEDLAEYCDENTIGVVATLGITFTCVYEPVKALAGALDALQANVGLDIPIHVDAASGGFVAPFIQPDLEWDFSVPRVKSINASGHKYGLAPLGVGWVVWRSTQDLPDELIFRVDYLGGDMPTFALNFSRPAGQIIAQYYMLLRLGREGYRRIQQECADTAQALADGLAKIDQLEMIYDGRGALPAVCYKLKHPETAGFTLFDLSDQVRMRGWQIASYELPAGREDTIVQRVLIRRGVTRDMAAMLLEDIRHAIGHLTKNPVLHSSAGPTFHHN

SEQ ID NO: 56666 - protein, 408 aa, Prochlorococcus marinus str. NATL1A
MVKVNADYLKLKAGYLFPEISRRITEFSSKNPNANLIRLGIGDVTEPLPLACREAMKAAIEEMGTEDGFRGYGPEQGYKWLREIISENDYISRGCEISAEEIFVSDGSKCDSSNILDILGKENKIAVTDPVYPVYVDTNVMTGRTGEANSVGEYTGLSYIPINSENGFEASIPKDKFDLIYLCFPNNPTGAVATKEQLVSWVKYAKENNSLILFDAAYEAFIKDESIPHSIFEIEGARDCAIEFRSFSKNAGFTGTRCAFTVIPKSLKGKAGIETVDLWSLWNRRQSTKFNGVSYVVQRGAEAVYSKEGKIQIKKLVSFYMDNAEIIKSNLTAAGFEVFGAVNAPYAWIKTPKNMSSWDFFDFLLEKANVVGTPGSGFGAAGEGYFRLSAFNSRENVEKAMERIVKLK

SEQ ID NO: 56667 - protein, 395 aa, unidentified eubacterium SCB49
MDNRLSNRVNSMATSATLAMAAKARELRAEGKNIIGLSLGEPDFNVPDFVKDAAIKAVNDNFHAYTPVDGYADLKEAIITKFKRDNNLTYTPSQIVVSTGAKQSLYNLAQVLLNEGDEVLLPAPYWVSYSDIAKVAGGVPVEIKTSIDNDFKVTAEELEAAITPKTKMIIYSSPCNPSGSVYSEAELRALADVLVKYPKIIVISDEIYEHINFTGAHASMAQFEDMYDQTVTVNGVSKAFAMTGWRIGFIGAPEWIARACNKIQGQITSGTNCIGQKATVIALNNPPSKIKYMVDAFKARRSMILDLLNDIPGFKTNVPEGAFYVFPDISYYFGKELKGTTINNASDFSLYLLEQANVATVTGEAFGNPDCIRISYAAAEEDIQQAMKQIKDALI

SEQ ID NO: 56668 - protein, 811 aa, Pyrobaculum aerophilum str. IM2
MRFIKWLDEIGKKDILLAGGKGANLGEVAKMVQVPPGFVITTEAYLHFLNVTGLKDRINEVLKEFISKGEPDEYEKASTVIRGLIESSPLPSDLEKELLEAYKKLGEIVGMANVPVAVRSSATAEDIPEASFAGQQDTYLNVKGAENVIYYAKKVWSSLYTPRALYYRDKMGIPHEKSLMAVVVQKLVNARSAGVIFTLDPTTGDRSKVVIEASWGLGEGVVKGIVTPDEFVVDKSSLKIVERRISPKKVAVVRDEAGLVKEVQLPPEKVNAPALSDEEVVELAKMAIKLEEYYGHPVDIEFAVDADMEYPRNLFILQVRPETVWSRKAERPAKAAEEAPVGTVVVKGIPASPGIAVGQAKICLTLEDAKRKLKKGDILVTKMTDPDWVPYMRLASAIVTDEGGRTSHAAIVSRELGIPAVVGAGNATSVLKDGETYTVDGSKGIVMVGAVVKKEEAKAVEVGVAAPPKEIILHIYRAVPTATKVYMNLGEPDKIDEYKDLPFDGIGLMRIEFVISSWVGQHPLYLLSIGQEHKFVNKMAEGIAKVASAIYPRPVVVRFSDFKTNEYRGLEGGEKFEPEERNPMLGWRGVSRYISPQYERAFRLELKAIKKARQEMGLNNIWVMAPFVRTVWESEKFAKLLEEEGLYRDRDFKVWAMAQVPSIAFMVQEFSEYFDGFSIGSNDLTQLVLGVDRDNDFLVRINPKYFDEREAPVLRAIYELIKRAHKMGRTVSICGQGPSVYPQLVEFLVRGGIDSISVNPDAVLQTRVLVASVELKVLRERLDAIYNALYKPDESSEFYDILKKVFGQVRY

SEQ ID NO: 56669 - protein, 373 aa, Nicotiana tabacum
MAIEHNEQQELSQSFLLDALYCEEEEEKWGDLVDDETIITPLSSEVTTTTTTTTKPNSLLPLLLLEQDLFWEDEELLSLFSKEKETHCWFNSFQDDSLLCSARVDSVEWILKVNGYYGFSALTAVLAINYFDRFLTSLHYQKDKPWMIQLAAVTCLSLAAKVEETQVPLLLDFQVEDAKYVFEAKTIQRMELLVLSSLKWRMNPVTPLSFLDHIIRRLGLRNNIHWEFLRRCENLLLSIMADCRFVRYMPSVLATAIMLHVIHQVEPCNSVDYQNQLLGVLKINKEKVNNCFELISEVCSKPISHKRKYENPSHSPSGVIDPIYSSESSNDSWDLESTSSYFPVFKKSRVQEQQMKLASSISRVFVEAVGSPH

SEQ ID NO: 56670 - protein, 136 aa, Lactuca sativa
LDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLLSLRQRHWYIQSTCA

SEQ ID NO: 56671 - protein, 136 aa, Lactuca sativa
LDAAGKTTILYKLKLGEIVTTIPTIGFNVETVEYKNISFTVWDVGGQDKIRPLWRHYFQGTQGLIFVVDSNDRDRVVEARDELHRMLNEDELRDAVLLVFANKQDLPNAMNAAEITDKLGLHSLRQRHWYIQSTCA

SEQ ID NO: 56672 - protein, 531 aa, Arabidopsis thaliana
MEALSSLTFKGSLPEAIFEAKGKKKLFVVYISGEDEESDKLNRLTWTDASVADSLSKYCILVHIQAGSVDATNFSAIYPYSSVPCIAAIGFSGTQVWRTEGFITAEDLASSLEKAWLGLHIQETTASIFSAALASQNSETPVSSASSVVLPPGSVPLDAAVASPSTASSVQPSETKSTVTSASTTENNDGTVAVKGKESAEPSNLCDTTKNQPAPSVDGTKANVEHEATETPLRVQAEKEPIRPTAPGTNDNTSRVRSSVDRKRKQGTVINEEDSGVGVSGRDINLTKSVDTKETMKPKDEGGEEEDGEKSKKASDVHLNIRLPDGSSLQEKFSVTSILRMVKDYVNSNQTIGLGAYDLAVPYPRKVYTDQDLDKSLSELRLFDRQALVVVPRKRATVYQRGTSYSESNNNTDPNSGGYFAYVRRVLSYANPFSYFGGGTANASSSVPERQTRPNTEVRNNLGQVGTSFQDPSEGRSNVRNRRPTTSRIGSNIHTLNHNEDEAPFGDGNAFWNGNSTQYGGGSGGDSNDRR

SEQ ID NO: 56673 - protein, 756 aa, Haemophilus influenzae Rd KW20
MTEQLRQAALDFHEFPIPGKIEVTPTKSLATQRDLALAYSPGVAEPCLEIEKDPAASYKYTARGNLVAVISNGTAVLGLGNIGALAGKPVMEGKGVLFKKFAGINVFDIEVNEHDPDKLVDIIASLEPTFGGVNLEDIKAPECFYIEQKLRERMNIPVFHDDQHGTAIISAAAIINSLRIVGKKIEDVRLVASGAGAASIACLNLLLSLGMKRENITVCDSKGVVYKGRDDKMDQTKKEYAIEDNGWRKLADAIPNADIFLGCSAAGALTQDMVKSMAAHPIILALANPNPEITPPEAKAVRPDAIVCTGRSDYPNQVNNVLCFPFIFRGALDVGATTINEEMKRAAVYAIADLALEEQNEVVTSAYGGEGATFGADYVIPRPFDPRLIVRIAPAVAKAAMESGVATRPIQNWDAYVEKLTQFVYKTSLFMRPIFSQAKSAKQRIILAEGEENKALHATQEVISMGLANPILIGRRSVIEEKIKKLGLRLTAGVDFEIVDNEDNPRYEECWKHYYELTKRKGITPAIAKRVVRSNTTVLASTLLSLGYADALVCGLFGSYGKHLASIRDIIGLKDGVKTAAALNSLVLPTGNVFLTDTHVNSNPTAEELAEITLMAAEEIHRFGIEPAVALLSHSNFGSSDSLGAPKMREVLQIVKERNPHLMIDGEMRGDLAMNEAHRKELMPDSPLKGSANLLVFPDLSASRISYSLLRGTTTAITVGPILMGMNKSAHILNPGASVRRIINMIAYAAVKAQQE

SEQ ID NO: 56674 - protein, 284 aa, Bacillus cereus ATCC 10987
MTKIFILASTLSLSFFSGLNIGNAATENFSPVTNAIVQNNDHFAEGNSKDNNKPPGNDGSQDDSDSGGNGSDGSGSGDNGSGGNGSGGNGSGDNGSGGNGSGGNGSGGNGSGGNGSGGNGSGGNGSGGNGSSGNGSDGSGSGGNGSGGNDSGGNGSGGNGSGGSGSDGNGSGGSDSGGSGSSGNGSGGSGSDGNGSGGSGSGGNRGKGDSSSQGGNDSHGGNRGKGDSSSQGGNGSQGGNVKDNAKKQGDKLPNTATHYPASILMGLSTFLIGMLLFIRRKNAK

SEQ ID NO: 56675 - protein, 314 aa, Zea mays
MGHSPSSLSKSGPSSPPRRSRSFSPMAPPQQLLLTAPLQVAAGGQRQRLVLLAARAPGLVELHLEKLQVGDRGLAALSACANLEVLFLVKTPECTDSGIISVAEKCHKLRKLHVDGWRTNRIGDFGLMAVARGCPDLQELVLIGVNPTVLSLRMLGEHCRLLERLALCGCETVGDAEIICLAERWAALKKLCIKGCPVSDRGMEALNGGCPSLVKVKLKRCRGVSYECIENLKVTRGESFSISLDVVLEHDAGSTSENGAQENGQTQITELAGQMTGMDLLTNAAGTQSSIHTINRMRSVMSAIRRRFGNPLPP

SEQ ID NO: 56676 - protein, 336 aa, Streptococcus uberis
MVVKVGINGFGRIGRLAFRRIQNVEGVEVTRINDLTDPNMLAHLLKYDTTQGRFDGTVEVKDGGFEVNGNFIKVSAEKDPENIDWATDGVEIVLEATGFFAKKAAAEKHLHANGAKKVVITAPGGDDVKTVVFNTNHDILDGTETVISGASCTTNCLAPMAKALQDNFGVKQGLMTTIHAYTGDQMILDGPHRGGDLRRARAGASNIVPNSTGAAKAIGLVIPELNGKLDGAAQRVPVPTGSVTELVAVLEKETSVEEINAAMKAAANDSYGYTEDPIVSSDIIGMAYGSLFDATQTKVQTVDGNQLVKVVSWYDNEMSYTAQLVRTLEYFAKIAK

SEQ ID NO: 56677 - protein, 529 aa, Mycobacterium bovis AF2122/97
MTTPSIAIAPSFADEHRRLVAELNNKLAAAALGGNERARKRHVSRGKLLPRERVDRLLDPGSPFLELAPLAAGGMYSDESPGAGIITGIGRVSGRQCVIVANDATVKGGTYYPMTVKKHLRAQEVALQNMLPCIYLVDSGGAFLPRQDEVFPDREHFGRIFYNQATMSAKGIPQVAAVLGSCTAGGAYVPAMSDEAVIVREQGTIFLGGPPLVKAATGEIVSAEELGGGDLHSRTSGVTDHLADDDEDALRIVRAIADTFGPCEPAQWDVRRSVEPKYPQAELYDVVPPDPRVPYDVHEVVVRIVDGSEFSEFKAKYGKTLVTAFARVHGHPVGIVANNGVLLSESALKGAHFIELCDKRKIPLLFLQNIAGFMVGRDYEAGGIAKHGAKMVTAVACARVPKLTVVIGGSYGAGNYSMCGRAYSPRFLWMWPNARISVMGGEQAASVLATVRGEQLSAAGTPWSPDEEEAFKAPIRAQYEDQGNPYYSTARLWDDGIIDPADTRTVVGLALSLCAHAPLDQVGYGVFRM

SEQ ID NO: 56678 - protein, 326 aa, Candida albicans SC5314
MEEYKLQPMAKESNHLLSDIKNFIKIDSNASFIAGGIAGAVSRTVVSPFERAKILLQLQGPGSQQAYQGMFPTILKMYREEGWKGLFRGNLLNCIRIFPYSAVQFATFEKCKDIMLHYNPRDTQQLNGYERLIAGSVGGIVSVAVTYPLDLVRARITVQTASLSKLNKGKMVRAPKVMETLKDVYKNEGGILGLYRGIIPTTLGVAPYVAINFALYEKLREMMDSSPRDFSNPVWKLSAGAVSSFIGGVLIYPLDLLRKRYQVASMAGGELGFQYRSVAHALHSIFTTEGFFGAYKGLTANLYKIVPSMAVSWLCYDTLKDWINRW

SEQ ID NO: 56679 - protein, 336 aa, Streptococcus parauberis
MVVKVGINGFGRIGRLAFRRIQNVEGVEVTRINDLTDPNMLAHLLKYDTTQGRFDGTVEVKDGGFDVNGKFIKVSAEKDPEQIDWATDGVEIVLEATGFFAKKAAAEKHLHENGAKKVVITAPGGDDVKTVVFNTNHDILDGTETVISGASCTTNCLAPMAKALQDNFGVKQGLMTTIHAYTGDQMLLDGPHRGGDLRRARAGANNIVPNSTGAAKAIGLVIPELNGKLDGAAQRVPVPTGSVTELVAVLNKETSVEEINSVMKAAANDSYGYTEDPIVSSDIVGMSFGSLFDATQTKVQTVDGNQLVKVVSWYDNEMSYTAQLDRTLEYFAKIAK

SEQ ID NO: 56680 - protein, 177 aa, Oryza sativa Indica Group
MAAPVAPQETNAAAGEMVTLISSDGARFEVPEAAVRLSQTVLDEMKKDDYNAINGIPLPNVAGDVLAKVVEYCTKHASAAAAAINADTAKTSKEEEELMMKSFDDEFILVDNHMLYSLLTAADAMRIQGLMDLACQRLADMLKGKTSEQMRQTLGITNDFTPEEEEEFRREDEEQWL

SEQ ID NO: 56681 - protein, 228 aa, Triticum aestivum
  misc_feature (156)..(156): Xaa can be any naturally occurring amino acid
MATMAPSPALLPLLLLLPLLLLSVACTAGAAPAATATVPTIPSQPGKPNSNNKQKQGGAPLGPAVRALVQSTCNATTYYDLCVAALVADPASSTADLRGLCAIAVSAAAANASATASALANTTWARLGRPRDGQRRARAAGAGAPDEDLRPARYRXGAGKALLEARESVGEEAYDYAFVHVGAAAEYPAVCRTLFRRKRVPYPVELARREQALEHLCTVVIDIITLLA

SEQ ID NO: 56682 - protein, 350 aa, Oryza sativa
  misc_feature (191)..(191): Xaa can be any naturally occurring amino acid
MGSTRTPSIAIPVDSDASPRKNTPETVTSPLVNGEKSIFRDQVRGYSALGSPLRREVGNRSITRSFCIDNTDLEDGKAEKDRDRPSHFLSLPKIQNQALLSGLAYCISSCSMILVNKYILSGYGFSAGIFLMLYQNIVSVTIVSTLSLSGVIPTEPLTWKLIKVWLPVNIIFVGMLITSMFSLKYINVAMXTILKNVANVLTASGETYFFKKQHDRQVWISLTLMIISAIAGGITDLSFNAIGYTWQILNWFLTASYSLTLRHVMDSAKQATKSGNLNELSMVLLNNILSVPLGIILVLGFNEVEYLFETPLLRMPMFWIVITASGVLGLAISFTSMWFLHQSSATTYRY

SEQ ID NO: 56683 - protein, 410 aa, Nostoc punctiforme PCC 73102
MLLNLDKVRQYFPALASEWTFFDNAGGSQTLKKVVDRISEFLLSSDVQLGASYAVSQLAGERLALATRGMAILINANSFKEVVMGPSTTMMLKVLSICLGQTFTSGDEIIVTNCDHEANIGAWVALEKQGIKVKVWQIRPDTLELHLADLEALMSPRTKLVTLTHASNVLGTINPIKEIATFVHDRNAMICVDGVAYAPHRLVDVQDLDVDFYALSFYKVYGPHHALLYGKEEHLLRLPGLNHYFIQQTDIPYKFQLGNVNFELSYGMLGLCDYLSELAQLHYGDKTAPDLRSQMVQAFDLISIHEEELSDRLLSYLNSKPNVRVIGQSKADRKLRVPTISFVVDGMNSSTIPAKIDQHYIGIRYGDFYAKRLIEYLGLALQGGIVRVSMVHYNTLEEVNSLIEAFEQLF

SEQ ID NO: 56684 - protein, 533 aa, Magnaporthe grisea
MAANTMAARGAQSVTESATDLIGNTPLVRLNKIPQSLGIKAQVFGKLELMNTGGSVKDRIALRMIEEAEKEGRIKPGDTLIEPTSGNTGIGLALVGAVKGYKTIITLPEKMSAEKVSVLKALGATIIRTPTQAAWDAPESHIGVAKRLLKEIPNSHILDQYSNPNNPLAHEHGTAEEIWAQTGGKITAVVAGAGTGGTISGLARGLRKHSKTVKVIAADPIGSILALPESLNDNGVNEPYKVEGIGYDFIPDVLDRELVDKWYKTEDRESFMYARRLIAEEGLLVGGSSGSAMAAMVRAVKDLNLGEDDVVVVVLPDSIRSYLSKFADDDWLAANDLLLPTPDSSVNGDTLDSPAVAEAQALHKSRARRASNPYGGATVRSLRLKPVTSVLADSKCSEAIETMRDKGFDQLPVVRDNKLVGLVTLGNMLSYVSRGRVKTNSPVSDVMFDFGRLDEVITDPRDVEGAAKMSTAHGRKKRNFVEITMNTPLDVLSKFLEWNSAAIVTEKSGEVSKPVAVVTKVDLLTWMMKELKA

SEQ ID NO: 56685 - protein, 506 aa, Pseudoalteromonas tunicata D2
MIYKNPGQPGSLVSFKSHYGNFIGGKWVEPVDGHYFENISPVTGEVICKIPRSNEKDINLALDAAHAAKDAWGKTSVTERSNLLLKIADRIEQNLEMLAVAETWDNGKAVRETLAADLPLCVDHFRYYAGCIRSQEGSIGQIDEQTVAYHFHEPLGVVGQIIPWNFPLLMAAWKLAPALVTGNCVVLKPAEQTPVSILKLIEVIEDLLPAGILNVVNGFGKEAGEALATSKRIAKIAFTGSTPVGAHILKCAAENIIPSTVELGGKSPNIYFNDVMNQSEEYISKCIEGAVLAFFNQGEVCTCPSRLLIQEDIYDAFIAKVIERTAQIKRGNPLDSDTMVGAQASQQQFDKILSYLEIGKQEGAHVLIGGGIEAISDDLSKGFYVQPTLFKGNNSMRVFREEIFGPVVSVTTFKDEAEAIAIANDTEFGLGAGLWTKDMNLAYRMGRAIEAGRVWTNCYHHYPAHAAFGGYKKSGVGRETHKMMLDHYQNTKNLLVSYADSPLGFF

SEQ ID NO: 56686 - protein, 276 aa, Prochlorococcus marinus str. NATL1A
MSTRVAYLGPKGTYAEKAAKALAELEKLESPVFSPCKGLRSVVDNLANNLCEAAVVPIENSVEGGVTTTLDSLWRHENLFIHRALVLPIKHSLMSSGSISKISEVLSHPQAIAQCSQWLNDNIPNAVHLPTNSTAEAVRMVKGSLFRAAIGSKDASEDLNILAYPINDIEGNCTRFVLLSKNNIKVNGNRASMAFSLKSNSPGALLKALNCIANLGLNMSRIESRPSKRELGEYVFFIDLDLNNNNKKDYKNITKELSPLCNQIINFGCYFGSEVE

SEQ ID NO: 56687 - protein, 135 aa, Glycine max
  misc_feature (128)..(128): Xaa can be any naturally occurring amino acid
CTSENKEPEVKIVSLTIICPGRPDLILPIPFTSESKNSIFTLKEGSQYRLKFSFTVSNNIVSGLKYTNVVWKTGLRVDNTKKMLGTYSPSQEPYTYELEEETTPSGLFARGTYSARTKFVDDDHKCYXDTSYHFE

SEQ ID NO: 56688 - protein, 322 aa, Salmonella typhimurium
SKIYEDNSLTIGHTPLVRLNRIGNGRILAKVESRNPSFSVKCRIGANMIWDAEKRGVLKPGVELVEPTNGNTGIALAYVAAARGYKLTLTMPETMSIERRKLLKALGANLVLTEGAKGMKGAIQKAEEIVASDPQKYLLLQQFSNPANPEIHEKTTGPEIWEDTDGQVDVFISGVGTGGTLTGVTRYIKGTKGKTDLITVAVEPTDSPVIAQALAGEEIKPGPHKIQGIGAGFIPGNLDLKLIDKVVGITNEEAISTARRLMEEEGILAGISSGAAVAAALKLQEDESFTNKNIVVILPSSGERYLSTALFADLFTEKELQQ

SEQ ID NO: 56689 - protein, 526 aa, Bradyrhizobium japonicum USDA 110
MDGPDSGPPAALLPEVPQRASLPQQNQGRNANLGSNAMDQTRDQILDRSLDRSPASAPLRALADAFHAMIARSRAEPAADLAERLDRLARLRAVVADNEERFRQAISADFGHRSAVETTIAETMMVYSEIRHATKHLKSWMAPQRIATALQFLPARNRLIPQPLGVVGIIAPWNYPLQLTLAPAIGAIAAGNLVMIKPSELVPHFAGLLKETVAARFDATELLVTGVEDEIAKAFASLPFDHLVFTGSTRVGRLVAEAAGRNLTPVTLELGGKSPAIIDASADLDEAAERIAYGKLLNAGQTCIAPDYVLVPERSLQAFAEKLRAQMRRMFGTDPANKDYTSVISDRHYARLEGLVADAVERGAKILQPARADDPNWKAHRKFPPTLILGATEDMAVMQEEIFGPVLPVLGYREPADAIAFVNRRDRPLALYWFGKDRDARDAVLSRTVSGGVTVNDCLFHFAQVNQPMGGVGASGTGAYHGEWGFRTFSKLKPVFYRSKFNRLADLYPPYGGKIARLEKMMRFMS

SEQ ID NO: 56690 - protein, 365 aa, Gentiana triflora
MGSLLPSRVESLAISGIKTIPKEYIRPKEELASIGNIFEEAKNNNKTSQIVPTIDLKDMDSLDNNKDVQTQCHDELKNAAMEWGVMNLVNHGISQELINRVKSAGQAFFDLPIEEKEKYANDQASGNVQGYGSRLANNASGQLEWEDYFFHCIYPERKRDMSIWPKTPHDYIPATIEYAKQLRDLATKVLAVLSVGLGLEPDRLENEVGGMEEMILQKKINYYPKCPQPELALGVEAHTDVSALTFILHNMVPGLQLFYQGKWITAKCVPDSIIMHVGDTLEILSNGKYKSILHRGLVNKEKVRISWAVFCEPPKDKIILKPLPETVSEIEPARFPPRTFAEHIKHKIFRKTEEAIKDNNIANGN

SEQ ID NO: 56691 - protein, 306 aa, Fusobacterium nucleatum
MLANSVIDLIGNTPLVKINNINTFGNEIYVKLEGSNPGRSTKDRIALKMIEEAEKEGLIDKDTVIIEATSGNTGIGLAMICAVKNYKLKIVMPDTMSVERIQLMRAYGTEVILTDGSFGMKACLEKLEELKKQEKKYFIPNQFTNVNNPKAHYETTAEEILRDMDNKVDVYICGTGTGGSFSGTAKKLKEKLPNIKTYPVEPASSPLLSKGYIGPHKIQGMGMSIGGIPVVYDGSLADGILVCEDDEAFKMMRELSFKEGILAGISTGATLKAALDYSKENANKSLRIVVLSTDSGEKYLSSSHGL

SEQ ID NO: 56692 - protein, 254 aa, Haemophilus ducreyi 35000HP
MERIDNYERRFGGIGRLYTVEGLAVLRRAHICVIGIGGVGSWGVEALARSGIGNITMIDMDDICVTNINRQIHAMTGTVAQLKTEVMKQRVLGINPECVVDIIDDFITPENIPDYLDRSYDYVIDAIDSVKTKAALIAYCKRYKIKLITIGGAGGQTDPSQIQIADLSRTIQDPLASKVRSLLRKQYHFSQNPRRKFGIDCVFSSQPLIFPQMEEGCQMSASMNCANGFGAVTMVTATFGFFAVSRVIDKLLHR

SEQ ID NO: 56693 - protein, 136 aa, Jacobaea maritima
LDAAGKTTILYKLKLGEIVTTIPTIGFNVEAVEYKNISFTVWDVGGQDKIRPLWRHYFQNTQGLILVVDSNDRDRVVEARDELHRMLNEDELRDAVLLVFANKQDLPNAMNAAEITDKLGLHSLRQRHWYIQSTCA

SEQ ID NO: 56694 - protein, 1489 aa, Candida glabrata CBS 138
MSVLIPHQQQRLRASSAAKKAAWNAMNKTVNIVSPHNNVNYVKKPSPKTNSNHLDRVIKSVNDATKRLSEAESINSNNTKSSKRKSRDTVGPWKLGKTLGKGSSGRVRLAKNIENGTLAAIKIVPKRTYNRRMRDQKMKTAGGVSSGTDSKDSSNREDPIKNGTDSALNPYGIEREIVIMKLISHPNVMGLLEVWENKSELYLVLEYVDGGELFDYLVSKGKLSEPEAVHYFTQIIQGVSYCHSFNICHRDLKPENLLLDKKNKVIKIADFGMAALELPNKLLETSCGSPHYASPEIVMGKPYHGGPSDVWSCGIILFALLTGHLPFNDDNIKKLLLKVQAGRFQLPPYLTNDAKDLITRILVTNPEKRLTINEILNHPLIKKYRNPPAHIRKLNLLGRGKSNSDLHVLEYNTPATVCLNSEEDIDQSILKSLQILWHGTPRQRLVERLLVEGATEEKLFYSLLFQYKLKHSKPISATKLQKKIEDVVLENESTKTESKDSSNEPGIDNNNDTSDFTQDGNSSEMVNELHTSAPMLEQKSQFSQHSLKSKETVPISDLPPLPPVIPTFAASSSKAFRRSKSNLSSYLKRPKLENARSRTSLFNSSSNTSITSSSISELNTRPRGNIPLSPSNITLTSLVSSRSLHNSASKKSLKNLQKRTLQNSESKRSLYSQTSISKRSLNLNDYLIGGPSNSAELPPLPKLDSNNEFEMLCDKILNTSALDNILEEEEEDITPSKNTTQTNDVHNEDTIIRKEMHDFEINVNNHQPEFKRQPSDFSVNGPDTSIFSIEPMPEGLGISKKPVRVQPTFNFIIDEDKVDDSIKVKQVSGTGPSNNVLKDISNQINNGKGIENSKLHPTSNNNYKNIRNVTAPEGNFTSKTFSLDPRRNVSQPPKESLFHSLLNNKSSKNAEENTQFESKSKQYNFMNKTAHSEFEKERLNAHRDADRSNDQNVYNETSVLAQSSTIHESPLLSIPSTLLNTSMTFKNLVDMLQENKLDDINETVAKESSAPLRKKSTKLSLAPHSNLVSDLNKRTSGYNTLASVDRSSSDLSYAIDLPTNTNIAEIVYLSGNNKQSSEKNIFMLSNDNNETELFHTDENKTSIKSAVNIFEDPPSDSTSLQTSSSESDSIPKVQRKAVSIETLNASNIITPAADVRVSLYGNNVSNSNTMPRETTEELISRFKLTPEKPQHQVQKRFSSLTQTGRNTDSIALSQSMISMFKDAEENGNNKSVKVLDQVEEENASKLTPTSPKNRVTMLFDDYEAQQNITSDQSNKSSKVIEIPNDSPIKVKVQKASTIFEKEIISAAEADENDHLRIPYESKSKKEIAQVHQQEQKEQQVRKPTESQEKAVQKTTKPSWFSKLIHGFKTTGGSGHTKLIREHSTKMTFEEVHMITVKEFGNNGIDYQLRTLDKKGDREKVEYDCKFVKGNFEFKIKIFNSGFPHQNTIITVKKKGKINSKETTDLFQRFNANIENLIKSAERNIESNPK

SEQ ID NO: 56695 - protein, 524 aa, Gentiana triflora
MEMNPSPFIVHTAVFGLFVVFIFIFLKLVSRKKGHGRSLPLPPGPRPWPILGNIPHLGSKPHQTLAEMAKTYGPLMHLKFGLKDAVVASSASVAEQFLKKHDVNFSNRPPNSGAKHIAYNYQDLVFAPYGPRWRLLRKICSVHLFSSKALDDFQHVRHEEICILIRAIASGGHAPVNLGKLLGVCTTNALARVMLGRRVFEGDGGENPHADEFKSMVVEIMVLAGAFNLGDFIPVLDWFDLQGIAGKMKKLHARFDKFLNGILEDRKSNGSNGAEQYVDLLSVLISLQDSNIDGGDEGTKLTDTEIKALLLNLFIAGTDTSSSTVEWAMAELIRNPKLLVQAQEELDRVVGPNRFVTESDLPQLTFLQAVIKETFRLHPSTPLSLPRMAAEDCEINGYYVSEGSTLLVNVWAIARDPNAWANPLDFNPTRFLAGGEKPNVDVKGNDFEVIPFGAGRRICAGMSLGIRMVQLVTASLVHSFDWALLDGLKPEKLDMEEGYGLTLQRASPLIVHPKPRLSAQVYCM

SEQ ID NO: 56696 - protein, 136 aa, Jacobaea maritima
LDAAGKTTILYKLKLGEIVTTIPTIGFNVETVEYKSISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCA

SEQ ID NO: 56697 - protein, 217 aa, Arabidopsis thaliana
MKRGIKHLCFNGFTGYSSLHHHYHEHHVDFFGERLIVTVTHTPSVIRRWIHSIRFVSRLRLSHPLVVGLGVQWTPRGSDPPPDILQLCVGTRCLIIQLSHCKYVPDVLRSFLEDQTITFVGVWNSQDKDKLERFHHQLDIWRLVHIRHYLHPLLLSSSFETIVKVYLGHEGVTKDKELCMSNWGARSLSHDQIVQASHDVYVCCKLGVKERLWKMGA

SEQ ID NO: 56698 - protein, 509 aa, Candida glabrata CBS 138
MEEQRQIIEQLKQTLNALTVSQNTTSNKTPADEPFYHINEHTYEDCAQEFIDFTYENPTTYHVIEFFSKLLEGKGFKYLPEKKTWNDELEPGKPGRYYTIRNGTNMTAWVIGKKWKPESGVGVVASHVDSLTAKLKPASLMEKVEGYKLFGVAPYGGTLNELWFDRDLGIAGRVLYKKKNSSKVESTLVNSAPHPIGRIPSLAPHFGQPSEGPFNKETQAVPFFGWCCDIDDEGTITDEEKKCPLVGKHSILLLRYIAELAGIKVSEILQLDLDLFDVQKGTFGGIKKDFIFSPRMDDRLCSFTAMIAMAYYGATVDLDELSSFNMVALFDNEEVGSLTRQGAESTLLKTSICRTAKRFTNMEGLEPPTLFANSIVLSADVNHLFNPNFKEVYLKKHSPKPNWGMTISLDPNAHMATDVVGLAFVEELARKNKDTVQYFQIRNDSRSGGTVGPIVAAQLGARTIDVGISQLSMHSIRAATGTKDIAMAIKFFRGFFDNWREVYDNFGEL

SEQ ID NO: 56699 - protein, 466 aa, uncultured bacterium
MAARVGLWGGLAAFVVILLLPAPGDMPQAAWATCAIVVLMATWWMSQALPLTATALLPFLAFPMFGIMTATDTAGAYYSPILFLVLGGAMIALAIERVGLHRRLALSIIRRGGHTPGAMLFAFLAATAIISMIVSNTATTLIMIPIAVAVIKAAEIPEGDTGGFAGALAMGIAFAASIGGLGTLVGSPTNAISVGIIEKATGLRITFLDWAIFGMPLVVLAIPLCWLILMKVQRVQPTDFVPEKALEAIGETGPWSKAEKRLVPLIAIVLAAWIAIPFIAPLLPKDSLTDGTIAIAAALALFVIPDGSGRALLNWDEANRAPWGVIMMFGGGLALAAGMGASGLGDWLGVALQPLKAVHPLIVALVLVALVVLITEFASNVAAASAIIPVVAGVIAATGVDPILLALPAAWAASWGFMLPSGTGPNAIAWATGHIALPRMLKAGLLLDLAGIPLMVGTVWLIASIG

SEQ ID NO: 56700 - protein, 530 aa, Gentiana triflora
MMLLDFFYSASIFVLSILLFRAIYTTKNRRLRLPPSPFGLPIIGHLHLLGPKIHHSFHNLYKRYGPIFHLRLGSNRCIVVSTPELAKEFLKTHELDFAYRKNSSAISLLTYHVSFAFAPYGPYWKYIKKITTYQLLGNRNLTHFEPIRRLETNRVLYDLMVSSKHGKSVNLTEEMIKLTSNIISQMMLSIRCSDTESGATNVRNVIRDVTELFGEFDVSDIIWFCKNTDLQGIKKRANGIHERYDALLEKIISDRERTRIVEKKNSGAGGGSGDGERNDFLDILMDAMEDDTSEVKLSRNHIKAIILDFLTAATDTTAISLEWALSELINNPRVLKKAQEEINNVVGNQRLVKELDTPNFPYIKAIIKETFRLHPPIPMVIRKSANDIQVAGYDVPKNTMLFVNIWSIGRNPSYWEKASEFSPERFLADTDGGGLSHMDINGQYFELMPFGTGRRGCPGMPLAMQELPTVLSLMIQCFDYIPLDFKGEKAERVMDMSERPGLTAPRANELMCLLKPRIDLPNLLGNVKGE

SEQ ID NO: 56701 - protein, 500 aa, Arabidopsis thaliana
MAHIWLLPLIFLVCILLAVFNHKKHPKYRQFPCPPGFPIIGNLHQIGELPHQTLWKLSKKYGPVMHLMLGRVPTVVVSSSDTARQVLRVHDLHCCTRPSLSGPRELSYNYLDIAFSPYDDYWKEVRKLCVQELFSTKQVHSIQPIKDEEVKKMIDSIAESASQKNPVNLNNKCLELTVSVVCRTAFGVSFEGTVLNSDRFNKIVREALEMLGSFSAADFIPYVGWIIDVLTGLQGRRERSKRDLNAFFEQMFDLHKEGKKEGNEDFVDLLLRLEKEEAVLGNDKLTRNHIKAILLDVLLAGIDTSAITMTWAMTELARNPRVMKKVQSEIRTQMGNRSMISFEDMDQLEYLKMVIKETWRLHPTTPLLLPREAMSEFDINGYTIPVKTRLHVNVWAIGRDPDTWKDPEVFLPERFMDNNIDAKGQHFELLPFGGGRRICPAIYMGTTMVEFGLANLLYHFDWKLPEGVEVKDIDVEEAPGLTVNKKNELLLVPEMRRSCG

SEQ ID NO: 56702 - protein, 168 aa, Oryza sativa Indica Group
MAAANDGADAGDSKILLISSDGQHFQVTEAEASMSKLVSNMIEDDCTENGVPVPNVASNVLAKVLDYCKKHAAAAAAAAAEDVAVKDQELKSFDASFIDVDNTMLFGLILAANYLNVPSLLDLACQHTADLIKGKTVQDIRDTFGIVNDFTPEEEEEIRKENEWAFEN

SEQ ID NO: 56703 - protein, 452 aa, Brassica napus
MKTNDFSSSSSSSPSDRRIGALLRHLTAGTDADRVSSVFASPTSGGAGGSVFAHLVQAPEDAILGVTIAYNKDPSPIKLNLGVGAYRTEEGKPLVLNVVRKAEQQLINDRSRIKEYLPIVGLVEFNKLSAKLILGADSPAIRENRVTTVECLSGTGSLRVGGEFLARHYHQKTIYIPQPTWGNHPKIFTLAGLSVKTYRYYDPSTRGLNFQGLLEDLSAAPQGSIVLLHACAHNPTGVDPTLEQWEQIRKLMRSKGLMPFFDSAYQGFASGSLDTDAKPIRMFVADGGELLVAQSYAKNMGLYGERVGALSIVCKAADVAGRVESQLKLVIRPMYSNPPIHGASIVAVILRDRNLFNEWTLELKAMADRIISMRKQLFEALRARGTPGDWTHIIKQIGMFTFTGLNPAQVSYMTKEYHIYMTSDGRISMAGLSSKTVPHLADAIHAVVTKAL

SEQ ID NO: 56704 - protein, 136 aa, Jacobaea maritima
LDAAGKTTILYKLKLGEIVTTIPTIGFNVETVEYKNISFIVWDVGGQDKVRPLWRHYFQNTQGLIFVVDSNDRDRVVEARDELHRMLNEDELRDAVLLVFANKQDLPNAMNAAEITDKLGLHSLRQRHWYIQSTCA

SEQ ID NO: 56705 - protein, 522 aa, Blumeria graminis f. sp. hordei
MGISESFMFPYLQPLLQLGFGIALASGILSLLLLLTFLNVLKQLLFKNPNEPPIVFHWIPIIGSTISYGMNPYKFFHESQAKYGNIFTFILLGKKTTVYLGRQGNNFILNGKLRDVNAEEIYTVLTTPVFGTDVVYDCPNSKLMEQKKFMKAALTTEAFRSYVPIIQNEVKSFIEKCDDFRKSKGIINIDAVMAEITIYTASHTLQGKEVRDRFDSSLAVLYHDLDMGFTPINFMLHWAPLPHNRARDHAQRTVAKIYMEIINSRRTQKETDDSNLDIMWQLMRSSYKDGTPLPDKEIAHMMIALLMAGQHSSSSSSTWIMLWLAARPDITEELYQEQLELLGSELPPLKYEDLSKLSLHQNVLKEVLRLHAPIHSILRKVKNPMPVPGTSYVIPKTHSLLAAPGWTSRDASYFPNPLKWDPHRWDTGSGGVIGTDMEDEKFDYGYGLISTGAASPYLPFGAGRHRCIGEQFATVQLVTIMATMVRSFKFHNLDGRNSVAETDYSSMFSRPMQPATIAWEKR

SEQ ID NO: 56706 - protein, 165 aa, Oryza sativa Indica Group
MATVKEGADAGDSKILLISSDGQHFQVTEAEASMSKLVSNMIEDGCTENGVPLPNVASNVLAKVLEYCKKHAAAAAAEDVAVKDQELKSFDASFIDVDNTMLFNLILAANYLNVPSLLDLACQHTADLIKGKTVQEIRDMFGIVNDFTPEEEEEIRKENEWAFEN

SEQ ID NO: 56707 - protein, 157 aa, Picea sitchensis
MANAVGGSRAVDNLEQLFVKANNDLTAVQHKLEIESEQRYPGKANPYKLMYRIKKIQEELPSLKDQCEKLLAAKQDLIDKTQSMLVGNRGLLQRMQARANIPVICDTDDTVYISFEKIIDEWNQQLGLKSNEMGYDNGSVVLQNLNQTLFSSKIQNC

SEQ ID NO: 56708 - protein, 364 aa, Oryza sativa
MLTRLPHHSSPLVFPCRLSAAAAARTLSTATGSNSTTVKMARSALDEVTDAGAFDRSPSTFRSSISRDSSARFPAVPGRYHLYVSYACPWASRCLAYLKLKGLDHAIGFTSVKPIFERTRETDDHLGWVFPATGDEEPGADPDPFNGAKTIRELYEIASPNYIGKPTVPVLWDKQLKTVVNNESSEIIRMLNTEFNEIAKNPDLDLYPAHLQTSVNEINELVYDAINNGVYKCGFAKKQGPYDEAVTRLYEALDKCEEILSRQRYICGNQLTEADVRLFVTLIRFDEVYAVHFKCNKRLLREYPNLFNYTKDIYQIPGISSTVNMEHIRKHYYGSHPSINPYGIIPAGPNIDYNTPHDRERFSA

SEQ ID NO: 56709 - protein, 164 aa, Oryza sativa Indica Group
MAAADGTTGEEVKKTIDLVSKDGERFEVARDAALLCKTLRWMIKGGYGRIPLPNVASPILARVVDYLARHAAAAAAAAAAMDDDGLDRFDRDFLAGVDQDTLFDLLLAANYLQADGLLDLACKKVAAMMTGKSPEQMREIFHIVNDLTPEEEKEIREDIAWALN

SEQ ID NO: 56710 - protein, 136 aa, Oryza sativa
KLRAVPSLSDPSKPASFGQPTYDGVIAGRVSGRRWKEARTRRASALAASRKPTPLEQRARDKSLKRAYQARVAELKEEIRQSKAAKRKLQRVTNPKTIQKIAKSKKRKQLKVVPDELLGGKKSDANRRMQVPGLDN

SEQ ID NO: 56711 - protein, 509 aa, Oryza sativa Indica Group
MDELFYQSLLLSVAAVTVLQLLKLLLVRHRRPRTPPGPWRLPVIGSMHHLVNVLPHRKLRELAAVHGPLMMLQLGETPLVVATSKETARAVLKTHDTNFATRPRLLAGEIVGYEWADILFSPSGDYWRKLRQLCAAEILSPKRVLSFRHIREDEVMMRVNEIRAAGPTTPVNLSVMFHSVTNSIVSRAAFGKKRKNAAEFLAAIKSGVGLASGFNIPDLFPTWTGILATVTGMKRSLRAIYTTVDGILEEIIAERKGIRDEKISGGAENVDENLVDVLIGLQGKGGFGFHLDNSKIKAIILDMFAGGTGTSASAMEWGMSELMRNPSVMKKLQAEIREVLRGKTTVTEADMQAGNLRYLKMVIREALRLHPPAPLLVPRESIDVCELDGYTIPAKSRVIINAWAIGRDPKYWDNPEEFRPERFEDGTLDFTGSNYEFIPFGSGRRMCPGFNYGLASMELMFTGLLYHFDWSLPEGVNEVDMAEAPGLGVRRRSPLMLCATPFVPVVSAN

SEQ ID NO: 56712 - protein, 442 aa, Chromobacterium violaceum ATCC 12472
MSARQLDVGDLINRQRFSARQWRILMLCFLIVLCDGFDTAAIGYIAPAVIRDWGVARTQLGPVMSAALWGLAAGALLAGPLADRIGRKRVLLGAVLLFGAMSVATSAAADLAALAWLRFATGLGLGAAMANAVTLTSEYSPEPRRAFIVSAMFCGFPLGAACGGLLASWLVPHAGWRSVLLLGGIAPLLLLPPMWLSLPESLRFLILRGREGEARRILRRLLPDAPLRDGDRLVLREAERMPGLRLVWSADYRTGTLLLALAYFMGLLIFYLLTSWLPILISDSGMDLRQAALLTALFPFGGLLGSTLTGWLMDRCDAHRVLALAYLLTGALVFCIGQALNNHGLLAAVICLAGIAMNGAQASMPSLAAGYYPTAGRASGVAWMMGMGRFGGIAGAMLGATLLKLQLGLPLFFALLSLPALLAAAALLLKRRSIAMARRAWA

SEQ ID NO: 56713 - protein, 427 aa, Nostoc punctiforme PCC 73102
MSLQTLVEQATIPPDSGSVASSPFDADSFNEAVMSTYGRFPLALERGAGCRVWDTQGREYLDFVAGIATCTLGHAHPVMVEAVTRQIQKLHHVSNLYYIPEQGELAKWLVEHSCADRVFFCNSGAEANEAAIKLARKYAHTVLDIEKPIILTANASFHGRTLATITATAQPKYQKYFDPLVPGFHYVNYNDINAVEVAISELDEGDYRVAAILIEPLQGEGGVRPGDVAYFKKLRQICDETGILLIFDEVQVGMGRSGKLWAYEHLGVEPDIFTSAKGLGGGIPIGAMMSKKFCDVFQPGEHASTFGGNPFVCGVALSVCQTLERENILQNVQDRGEQLRSGLRAIAAKYPQQIGEVRGWGLINGLELRADIQLTAADIVNAAINEGVLLVPAGPKVVRFVPPLIVTEAEVNTALEAVDKAMSNDKP

SEQ ID NO: 56714 - protein, 1131 aa, Blastopirellula marina DSM 3645
MRIFLLTTLLLCVASAATAAEPAVDYTRDIGPLLTKYCAGCHNPDDANAELILTTFDGLQTGGESGAILAPDQPEKSLLLAVLATDGEPKMPPEEEPQPTAAELALLRRWILAGATGPQADEAAPQMNIPQIAVRGDLQAGTSCIALSPRGDQMAIARYGKVELAAFPAHKTIHRLDFPGKVNQIAYSADGTLVAGAGGQVGVSGEVRIWDAATGRLKQSIRGHHDAIYSVAFSPDAQVLATGSYDKDVIVWDLQSGLPLNTLTGHNDAIYDLAFRNDSKVLATCSADRTVKLWDITTGERLETFGEATDETNAVCFSPAGNRVAAAGADNRIRVWQVSKSAAEGTNRLLFTKFAHDAPILDLALSPDGKLLVSAAEDRTVRFWRFADMELLGETPHQADWPVSLAVTQTEALVALARGDWRVEPITGIRGKLNDAAATIGLPYQPPPAIRSAEHVAWEKLPSADEVEPNNGVNQAGSLAWPQVIRGVLQDDGAGADVDLYRFAAEAGEQIIFETRAARDKSPADTCLEILDAAGEPVPHVLLRGVRDAEVTFRGINSSTIDCRTTNWEEMELNQFLYIQGEVVRLYRMPQGPDSGFNFYPGQGKRRPYFDTTAHAHALFEPCYIVEPYAPGSDLPDNGLPTFTLNYQNDDDSEGRGAGDSLLAFVAPHTGDYLVSVRDVRGFEGDDYKYQLIARRPLADYSAKLNGANPTINAGSGKEFTIQIERFDNFNGPVEVEITGLPPGFQATSPLVIEAGHIEATGVLSALPWAPAPTAENESISQVIARAMIDGQQVTKEVGSLGKIQLAERPKLAVFLSPQSSPDGPFGEPPPERTWKALRTDQFTTSDDHSELALLNDGSLLAIGANPGNDHYRLEIPLAAGETLHAIRLDVLGHASLPSGSPGRGADNGNFVLTGLKLSYQPAGKPSQPIAIASAAVDYAQAGFAAAGLIDDNPKTGWAIAEPKDGKFPVKRNGKDPAHYAVLEFAQPLATAQAGKLICELRHEGNAGHQLGHFRLAATVEPPIIPDYHFPAVQELTIVAGETITCQLRVDRNGFDDRIQFDVSNLPHGVIVDNIGLSGVLIPAGQLERTLHLTAAAWTPASQRTFQASTKVEGKQTSLPIRLRVVRPAAN

SEQ ID NO: 56715 - protein, 269 aa, Erythrobacter sp. NAP1
MSEINQLLIIGCGNMGGAMLAGWLAAGVDPSRFAILDPGMEAAPEGVTLYRDPAEAEAAGAHDAVMLGFKPQQLGNLAPGLQKLTGEGVTIYSLLAGLTLAQLKKAFPGAAAHVRVMPNLASRINKSPIILLEDGLDGSERDAAFALFDLLGTAVWLEEEGKFDLVTALAGSGPGFVYRFIDALAEAARNLGLEDEQATSLALAMVDGASSLAAGSDISPGELADRVASPGGMTREGMNVLDADKALVKLLTDTLIATRDRGAELSAGG

SEQ ID NO: 56716 - protein, 233 aa, Triticum aestivum
  misc_feature (119)..(119): Xaa can be any naturally occurring amino acid
  misc_feature (178)..(179): Xaa can be any naturally occurring amino acid
  misc_feature (188)..(188): Xaa can be any naturally occurring amino acid
MAAVWMALAVMLVAAAQVAVAAPVTAPAFLWAPKNYGLSPNEVKEVVHYQTISPKSLADSVLEEGGWSNLVCSKDGPQKNVDVAVLFLGSKLQSSDISKDKQVDPALADILKLSFSSSXEFSMAFPYVAMSDDEALENSLLSGFTENCEDGSGGNHITYTDTCTASSESVKNHPNMDXXHDWVKSRMXKHPSGQLSANRLLRSGGFKDNAKSRRAVAFGSGSGPAVEIFLPPT

SEQ ID NO: 56717 - protein, 321 aa, Brassica oleracea
MESFPIINLEKLNGEERGLTMEKIKDACENWGFFECVNHGIPHELLDRVEKMTKEHYKKCMEDRFKESIKNRGLDSVRSEVNDVDWESTFYLKHLPASNISHVPDLDDDYRTLMKEFAGKIEKLSEELLDLLCENLGLEKGYLKKVFYGSKSPTFGTKVSNYPPCPKPDLIKGLRAHTDAGGIILLFQDDKVSGLQLLKDGEWVDVPPVKHSIVVNLGDQLEVITNGKYKSVEHRVIAQTDGEGRMSIASFYNPGSDSVIFPAPELIGKENEKKDNYPKFVFEDYMRLYSAVKFQAKEPRFETMKAMETTVANNVGPLATA

SEQ ID NO: 56718 - protein, 567 aa, Dioscorea tokoro
  misc_feature (238)..(238): Xaa can be any naturally occurring amino acid
  misc_feature (303)..(303): Xaa can be any naturally occurring amino acid
MATSTLICETPQWKDLNDHVEEIKKTHLRDLMQDSDRCKSMITEFDGIILDYSRQRVLPATVEKLFQLAEVACLKQKIDRMYNGEKINCTENRSVLHIALRAARDKAIKSDGKNVVPDVWHVLDKIKEFSERIRSGSWVGATGKALTDVVAVGIGGSFLGPLFVHTALQTDPEAAECAKGRQLRFLANVDPIDVARSITGLNPETTLVVVVSKTFTTAETMLNARTLREWISAALGPXAVSKHMVAVSTNLTLVEKFGIDPANAFAFWDWVGGRYSVCSAVGVLPLSLQYGFSVVHKFLNGAXSIDDHFHSTPFEKNIPVLLGLLSVWNVSFLRYPARAILPYSQALEKFAPHIQQVSMESNGKGVSIDGVPLPFETGEIDFGEPGTNGQHSFYQLIHQGRVIPCDFIGVMRSQQPIYLKGEVVSNHDELMSNFFAQPDALAYGKVAEQLLNEKVPBHLIPHKTFPGNRPSLSLLLPSLNAYNVGQLLAIYEHRIAVEGFVWGINSFDQWGVELGKSLASQVRKQLHLSRTKAEPVEGFNFSTTTLLTRYLEAETGVPSDQSQLPKL

SEQ ID NO: 56719 - protein, 274 aa, Yarrowia lipolytica CLIB122
MDFDLINVIRGPIELTNLHLQSFMYQLLCGVKYIHSGRVIHRDLKPGNLLVSRDGVVKICDFGLARGMNYDLNDKTQITAYVATRWYRAPELIMSYRNYTEAIDIWAVGCIFGELLGRHPLFQGQNPMDQLKKICKVVGIPSKPVLERMGIKKTWEVLESNMPQYTGIPYSKLFPDADFAALDLIGKLLRFDPTKRVSAVGALRHKYLANFQNSSSEAIMTSPVDFNFESLSFENLKAELEEEVRGFRREVRGIPPGGPIHPHRLYHQDYIHTR

SEQ ID NO: 56720 - protein, 265 aa, Campylobacter lari RM2100
MKIKFNGSVIDTHFKNTLDFFQSVSKNENDVWIVNGFATKDNLELKENDELFCIEKNTLPPYEALDAMMRARHTPKLHDKLKKASVAVCGLGGLGSHIAINLARSGVGRLHLIDFDVVEPSNLNRQAYMVEDLGKFKAEALKDQIAKINPFIEVFAQVLKIEKENITNLFTNDDIVCEAFDNAKYKALLAQNFHQHYPQKTLICASGLAGYGDSNSIQTKKIAKNFYVCGDLKNEAKVGNGLMAPRVNICAGHQANLVLELLASE

SEQ ID NO: 56721 - protein, 262 aa, Coccidioides immitis RS
MTESSFHRFRDRMRGRLGESASPDDTYVTYYDISLTNEDVDTLKNDWLTDNVIAFWEEYLEREVISHYQTTRIILLRPSMSYLLYQTPDPRSLRGALPEFSRASHIFLPINDCRSVTEAEGGTHWSLLLVSVVDNVAFHYDSLPPGNRNEALRVAQKISVLLDRGFRFVQLDDSPVQENSSDCGVFVCLTMRHLLINRLLKACTSEKVSMSLSGKKVNASAGRREMLRIIDRFKKKKDRKRSPTPNSRTKALAKLSLSPSRA

SEQ ID NO: 56722 - protein, 415 aa, Chengiopanax sciadophylloides
MPLIEELFLEETRGKIGALWGSFLQNLSESMSTTTCGGRAAELERCRDEKVAFFLKMAAIAAILISGVFGVAIPLVGKKRRFLRTDSNLFVAAKAFAAGVILATGFVHMLPDATSALTDVCLPKYPWSKFPFSGFFAMMAALATLFVDFVATQYYERKQEKQSQVFRVDSVETVSESGIVPAEINDNSGKVFGEEEGGGMHIVGMHAHAAHHKHNHPHGQEACEGQARELAPSHSPSHSHSHSHSHGLGGADEEGGVRHVVVSQVLELGIVSHSIIIGLSLGVSQSPCAIKPLIGALSFHQFFEGFALGGCISQAQFRTLHTTLMACFFAITTPIGIAIGTGISSFYNPNSPRALVVEGIFDSFSAGILVYMALVDLIAADFLSKRMSCNMRLQIVSYFTLFLGAGLMSSLALWA

SEQ ID NO: 56723 - protein, 453 aa, Candida glabrata CBS 138
MTLNYASVQCVLRMRSAVMLGRRRLSRKALKQSTLFDIPMAPPDGVLGLTETFNADENPNKINLTVGVYKDGWGQVTTFPSVAQAQKIIDMDVGMNTDLSYLPISGCEDFKKHTINFLYRDSCPQDGPALIKNDRISFIQTLSGTGALAVASRLLSSFISRKIWIPKPSWPNHTNIFTQNGFTNPRFYSYYDRGDLTIGRWLQELRHEVGKDSNTKTPHCIVLHACCHNPTGLDPTKKQWEDIMDTIYELGMIPIIDMAYQGLESGKLIDDAYLLRLCLDTSRYRSWDNGLYLCQSFAKNMGLYGERVGSLSIVAPEHVPGVKEVLDSQLKQIIRSMYSSPPGYGSRVAKLVLSNDKLKYQWYSDVETMVNRLKSVREMIHERLQWEEIVNFEQQHGMFYFTKLGPDIVKKLREQYSIYLTNDGRMSLSGVNKSNVDYLCNSIKAVTSSKTLL

SEQ ID NO: 56724 - protein, 492 aa, Aspergillus nidulans FGSC A4
MSLASLKRKDLFQQHGLIGDKWVSSSGGGTFTVTNPATLETLATLPEMNGADTESAITAAHTAFQSFRKTTARQRATWLRKWHALCVENIDDLALILTVENGKTLAEAKGEVLYAASFLEWFAGEAERVHGEVVPASNANQRILTVKQPLGVAACLAPWNFPIAMITRKVGAALAAGCTTVWKPAGETPLSALAQAVLAREAGFPSGTINVITTLNSVAEVGAALCNSKLVRKLSFTGSTRIGKLLASQCSQNLTKLSLELGGNSPFIVFDDAKVETAVEACILAKFRNSGQTCVTANRIFVQEGIYDRFSAALVEKVKALKVGNGVEEGVIIGPLTHERAVEKAVAHIKDAQEKGASLLLGGSPCQPNNLPGYFLEPTVLGKMSTEALTTREEVFAPVVALYPFKTEEEVLAKANDCDVGLGSYVITESMPRMWRVAESLEVGMVGINMGTLSAAESPFGGVKESGYGREGGRQGIEEYMTVKSILMNVAA

SEQ ID NO: 56725 - protein, 136 aa, Jacobaea maritima
LDAAGKTTILYKLKLGEIVTTIPTIGFNVETVEYKNISFTVWDVGGQDKTRPLWRHYFQNTQGLIFVVDSNDRDRVVEARDELHRMLNEDELRDAVLLVFANKQDLPNAMNAAEITDKLGLHSLRQRHWYIQSTCA

SEQ ID NO: 56726 - protein, 349 aa, Kluyveromyces lactis NRRL Y-1140
MASYELLCFGSNGNGQLGVGHDEDLMLPQLSFQSDGVGIKKVSCGGNHSLLLLEDGSLYWCGDNSSGQCASSDIKISLEWIPIPGKFLDIACGWEVTIVIDEDGWVKTRGRGDKGELGVPRLKHSTEWIDLFRCEDPKGSRCYATFQHCVVVVPEKIYGWGNNRKLQVCDDSALKIIEEPKVIYEGDTSDIEMALGKDFTCVLSRTENKLIIKGSLAKELPELISQLSHDFGSIAKIDSMWSSLHILTGERKLISIGRGSHGQFLEEPLPSETLDFVTGSEHGVVTTADMKVYCWGWGEHGNCGSLFKTETNPINDKSNVISPLNMIGKYEKVVSIFGGCATTWLVLVT

SEQ ID NO: 56727 - protein, 1079 aa, uncultured soil bacterium
MASNNKMSPIPQPPTRPVVGNMLSLDSAAPVQDLTRLAKELGPIFWLDMMGAPIVIVSGYTLVDELSVETRLDKVVRGALRRVRAIGGDGLFTADTAEPNWSKARNILLQPFGNRAMQSYHPSMVDIAEQLVKKWERLNADDEIDVVHDMTALTLDTIGLCGFDYRFNSFYRRDYHPFVESLVRSLETIMMIRGLPLENFWMRRRRSDLATDVAFMNKMVDEIVAERRKSAEASDGKKDMLNAMMSGVDRSTGEQLDDVNIRYQINTFLIAGHETTSGLLSYAIYALLKHPDVLKKAYAEVDRVLGADIEARPSYQQVTQLTYITQILKEALRLWPPAPAYGIAPLKDETIAGGKYSLKKNTFISILVTALHHDPAVWGPNPDLFDPENFSPEAEAKRPVNAWRPFGNGQRACIGRGFAMHEAALALGMILQRFKLIDHQRYQIRLKETLTIKPDGFKIKVRPRSGHDRTVHAEAATAAVATGAALPRARPRPGHNTPLLVLYGSNLGTAEDLATRVADLAEVNGFATRLAPLDDCAGQLPDSGGVLIFCASYNGAPPDNATKFVGWLRGELPNDAFAKLRYAVFGCGNRDWAATYQSVPRLIDETLSAHGGKRVFPRGEGDARSDLDGQFESWFAALGAAAVKEFGLESRFSRSADDAPLYSVEPVAPSAVNAVAALGGTVPMTILVSRELQNKSGPDASERSTRHIEVQLPGGMTYRVGDHLSVVPCNAPALVDRVARRFGFLPADQIRLAVAEGRRAQLPVGEAVSIGQLLTDFVELQQVATRKQIQIMSEHTRCPVTKPKLVAYVGDDADSSERYRADILSRRKSVYDLLEEFPAIELPFPAYLEMLSLLAPRYYSISSSPTGDASRCSITVGVVSCPASSTGRGLYRGVCPYYLASRREGESVFATVRETKAGFRLPDDPSVPIIMIGPGTGLAPFRGFLQERAARKAGGATLGPAMLFFGCRHPEQDYLYADELKAFADEGITELFVAFSRSEGPKTYVQHLLATQKARVWDLIEQGAVIFVCGDGSKMEPDVKATLVQIYRDCTGADANGGAKWIADLGAQNRYVLDVWAGG

SEQ ID NO: 56728 - protein, 513 aa, Triticum aestivum
  misc_feature (391)..(391): Xaa can be any naturally occurring amino acid
MCRTLVRRTPNCTKEAMVAMAVFAPWLSWLVVSLLSFYLLNLLAHARSGLPPGPRPLPLIGSLHLLGDKPHRSLAHLAKIHGPLMSIRLGAVTTVVVSSPAMAREFLQRHDSVLATRSVPDATGKHAAGVAWLPPGPRWRALRKIMATELFAPHRLDALHHLRSDKVWELTDHVARLAREGTAVNVGRVAFTTSLNLISRTIFSIDLTSLDDHGGSEDFQGVITAMMEGLGTPNVSDFFPVLAPADLQGMRRRLARIFARLHAVLDAEVDKRLRGRHAGQPRKNDYLDVLLDVAARDEGKDLLDRDTLRSQFTDLFAAGSDTSSSTVEWAMAELLRNPSSMVKVCDELAQVIGSRRNIEEADIVRLPYLQAVIKETFRLHPPAPLLLPRQXMTVKIAGYTIPKGSRVFINVWAIGRDKDVWAEPETFMPERFLGSAIDFRGVDFELLPFGAGRRICPGMTLAIRMVHVMLASLLNQFKWSLPIELERDGIDMEDHFGLTLVKNVPLCIIATPI

SEQ ID NO: 56729 - protein, 136 aa, Jacobaea maritima
LDAAGKTTILYKLKLGEIVTTIPTIGFNVETVEYKNISFTVGDVGGQDKIRPLWRHHFQNTQGLIFVVDSNDRDRVVEARDELHRMLNEDELRDAVLLVFANKQDLPNAMNAAEITDKLGLHSLRQRHWYIQSTCA

SEQ ID NO: 56730 - protein, 366 aa, Desulfitobacterium hafniense Y51
MTLHAGIVGLPNVGKSTLFNAITQAGAEAANYPFCTIDPNVGMVQVPDARLQVLAEMVHPDKIVPATVEFVDIAGLVKGASKGEGLGNKFLSHIREVDAVVHVVRCFEDSNVVHVEGSVDPKRDIDIIQLELILADMESVEKRLERSAKLLKSGDKKAQVEVALLNRLKETLDAGLAARSLEFSDEEREILKSFPLLSMKPVLYAANVSEEEIAQPDNNPYVRKVREIAAAENSEVVVVCAKIEAEIAELEEEEKKVFLEDLGLTESGLDRLIRAAFHLLGLMTYFTAGQIEVRAWEIRRGMKAPQAAGVIHTDFERGFIRAEVVAYKDFVENGGLNGAKEKGLVRLEGKEYVMNDGDIVHFRFNV

SEQ ID NO: 56731 - protein, 276 aa, Roseovarius nubinhibens ISM
MREGFMVMQSVAEGGLVLLGCGKMGSAMLEGWLANGLPPTSVWVIDPRPSDWLKSTGVTINGALPKAPAIVLIAVKPQMMGDALPEIAAMGNGETLFVSVAAGTSIAAFEAAMGAQSPIIRAMPNTPAAVGRGITAIIGNSHASAAHLDMAEELLRAVGQVVRLESESQMDAVTGVSGSGPAYVFHMIECLAQAGEAQGLAPELAMQLAKATVAGAGALAEAAEETPAQLRVNVTSPNGTTQAGLEQLMDETTGLPPLMARTVAAATDRSKELARG

SEQ ID NO: 56732 - protein, 388 aa, Mycobacterium avium 104
MSDERVKPFLVPDLGEGLEEVTVTHWNVAVGDDVELNQVLCTVETAKAEVELPSPYAGRIVEMNGAEGDVLKVGAVLVRLDTAPESAEPPAAETAPTLVGYGADAGIDTSRRTARPLAAPPVRKLAKELMVDLGSLRPRSGAVITREDVLSAAHGTGNGAEVRPVQGVQARMADKMTLSHKEIPAATVSVQVDCTALVRLSERLGPAEQRITPFVLTLRLLVIALRRNEIMNSTWVDTPQGPQVRIEHRVHLGVAVATERGLLVPVIADAHTKTTRELASRAAELISGARAGSLTPGELRGSTFTVSNFGALGVDDGVPVINHPEAAILGMGAIKPRPVAVGTEVVVRPTMSLSAVFDHRIADGAQAARFVCELRDLIESPETALLDL

SEQ ID NO: 56733 - protein, 424 aa, Vitis vinifera
MDSVEAVVTQIQGLSGGSGDISLLHSLLKQADDLLHNESTRLAPFLEQLDPSIHTLGYLYLLEACTSTPIPKEQANQLVLSIANFINNCSAEQIHLAPDKFVSLCKRLKDQVILLEAPMRGVAPMLTAVRKLQSASELLTVLHPDFLLLCLLAKCYKTGLCILEDDIFEVDQPRDFFLYCYYGGMICIGQKRFRKALELLHNVVTAPMSTINAIAVEAYKKYILVSLIHNGQFSTTFPKYTSSVAQRNLKNFSQPYLDLANSYSSGKISEPEKCIQTNREKFEADKNLGLVKQVVSSMYKRNIQRLTQTYLTLSLQDIANTVQLNSPKEAEMHVLQMVVDGEIFATINQKDGMVRFQEDPEQYKTCEMIEHIDSSIQRIMTLSKKLTTMDELISCDPLYLAKAGRERQRFDFDDYDTVPQKFNI

SEQ ID NO: 56734 - protein, 181 aa, Alteromonadales bacterium TW-7
MTQVTPAIIKNSIATIADYPKAGIMFRDVTTLMANPEAFKATIDAFITEYKDQGFTKIIGTESRGFIFGAPLSYALGIPFIPVRKPGKLPREVIRQDYLLEYGEDTLELHVDAIVPGDKVLLVDDLLATGGTIEATAKLVNKLGGEATDAAFVVSLPELGGEQRIEKMGIKILKLVEFEGE

SEQ ID NO: 56735 - protein, 831 aa, Alteromonadales bacterium TW-7
MSYQVLARKWRPQTFHELVGQSHVKQALVNALTQNRLHHAYLFTGTRGVGKTTIARIFAKSLNCDEGISASPCGQCSSCTDIEAGRYIDLLEIDAASRTKVEDTREILDNVQYAPTRGRYKVYLIDEVHMLSKHSFNALLKTLEEPPEHVKFLLATTDPQKLPVTILSRCLQFNLNALSQSEIKTQLQHVLTQEQLRFDNDALSVIAKAADGSMRDALSLTDQAIAQTNGDINNQAVQAMLGLMDTHYSQSLLAALLSQDGAALMSEIANVASKNPNYIALLDDLISLTHLTQLTQLVPQAAGLDETNADYIKHVAEHTSAQQVQVYYQLLLNGKKDLQWAPEPRLGFEMILLRLLAFQPAGNENQQNDINTPQLPARNTESRANALRDILSKNKPESTNNAANHSDTNIVQQPAEKSIISAEQHEQVTPTATDTPVDSAHVEHLQVENEDAQTETSQNTPAKQISDEQAQRNSENEAYMQHNDVEQTLAAQFDDVMSSALDQGFNPQAQSTSQQAESPSAPVSLDASSLHDKESQAQSAIARILRDRNISGSGRLSGNNIAQPPVSEKPETANNEQNNRLVGSPIVEQSESTNTDIHTHSENAEHPQAASVQSTNPPPWDDYNTGEHEKKSELPVSGSQAKRPSVVATKAQKVDFKAKHQTITENLAPELLEQINPQSVPAPAPQEESIPVPDDFQSPISEIKFAHQQDEWAYLIKRMGLGGRMRQFALHSIFTKQGSNLHIDVDESQKHLDTPMLRQKLDAALSSIYDHNVSLSIKFAQGVIDSPYLIQQKIDAGRHQQAIDVITSDENIVQFQQLFSAEIDENSIQAL

SEQ ID NO: 56736 - protein, 366 aa, Eurotium herbariorum
MAEFVRATIFGTTFEITSRYTELQPVGMGAFGLVCAARDQLTGAPVAVKKIMKPFSTPVLSKRTYRELKLLKHLGHENIICLSDIFISPLEDIYSVTELLGTDLHRLLTSRPLEKQFIQYFLYQILRGLKYVHSAGVVHRDLKPSNILINENCDLKICGFGLARVQDPQMTGYVSTRYYRAPEIMLTWQKYDVEVDIWSAGCIFAEMLDGKPLFPGKDHVNQFSIITELLGTPPDDVIETICSENTLRFVKSLPKRERQPLTSRFKNADPEAVDLLERMLVFDPKKRIRAGEALAHEYLAPYHDPTDEPEAQEKFDWSFNDADLPVDTWRIMMYSEILDFHNIDQSEDAGQVLVEGVGDGQQAFAA

SEQ ID NO: 56737 - protein, 270 aa, Pseudomonas fluorescens PfO-1
MSTEDPRFAGIARLYGIEGLERLRAAHVAIVGVGGVGSWAAEAMARCGVGEISLFDLDDVCVSNANRQLHALDSTVGKPKVEVMAERLRGINPDCTVHAVADFVTRDTMAEYITPNIDCVIDCIDAVNAKAALIAWCKRRKIQIITTGGAGGQIDPTLIQVCDLNRTFNDPLASKVRSTLRRDYGFSRTVTRHYSVPCVFSTEQLRYPKPDGSICLQKSFVGDGVKLDCAGGFGAVMMVTATFGMVAATKAVDKIVAGVRRPADRVKPQA

SEQ ID NO: 56738 - protein, 87 aa, Arabidopsis thaliana
  misc_feature (34)..(34): Xaa can be any naturally occurring amino acid
  misc_feature (52)..(52): Xaa can be any naturally occurring amino acid
MDSYSSPPMGGSGSSVSPEVMMESVKTQLAQAYXEELIETLRTKCFDKCVTXPGSSLGGSESSCISRCVERYMEATAIISRSLFTQL

SEQ ID NO: 56739 - protein, 314 aa, Picea sitchensis
MGGGVMLRNVGRAIGARGVGGGPVVTSVAQQASCSACRSSSSSAAKVRASTCVCEKGRGIATQQTLPNQPCWLLDDWEFTGDEEGFQRHYDDDHHDRLIFGSVPTQKEVQEVVSDFQDALTQGIVPVSGNFNDKTTLSSSSSVYKKSGNKSCGTLVNLDQMERESHEDNYRIVQKAGHNNVCEAFNLLQSNPAVQEMVISLASDKTVWEALLKNEKVTEFRQSLQKDESKLRELSKDSDKPPPHQENHFMWVIENTKMKVMECIEKITELLNQYFGFVDEKDLFKKDEDPLERILRASLMLSVAVLLMILVKRV

SEQ ID NO: 56740 - protein, 430 aa, Pseudomonas fluorescens PfO-1
MAFDRSSSRASPLPQGSALTRPSSPGLETVMIPSPWRADFPAIAALQRQDQTYLDNAATTQKPQALLDALAHYYANGAANVHRAQHLPGAHATQAFEDSRLKVAQWLNAGDSGQIIFTHGATSALNLLAYGLEHLLHPGDEIVISALEHHANLLPWQQLAQRRELKLVILPLDDDGVIDLAAAVHLIGPRTRLLAVSQLSNVLGAWQPLPALLAMAKAHNALTVVDGAQGVVHGRHDVQALGCDFYVFSSHKLYGPDGLGVLFGCNAALEQLRPWQFGGEMVLEANYHDARFRPAPLGFEAGTPPIASVIGLGATLDYLAGLDQDAVSAHEAALHDYLLRGLAARNGIRLLGKPQLALASFVVEGVHNADLAHLLTEQGIAVRAGHHCAMPLLKRFELAGAIRVSLALYNDSEDLERFFEALDQALELLR

SEQ ID NO: 56741 - protein, 154 aa, Zea mays
AEVEVVRELLASSASVLDRAMEWSEAEAKLNLHGFSTVAAYVLVLQWVDAVRGRARAFPLEVSVVCGVGKPSDFRGESRVRELAQEVLGRMGSPLKLSARNRGRLVAKRARVEQWLASLPVPEDGPAPSPDAANEDPFVFALFRKLGQFFSTLM

SEQ ID NO: 56742 - protein, 194 aa, Zea mays
IHCCVCSHTVNPKSESAKLRYNAEKGWLNLIDDPKLSAFVFRLGGIYGPGRSALDTLAKSKSLSRKQKLRESKQYTARIHVADIYQAVLASMSIRCARKIFNVVDDDPAPRAEVFAFATSLIQRRYPDMITETIDAKPAGLDYQEMIVPAEKRVSNARMKQELGVNLLHPTYRSGLQSILDAWQIQPPLPNTSQ

SEQ ID NO: 56743 - protein, 381 aa, Brassica napus
  misc_feature (332)..(332): Xaa can be any naturally occurring amino acid
EQEVKQEVKQEASPVKKSSRWETGLTSHKEELPSYADDVVPKTSRWNRSSLSPECGELVVSEERQCNSSGSGSGRQSVETLSGNEYSDNEYFSSDHDELEAEEPASPAQGVMNMLLGSRSVNGFQKLNKINEGTYGIVYRARDEKTKEIVALKKIKMKEDKYEEEYGFPLTSLREINILLSCNHPSIVNVKEVVVGGRNDSDVYMVMEHLEHDLKGLMERKKQPFSTSEVKCLMLQLLEGVHYLHTNWIIHRDLKPSNLLMNNSGELKICDFGMARQYGSPIKPYTQMVITQWYRPPELLLGAKQYSTAVDMWSIRCIMAELLSQKPLFPGXTELDQLRRIFAVHGTPNESIWPGFSSLPNAKAKFLTQSYNLLRKTFPAI

SEQ ID NO: 56744 - protein, 161 aa, Vitis hybrid cultivar
REVRRQFNTIPGLMEGRAKPDYATCVKISTDASLREMIPPGALVMLTPLIAGTLFGVETLAGVLAGSLVSGVQVAISASNTGGAWDNAKKYIEAGASEHARSLGPKGSDPHKAAVIGDTIGDPLKDTSGPSLNILIKLMAVESLVFAPFFAAHGGLLFKLL

SEQ ID NO: 56745 - protein, 440 aa, Acidobacteria bacterium Ellin345
MGSAVATVVGESIAIGIFLTPAGMAKALGSPFWLLAVWMLMAAMALSGALCFGELSTRYPEDGGLYVYLREGFGKRIAFLYGWMSLLVMDPGITAAMAVGMATYGSYIFGWGGVGTKIVAVSSVLALGLLNIVNLRVSAGLLRIVTWLKFAVLGALVLRGLLFHLGSSHNFTPFVQQRTGSMPLGPALAVATVAAFFSFGGWWDVSKIAGEMKNPERILPRALVAGVLGVTAAYVIITGVFVYLVPLEKVVSDKGFVAQAGEVLFGGPGAQLLSAAVVICVLGSLAVLIMVSPRVYFAMARDGLFFSAVAETHPKFGTPSRAIAVQVVMASLLIVLGSFGQILSYFMFPAVIFLGLALSTVFVFRRKGIPDGVVKTAGYPITPVFFLVLVVVVLALIVGHDPVQAFTGLGVVLLGLPVYALVHRKTSPAALEPIADQKAS

SEQ ID NO: 56746 - protein, 547 aa, Erythrobacter sp. NAP1
MYKYDNYDQQMVDARVEEFRDQARRRLEGKLTEDQFKPLRLMNGLYLQLHAYMLRVAIPYGTLNSEQMIALGDIADKYDRGYGHFTTRQNLQYNWIKLEDAADILADLAKVEMHAIQTSGNCIRNISSDHFAGAAHDELVDPRPYAELLRQWSSFHPEFTYLPRKFKIAVIAAEKDRAAMRLHDIGIQIVKNDAKDGGSEIGARFFVGGGMGRTPMVAPMIRDFVPLDQLITYAEACLRVYNRYGRRDNKYKARIKILVHELGKDEYTRQVEEEFAHLLKQGVEPPREELERIKPYFSDPAFEDGPKSVDRSDPDFAVWVDRNTHRHKHDSYVSAVISLKPVGGIPGDATGEQMRLMARLAKQYSFDELRIMHTQNVVLPHVKIGDLHALWTELEAAGLGSPNMDTIEDMIACPGLDYCSLANARSIPLAQRISERFDASGKTSKLGELKLKISGCINACGHHHAGHIGILGVDRKGVENYQLSLGGSEAEDVSLAKITGPGFTEDGVIEAVDTVTNVYLANKQGEERFLDTYRRIGMEPFKEALYG

SEQ ID NO: 56747 - protein, 129 aa, Nostoc punctiforme PCC 73102
MKFGYTVIWVDDVVKTVEFYEKAFGLVRRTLLDKGQSIWAEIETGNTTLAFSSTSEAQNLFPGGFHPNDPAQPPTLIQISFITPDVGSAYMRAIGAGAKALNAPKSQPGGQTIARVRDPNGVLVSLVSG

SEQ ID NO: 56748 - protein, 439 aa, Bacillus cereus G9241
MAVENITMPQLGESVTEGTISKWLVNVGDHVNKYDPLAEVMTDKVNAEVPSSFTGIVKELIAGEGDTLAVGEVVCVIQVEGADEVAATAVEEKTKEEPKAEVATPEKAPKAKQPTDGKPRFSPAVLKLAGEHNVDLDLVEGTGANGRITRKDILKLVESGNIPQAGAAKKEEAVAAVVEARPEAPKAAPVAQKVEAVKPVSVPTMPGDIEIPVTGVRKAIAANMLRSKHEAPHAWMMIEVDVTNLVSYRNSIKGDFKKREGFNLTFFAFFVKAVAQALKEYPQINSMWAGDKIVQKKDINLSIAVATEDELFVPVIKHADEKTIKGIAREITELAGKVRTKSLKADEMQGGTFTINNTGSFGSVQSMGIINYPQAAILQVESIVKRPVIMENGMFGARDMVNLCLSLDHRVLDGLICGKFLGRVKEILENTSENNTSVY

SEQ ID NO: 56749 - protein, 377 aa, Streptomyces avermitilis MA-4680
MKAVVYKGAFDVAVEDVEKPSIQHPNDVIVRITSTAICGSDLHMYEGRTAAEPGIVFGHENMGIIEELGQGVTALKEGDRVVMPFNVACGFCTNCVDGFTGYCLTVNPGFAGGAYGYVAMGPWQGGQAEYIRVPYADFNCLKLPPGNEHESDFILLADIFPTGYHGCELAQVRPGESVAVYGGGPVGLMAAYSALLRGAKKVFVVDRVLERLQKAEEMGAVPINFAEGDPIAQIKEQTEGIGTDKGVDAVGYQAMAHGTDREEPATVLNSLVGTVRPTGALGVPGLYVPADPGGPDEQAKQGMLLVAIGKLFEKGLRVGTGQCNVKRYNRYLRGMITEGRAKPSFVVSHELPLDQAPSAYDKFDKRIEGYTKVVLHP

SEQ ID NO: 56750 - protein, 779 aa, Neurospora crassa
MDTLLQHMAGQTVSCSDGTSSTVSNPAASTTGAPVTGQMVLLDMFFPGFSTFSAFVQKNLNIDLNVYIPLVLICGALTFAWQYFSDYCWDLIDRYMMSVVDVRTDDEIYNMLMGWVAAQKFAQGARRFVVNTNLNSRFWWLWRYDYDDEAEDGTEEDDHVQSTKGGKKALAYTPTFGSHWFWYNGRLLCFRRQQSRDMAGYSLSSEREEISIKCFGRDPWILKELLLEAREVYMKRDEAKTLIYRGTAKGSGSEPTWQRCMARTSRPFSTVILNEKVKKDLIDDVTDYLNPATRRWYANRGIPYRRGYLLHGPPGTGKSSLSLALAGFFKMRIYIVSLSSIAANEENLASLFSELPRRCVVLLEDIDTAGLTHTREDGKGAAIDGGSDDMVPGQITAGDGTATTPTPSGRLSLSGLLNILDGVASQEGRVLIMTTNHLKKLDKALIRPGRVDMIVEFGRADKEMTAAIFRAIFAPLEGDDVDTPSDADSKDLFKTPSTSTSPAGAAAAAAAEARRELARNEATLKVVELADQFADKIPAHEFSPAEIQGFLLKHKRNATAAVEGAEQWVVDARKEKMEKDLREARERREKEEKAEAEKKGTKKEEKGGKDKTETKKSKKSSKHNKVTSKKSSSKKSTMKAAISDADFSDNSSSSSSSSSSSSSSSTKSSSSESESESEPERFKEKKSKRKHSKKEKTDITAPPPLLVKEDTIRVQVVPVQQKVQTIASHIAPGAEKTDGLAKAVVAVEDILVPQISVIAANETRSTGSEDGKDSGYGTP

SEQ ID NO: 56751 - protein, 489 aa, Chlamydomonas reinhardtii
MKLCKERIIDARRAAQSCPVAHVVSGRVAQRVAFGRTATQQQQRAAHVAVRVAEASPAKPAGDVYRVETRPLEEGVEKHIISIFVADEPGLINRVAGVFARRGANIESLAVGLTVDKALFTVVVAGKANVVANLVKQLGKLVKVRYVEDITSTNRIEREMLLLKLRVPAGSTRAEVLELAAVFRARVVDVGDETLSLCVTGDPGKLTAMIKVMSKFGIEQLTRTGRICLRRGEALLERSAGIPEQIAVPLPEAAKVKAASSNGAPKAAAAGEERGADVYVVDDADLKGVWDVDNVLSPTYSASGAGALPADFKPYTLSIEVQDVPGVLNQVTMVFSRRGYNVQSLAVGPSEREGLSRIVMVVPGKVSSPDGSSGISPLLKQLSKLVFVQSIDDLTDIPFVNRELMLVKVRCSASQRGELSDLANIFRGSVLDVSPSCMTIEVVGKEDKMKAFTDLLEPYGILEIARTGRVAMPRDSGVNSEFLERMSMG

SEQ ID NO: 56752 - protein, 340 aa, Ginkgo biloba
MAPTRVQYVAESRPQTIPLEFVRPVEERPINTTFNDDIGLGRQIPVIDMCSLEAPELRVKTFKEIARASKEWGIFQVINHAISPLLFESLETVGKQFFQLPQEEKEAYACTGEDGSSTGYGTKLACTTDGRQGWSDFFFHMLWPPSLRDFSKWPQKPSSYIEVTEEYSKGILGVLNKLLSALSISLELQESALKDALGGENLEMELKINYYPTCPQPEVAFGVVPHTDMSALTILKPNDVPGLQVWKDEKWITAHYVPNALIIHIGDQIQILSNGKFKSVLHRSLVNKEKVRMSWPVFCSPPLDTVIGPLKELIDDSNPPLYNARTYREYKHRKINKLGQ

SEQ ID NO: 56753 - protein, 399 aa, uncultured bacterium
MSEEFYRIKRLPPYVIAEVNDMRAAARQAGRDIIDLGMGNPDLPPPQHVIDKLCEVAMKPDAHGYSASKGIPGVRKAQANYYARRFGVELDPNTEVVMTMGSKEGLASMATAMTAPGDVVLAPNPSYPIHTFGFIIAGATIRAVPTTPDENYWRALERAMAFTVPRPSVLIVNYPSNPTAETVDLAFYERLIAWAKENQVWVLSDLAYSELYYDGNPTPSILQVPGAKDVAVEFTSMSKTFSMAGWRVGFAVGNRKLIAALTRVKSYLDYGAFTPIQAAACAALNGPQDIVEANRTLYQKRRDVLVEAFGRAGWDVPSPKASMFAWAPLPPALKDMGSLEFSKQLLTHAEVAVAPGVGYGEDGEGFVRIALVENEQRLRQAARNIKRYLTSMGVNSTAA

SEQ ID NO: 56754 - protein, 249 aa, Brassica napus
  misc_feature (127)..(127): Xaa can be any naturally occurring amino acid
  misc_feature (144)..(144): Xaa can be any naturally occurring amino acid
MDKEVIAVSAMDAFEKLEKVGEGTYGKVYRAREKATGKIVALKKTRLHEDEEGVPSTTLREISILRMLARDPHIVRLMDVKQGLSKDGKTVLYLVFEYMDTDVKKYIRSFRQTGDNIPPQIVKSLMXYQLCKGIAFCHGNGVLXRDLKPYNLLMDPKTMRLKIADLGLARAFTLPMKKYTHEIVTLWYRAPEVLLGATHYSTAVDMWSVGCVFAELVTNQAILAGGSELQRPHHHSHLNFLIRLEKILR

SEQ ID NO: 56755 - protein, 608 aa, delta proteobacterium MLMS-1
MTVLEAAPKLGGMLRYGLPRYKVPENVLDYEIGTILRMGISVRLNQRWGRDFTLQGLQEQGFAAILLAVGACYDESLDIEGGSLPGVVPALKLLRRANEGDKTDYGRRAMVVGGGNTAMEAARTLLRRGVEQVTVLYPRAQTEMPANQRNIGEAKEEGVQFLLMASPVTIQEGEQGLDVDLIRMKLGEPNDKGLRFPEAIPGSNIAMNVDTVVVASGQSATGDGVLGGELEEKLELTPKNNIKANPRNFQTNLPTIYAAGDATSGPRSVIQAVVAARRAADNIHAQLLGLGKEAPASRFNFSRGKSFEQVDLRNFEGIRVNLREKMPSRPPERAIQDFNEVRLGFTEQMAKSEAERCLSCGCTAFDRCDLKEQAIAHGVDPNKTGMGTTPRYARQEEHPTISVDLNKCIYCHKCANSCEYRALEITAGSFDEQGRAQDLSLTFMEHCVSCGKCVDNCSTGALNKKDQIVPITDEEIRLVPTTCPYCGAGCQMNLKVKGDTIIEVTADPELAPNYGALCVKGRFGFHFVQDRRRLTRPLIRRGGQLVECSWDEALNYTAKRFFDIKAMYGSDAVAGFSCARATNEENFLMQKFMRTAIGTNNIDHCARL

SEQ ID NO: 56756 - protein, 291 aa, Triticum aestivum
  misc_feature (56)..(56): Xaa can be any naturally occurring amino acid
  misc_feature (184)..(184): Xaa can be any naturally occurring amino acid
  misc_feature (220)..(220): Xaa can be any naturally occurring amino acid
  misc_feature (272)..(272): Xaa can be any naturally occurring amino acid
MEGKEEDVRLGANKYSERQPIGTAAQGSEDKDYKEPPPAPLFEPGELKSWSFYRAXGIAEFMATFLFLYVTILTVMGYSGAASKCATVGIQGIAWSFGGMIFALVYCTAGISGGHINPAVTFGLFLARKLSLTRAVFYIIMQCLGAICGAGVVKGFQQGLYMGNGGGANVVAPGYTKGSGLGAXEIIGTFVLVYTVFSATDAKRNARDSHVPILAPLPIXGFAVFLVHLATIPITGTGINPARSLGAAIIYNREHAWSDHWIFWVGPFIGAXLAGVYHQVVIRANPFKTKS

SEQ ID NO: 56757 - protein, 480 aa, Oryza sativa Indica Group
MKKFSGRKGWIFGPKPMKKYNVQLWPGHARASPAGGRRSRWTTAAARHPTAAVNSIGFRVFAPFLAWELGFLKLPGNELLMIFLHHIQAIGVLEAVDVSVEKEGLITELRKELRVSDVDHRELLNRVNSDDIIRSIREWRSAGGPQAMLPNNAQPMHDLAPSPTTSGRKRQKTSQSFPALPAPPPVMHSQQLALQGPPSSSTAKKGASSGAKGKKTKPGQKVPGGPSVKAMTSSAGPSGRGPHMNRNFPVGLVSFEPSEALHINPLINRKVMSRWPEDNSFYEATITDYNPETDLYALAYDINTANESWEWVDLKQMGPEDIRWQGDDPGIYQGVRGAPGSGGKKSSSRGGPTPGTGRGRGLPKHVSRKDFPPSQNGVGKRSSDDIDILHTESLIKEVERVFSVNNPDPLEVEKAKKVLKEQEQSLIDAIARLAEASDGESDEHNRVRRNAPYAGSQHQANYADAMAVDGGHMLGGADAV

SEQ ID NO: 56758 - protein, 324 aa, Arabidopsis thaliana
MANTPLIVSFGEMLIDFVPDTSGVSLAESTGFLKAPGGAPANVACAITKLGGKSAFIGKFGDDEFGHMLVNILKKNGVNSEGVCFDTNARTALAFVTLKKDGEREFMFYRNPSADMLLKESELNKDLIKKAKIFHYGSISLISEPCRTAHMAAMKTAKDAGVLLSYDPNVRLPLWPSTEAAIEGIKSIWNEADIIKVSDDEVTFLTRGDAEKDDVVLSLMHDKLKLLIVTDGEKGCRYYTKKFKGRVPGYAVKAVDTTGAGDSFVGAFLVSLGKDGSILDDEGKLKEALAFANACGAVCTTQKGAIPALPTPADAQKLMKSKSK

SEQ ID NO: 56759 - protein, 399 aa, Pseudomonas fluorescens PfO-1
MNNALSQLQPYPFEKLRALLGSVTPNPDKRPIALSIGEPKHRSPSFVAEALANNLEQMSVYPTTLGIPALREAIAAWCERRFNVPSGWIDPARNVLPVNGTREALFAFTQTVVNRGDDALVVSPNPFYQIYEGAAFLAGAKPHYLPCLDENGFNPDFDAVSPDIWKRCQILFLCSPGNPTGALIPVDVLKKLIALADEYDFVIAADECYSELYFDEQTPPPGLLSACADLGRKDFKRCVVFHSLSKRSNLPGLRSGFVAGDADILKGFLLYRTYHGCAMPVQTQLASVAAWNDEVHVRANRALYREKFDAVLAILSPVMDVQRPDGSFYLWPNVQGDDAAFCRDLFAEEHVTVVPGSYLSRDVDGVNPGAGRVRMALVAPLAECVEAAERIRDFVLRHK

SEQ ID NO: 56760 - protein, 339 aa, Mycobacterium sp. JLS
MSEPVADFSPLRVKRVVRETSDAVSLVLDVPRHCSGRFRYQVGQFLTLRVNLDGQELRRCYSMSSAPVEEELRITVKRDPGGLVSNWLNDTVSEGAEIHAAPPEGRFLLRDTDSEIVAFAGGSGITPIMSLIRTALATSARSIRLFYANRNRGSVIFADDLARLVEHNADRLVLTHHYDDDSGVVTPAAIESFVAGAGDADFYICGPGPFMDTVEGALATRGAPRDRVHLERFQVAQVPAGADASEAQATEEIVIELDRKTTTVPYRSGNTLLQTARTAGLRAPSSCETGSCGTCMAQVVSGSARMLNNDALDDDEVADGWVLTCQSLPTSRSVHVVYE

SEQ ID NO: 56761 - protein, 260 aa, Pseudomonas fluorescens PfO-1
MTVTLKTPEDIAGMRVAGKLAADVLEMIAEHVKPGVTTDELNQICHDYIVDVQKAIPAPLNYKGYPKSICTSINHVVCHGIPNDKPLKNGDTLNIDVTVIKDGYHGDTSRMFHVGTVPVWAERLSQVTQECMYKAIEIVKPGCRLGDIGEIIQKHAEKNGFSVVREFCGHGIGKVFHEEPQILHYGRAGTGMELKAGMTFTIEPMINQGKADTKVLGDGWTAITKDRKLSAQWEHTLLVTDTGYEIFTLRSDDTIPRISA

SEQ ID NO: 56762 - protein, 515 aa, Daucus carota
MENGTKELNKPQPPSSAAMQLQTPVQKIPTATWKLVLVAAIAAGVQFGWALQLSLLTPYVQLLGIPHKWAAYIWLCGPISGMLVQPIVGYYSDHCQSSFGRRRPFIASGAGCVAISVILIGFAADIGYKAGDDMSKTLKPRAVTVFVIGFWILDVANNMLQGPCRALLADLCSGDTRRMRSANAFYSFFMAVGNILGYAAGSYNNLYKLFPFSKTHACDLYCANLKSCFIISIALLIIITVVALSVVREKQWSPDDADAADEPPSSGKIPVFGELLGALKDLPRPMLLLLIVTCLNWIAWFPFILFDTDWMGREIYGGTAGKGKLYDQGVRAGSLGLLLNSVVLGLTSIAVEYLVRGVGGVKILWGVVNFILAIGLVMTVVVSKVAQHQREHSANGQLLPPSAGVKAGALSLFSILGIPLSITYSIPFALASIYSSGSGAGQGLSLGVLNLAIVVPQMIVSVLAGPFDSLFGGGNLPAFVVGAISAAISGVLAIVLLPKPSKDAASKLSLSGTYH

SEQ ID NO: 56763 - protein, 283 aa, Vitis vinifera
MGSSQAAVSFLTNLARAAFGLGAAASVLNASLYTVDGGQRAVLFDRFRGVIDDTIGEGTHFLVPWLQKPYIFDIRTRPHTFSSVSGTKDLQMVNLTLRVLSRPEVSRLPYIFKTLGLEYDEKVLPSIGNEVLKAVVAQFNADQLLTDRPHVSALVRDSLIRRAKDFNIVLDDVAITHLSYGAEFSKAVEQKQVAQQEAERSKFVVAKAEQERRAAIIRAEGESESAKLISDATAAAGMGLIELRRIEASREIAATLAKTPNVAYLPGGNNMLLGLNPTIAGGR

SEQ ID NO: 56764 - protein, 194 aa, Picea sitchensis
MASAIMSSAAAMAAVAAPLKTSNGNGSSSSGNVVSAFTGLKSTAQFPSSMKTNNAGAEWEQKTTSNGGRVRCMQVWPPYNNPKFETLSYLPRLTQEQLLKEVEYLLKNKWVPCLEFDEDGIIKRKYGSTPGYYDGRYWVMWKLPMFGCTEASQVLNEVNECAKAYPKAFIRVIGFDNVRQVQCISFIVHKPEYN

SEQ ID NO: 56765 - protein, 337 aa, Vitis vinifera
MAKIKIGINGFGRIGRLVARVALQRDDVELVAVNDPFINTDYMTYMFKYDSVHGQWKHHDIKVKDSKTLLFGDKAVTVFGAKNPEEIPWGEAGAEYVVESTGVFTDKDKAALHLKGGAKKVIISAPSSNAPMFVMGVNEKEYKSNIDIVSNASCTTNCLAPLAKVIHDKFGIVEGLMTTVHSITATQKTVDGPSMKDWRGGRAASFNIIPSSTGAAKAVGKVLPALNGKLTGMAFRVPTADVSVVDLTVRTEKKASYDDIKAAIKAESEGNLKGILGYTEDEVVSSDFLGDSRSSIFDAKAGIALNENFIKLVSWYDNEWGYSSRVVDLIRHIDSTK

SEQ ID NO: 56766 - protein, 424 aa, Staphylococcus aureus subsp. aureus NCTC 8325
MEITMPKLGESVHEGTIEQWLVSVGDHIDEYEPLCEVITDKVTAEVPSTISGTITEILVEAGQTVAIDTIICKIETADEKTNETTEEIQAKVDEHTQKSTKKASATVEQTSTAKQNQPRNNGRFSPVVFKLASEHDIDLSQVVGSGFEGRVTKKDIMSVIENGGTTAQSDKQVQTKSTSVDTSSNQSSEDNSENSTIPVNGVRKAIAQNMVNSVTEIPHAWMMIEVDATNLVNTRNHYKNSFKNKEGYNLTFFAFFVKAVADALKAYPLLNSSWQGNEIVLHKDINISIAVADENKLYVPVIKHADEKSIKGIAREINTLATKARNKQLTAEDMQGGTFTVNNTGTFGSVSSMGIINHPQAAILQVESIVKKPVVINDMIAIRNMVNLCISIDHRILDGLQTGKFMNHIKQRIEQYTLENTNIY

SEQ ID NO: 56767 - protein, 507 aa, Triticum aestivum
  misc_feature (227)..(227): Xaa can be any naturally occurring amino acid
  misc_feature (343)..(343): Xaa can be any naturally occurring amino acid
  misc_feature (354)..(354): Xaa can be any naturally occurring amino acid
  misc_feature (371)..(371): Xaa can be any naturally occurring amino acid
  misc_feature (384)..(384): Xaa can be any naturally occurring amino acid
HSITSLYKKAGWYRSGIPGISPSASLSPSLSLLVCQVSLSGLPASAAARALGGSSRPRRRAAEWAGAGAREGALRRPCRDPGRDPAGDCWPGSAAAMNGPSAGAGSGGEGPLVYQAWKGNNVFFLQGRFIFGPDARSLFVTMFLIIAPVTVFCVFVAKELMNSFSYGLGLPVMVVAVVFTAYDLSLLFLTSGRDPGIIPRNAHPPEPEGFEGNAEVGANQTPPLRLXPRVKDVVVNGITVKTKYCDTCMLYRPPRCSHCSICNNCVERFDHHCPWVGQCIGLRNYRFFYMFVFSTTLLCLYVFGFSWVYIIKIRDAEQITIWKAMAKTPASIALVVYTFIAVXWFVGGLSVFHXLYLMSTNQTTYENFRYXRYDQRANPYNRGXVVENIKEIFFTPIPASRNNFGARVPQEQGLRPRSTNGFMSPNMGRAVGDIEMGRKPVAWDEPRMAAEIGDLGGLGNLLEDKDGRFRNASPDLSRDALVVGGLDEQGSSVMNPPRTSWGVEAGR

SEQ ID NO: 56768 - protein, 175 aa, Microcystis aeruginosa PCC 7806
MNLPNSITLSRLLGLPLILYWLHQGTEIDRWLSLIIFLIAASTDWLDGYLARKLDQITELGKFLDPLVDKLLVLAPLLALIEMDVIAAWGVFLILARELAIAGWRINPNLTGNSDIKGANWWGKSKTVSQIIAIALLIAPLPSEYNLIAQGAFWLSVTLTLISGVIYIIPSQKLT

SEQ ID NO: 56769 - protein, 174 aa, Microcystis aeruginosa PCC 7806
MKHTLSVLVEDEAGVLTRIAGLFARRGFNIESLAVGPAEQMGVSRITMVVPGDEDSIEQLTKQLYKLINVLKVQDITQTPCVERELMLIKVNATAERRAEVIELAQVFRARIVDISEETLTIEVVGDPGKMVAIMQMLNKFGVREVARTGKIALIRESGVNTEYLKALEAKMAI

SEQ ID NO: 56770 - protein, 473 aa, Bacillus cereus G9241
MAKEYDLVIVGGGTGGYVAAIRASQLGLKTALVEKENLGGTCLHKGCIPSKALLRSAEVYATAKKSEEFGVIASNVELNFAKVQERKEKIVTQLHKGVQHLMKQGKIDVFEGIGRILGPSIFSPMPGTISVELASGEENEMLIPKNVLVATGSRPNSLPGLELDGEYVMSSDHALKMETLPSSIIIVGGGVIGIEWASMLADFGVEVTVLEYAKTILPLEDQDVSKEMQRLFKKKGIKVVTGAKVLPETLVKDNGVTIQAEHNGENKEFKAEKMLVSVGRQANTQNIGLENTDIVVEKGYIQTNEFYQTKESHIYAIGDVIGGLQLAHVASHEGIVAVEHIAGKEVTPIDYSMVSKCVYSSPEVASVGLTEQEAKEKGYKLKVGKFSFRAIGKALVYGESDGFVKLVVDEETNDILGVHMIGPHVTDMISEAGLARVLDATPWEVAHTIHPHPSLSEAIGEAALAVDGKALHA

SEQ ID NO: 56771 - protein, 256 aa, Thiobacillus denitrificans ATCC 25259
MNAPSDPAPPVRAPHPPLTDYYADEDARRRFVGALFDRTASDYDRIDRLLALGSGPWYRGQALQRAGLAPGMRVVDVGVGTGLVAREAVKRVGDAALVVGVDPSLGMMAAADLPGVRLVEGRAESIPFPDASFDFLSMGYALRHIGDLSAAFAEFHRVLRPGGRLCLLEITKPERAWSRALLKAYMRGAVPVLARLVGGSAESARLWRYYWDTIEACVPPAGVIATLEDAGFLAVRRHVETRALSILAEYQAVKPG

SEQ ID NO: 56772 - protein, 460 aa, Pseudoalteromonas tunicata D2
MSQSAFSSLKLQPALLENLTSLEYTSMTPIQAQSLPHILSGKDVIAQAKTGSGKTAAFALGLLENLDVRKYRVQALVLCPTRELADQVAQEIRKLARGIPNVKVLALCGGVPMGPQIGSLEHGAHIIVGTPGRIEDHLSRRTLDLSHVNTLVLDEADRMLDMGFSAALDAIIDQTPRDRQTLFFSATFPEKIQQIASRTMRDPVKVEVESSHNNVNIRQYFYKVEQNKQRTTALRLLLLKHEPNSCVVFCNTRVETQAVADELAVSGFSVLALHGELEQRERDQTLVRFANKSISILVATDVAARGLDINELDMVINYHITQDPEVHVHRIGRTGRAGSKGTAHSLFTDNESYRVAAVSEYFDKQFELSALPPFTLLDKVPEKPLMVTLQIDGGKKQKVRPGDILGALTSKDGIAGKQVGKITVLENFAYVAVARDAAKPALRKLGEDKIKGRLFRARRI

SEQ ID NO: 56773 - protein, 356 aa, Streptomyces sp. NRRL 5331
MTSKGTHQWRGIIEEYRDRLPVTATTPSVTLREGGTPLVPAQVLSERTGCEVHLKVEGANPTGSFKDRGMTMAITRAKEEGAKAVICASTGNTSASAAAYAVRAGMVCAVLVPQGKIALGKMGQALVHGAKILQVDGNFDDCLTLARSLSDNYPVALVNSVNPVRIEGQKTAAFEIVDALGDAPDIHVLPVGNAGNITAYWKGYGEYAGDGVSTHTPRMWGFQASGSAPLVRGEVVKDPSTIATAIRIGNPASWDFALAARDESGGFIDEVTDRQILSAYRLLASQEGVFVEPASAASVAGLLKAAEQGKVDPGQRIVCTVTGDGLKDPDWAVAGAPQPVTVPVDAATAAQKLGLV

SEQ ID NO: 56774 - protein, 638 aa, Haemophilus ducreyi 35000HP
MIFFTDLILKRGLNVLLDKTSAIIHKGQKVGFVGKNGCGKSSLFALIKGELQAEAGEVALPKNCSMAWVNQETPALDISALDYVIQGNREYTTLMTQLEQANLANDGNQIAHIHNHLDMIDAWTIQARAAALLNGLGFANEQLTLAVKSFSGGWRMRLNLAQALLCRSDLLLLDEPTNHLDLDAVIWLEKWLTNYRGTLLLISHDRDFLDPIIDHVIHLENQRLQEYTGNYTSFEIQRATKISQQNAAYQQHQRKVAHLQSFIDRFKAKATKAKQAQSRIKALEKMELIAPAYADSPFEFEFKPPLSLPSPLMMMEKVSAGYEKQVILESVKLNLVPGSRIGLLGRNGAGKSTLIKLLAGKIDPLAGNIQLAKGVQLGYFAQHQVDTLRFDESPLWHLQKLAPQQTEQALRNYLGGFDFKGDKVNQLVMTFSGGEKARLVLALIVWQRPNLLLLDEPTNHLDLDMRQALTDALTYYEGSLVVVSHDRHLLRTTVNEFYLVHNHKVVEFKGDLDDYQKWLIEQNQLATVSNQVNSTTLNKTEQDNSAQSHKAQKRLAAELRQQTAPLRKKISQLEKAIEKATEKLTALETLLASNTLYEAGNKAQLAETLAQQVETKRSLEENELMWLEAQETLEKMLK

SEQ ID NO: 56775 - protein, 754 aa, Caulobacter crescentus CB15
MAASGIAVRGPRSLLRQIREAMAGAGPAQGKLDVVVRTIAISMVAEVCSIYLRRASGDLELFATEGLAREAVHVTRLKPGEGLVGETMRLGRPLNLSDAASHPSFSYRPETGEDPYHAFLAVPLLRGGRAIGVLVVQNRTERNYDEEEVEDLQIIAMVLAEMVSSSELLGADELKDVELAPHKPERLKGSRFAEGLAYGVAVLHEQPVAPETLLSDDALAEEARLTYAIEALQTQIDQMLEGQHGLVGASYEVLETYRLFAHDRGWNRSLQEAVRSGLTAEAAVERVRSEHRARLGQARDPYLRERLHDLEDLNDRLLRHLSGDVHHVRQLPEDAILIARNLGPADLLEYDRTKLKGILLEEGSAASHAGIVARALDIPCVGRLVGLRDRVNEGDPVVVDAETQEAWLRPRPDVVKALKARMEVRAQRKAEFARLRDTPPITKDGSKVTLLMNAGLAVDLDILGETGAEGIGLFRTEFQFMVAEELPRLEAQTALYEKVLDAANGMPVTFRTLDLGGDKLLPYMELEREDNPALGWRAVRMGLDRPALLRMQIRALIKAANGRPLRIMFPLVANVDEFRAARSFVDQEVAWALKRGRPAPARLDVGAMIEAPSLLWHLDALLPMTDFVSVGTNDLMQYMFAADRGNPRVSDRYDPLSPAALRALKTIQQACADTGTQVSVCGEMAGRPLEAFALVALGFDRLSMPPAGIGPVKQMVLSLDREAARRNVEALLKGSGGSLRGEIETLARKLYVAV

SEQ ID NO: 56776 - protein, 499 aa, Yarrowia lipolytica CLIB122
MEFEELELIGRGSFGQIRKVRRINDGQILARKEISYRRMTPKEKEQLIAEFRILKGLHHTNIVGYLHHEHLPDKHLVHLYMDYCGGGDLAGLIQQCKETDERVPERIVWSIFTQLLLALYRCHFGQDAPPLTDLFTNQGEEDEVYPSNVILHRDIKPDNIFLDGDHCVKLGDFGLAKMLDQSHMMANTFVGTPYYMSPEVLLNDVSSPASDIWSLGCVIYELCQLHPPFQAKNHVQLTQRVQDGMYPELPPRYSSTLKRTIQACLDINPHNRPSTATLLRLDIIKLVRKDRMLSEQHQHLLEYQENLKREVEIFEERREEVLQISQNLEQYRETVEQEYFNNIQSELESVVEQEVERRVRQALADLPAPTPPPPISPTAHRSSPRDISMSFSPSQLTPIKHVKGPRGLAISTPLKRTPLKPLEELPLTNASNPSLTSSGSSHDSDKSASKQRAAPHFHAVYAGFKTPAAVKRPAKRTYIDQWDEAPSPFLRRQAAASYD

SEQ ID NO: 56777 - protein, 417 aa, Zea mays
MTDGDDEYKREESVALLVIVFLAALSLLSVIAAFAYYCYITRKVSRRLQAFHIPKRSSSHHTLPPRALPPQQQGTDNPSSNSTRDGVGAAAMSVVAAGERGVQVFSYRQLHAATGGFDRAHMVGQGSFGTVYRGVLPDGRKVAVKLMDRPGKQGEDEFEMEVELLSRLRSPYLLGLIGHCSEGEHCLLVYEFMANGGLQEHLYPNRGSCGGISKLDWDTRMRIALEAAKGLEYLHEHVNPPVIHRDFKSSNILLDKDFHARISDFGLAKLGSDRAGGHVSTRVLGTQGYVAPEYALAGHLTTKSDVYSYGVVLLELLTGRVPVDMKRSPGEGVLVNWALPMLTDRDKVVRILDPASEGQYSLKDAVQVAAIAAMCVQPEADYRPLMADVVQSLVPLVKNRYNQKSCNPNVQPSKPLD

SEQ ID NO: 56778 - protein, 285 aa, Zea mays
MSTSEVWSLSDFEISKYIGEGRFGKVYLAREKQSGYVVALKVIFKAKLQKYHFHAHLRREIEIQQSLDHPNVLRLFTWFHDEERVVLVLEYAARGELYKVLRAAGRFTERTSATYVASLAGALAYCHKKQVIHRDIKPENLLIDIEGRLKIADFGWAARSNAKRHTLCGTIDYLAPEMVEKKAHDHAVDNWTLGILCYEFLYGSPPFEADEQDDTLRRIVRVDLAFPSPPCVSSEAKDLISKLLVKDSSKRLCLEDIMKHPWIKKNADPSGSCIKQKDVTRSKLL

SEQ ID NO: 56779 - protein, 532 aa, Oryza sativa
NLAFPPVKRPHEDDLGAGDVLTFRFHSLAVLKLFDRIREYRLHDYRYQATRGWYSSGTAPEDALLPCAVARPPRMYGCVIGVQRGRTVEVVDTSDILLDTDPGTLDRDLLKKKLETYKKAFPGLAILGWYSIDTHVTNTDMETNQALMDASGTTFYLLFNPAMNLSLKDLPVTIYEKVHSTNRSPTPLIFVQGKYKTETVEAERISLDHTCPVVSDVSVPPLVGKGQHANIMQTSGFKLMLFEIPSGFAMFEVSQELIARPKDIWARFAYQDDITNVIVTLGSIQIHNKSVARDIIVGPGDELKEFILSFCTHNYLIVQDVELKDVIEKKLNIYCYCNPTVVGELTWGLNYVLHKLLPQEQSLTHEPYLPLSKAMSKQIKEYGFKISPREIDREFLRAMSFLNYLGYMSERYSLLLDHLFGQYRKNNMSDIEFAKSIASHLHSSEGIVPRDERYTRAEIMEFIDFIIAAPENRSRTLSFLRRIEAASIDDSPPPPSLPGGMGVSLLKRLRLDWITVCCLGCAVALYPFYRRV

SEQ ID NO: 56780 - protein, 478 aa, Pyrobaculum aerophilum str. IM2
MIIVKNYINGEFIEVEERRPKHSPIDGSVIAETPVSKREDAKAAIDAAYDALKAWSQLPAIKRAEYLYKLYEIIKSREEELINILMVEGGGIYKKAWGEVVFTERLVRNAAELARHYGGKTLQSDAEGVVSMVFKRPKGVVGVITPWNYPLSISMKKIAHALATGNTIVYKPASETPVTGFKIAEMIHQAGFPKGVFNLVVGPGSTVGDEIVVNKKVSHVTFTGESATGREIASKAGGALKTVTLELGGSDPLIILDDADLNLAVRIAVFGAFFHQGQICTSSKRIIVHERVYDVFVKKFVERVSQLKVGDPRDRTVEQGPLISPRQADEMERFYQDAVSRGGRALTGGKRAGAYFWPTVFVDVDRNFRIMREEVFGPIRPVVPVKNDDEAVEVANDTEYGLSAAVVTTNINRAFKIAEAIESGMVHINDVTMLEESHVPFGGIKASGFGREGGEWSFHETTYDRWLTITLRERKYPI

SEQ ID NO: 56781 - protein, 329 aa, Candida glabrata CBS 138
MSLHHDNVTIAPLVLLSVLDHYERTNTPEGKRCVGVILGDSQTNTIRVTNSFALPFEEDEKNSDVWFLDHNYIESMNEMCKKINAKEKLIGWYHSGPKLRASDLKINELFKKYTQGNPLLLIVDVKQQDVGLPTDAYMAVEQVKDDGTSTEKTFLHLPCTVEAEEAEEIGVEHLLRDVRDQAAGGLSIRLTNQLKSLKGLQKKLNDIVIYLNKVINNELPVNHTILGKLQDVFNLLPNLGYNEETDVSATSNDMVTASNNLQRALTVKTNDELMVIYITNLVRAIIAFDDLIENKMQNKKLQEERNKELQADINKVESETAETEKVATD

SEQ ID NO: 56782 - protein, 327 aa, Brassica napus
  misc_feature (316)..(316): Xaa can be any naturally occurring amino acid
MMASLSSSVTSRPYRSGYLGSFSPVNGSNRHRSLSFLSAFPRGLSSHELCIRFQRNSTRTSVFMQDGAIVTNSNSTETTTSLKGLKEEVLSVIAQEAAKVGEGSNGQNQSTVSITVVGASGDLAKKKIFPALFALYYEDCLPEHFTIFGYSRSKMTDGELRNMVSNTLTCRIDKRANCGEKMEEFLKRCFYHSGQYDSQEHFTELDKKLKGHEAGRISNRLFYLSIPPNIFVDAVKCASSSASSVNGWTRVIVEKPFGRDSETSAALTNSLKQYLEEDQIFRIDHYLGKELVENLSVLRFSNLIFEPLWSRQYIRXNVQFIFSEDFG

SEQ ID NO: 56783 - protein, 136 aa, Senecio vulgaris
LDAAGKTTILYKLKLGEIMTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCA

SEQ ID NO: 56784 - protein, 368 aa, Blastopirellula marina DSM 3645
MTHPWIADRTAAFDSSGIRKVFDLAAKMTDPINLSIGQPDFDVPDAVKDTAIAAIRDGKNGYALTQGMPVLRDKLQASIDAELGHRDRTNFVCSGTSGGLVLSMLALVNPGDEVIIFDPYFVMYESLVKLVGGVPVIINTYPDFRIDLPKVEAAITPRTKLILLNSPANPTGVVATEAEVAGLAKLAGEKNIALISDEIYRMFTYGDFVSPAKYNDQTIVIDGFSKSYGMTGWRVGYVHGPSAVIETMVKLQQYTFVCAPQPAQWASAAALDVDMSQHVATYARKRDLMLEGIGDLYEVSQPDGAFYIFPKAPWGTGTEFVAKAIENNLLIIPGNIFSKQDTHFRISYAAPDETLKRGVDTLRKLAQG

SEQ ID NO: 56785 - protein, 318 aa, Vitis vinifera
MENGDSNQIPENANEHCPGPQSESAGQSDACQGCPNQEACATAPKGPDPDLVAIAERMATVKRKILVLSGKGGVGKSTFSAQLSFALAAMDFQVGLLDIDICGPSIPKMLGLEGQDIHQSNLGWSPVYVESNLGVMSIGFMLPNPDEAVIWRGPRKNGIIKQFLKDVYWGELDFLVVDAPPGTSDEHISIVQFLQGTGIDGAIIVTTPQQVSLIDVRKEVSFCKKVGVEVLGVVENMSGLCQPVTDFSEVFDSSSGGAAKMCKEMNVPFLGKVPLDPQLCKAAEEGRSCFADTKCGVSAPALQRIIEKLVANQALSTT

SEQ ID NO: 56786 - protein, 516 aa, Vitis vinifera
MGSSTWSVEKRSGLRSDTFLKDIDNVPETGCLSIIVLGASGDLAKKKTFPALFNLYRQGFLHSNEVHIFGYARTKISDDELRNRIRGYLINKDATSEHSEEVSKFLQLIKYVSGSYDAEDGFRLLDKEIAEHEFSKNSQEGSSRRLFYLALPPSVYPSVCRMIKLCCMNKSNLGGWTRIVVEKPFGKDLDSAEQLSAQIGELFDEPQIYRIDHYLGKELVQNLLVLRFANRMFLPLWNRDNIDNVQIVFREDFGTEGRGGYFDEYGIIRDIIQNHLLQVLCLVAMEKPVSLKPEHIRDEKVKVLQSVLPITDDEVVLGQYEGYTDDPTVPDLSNTPTFASMILRIHNERWEGVPFILKAGKALNSRKAEIRIQFKDVPGDIYRCQRQGRNEFVIRLQPLEAIYMKLTVKQPGLEMSTVQSELDLSYGQRYQGFTIPEAYERLILDTIRGDQQHFVRRDELKAAWEIFTPLLHRIDNGEMKPIPYKPGSRGPSEADELLSKSGYVQTHGYIWIPPTL

SEQ ID NO: 56787 - protein, 471 aa, Alteromonadales bacterium TW-7
MSENVYQFIDVQRVDPRKKPISSRKKSFVEIYEPFSENQVNSQADRCLDCGNPYCEWKCPVHNYIPQWLKLIRTGRILEAAELSHRTNSLPEVCGRVCPQDRLCEGSCTLDEEFGAVTIGNIEKYITDTAFKMGWKPDMSYVTWTDKKVAIIGAGPAGLGCADILVRNGVKPVVFDRHPEIGGLLTFGIPSFKLEKEVMQKRREIFTEMGVEFKLNVEVGVDITMDDILADYDAVFLGVGTYQSMRAGLENEDAPGVHDALPFLIGNTNRVMGYDEANQAYIDMANQKVVVLGGGDTAMDCVRTSIRQGAAKVTCAYRRDEENMPGSKREVKNAKEEGVIFTYNVQPKGIVLDANGHVAGVKMVKTKLGEPDANGRSRAEEVAGSEHVIEATQVIMAFGFKPHKMDWLEKYDVEINHWGGINAPEQGEFTHQTTNPKIFAGGDIVRGSDLVVTAIFEGRNAAEGIMDYLKV

SEQ ID NO: 56788 - protein, 297 aa, Physcomitrella patens subsp. patens
MGSDADVKYVRQESQGAGGDSIAEKRWSLTDFDIGKPLGRGKFGNVYLAREKQSKYVVALKVLFKNQLQQSQVEHQLRREIEIQSHLRHPNILRLYGYFYDQARVYLILEYAAKGELYKELQRCKVFSEKRAATYIASLARALMYCHEKHVIHRDIKPENLLIGLKGELKIADFGWSVHTCNRRRTLCGTLDYLPPEMVEGKEHDAGVDVWSLGILCFEFLYGTPPFEAKKHSDTYKRIVRVDLRFPSKPVISSSARDLICQLLVKDSAQRLPLSKVLTHPWIVNNADPSGVYNGHN

SEQ ID NO: 56789 - protein, 360 aa, Azoarcus sp. EbN1
TGRANERFTSSELIRAHARFKGKDGDHFRLEVGAREVLAREVVLDTGTRSAVPPIENLHEQDFINSENWLDRPQLPDRLVVVGGGYIGLEMGQFYRRLGSEVTIVQHGAQIAGHEDRDVADALQQLLEDERIGFRIGAKATRVRKLAAGLALTLDTDAGCEELEASDLFVAVGRQPNTDEQGLETIGLAPDDEGIIDVDSRLRTEVAGVWAVGDIRGGAMFTHTSWDDYRIVASQVLGDGSRTLDRVVPYAIFTEPQLGRVGMTEDEARRAGRNIRVGRFDMAGNGKARELGETRGFIKVVVDADSCKLLGTAVLAEDAAELVQLYVILMNVDAPYTVIENAVLIHPTLAEAAQSVFLTL

SEQ ID NO: 56790 - protein, 481 aa, Thiobacillus denitrificans ATCC 25259
MGDVFQFLKQSRRDGAKTPADVRKHEFREIYALMDPAHAQEQADRCLGCGNPYCEWKCPVHNYIPNWLKLVNEGRLFEAAELSHQTNSLPEVCGRVCPQDRLCEGACTLNTDGFGEAVGGGPNTGGFGAVTIGQIERYISEEAFKAGWRPDLSNVVPSGRRVAVIGAGPAGLACADVLARNGVQAVVYDRYDAIGGLLTFGIPEFKMEKTVMTRRREVFEGMGIEFRLNTEVGRDVSMQTLLDEYDAVFMGMGTYTYMKGGFPGEDLPGVLEALPFLISNVRQCLELAGPDEAFHDMKGKRVVVLGGGDTAMDCNRTSIRQGAASVVCAYRRDEKNMPGSKREVANAKEEGVQFLWNRQPVEIVGNGRVEGVKLVTTELGPPDARGRRTPVVIPGSEEIIAADHVIVAFGFRPNPQPWFAEHAIATDPAGRVIASGQAHPYQTANPKVFAGGDMVRGSDLVVTAVWEGREAAKGILAYLEI

SEQ ID NO: 56791 - protein, 409 aa, Prochlorococcus marinus str. MIT 9313
MRLRIWDSGKGIASGTLSPMGLHETVDVDLSPDELERFSRHLTLPEVGMNGQKRLKAASVLCVGSGGLGSPLLLYLAAAGVGHIGIVDFDVVELSNLQRQVIHGTSWVGQAKTHSARARILEINPHCQVDVYEKALRRDNAFEIIQPYDIVCDCTDNFPSRYLVNDACVLLGKPSIYGSIHRFEGQATVFNLDAESPNYRDLVPEPPPAGLVPSCIEGGVMGILPGLIGLIQSAEVIKIITGIGTTLSGRLLVVDALAMTFREMALRPSQPRVVIDQLIDYQDFCGSGADKPAHEKVAGLESISVKDLKSLLDLGAEDFALVDVRNPNEAEIACIAGSELIPLNKIESGEAIEKVRQLASGRRLYVYCKLGGRSAKALTTLKRHGIEGVNVTGGIDAWAKEVDRSLPRY

SEQ ID NO: 56792 - protein, 275 aa, Nostoc punctiforme PCC 73102
MNIFSNLLSQATQPTPAKKQRRGIEIKSPREIEIMRKSSAIVATVLKEISELVKPGMTTADLDAHAEKRIREMGATPSFKGYHGFPGSICSSINNEAVHGIPSPKKVIRVGDVLKVDTGAYYQGFHGDSCISIAVGEVTEEAAKLIRVAEEALFKGIEQVKAGVYLLDLAGAIEDHVKANGFSIVEEFTGHGVGRNLHEEPSVFNYRTREMPNVKLRAGMTLAIEPILNAGSRHTRTLSDRWTAVTVDNSLSAQFEHTVLVTDTGYEILTDRSKV

SEQ ID NO: 56793 - protein, 275 aa, Saccharomyces cerevisiae
NPKSSLADGAHIGNYQIVKTLGEGSFAKVKLAYHTTTGQKVALKIINKKVLAKSDMQGRIEREISYLRLLRHPHIIKLYDVIKSKDEIIMVIEYAGNELFDYIVQRDKMSEQEARRFFQQIISAVEYCHRHKIVHRDLKPENLLLDEHLNVKIADFGLSNIMTDGNFLKTSCGSPNYAAPEVISGKLYAGPEVDVWSCGVILYVMLCRRLPFDDESIPVLFKNISNGVYTLPKFLSPGAAGLIKRMLIVNPLNRISIHEIMQDDWFKVDLPEYLL

SEQ ID NO: 56794 - protein, 75 aa, Glycine max
  misc_feature (34)..(34): Xaa can be any naturally occurring amino acid
  misc_feature (47)..(47): Xaa can be any naturally occurring amino acid
  misc_feature (60)..(60): Xaa can be any naturally occurring amino acid
SISWPGDTTVNRAGAGMDAPFTGLKSMAGLPTRXTYNDITSIGCNCXRVQCMQVWPPIGXKKYETLSYLPDLDDA

SEQ ID NO: 56795 - protein, 208 aa, Prochlorococcus marinus str. NATL1A
MTDSNNQSPNKKTSGSSGAPTAADGRQENRRSRGEKRGGRRDRRGQERDSEWQERVVQIRRVSKTVKGGKKMSFRAIVVVGNEKGQVGVGVGKAGDVIGAVRKGVADGKKHLVRVPLTRNSSIPTLSNGRDGAASVLIRPAAPGTGVIAGGSIRTVLELAGIKNVLAKRLGSKTPLNNARAAMVALSELRTHKATAKERGISLEQIYS

SEQ ID NO: 56796 - protein, 297 aa, Prochlorococcus marinus str. MIT 9313
MNERLRQGLVAAEGPLSGEVIKDVECVAGGCIHQAWCLQLKGGRQLFAKTGGADALPMLKVEVEGLKALKAWVDPGVLEVPEPLAFDQVCGEAVLLLPWLDFRAGNQASLGRGLALLHRASAAENPGRFGWPVDGFIGAGSQPGGWREQWGDAFVTLRLRPQLREAARWGLDLVDVEPILAALIPWLDRHQPSPSLVHGDLWSGNANVLSDGRGVLLDPATWWADREVDLAMTQLFGGFSQDFYIGYENVWPLPADASQRVEVYNLYHLINHANLFGGSYRNQSQAILNRLASWLLT

SEQ ID NO: 56797 - protein, 331 aa, Acidobacteria bacterium Ellin345
MKVLVTGGAGYIGSVVAAALVERGHSVVVYDNLSNGHRAAVPSAAQVVAGDIGDRAMLDATLRNGAFDGVMHFAAFIEAGESMRFPERFFRNNTANTLTLLELMLEHRVSRFVFSSTAALYGNPERTPIEESDPLKPTNAYGESKLLVERMLEWFHSIHGLCYASLRYFNAAGATATLAEDHHPESHLIPIVLEAAAGKRDSIAIHGTDYPTPDGTCVRDYIHVSDLADAHLLALERLGRDEQPERLIYNLGNGHGSSVLEVIEAAKRVTGNPIQVKEGPRRAGDPEILVASSQKIRKELGWSPKYTDIDTIIESAWRWRNSHPKGYGDEQ

SEQ ID NO: 56798 - protein, 230 aa, Coccidioides immitis RS
MSSGQTDAMSQPPSTFRTKQKPERLPITVEKPTPYTFDLGRLMALDPNPLNLPANSLSNPPVLNSTLKSTARDGAQCLLNQLLTACPITSSATDGVLLTLPTPVTPLPRFKPLPTPKPPTKWELFARKKGIGKYNNKLGANEAERRKKLVYDEEKGEWMPRWGYKGKNKAEDDQWLVEVDDKKWKKEEDMNIRGESIRNEGRKERMERIRRNERKMRANMRRTGNAKSKA

SEQ ID NO: 56799 - protein, 403 aa, Zea mays
MAAALYGNGSSTSGGGGARGRGKPITCKAAVAWGPGVPLSLEEVEVAPPGPMEVRVKVLFTSICHTDLSAWKGECEAQRKYPRILGHEAAGVVESVGEGVEGLAPGDHVVPIFTGECEKCVYCKSDKTNLCGTYRVDPLKSSMVYDDGTRFSVVDQPSGQRRPVYHFLNTSTFTEYTVLDAACAVKINPEAPLQRMCLLSCGISTGVGAAWNTANVSARSTVAVFGLGAVGLAVAEGARLRGATRIIGVDVNPSKFTKGKEMGITDFIDPNDICDKPVHEVIREMTDGGVDYSFECTGINDVLREAFLSTHDGWGLTVVLGIHSTPKMVPLHPMELYSRRITGCVFGDFKGKSQLPDLVDKCVNGEVNINFDGFITHKMPFSYINKAFRLLEEGKSLRCLLSL

SEQ ID NO: 56800 - protein, 369 aa, unidentified eubacterium SCB49
MKYQVRKNALILLADGTIFYGKAVGDKTGSAFGEVCFNTGMTGYQEIFTDPSYYGQLMVTTNAHIGNYGVNNEEVESESVKIAGLICRNFSYNASRVDSDGTLEDFLSANNLLAISDVDTRALVNYIRDNGAMNAVITTEVDDIEALKIQLSETPDMKGLELASKVSTKEPYFYGDENATYKISALDIGIKKNILRNLAKRDCYIKVFPYNSSFSDIESFNPDGYFLSNGPGDPEPLKEAIATTKEILNTGKPLFGICLGHQVLALANGISTYKMHHGHRGINHPIMNLITGKGEITSQNHGFAINKEEAEAHEDVTITHIHLNDQTAAGIKMNSKPVFSVQYHPEASPGPHDASYLFDDFITNIKNSK

SEQ ID NO: 56801 - protein, 428 aa, unidentified eubacterium SCB49
MSIIIDIRARQIFDSRGNPTVEVDVITDNGILGRAAVPSGASTGEHEAVELRDGGDAYMGKGVLNAVENVNGKIAGTLLGVSVFDQEEIDQIMLDLDGTKNKAKLGANAILGVSLAVAKAAANELGLPLYRYVGGVSAKTLPVPMMNIINGGSHSDAPIAFQEFMIMPVKAATFTEAMQMGSEIFHHLKKVLHDRDLSTAVGDEGGFAPTLDGTEDALDTIKKAVENAGYTFGDQIMIALDCAAAEFYVDGKYDYSKFEGTSGKIRTSKEQADYLAQLCADYPIISVEDGMDENDWEGWKYLTEIVGDKVQLVGDDLFVTNVERLSRGISENIANSILIKVNQIGTLSETIAAVNMAHNAGFTSVMSHRSGETEDNTIADLAVALNCGQIKTGSASRSDRMAKYNQLLRIEEQLGDVSYFPGKNAFKI

SEQ ID NO: 56802 - protein, 480 aa, Aspergillus niger
MPSLGGLLKKRRTKDSQTLSKELEAGSAQTQTSPNAAEDHHNHNHHQHHHHLFHHHHQPQPATNSGSAANTPPQPQDSVPQQSNRSSGAEKSSDGQVASMQSAVTQASPSAHHTSGLPQPNANAASIQNIINPSQQGAMHSASSGHTQSHHAGRSDARTTKGKYSLDDFSLQRTLGTGSFGRVHLVQSKHNHRFYAVKVLKKAQVVKMKQIEHTNDERRMLNRVRHPFLITLWGTWQDSRNLYMVMDFVEGGELFSLLRKSQRFPNPVAKFYAAEVTLALEYLHTQNIIYRDLKPENLLLDRHGHLKITDFGFAKEVPDITWTLCGTPDYLAPEVVSSKGYNKSVDWWSLGILIFEMLCGFTPFWDSGSPVKIYENILRGRVKYPPYLHPDAVDLLSQLITADLTKRLGNLHGGSDDVKNHPWFAEVTWDRLARKDIDAPYVPPIRGGQGDASQYDRYPEETEQYGMAGEDPHGHLFPDF

SEQ ID NO: 56803 - protein, 492 aa, Aspergillus nidulans FGSC A4
MTRPQIRRVAVIGAGISGVVSAAHLIQAGLDVTVYERSHAAGGVWLYDERVAPEPSYTSLKPLESERYFDKNEHNIALTHAPPGPCYDGLKNNVPTPLMRVKLNAWPEGTPDFVSHSVMKEYIQDTSRKTGVDDITIYGARVKNLIKQGDSWQVTWSRLEQYDDELKEQERKTTFDAVVVASGHYHTPRIPETPGLAEAKARWPDRIYHSKRYRKPEGYEKKNVLLIGGAVSAIDIAREIGPQADTIYQSTRNGEFDISASILPENGVRVSEVTRYEILDESQVVDGKLPLKVHLKSGQGLCGLDQVIICTGYQFTLPFLADYHNDRLSPAEADETILVTDGTQAHNLHKDIFYIPDPTLAFVGVPFYTATFTLFEFQAITAANVFSGIADLPSKQEMRAEYNEKLKRKGHGKRFHSLKDVEDDYVNNLLEWINTPRVRIGLTPIEGHTERWHEAKEAQRERLKAFFETPTATNDRRDSGIEGLPVLPACSA

SEQ ID NO: 56804 - protein, 176 aa, Escherichia coli
EGFWDTLSARLDFCHLDVNDTAAFSRLGAMLDQKNRITINYFAMPPSTFGAICKGLGEAKLNAKPARVVMEKPLGTSLATSQEINDQVGEYFEECQVYRIDHYLGKETVLNLLALRFANSLFVNNWDNRTIDHVEITVAEEVGIEGRWGYFDKAGQMRDMIQNHLLQILCMIAMSP

SEQ ID NO: 56805 - protein, 482 aa, Clostridium acetobutylicum ATCC 824
MFENISSNGVYKNLFDGKWVESKTNKTIETHSPYDGSLIGKVQALSKEEVDEIFKSSRTAQKKWGETPINERARIMRKAADILDDNAEYIAKILSNEIAKDLKSSLSEVKRTADFIRFTANEGTHMEGEAINSDNFPGSKKDKLSLVERVPLGIVLAISPFNYPVNLSGSKVAPALIAGNSVVLKPSTTGAISALHLAEIFNAAGLPAGVLNTVTGKGSEIGDYLITHEEVNFINFTGSSAVGKHISKIAGMIPMVLELGGKDAAIVLEDANLETTAKSIVSGAYGYSGQRCTAVKRVLVMDKVADELVELVTKKVKELKVGNPFDDVTITPLIDNKAADYVQTLIDDAIEKGATLIVGNKRKENLMYPTLFDNVTADMRIAWEEPFGPVLPIIRVKSMDEAIELANRSEYGLQSAVFTENMHDAFYIANKLDVGTVQVNNKPERGPDHFPFLGTKSSGMGTQGIRYSIEAMTRHKSIVLNL

SEQ ID NO: 56806 - protein, 226 aa, Arabidopsis thaliana
MDDWEDEKIAPLPAKVELKSNWDDEDVDENEIKDSWEDDDDEPAQPPVINPAPEKAPKKAAPKTVEKKGKAVEVPKEAPKEKPLDPIAEKLRQQRLVEEADYRATAELFGVKDDDKNLDMFIPKSESDFLEYAEMISHRIKPYEKSYHYIALLKTIMRLSLTNMKAADVKDVASSITTIANEKLKAEKEAAAGKKKGGKKKQLIVDKANDDLVAGPYDAMDDFDFM

SEQ ID NO: 56807 - protein, 578 aa, Coprinopsis cinerea okayama7#130
MDAQFPSTLIPNDDQTGVKKKIAIIGAGPAGLAALKAVLESPQYKAGLWETIVFESRSSLGGVWLPDAPDAHKPDVPPATPLYDMLTTNLPHPLMCYSDFLFPPETPLFPKAAAVLQYLEAYADRFNLRPHILFNTTVTSVEPNPSDPSGEFKWKIQTSILSMDVDLVIVGNGHYSVPRYPTTPGLSTWLSESSKAQHAVFYRHPLPKHGDKVLVVGAGPSGRDISTELLSTGRTVIHSMTGTPSEDKLGGKLKLRGRVKEYGDPQTGTLTFEDGSEETGVDFCILATGYEYSFPFLDSSVLHYPTSSDGASTPYPPPPPPLPTRLYNTSFNVFPLAQHLLPLIPYHPSNGDNGSPTSYPPTSLAFLGLLTRVSPLPLVEIQSKAVLAAFAHPENIDLTKEAVEVMNRYYELLPTGTTNQNPDEALKVVMKNWHKFEPQDQYDYRDKLASFVDSVSSPAPPSATSSPTLPTTTSTPTPKVPSYERYFYSLKDILRSTWVKLEKSGEAEEWVRGVGQGGLETSDSDERLKKAKEEWVELMHRVVRRGEEDMEREYRERQRGGNEKVETIDDVDVGGAKL

SEQ ID NO: 56808 - protein, 429 aa, Pseudomonas fluorescens PfO-1
MAKIVDIKGREVLDSRGNPTVEADVLLDNGIIGSACAPSGASTGSREALELRDGDKSRYLGKGVLKAVANINGPIRDLLLGTDPSDQKALDQAMIKLDGTENKATLGANAILAVSLAAAKAAAQDQDLPLYAHIANLNGTPGVYSMPVPMMNIINGGEHADNNVDIQEFMVQPVGAKSFSEGLRMGTEIFHHLKAVLKARGLSTAVGDEGGFAPNLASNEDALKVISEAVANAGYKLGTDVTLALDCAASEFFEDGKYNLSGEGQVFTAEGFADYLKGLTERYPIISIEDGLDESDWAGWKILTDKIGEKTQLVGDDLFVTNTKILKEGIDKKIANSILIKFNQIGTLTETLEAIQMAKAAGYTAVISHRSGETEDSTIADLAVGTSAGQIKTGSLCRSDRVSKYNQLLRIEEQLNGKAKYNGRSEFRG

SEQ ID NO: 56809 - protein, 429 aa, Bacteroides fragilis YCH46 [sequence omitted]

SEQ ID NO: 56810 - protein, 118 aa, Glycine max
MRWPAPPANAGLGIAAMSYITVDYLRHLSPAWHSRLQPALWSLLALTAVFRVPPYRHWSAEFRSAIPFIASMLFMLAALLCEMISVRSVTAVLGLDWHLNTPPLPDTGQWLLLALNEK

SEQ ID NO: 56811 - protein, 488 aa, Treponema pallidum subsp. pallidum str. Nichols
MGADIGFIGLAVMGENLVLNIERNGFSVAVFNRTTTVVDRFLAGRAHGKRITGAHSIAELVSLLARPRKIMLMVKAGSAVDAVIDQILPLLEKGDLVIDGGNSHYQDTIRRMHALEAAGIHFIGTGVSGGEEGALRGPSLMPGGSAQAWPLVSPIFCAIAAKADDGTPCCDWVGSDGAGHYVKMIHNGIEYGDMQIIAEGYWFMKHALGMSYEHMHHTFTRWNTGRLHSYLIEITAAILAHQDTDGTPLLEKILDAAGQKGTGRWTCVAALEEGSPLTLITESVMARSLSAQKQARCKAHRVFGSPVKVSKAETLSAQQREELVSALEDALYCAKIVSYAQGFELLSHTAKRRGWTLDFSRIASLWRGGCIIRSGFLSKISAAFAQQHDLENLVLAPFFAEELKRACPGWRTIVAESVRQALPVPALSAALAWFDGFTGAALPANLLQAQRDYFGAHTYERTDAPRGEFFHTNWTGTGGDTIAGTYSI

SEQ ID NO: 56812 - protein, 65 aa, Brassica napus
METISVQRSSSGKQVSGMRPFKNPRRRSSRGSLSRSGGSLALPNNPASSWGSSPAYPTPPPPDSQ

SEQ ID NO: 56813 - protein, 175 aa, Nostoc punctiforme PCC 73102
MSTASYWTSPDFSQAAFIAANAVVMGSVNIAAGVSIWYGAVVRADVERIEIGECTNIQDGAILHGDPGFPTILEDHVTVGHRAVVHSAYIERGSLIGIGAVILDGVRVGAGSIIGAGAVVTKNIPPLSLVVGVPGKVLRQLTEAEAAELIEHAKRYQKLALVHAGKGTDIGFSKS

SEQ ID NO: 56814 - protein, 481 aa, Prochlorococcus marinus str. MIT 9313
MLEARSHQQLKHLLLQNSSPWPHHLTLSRLVARSLRRKDHTLIQLDPRSKDLWWLGLLVPLCLEAKDAVMILSDQQRRRLLKVELPQLLTKGIKLPCWEGHLPPSGNQLWLMNHSELIEAHHQGHLKSRQLIIPEADQLSQRLRDSMALSITPQDWERLRRAHPSAEASLMQLHERLSRSLFTHATRANAQVRLDGSEIQALKDLMRLLGPSPSPWPAVLKADSRFWASWAELDHRLLQWQWHLQPLEPLQNLPGLLRDQPSVLLSGSREHELVRTELDAAAFPATVIARLNEPNLQEPIPLFAPRRQPLPNTEIYAEHLLDQCRRLILGRPGITVVLLDDQQLRRQLTSELAAEFGRRVVHETTAPESNGVVCCRWAWWLHHQDQLPLPEQLIVALLPLASVESPLTAARVESLKNQGLDWFRDLLLPEALSLLTPAIAPLRKNHGRLAILDGRLRGRSWGKQVLSTLEPWTPLQRLLPD

SEQ ID NO: 56815 - protein, 577 aa, Vitis vinifera
MGIAASLSCLLFFTTILPALTASPILFQGFNWESSKKEGGWYNFLINSIPELAASGITHVWLPPPSQSVSPEGYMPGRLYDLNASKYGTQDELKTLIKVFHSKGVQCIADIVINHRTAEKQDAGGIWAIFEGGTPDDRLDWTPSFICKDNTPYSDGTGNPDSGDDYSAAPDIDHINPLVQQELTDWMNWLKIEIGFDGWRFDFARGFSPAFTKFYMANTRAKFAVGEIWKSLSYRGDGKPSYNQDSHRRELMEWVRGAGGAVNAFDFTTKGILQAAVEGELWRMKDLNGKPPGMIGLMPGNAVTFIDNHDTGSTLQHWPFPSDKIMQGYAYILTHPGIPSIFYDHFFEWGLKEEIIKLIIIRTRNRIKPNSAVRILASDSDLYVAAIDGKIIVKIGPRFKGSRSINPSLRGRPFYDHFFEWGLKEEILKLIMIRTRNRIKPNSAVRILASDLDLYVAVIDGKIIVKIGPGFDVGNLVPQSFKKIATSGKDYCCMGEKNNPDMKNPAPPPGVVRVVPLDMILGLMFDRDWPMKAPSVTFFASSKPQSERMKGTSPVSCHGLTVVEKSDIRGLNMMFVS

SEQ ID NO: 56816 - protein, 263 aa, Chromobacterium violaceum ATCC 12472
MHPMLNVAVKAARRAGSVIQRASLNLDAIRVEKKKHNDFVTEVDRAAEEAIINVILEAYPKHAILAEESGAKGVGSSEYEWIIDPIDGTTNFLHGHPQYGISIAMAHKGQIQQAVVYDPNRNDLFTASRGVGAFLNDRRIRVSKRFMMNECLIGTGFPVSDQSYLDQYLGMLKDVIAKTAGVRREGAASLDLCNVACGRTEGFFELNLKPWDIAAGSLIVQEAGGIVTDPTGEQGWFESGDIVAGNPKVLAQLLQLLAPHVAK

SEQ ID NO: 56817 - protein, 487 aa, Glycine max
MAAKLDSHAVASDMIDFLNASPTAFHAVDEAKRRLRSAGYHQLSEREPWKLQPGNKYFFTRNHSTIVAFAIGKKYVSGNGFHIIGAHTDSPCLKLKPVTKVVKAGILEVGVQTYGGGLWHTWFDRDLTVAGRVIVQEENAGSVSYSHRLVRIEEPIMRIPTLAIHLDKTVSDGFKFNNETHLIPILATSLKGELNKVSTENGPVESGNQNDGKKANDKTGTSNTKHHLLLLQLLASKLGCEPDDICDFELQACDTQPSTIAGAAKEFIFSGRLDNLCMSFCSLKALIDATSSDSSLEEESGVRMVALFDHEEVGSNSAQGAGSPVMLNAVTRVTNSFSSNPNLLEKAVQLSYLVSADMAHALHPNYMEKHEANHQPKLHGGLVIKTNANQRYATNVVTSFIFREIASKHKLPVQDFVVRNDMGCGSTIGPILASGIGIRTVDVGAPQLSMHSIREICAVDDVKHSYEHFKAFYEEFSHVDGKMVVDI

SEQ ID NO: 56818 - protein, 424 aa, Bifidobacterium longum DJO10A
MVDFKAIRAQFPILDQEIHGHPLVYLDSAATSQKPNAVIDAEANFYRTINAGVHRGAHELAARSTMAFEEARAKVAKLVGANAAEGEEEVVVTGGATAGLNLLATAFGNASLGRGGEAAKRFALKPGDEIVVSRAEHHSVLLPFQELSYRTGATFKWIDLTEDGRVRTDNLDEVITERTKVVAVTHVGNATGAITNIAPIIKRAHEVGSIFILDACQSVPHLKVDFHALDVDFAAWSAHKMYGPTGVGFLYGKRDLLEALPPANFGGSMVELAYMDHEAQYMAPPARFEAGTQPVAQVVAAGVAAEWMMNIGLENIEAHEKTIAAELLKLGDVDGIRILGPRENVDRIGTVAFDVAGVHPHDVGQFIDAQGIAIRVGHHCAQPVHRHFGLYASNRASSGVYNSVEDAQALVEAAKGIRKFFGVE

SEQ ID NO: 56819 - protein, 328 aa, Zea mays
MVGGGRRGGAAAEEVKLNTGNVFAALESLKKKKKGDKGRAAGPSSRKKHGAGAAQQQQEPPQKDVFWAPAPLTTKSWADVEDDDDDDYFATTAPPRPVWAAAAAAEPAKEEEEDVEDAVRAALQEDVESDDEDLDDEDLDDGAEHEVEDAPAELAVKTVEALAAPPKDTERQLSKKELKKRELAELDAVLAELGLSGNSTSAAQDAEKEGANQAGDAEKKEDATVPSESKTSKKKKKKDKSSKEGRKETQEAAEGSEETASAGPDEEDTTAVDVKERLKKMASMKKKRSSKETDTGAKIAAAEATARSARLAAAKKKEKSHYNQQPVR

SEQ ID NO: 56820 - protein, 176 aa, Escherichia coli
EGFWDTLSARLDFCHLDVNDTAAFSRLGAMLDQKNRITINYFAMPPSTFGAICKGLGAAKLNAKPARVVMEKPLGTSLATSQEINDQVGEYFEECQVYRIDHYLGKETVLNLLALRFANSLFVNNWDNRTIDHVEITVAEEVGIEGRWGYFDKAGQMRDMIQNHLLQILCMIAMSP

SEQ ID NO: 56821 - protein, 414 aa, Bifidobacterium longum DJO10A
MTKNPKILSIVLAGGEGTRLMPLTRDRAKPAVPFGGVYRLIDFPLSNLVNSGYRQVVVLTQYKSHSLDRHISQVWRFSPLLGSYVSPVPAQQRLGKHWYLGSADAIYQTINIIEDVQPDIVVIVGADHVYRMDFEQMVQQHIESGAEFTVAGIRQPIEESNQFGVIEVDPDHPNMIKNFQEKPPTTTGLPDNPNQILASMGNYVANTKALFEALALDEKAADTKHDMGGDIAPYFASRNEAGVYDFNSNEIPGSTATDHAYWRDVGTIKQFYDAHMDLIAYVPEFNLYNQDWPIYTMSGNLPPAKFVHAGRDRLGHATDSIVSPGVIVSGGEVHHSVLSPNVRIHSWAQIVDSVLFDGVVINRRARVYKAILDKNVVLTENSTVGIDTEHDLARGFTVTPDGITVVPKNTIVDD

SEQ ID NO: 56822 - protein, 429 aa, Arabidopsis thaliana
MVNSCENKIFVKPTSTTILQDETRSRKFGQEMKREKRRVLRVINQNLAGARVYPCVVNKKGSLLSNKQEEEEGCQKKKFDSLRPSVTRSGVEEETNKKLKPSVPSANDFGDCIFIDEEEATLDLPMPMSLEKPYIEADPMEEVEMEDVTVEEPIVDIDVLDSKNSLAAVEYVQDLYAFYRTMERFSCVPVDYMMQQIDLNEKMRAILIDWLIEVHDKFDLMNETLFLTVNLIDRFLSKQNVMRKKLQLVGLVALLLACKYEEVSVPVVEDLVLISDKAYTRNDVLEMEKTMLSTLQFNISLPTQYPFLKRFLKAAQADKKCEVLASFLIELALVEYEMLRFPPSLLAATSVYTAQCTLDGSRKWNSTCEFHCHYSEDQLMECSRKLVSLHQRAATGNLTGVYRKYSTSKFGYIAKCEAAHFLVSESHHS

SEQ ID NO: 56823 - protein, 1205 aa, Aspergillus nidulans FGSC A4
MDPDSYPFNLAKEREFYSSYPFAPFDDSSRKTFSPASSQDHALTSFAQLGAMRLGAQRAIISLFGPTNQYILAEATGSPDDELRLGCCVLPKENSICTELTTTPSNLPDNTTVSHGALIIPDLQGENKERYAVPKQLYAARFYAGVPIISPRGQVIGSYGVLDSQPRPSGVDESTINFMKDMAATIMRYLDMMHLEHENIQARKMITGLGSFVEGKSTLRDSWLESNEQDAARGRHGDETIEGLLDKRQQDLQEARDNTRKQPPHRPARKDSSPGADDDETDARPGTHKRQNSHLQRRAICRSEPSGDSLPDDDGIQGSLQEIFSRAANLIRESIAVEGVVFFDARVESFGGLVGYEYCEDHEARSESETTTSSEESPDTGLENGTTICRILGSSTSVFSTINEDSRARSNSQDNGYALREFLLKAMMNRYPRGKIFNYNNDGSLSDESGSNFSADTSKSVSTKDSRRRKRSHKQDANDLHRVLHGPRSIIFLPLWDSHKSRWLSGLLVWTNKPQRVFAAETELAYLRAFANSIMAAVHKLDIEMADRAKTNLVSNISHELRSPLHGILGTADLLSDTALNALQYGMVHTLEACGRTLLDTINHLLDFTYIDKFRKDRNSKHKHAKKAETSSQNHDTLERNPPNSSENINTHVQLDAVLEEVVESIFAGHTFYHHARRNGGSPKTAVVSAKQVTIIFDIQESNGWGFYTQAGCWRRIMLNVFSNALKYTQQGFVYIGLKVGEAETPRGESNDSSQSDSNAKYTVTLTVKDTGQGIGTAFLRNGLFVPFSQEDALAPGSGLGLSIVRKAVASLHGTIELSSEKDKGTEVTIQVPMSPVSDNPDESSTTAAYRSIRKKAQGKTLGLIGFGSSLVSERDSTLSNSLTRLCEDWFHLIVKRINLNDDPPAACDFYLMVHTDLDDPDAKGNQVLDLAEPSKVSPLIVICHCPEAAHKLYARSTSMSHNPKPIVEFISQPCGPRKLAKSMELCLKRMGGQETDQHEETRWVELPESSHLPLDIGPRDAPDERMKVSKRLAEEKNDEQHSRKPINDNISLPDEPGTVPEVTAPDGIAENGPPSVLLVEDNPINLNILDAYTKKEGWSSTTAQNGLEAFERFQEHPGKFALVIIDISMPVMNGFEASQRIRQFERKYFDAHPELRPSWHPTTIVALTGLDSKDAQHEAFASGINVFLTKPISRAKIRTLLKNL

SEQ ID NO: 56824 - protein, 378 aa, Alteromonadales bacterium TW-7
MTKSALLVLEDGTVFRGTAIGADGMSVGEVVFNTSMTGYQEILTDPSYAEQIVTLTYPHIGNTGTNSEDEEANQIWAKGLVIRDLPLLASNFRNEQSLDDYLKERNILGIADIDTRKLTRILRDKGAQNGCIIAGDELDEQKALQAAQAFPGLKGMDLAKVVSTKENFEWRESSWTLGEGFKTLDTADEKFHVVAYDFGVKRNILRMLVDRGCKLTVVPAQTSAADVLALNPDGIFLSNGPGDPEPCTYAIDAIKSFLETDTPIFGICLGHQLLALASGAKTEKMKFGHHGGNHPVKDLDRDVVMITAQNHGFAAQESSLPSTLRATHKSLFDGTLQGIHRTDKPAFSFQGHPEASPGPHDAAPLFDHFIDLMQARKH

SEQ ID NO: 56825 - protein, 682 aa, Aspergillus nidulans FGSC A4
MPIGAYLQYSRPASSLARAVSALARRHSVSSAPRSRPVSHAAARSRAYSIALVGTGYRGYRSHFLSLLGSPTLSITAVCDTNGTALESFSVEHPDIPTYNSLSSLLHHHRPDFAIVSVPHCAHLECISALAAKGVHVLKEKPIAESVDEYEWMTGLPVKVGITFQKRFEPHFLQFRSLLPLVGDVAAVDASLALNITNLEETWRASAGVGVTEDLGCHMLDLLVWLLGLPASVMAQQVSSVRPSQRYGGDDVCDIMMNWGTRNCIGHVRLSRVAHKPVSSIVVTGTNGTLIINGQAVTHYDTQGCETISSTHQPDEKQVIHSMVQEFGDWVTGRGPSFSTSLANVRNTVSLVDAVKMSLASRQLQRPLPLSASSTAVWGAINNRNGLSTKTLTSRVSAATLFTSTQARNRDRSFRLNTGALIPAVGLGTRRAQKPGLVYRAVRSALKTGYRHIDTAMSSGVEHEIGQAVKDSGVSRSQVWVTTKLDNRWHTRVQEALDMSLSELGMDYVDLYLMLADWDFVKTWYGKIFLSLMAGFLFLSSTGKNCKILRQPKCEILLHPYWPSRKLLQYCRNHEIHCTAYSCLGSTDSPLLEDKVLLEICKRRNKSPQQVLTDNSRIMWGLQRGTSVVPKTVNAARIEENFDLNGWALSDDELDKLNRCTTRFKSCNDDWLPATVFSEDGH

SEQ ID NO: 56826 - protein, 370 aa, Pseudomonas fluorescens PfO-1
MIKSRAAVAFEAKKPLEIVEVDVAMPKAGEVLLRVVASGVCHTDAYTLSGADPEGIFPSILGHEGGAIVEAIGEGVTSVAVGDHVIPLYTPECGQCKFCKSGKTNLCQAIRATQGKGLMPDGTSRFSYKGQTIFHYMGTSTFSEYTVLPEISVAKISKDAPLEKVCLLGCGVTTGIGAVINTAKVKPGDTVAIFGLGGIGLSAVIGAVKAKASRIIAIDINPAKFEIAKQLGATDCVNPKDFDRPIQEVIVDMTDGGVDFSFECIGNVQLMRAALECCHKGWGESVIIGVAGAGQEISTRPFQLVTGRVWRGSAFGGVRGRTELPSYVDMAQSGEIPLDTFITHTMGLEDINKAFDLMHEGKSIRTVIHF

SEQ ID NO: 56827 - protein, 157 aa, Pseudomonas fluorescens PfO-1
MRIGHGYDVHRFAEGDFITLGGVRIAHGFGLLAHSDGDVLLHALSDALLGAAALGDIGKHFPDTDPQFKGADSRVLLRHVVSLIHAKGWKVGNVDNTIVAQAPKMAPHIESMRALIAADLQVELDQVNVKATTTEKLGFVGREEGIAVHSVALLLRA

SEQ ID NO: 56828 - protein, 146 aa, Solanum chilense
TSSLESPIMLLSGHQSAVYTMKFNPTGTIIASGSHDKEIFLWNVRGDCKNFMVLKGHKNAVLDIQWTTDGSTIVSASPDKTVRAWDVETGKQIKKMAEHSSFVNSCCPARRGPPLIVSGSDDGTAKLWDMRQRGAIQTFPDKFQIT

SEQ ID NO: 56829 - protein, 414 aa, Arabidopsis thaliana
MVLISETSDDGSTGGDHQIKKPKKEEDRNKKLKEKVQVSLPIPEELILRCFLLVRRCHHPSLSLVCRSFHSLMSKLYDDRLRLGYTENVLYAYVGFPPVENPSWYILHRKPYRNLPNTISLKLCKIDSLPPMPWGSTVVTIGSDIYVIGGRVGEKLLEDVGVGYNKPISGGRRGETSIRGGHAGERRISDVTHINCRFHEYRSLPSMKMARCRAAAGVIDGKIYVIGGRKSWSSVPGPYPEAFGRGEFLTYAVMKEKIYCLDLTRNIHIYDPKESKWESWTHGPLSASWNDSSCVVDNLLFCINTSVYFLGWPIKIYDPEKKTWFYLQGLQGFPANGLFVDGYKMANFGGKLVILSADVHRLRRYDCRKREIWCIEIAWERKEDGTFWGKVESVAVVLTPAKTTSVDICGTVTV

SEQ ID NO: 56830 - protein, 339 aa, Microcystis aeruginosa PCC 7806
MSLPELPLHLQLTQMVSGYWLSQAIYAAAKLSLAEHLSKGAKSCQDLASLTETNPAALYRLMRALASVGIFQETESQQFILTPLAEHLSSDHPRSVKATAIMLGEAPHYQAWGNVLHSIKTGQPSFDDVFGMGVFEYFQTHPLDAEIFEQSMNSFSFSEEKAILAVYNFSEFQTLVDVGGGYGEMLGTILEQYPHLKGILFDEEYVISHCQPTLEKHGILHRCQTVGGNFFESVPSGGDGYLLKHIIHDWDDRRAIAILKNCCQALDSNGKVLVLEMVVPAGNNPSAAKMLDINMLVMCPGGKERTAEEFEELLSPAGLKLNRIIPTQEDICIIECVKK

SEQ ID NO: 56831 - protein, 250 aa, Picea sitchensis
MAIGVAFGRFDEAFGLDGFKSYLAEFISTLLFVFAGVGSAMAYDKLTSSAALDPAGLVGVAVCHGFALFVAVAIAANISGGHVNPAVTFGLVLGGQITILKGIFYWIAQLVGAIVACLLLKFVTGGLTTPTHNVAAGMSTIEGVVMEIVITFALVYTVYATAADPKKGSLGTIAPIAIGFIVGANILAAGPFSGGSMNPARSFGPAVVSGDFTNNWVYWVGPLVGGGLAGAVYGGVFIGSHSHAPLSQDY

SEQ ID NO: 56832 - protein, 521 aa, Microcystis aeruginosa PCC 7806
MSLESTANEAIAHNLEQFLLVLTISLSVATLSRTVAFLRKIPYTLLLVIVGMGLAFLDLRLVNLSPELILEIFLPPLLFEAAWNIPWAKLKEYWVTIVLFAVIGVIISVLGVAYPLHIFANLPLSIAFLLGAALAATDPVSVIALFKELGASKKLTILMEGESLFNDGVAVVAFVLLVGIPLGVDTFSVPVTIARFCTFVGIGIGVGCVIGFGISYLTQRFDLPFVEQSLTLVSAYGTYLVTEKLGGSGVIGVVIVGIILGNLGSRIGMSPRTRLVVSEFWEFIAFFVNSIIFLLIGDQTRFESLGSHLTGILIAIAAMVVSRLFSIFGLGGISNLITGNKINFKERTVLWWGGLRGSVSIALALSVPTSIPYRQEIIDVVFGVVLFTLLVQGLSIQWLLNALNLIGDQPIRTEYSALIARQIALTRVANYLQQPERFPDIDPEFYRDKKTLVEGQLKSLEDQLQKLLQEHPQLKDVVAEQFQDTLLDIEANTYAELIRAGRLNENLVPLLVEVEEEKEMV

SEQ ID NO: 56833 - protein, 472 aa, Synechococcus sp. WH 7803
MSKAHFGLIGLGVMGENLVLNAESNGFSSVVYNRTYAKTEEFLSGRGAGKNIQGATDLQDFVSKLERPRRILMMVKAGGPVDAVIQQISPFLEEGDLLIDGGNSEYHDTERRVAELESKSFGFIGMGVSGGAKGALEGPSMMPGGTKASYDAIESLVRKMAAQVEDGPCVTYIGPGGSGHFVKTVHNGIEYGIEQILAEGYDLMKRVGGMNGTQMADVFAHWNSTEELSSYLVEITEVCLRTKDPDDGADLVEKIQDKAGQKGTGLWTVVSALQMGASVPTIYASLNGRVMSSMKEQRIKAEPILKGPAIKSFDMGTPADGMAPLMDAMVLACMASYAQGMELLRIASAEHNYNLNMPSIAQIWKGGCIIRARLLKRIQDAFNADPQLANLLIDPWFAEQVNRRLPGLAKVVAGAAEAGIPVPCLSSTLDYINSYRTARLPQNLVQAMRDCFGSHTYERVDKDGIFHTEWLN

SEQ ID NO: 56834 - protein, 193 aa, Trichodesmium erythraeum IMS101
MNANQSNSTNISSLVTRLRNFMIVSVAIALSVSIFMALRTDKLSVSLNEMAQAATPLDVALSNNKPTLVEFYANWCTTCQAMAPELEEIRQKYTQNTNFVMLNVDNSRWLPELVEYRVDGIPHFVFLDREGTEVGQTIGEVPKSIMAANIEALVAGSYLPYNSTVGQGSHFNAPVEPTKASQADPRVHGSQVK

SEQ ID NO: 56835 - protein, 431 aa, Synechococcus sp. WH 7803
MKRVLAIILGGGAGTRLYPLTKMRAKPAVPLAGKYRLIDIPISNCINSNINKMYVLTQFNSASLNRHLSQTYNLSAGFGQGFVEVLAAQQTPESPSWFEGTADAVRKYQWLFQEWDVDEYLILSGDQLYRMDYSLFINHHRSTGADLTVAALPVDAKQAEAFGLMRTDEDGRILEFREKPKGDSLLEMAVDTSRFGLSAESAKERPYLASMGIYVFSRDTLFDLLHQNPTHKDFGKEVIPEALQRGDRLKSYVFDDYWEDIGTIGAFYEANLALTQQPTPPFSFYDAEFPIYTRPRYLPPSKLVDSQITDSIIGEGSILKSCSIHHSVLGVRSRVEDEVVLQDSLLMGSDFFESSSERAVLRERGGIPLGVGKGTTVKRAILDKNARIGSNVTIVNKDHVEEADRPEHGFYIRNGIVVVVKNASIPDGTVI

SEQ ID NO: 56836 - protein, 438 aa, Synechococcus sp. WH 7803
MHIAVVGLSHRTAPVEVREKLSIPEQTMEESLQNLRGHDQVLEASILSTCNRLEIYTLVRNPELGISAVREFLSSHSGLETGDLKPHLFAYHHEDAVGHLLRVAAGLDSLVLGEGQILSQVKKMMRLGQEHKSLGPILNRLLTQAVSTGKRVRSETNLGTGAVSISSAAVELAQLKLGQSRGLDELVTLEDEQVAVVGAGRMSRLLLQHLQAKGASGVVVLNRTVARAEALAADFPTLPVQCRPLKDLDHCLSTCSLIFTSTAADDPIIDAERLSKLNRRSSLRLIDIGVPRNIAADVEGIGGVDAHDVDDLKEVVERNQEARQQVAREAQGLLDGEARQFLEWWDSLEAVPTINRLRSSMESIRSEELMKALSRMGPDFSARERKVVEALSKGIINKILHTPVTALRSPQPRSDRQNALSVVERLFDLQADEDSVQN

SEQ ID NO: 56837 - protein, 227 aa, Synechococcus sp. WH 7803
MSTKSLVVSPSILSADFSRLGEEVKAVDQAGADWIHVDVMDGRFVPNITIGPLIVEALRPVTTKPLDVHLMIVEPEKYVPDFAKAGADIISVQVEACPHLHRNLAQIKDLGKQAGAVLNPSTSLSTLEYCLELCDLVLIMSVNPGFGGQSFIENQVQKIRDLRRMCDEKGLDPWIEVDGGVKGGNAWKVIEAGANAIVSGSGVFNQPDYAAAIQGIRDSKRPEAVLV

SEQ ID NO: 56838 - protein, 343 aa, Arabidopsis thaliana
MMEVEGSMNRAPDQSSFLRSRRSKALYQFKQQKLPACKPVLTPISVITVFMLMGFVFIPIGLITLRASRDAIEIIDRYDVECIPEEYRTNKLLYITDSSIPKNCTRYLKVQKYMKAPIFIYYQLDNYYQNHRRYVKSRSDQQLLHGLEYSHTSSCEPEESSNGLPIVPCGLIAWSMFNDTFTFSRERTKLNVSRNNIAWKSDREHKFGKNVYPINFQNGTLIGGAKLDPKLPLSDQEDFIVWMRAAALLSFRKLYGRIEEDLEPGKVVEVNLMNNYNTYSFSGQKKLILSTSNWLGGRNDFLGITYLVVGSSSVVISIIFMLLHLKNPRPYGDNSWNKKSLSS

SEQ ID NO: 56839 - protein, 129 aa, Zea mays
MAASAAAAAAAATPVAPTEGTVIAIHSLEEWSIQIEEANSAKKLVVIDFTATWCPPCRAMAPIFADMAKKSPNVVFLKVDVDEMKTIAEQFSVEAMPTFLFMREGDVKDRVVGAAKEELARKLELHMAS

SEQ ID NO: 56840 - protein, 327 aa, Candida glabrata CBS 138
MTWDPSELPYYNPQVDDRVAVVTGGNSGIGWFTVLHLYMHGFRVYVCGRNSHKVSRAMDDIIEEAVRRHNLYLKGLHDQKPTRYLGSLQYLHTDLTDLKCVDRAAAKILRMENHLDVLVNNAGVMAVPYEITKDGFEIQMQTNYIAHFLLTMRLLPLLRCSHGRVVTLSSLGHHIIFKYSKLDETWNYFPNFVFTWFRYAMTKVASIQYTKMLAIKNPDILFVSVHPGLVMNTNLFSFWTRLPLVGIFFWLLFQVVGFMFGVSNEQGAYSTLRCSLSQELTTTNDNGKYFTTGGKESRSSYVANNLDDAASTWIWTMKQLRNRGFDI

SEQ ID NO: 56841 - protein, 566 aa, Arabidopsis thaliana
MEEGHKEPLVLRVEGSHCSLSEMDDFDLTRALEKPRQLKIERKRSFDERSMSELSTGYVRQDSILEMAHSPGSRSMVDTPLSVRNSFEPHPMVAEAWEALRRSMVFFRGQPVGTIAAYDHASEEVLNYDQVFVRDFVPSALAFLMNGEPDIVKNFLLKTLQLQGWEKRVDRFKLGEGVMPASFKVLHDPVRKTDTIIADFGESAIGRVAPVDSGFWWIILLRAYTKSTGDLTLSETPECQRGMRLILSLCLSEGFDTFPTLLCADGCSMVDRRMGVYGYPIEIQALFFMALRCALSMLKPDEEGRDFIERIVKRLHALSFHMRSYFWLDFQQLNDIYRLIVKLLLRYKTEEYSHTAVNKFNVMPDSIPDWVFDFMPLRGGYFVGNVSPARMDFRWFSLGNCVSILSSLATPDQSMAIMDLLEHRWEELVGEMPLKICYPCIESHEWRIVTGCDPKNTRWSYHNGGSWPVLLWTLTAACIKTGRPQIARRAIDLIESRLHRDCWPEYYDGKQGRYVGKQARKYQTWSIAGYLVAKMMLEDPSHIGMISLEEDKQMKPVIKRSASWTC

SEQ ID NO: 56842 - protein, 277 aa, Arabidopsis thaliana
TNSPLLTIGLERPPGQVRDTTLLDSSNSDFEFHISSNFDPGDSSPADEIFADGMILPVLPFQVTATSTMPKRLYKYELPPIVSAPTLSSYLPPLPLPLPEHSRKYSVKETRGSLNGRGSGANSDSEAEKSSKSFWSFKRSSSLNCDIKKSLICSFPRLTRSNSTGSVAISKREMLRDINKHSSQRHGVPRPGVNPSSHMRPPSSFCCSSYQFRPQKHAGKNGGGRGGSFWIAPVIGGPSPFGLGSILRLTKKKKKKKKKKRPLNSNLPGRPLEPYSE

SEQ ID NO: 56843 - protein, 380 aa, Vitis vinifera
MAPAFEDETASETNFSDVEQLHKSKVTVVGSGNWGSVAAKLIASNTLKLSSFHDEVRMWVYEEILPSGEKLSEVINQNNENVKYLPGIKLGKNVVADPDLEHAVKDATMLVFVTPHQFMEGICKRLVGKIRGDAEAISLIKGMEVKMEGPCMISTLITDLLGINCCVLMGANIANEIAVEKFSEATVGYRENRDIAERWVRLFSTPYFMVSAVIMTYLNLFFNERTGPGCGRRFVDGLEMGNNTKAAIMRIGLREMKAFSKLLFSSVRDSTFFESCGIADLITTCLGGRNRKVAEAFARNGGKRSFDELEAEMLQGQKLQGVSTAREVYEVLSHRGWLELFPLFTAVHEISTGRLPPSAIVEYSEHTPRLNVLEGSAQYC

SEQ ID NO: 56844 - protein, 368 aa, Vitis vinifera
MGGVTSSMAAKFAFFPPNPPSYKLIRDDLTGLLLLSPFPHRENVEVLKLPTRRGTEIVAVYVRHPMATSTLLYSHGNAADLGQMYELFIELSIHLRVNLMGYDYSGYGQSSGKPSEQNTYADIEAVYKCLEESYGAKQEDIILYGQSVGSGPTLDLAARLPQLRAVVLHSPILSGLRVMYPVKRTYWFDIYKNIDKIPLVNCPVLIIHGTSDEVVDCSHGKQLWELCKEKYEPLWLKGGNHCDLELYPEYIRHLKKFVSTVEKSPSQRNSSRRSTDQFEQSRRSTDVFEVSRKSTDRREKPRQSTDRLEKQKNLSNNADKLEKLRMSFDQMERSRRSVDCHEKSRKSIDHQLERARKSVDRLERIRTG

SEQ ID NO: 56845 - protein, 136 aa, Pericallis appendiculata
LDAAGKTTILYKLKLGEIVTTIPTIGFNVETVEYKTISFTVWDVGGQDKIRPLWRHYFQNTQGLIFVVDSNDRDRVVEARDELHRMLNEDELRDAVLLVFANKQDLPNAMNAAEITDMLGLHSLRQRHWYIQSTCA

SEQ ID NO: 56846 - protein, 480 aa, Lactobacillus brevis
MMNKNDQETQQMINNVDLEKTFLGSVEAGQSLPTYTLPDDPMAPDVAAQLVEHYRLNEAKANQNLATFCTTQMEPQADELMKNALNTNAIDKSEYPKTAAMENYCVSMIAHLWGIPDNEKIYDDFIGTSTVGSSEGCMLGGLALLHSWKHRAKAAGFDIEDLHSHKPNLVIMSGYQVVWEKFCTYWNVEMRQVPINGDQVSLDMDHVMDYVDENTIGIIGIEGITYTGSVDDIQTLDNLVTEYNKTATMPVRIHVDAAFGGLFAPFVDGFNPWDFRLKNVVSINVSGHKYGMVYPGLGWIVWRHDTADILPAEMRFQVPYLGKTVDSIAINFSHSGAHISAQYYNFIRFGLSGYKTIMQNVRKVSLKLTAALKTYGIFDILVDGSQLPINCWKLADDAPVGWTLYDLESELAKYGWQVPAYPLPKNRDDVTISRIVVRPSMTMTIADDFLDDLKLAIDGLNHTFGVTTTVDQDNKTTVRS

SEQ ID NO: 56847 - protein, 520 aa, Roseovarius nubinhibens ISM
MSHALSSSQHTTKHVIETKGGVVASQHRLAAEAGAEVLRAGGDAVDAAVACSFVVGVLEPWMSGPAGGGAAVHWRADSGEAVAINFGMRSPKGLRVEDYPLSGEGKAGDLFPWERVTEDRNVQGAKAIAVPGTVEGLGQAHARWGKMPWAELVAPAVAHARQGMLVDWYAALIIASTARELAKDPDAAAMFLDDGQWPKGSGWTAIPDNRLDQSRMADSLDIVARGGARAFHEGDLAQAMARDVQEKGGSLSYEDLKGYRAWMGAATPVKYRDALYHVMPGLTAGPTFARVMEELEAVDMSTPAQAYTAYARALDQAYAERLGKMGDTGEVPEAPGCTTHFAVVDRAGNMVTHTQTLLSIFGSRVVSPSTGFLMNNGIMWFDPEQGKPNSLGPDKSCLMNVCPVLGAVGDKRFAIGASGGRKIVSAVSQLASFVVDGGMDIAGAFHNPRIDVSGGGQIIADETLDEDVLAALGEVLPMKTTRRTVLPYAFACPAGVMRQGAVNTGCTEIMSPWGDAALED

SEQ ID NO: 56848 - protein, 365 aa, Picea sitchensis
MAMGNWAITRVQTLAESGIQTVPSEYVRQVEKALVQEADDPRLLVPVIDLQRFSLLPSDHLRKDQYDTISTQISSAAENWGFFQIMNHGIPDSLIARVQAAGKAFFQLPIEEKEAYANEAQNPVGYGSKIGYSLDGEVKLEWGDYYYNIMWPPARRDMSKWPKQLSDFTEAMDEYSKELSKLFECLMEVLSRDLGLESENSLNESVGGEGKELRIRINYYPPCPQPDLVVGVAAHSDPGAITILLPDQIPGLQIRKDGAWIDVQFVPGALVVNIGDQFEILSNGKYSSIEHRSVVHKDLSRMSWAVFCAPPLDMVISPRRELIDDHHPPLYQQASFGEYLTKFFKKGLDGKGHVHEAKQQNQSLA

SEQ ID NO: 56849 - protein, 595 aa, Azoarcus sp. EbN1
MKPTDISAPDYLHKVVDCQWACPAHTPVPEYIRQIAAGDFAAAYMLNWRSNVFPGILGRVCDRPCEPACRRGRVDKEPVAICRLKRVAADFKEDIHELLPKAPSVKNGKRIACVGAGPASLTVARDLAVLGYQVTVFDSGKSAGGMMRSQIPKFRLPDSVIDEECGYVAGLDVELRQGEWIGSLRDLLADNWDAVFVGTGAPRGRDAALPGRQEAAANIHVGIDWLANVAFGHVTKIARRVIVLGGGNTAMDCCRSARRLGGEEVHVVVRSGFDEMKASPWEKEDAIHEGIPIHNYLVQKEFTHDNGRLTGVLFEKVQAEYDADGRRSLVPTGEPDVHMECDEVLLAIGQENAFTWIERDIGVEFDRWGMPVLDERTLQSTLPRVFFGGDAALGPKNIITAVAQGHDAAISIDLFCRNEPLTKRPGPLVNLVSQKMGIHEWSYDNHVSEEARRKVPVKTLEEALKDIKLEFELGYDLKLACGETERCLNCDVATVFTPKLCIECDACVDICPTECITFTADGEEEELRARLKVPAKNLEQSLYLAEGLKTGRVMVKDENVCLHCGMCAERCPTGAWDMQKFTIDVAQAGAEAPRS

SEQ ID NO: 56850 - protein, 64 aa, Zea mays
  misc_feature (26)..(26): Xaa can be any naturally occurring amino acid
  misc_feature (55)..(55): Xaa can be any naturally occurring amino acid
MEQTFIMIKPDGVQLSLIADIISLLXKKGFYLKGMKIMNVERSFTQQQYADLADXPVFRGLVEN

SEQ ID NO: 56851 - protein, 181 aa, Zea mays
  misc_feature (158)..(158): Xaa can be any naturally occurring amino acid
  misc_feature (163)..(163): Xaa can be any naturally occurring amino acid
MSSQICRSASKAARSLLSSAKNARFFSEGRAIGAAGAVTASGKLPLYASNFARSSGSSKSWITGLLALPAAAFMVQDEEVFAAEMERTFIAIKPDGVQRGLISEIISRFERKGFKLVGIKVVVPSKDFAQKHYHDLKERPFFNGLCDFLSSGPGIARXMGREXVIRYGRKLIGRTDPSESE

SEQ ID NO: 56852 - protein, 553 aa, Listeria monocytogenes str. 4b H7858
MFKHILLSLNGYKISYLRNDVISGVGVAALTIPVAMGYAQVAGLPPIYGLYASFLPVIAYVIFASSPQLVFGIDATASAITGSIILGTAGLAAGSKEAIALAPILAFFCAIFLVLFSVLKLGRFAKYISAPVLSGFISGLSVSIIMGQIPKIMGLKESGDSFFSSLGIIFGQFFQSNWISFAMGVVTVIIVITCKKVIPKIPMSLVVLVLGTMAAYFFKLDQYNVDIVGKIPVGFPSLALPEFGCSSWALAIGGGLVCAIATFAGSLLPSESFAMRNKYTIDDNRELFAYGISNFVAAFSGCSPASASVSRTAANEQFRGKTQMVSIVAATIIALIVAFLSGLLYYMPQPVLSGIVFAALVGIIDVDVLKGLFKVSRREATVWIVAALGTLLVGVIFGVLLGIFLSFINVVSRSMKSPIAILGVIEGRHGYFDLKRKPEAKPIPNVVIYRYSASLFFGNFNKFADGLKEAVQDDTKLVIFEASAIINIDTTATESMKDLLKWLDDKGIEYYFADLIDHLKTSFRKHDLGYIIDNGYTKKTVEDALEAYYAEHK

SEQ ID NO: 56853 - protein, 118 aa, Panax ginseng
LCEGGELFDRIVARGHYTERAAAAVVRTIVGVVQLRHRHGVIHRDLKPENFLVANKKENSPLKAIDFGLSTFFKPGEKFSEIVGSPYYMAPEVLKRNYGPEIDIWSAGVILYILLCGV

SEQ ID NO: 56854 - protein, 170 aa, Trichodesmium erythraeum IMS101
MDLSLIPAQPKPGLINVLIEITGGSKNKYEFDKDLQAFALDRVLYSSVQYPYDYGFVPNTLADDGDPLDGIVIMDEPTFPGCVIPARPVGMLEMIDGGDRDEKILCVPDKDPRYTEVKSLKDVAHHRLEEIAEFFRTYKNLEKKVTEILGWKDVEHVMPLVEKCVKAASK

SEQ ID NO: 56855 - protein, 118 aa, Panax ginseng
LCSGGELFDRIIQRGHYSERKAAELTKIIVGVVESCHSLGVMHRDLKPENFLLVNKDDDFSLKAIDFGLSVFFKPGQVFTDVVGSPYYVAPEVLLKHYGPEADVWTAGVILYILLSGV

SEQ ID NO: 56856 - protein, 400 aa, Caulobacter crescentus CB15
MSRLSEALTRLKAGGMIVLVDDEDRENEGDLVMAAEFADAAAIAFMAKRASGLICLTLEAETIDRLCLAPMVSDNRTSRQTAFTVSIEAATGVDTGISAFDRARTIAAAIAPDAQAADLVSPGHVFPLRARPGGVLVRNGHTEASVDLMRMAGLRPAGVICEIMKDDGSMARRPDLEVFCREHDLPLLTIAELVAHRKATELLVDEVAAARLPSDHAGQAFSVRAFRSRIDGGEHLAMVAGPLTGAPLVRVHSECLTGDALGSRRCDCGEQLRESLRQISDSGNGALIYLRNHEGRGLGLANKIAAYALQDQGLDTVQANHALGFADDQRDYGVAAQILRALGVGEVKLLSNNPRKAAGLRANGVTVRREVPLLIPANPDNAAYLETKRDKLGHSLARAS

SEQ ID NO: 56857 - protein, 313 aa, Sinorhizobium meliloti 1021
MHKILTIGEILVEIIATEKGDGFRKATPLIGPFPSGAPAIFIDQAGKLGQPCAIISRVGGDDFGTVNLERLKRDGVDISGIEVDPLATTGSAFVRYRPDGSRAFVFNIRDSACGKITLDERMTRLVGECSHVHVMGSSLYAPSVVESILAAIGIVKAGGGTVSFDPNLRPEILKSPGMREALLTVLAETDLFLPSGDELFLFTEAKTESQAVAELLASGIKAVVVKRGAAGASYFDAGAALSLPGFPVEEIDPTGAGDCFGATFVSFWLNGASPREALEFAAASGARAVMHFGPMEGASTRAELERFISEQQA

SEQ ID NO: 56858 - protein, 153 aa, Caulobacter crescentus CB15
MTDPVPPRIAIVVSQFNPEVTDGLLKGALDHLAAQGAPVAAPDIIAAPGAYELPLIAQTLARTGRYAGVVCLGCVIKGETAHFEFISLGASLGLMAAGLQTETPVSFGVLTTYTDEQAVARSRDDAENKGREAANACLSTVQTLRRIRENALA

SEQ ID NO: 56859 - protein, 504 aa, Arthrospira maxima
MLTELWSLKGRYKILHLTWFAFFLSFVVWFNFAPLATAIQDDMGLEISQIRTLAICNVALTVPARIIIGMLLDKYGPRITYSLLLIYAAIPCTAFALAQNFNQLVISRLALSIVGAGFVIGIRMVAEWFPPKEIGLAEGIYGGWGNFGSAAAAFSLPTLAAILTFGSGGVINWRVAVALTGIIAAAYGAFYFFNVQDTPPGKVYQKPKRARGLEVTTPKDFWFLMLMNIPLVGVLAILAWRLSKVGFLTLPQLYIVWVALFGLYLFQGYNCWEANKELILGHKHYPPADRYNFSQVAILELTYFVNFGSELAVVSMLPAFFENTFGLSKPAAGMIAASYAFMNLMSRPGGGLISDKLGSRKNTMAVLTAGMAFAYLIMGRVNGGWWLPLAVLLTMTCSFFVQAGEGSSFAIVPLIKRRVTGQIAGNVGAYGNVGAVVYLTLFSLFPEGDIGNRIFFEMLGVTSMIVAFLCWFFLKEPQGSFADHHQEELQANGRHYPCRQITPK

SEQ ID NO: 56860 - protein, 150 aa, Mycoplasma genitalium
CNYLTMIDHLKRTKIIATCGPALTKSLVSLKMLDDNEYAAIKKVAYANIEAIIKSGVSVIRLNFSHGTHEEQQVRIKIVRDVANNWNIPVSIMLDTNGPEIRIVETKKEGLKITKDSEVIINTMSKMIASDTSLLSVMLVAKYNMVNDVI

SEQ ID NO: 56861 - protein, 257 aa, Zea mays
MTTVSRALGSAFAGFTRAPAVAQTATTLPSPYGSSALHQHWRWSRACRTRRFSSGRAARISMSLRAGIVGLPNVGKSTFFKRHCELLGLPVSLLPVPWRNSCCQELVENGKAQAANFPFCTISPNVGVVAIPDPRLQVLSKLSKSQQTVPTSIELVDIAGLVKGASKGEGLGNQFLSNIREVDSILQVVRCFEDDDIVHVNGKVDPRSDIDVINLELIFSDLEQIEKRLDKLNKSKTKDTQVKVKEQAEKSGLEKIQ

SEQ ID NO: 56862 - protein, 167 aa, Herminiimonas arsenicoxydans
MTIKIGDQLPEARLAEYIDVASEACSVGPSKVMVHEATKGKKIAIFAVPGAFTPTCSETHAPGYIKAADQFKAKGVDEIWCISVNDPFVMGAWGRDQKAAGKVRFIADGSGTFTKALGMEFDLTKGGLGVRSQRYSMLVEDGVVKQLNVEDSGHLEVSTAEKLLEQI

SEQ ID NO: 56863 - protein, 466 aa, Flavobacteria bacterium BBFL7
MTDMSKYDVIVLGSGPGGYVTAIRASQLGLKTAIVEKESLGGVCLNWGCIPTKALIKSADVFNYLNHAEDYGLKVTGVDKDFNAVVKRSRNVADGMSKGVQFLLKKNKVDVIMGYGTVKKGKKIEVKAEDGSTSTVEGKHIIIATGAKSRVLPNLPQDGKKVIGYREAMTLEKQPKKMIVVGSGAIGVEFAYFYNSMGTEVTIVEYVDRIVPVEDIDVSKQMERSFKKAGIKIMTSSEVTGVDTSGNGVKATVKTKKGEEVLEADIVLSAVGIETNLSNIGLEEIGISTDRGKVLVNDWYQTNIPGYYAIGDITAGPALAHVASAEGILCVEKIADMHVEPLDYGNIPGCTYSTPEIASVGMTEAQAKEAGYELKVGKFPFSASGKASASGAKDGFVKVIFDAKYGEWLGCHMIGAGVTDMIAEAVLGRKLETTGHEVLKAVHPHPTMSEAVMEAVADAYGEVIHL

SEQ ID NO: 56864 - protein, 467 aa, Roseovarius nubinhibens ISM
MAKRFAKRFGRNNKGPLMLSFDTLKDQVADGSVDTVLACLVDMQGRLMGKRFHAGHFIASAWEETHCCNYLLATDLEMATPEGFASTSWEQGYGDYVMKPDLTTLRPVPWLEGTVMVLCDVLDHHTHEPVPHSPRAMLKKQLARLDAMGFDAMMATELEFFLFEKSFEELRKDGYRDLQPYSGYNEDYNIFQTTKEEHVMRPIRNHLWNAGIPIENSKGEAEAGQEELNIKYAAALDTADYHTIAKHAVKEISWQQGHAASFLPKWHHDKVGSSSHVHQSLWKEGKPAFYDANDPLGMSELMKHYMAGLLKYAPDMTYFFAPYINSYKRFVKGTFAPTRIIWSVDNRTAGYRLCGEGTKAVRVECRVGGSDINPYLAMAALLAAGIAGIEEKLSLPAPFKGDAYGEDTGLIPGNLRDAREALLGSSMLRKALGEEVVTHYARAAEVELEDFDRIVTDYELKRGFERV

SEQ ID NO: 56865 - protein, 305 aa, Gloeobacter violaceus PCC 7421
MRIAVLGGGAWGTTLADLAAAQDHQVRVWSRSGALALGEVLAQAEAVFSCLPMAAVAGVIDQVIALGLPAGVIVVNATKGLDRRTARPASSLWQARFADHPLVVLSGPNLAAEIRAGLPAATVVASADGQAAGRIQQCLASERFRVYTSADWRGVELGGVLKNVIAIAAGVSDGLGLGANAKAALITRGLAEMIRVGTHWGGLAETFYGLSGLGDLLTTCNSPLSRNYQVGFGLGKGQSLEAVLERLEGTAEGVATAAILAEYAQRSALEVPITDQICAVLGGLRPPTEALAALMTRRLREEDGG

SEQ ID NO: 56866 - protein, 136 aa, Pericallis appendiculata
LDAAGKTTILYKPKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCA

SEQ ID NO: 56867 - protein, 253 aa, Triticum aestivum
  misc_feature (118)..(118): Xaa can be any naturally occurring amino acid
  misc_feature (121)..(122): Xaa can be any naturally occurring amino acid
MVKLAFGSCGDSFSATSIRAYVAEFIATLLFVFAGVGSAIAYGKITDDGALDPVGLVAIAIAHAFALFVGVAIAANISGGHLNPAVTFGLAVGGHITILTGIFYWVAQLLGSTAALLXRCXXLRFVTHGKAIPTHGVTAGMNEFEGVVMEIVITFALVYTVYATAADPKKGSLGTIAPIAIGFIVGANILAAGPFSGGSMNPARSFGPAVAAGNFAGNWVYWVGPLIGGGLAGFVYGDVFIASYQPVADQDYA

SEQ ID NO: 56868 - protein, 560 aa, Zea mays
  misc_feature (213)..(213): Xaa can be any naturally occurring amino acid
MELAVGGGMRRSASHTSLSESDDFELTRLLSKPRINVERQRSFDDHSLSDVSHSGGYGRGGFDGMYSPGGGLRSLVGTPASSALHSFEPHPIVGDAWEALRRSLVFFRGQPLGTVAAVDHASEEVLNYDQVFVRDFVPSALAFLMNGEPDIVKNFLLKTLLLQGWEKKVDRFKLGEGAMPASFKVMHDAKKGVETLHADFGESAIGRVAPVDXSGFWWIILLRAYTKTTGDLTLAETPECQKGMRLILSLCLSEGFDTFPTLLCADGCCMIDRRMGVYGYPIEIQALFFMALRCALQMLKHDNEGKEFVEKIATRLHALSYHMRSYFWLDFQQLNDIYRYKTEEYSHTAVNKFNVIPDSIPDWLFDFMPCQGGFFVGNVSPARMDFRWFALGNMIAILSSLATPEQSNAIMDLIEERWEELIGEMPLKICYPAIENHEWRIVTGCDPKNTRWSYHNGGSWPVLLWLLTAACIKTGRPQIARRAIDLAERRLLKDGWPEYYDGKLGRYVGKQARKFQTWSITGYLVAKMLLEDPSHLGMIALEEDKAMLKPVLKRSASWTN

SEQ ID NO: 56869 - protein, 60 aa, Glycine max
  misc_feature (18)..(18): Xaa can be any naturally occurring amino acid
RCIDRNANSVAKYAPLAXLCGGFIFFASLELLTMWNGTACKTPLAPKVQPYVHLRVELGC

SEQ ID NO: 56870 - protein, 504 aa, Aspergillus nidulans FGSC A4
MAQPVQLTAPNGVSYSQPTGLFINNEFVPAASGKTLTTVNPYDESIIATVSSAGPKDVDRAVAAARQAFASEWRGLTPSERGLLLLRLADLCDRDKEILATIDAWDNGKPYEQALGEDIAEVIAVFRYYGGWADKIHGSTIDTGDAKFAYTRHEPLGVCGQIIPWNYPVMMAAWKLGPALACGNTVVLKAAEQTPLSVLYLATLIKEAGFPAGVVNLLNGEGASAGAAIAGHPGVDKIAFTGSTNTGRVIMKAAAGNLKAITLETGGKSPLLVFDDANIDQAVKWSHVGIMSNMGQICTATSRIYVQETIYDTFVEKFKQYTIENSKVGSQFDPSVTHGPQISKAQRDRILSYVQSAKSEGAQLVLGDEPVSEKGYFVPPTIFKNTTREMSAVREEIFGPFVVIQSFSTQQDAINKANDTEYGLGAAVFTENITRAHRVAAAIQAGMVWINSSQDSHFAIPFGGYKQSGIGRELGEYALAAYTQVKAVHGKFSLPLEFNLGTWL

SEQ ID NO: 56871 - protein, 315 aa, Flavobacteria bacterium BBFL7
MKSLKFKNGDELFPIGLGTWKSKPGEVKNAVISALESGYTHIDCAAIYGNEKEIGEAFNEVFSKGDIKREDVWITSKLWNNAHLPKDVEPAMKQTLQDLQLDYLDLYLIHWPVAFKPDVQSPEGPEDFLTPQEAPVSETWNAMTQLKEKGLAKHIGVSNFSKQKLDELISNTDEIPEMNQVELHPLLQQNELFEYCSNKGIHLTGYSPLGSGDRSEGMKQENEPNMFEKTAVQKIASKHNVSPAQVLINWSAQRGTAVIPKSTNPGRIKENLEAARIQLDKEDLKDLAQLDEHYRYVTGKFFEVEEKGYKNIYDE

SEQ ID NO: 56872 - protein, 300 aa, Vitis vinifera
MAESCLTSVPTTLFTTKTPHPLLSLPPKPVRLFHLSCSCSSSWVSLKTKTSPTTLVPFVAQTSDWAQQEEEEEKGGLTWDSEGGEEIEASGSEEAWEGEVGEDGEESEGSEDTYSEPPEEAKLFVGNLPYDIDSEKLAQLFDEAGVVEIAEVIYNRETDQSRGFGFITMSTVEEAEKAVEMFNRYDLNGRFLTVNKAAPRGSRPERPPQAFEPSFRIYVGNLPWQVDDARLEQVFSEHGKVVDARVVYDRDTQRSRGFGFVTMSSETELNDAIAALDGQSLDGRAIRVNVAEERPRRGSY

SEQ ID NO: 56873 - protein, 251 aa, Picea sitchensis
MFVDDSIRINYRDKGDSGGGEQEWYDKYRRSLYGGLTHKALLVDAVGTLVLPSQPAAQIYRNIGLKYGVCYSEDEILSRYRWAYQQPWPNTRLRFMDDARPFWQFVVQNATGCSDSRYFEELYEYYTTDQAWHICDPEAGKVFEALRRAGVKLAVVSNFDTRLRPLLQALKCEHWFDALAVSAEVEAEKPNPTIFWKACEFLGVEPEDAVHVGDDRRNDIWGARDAGCDAWLWGADVHSFKEVAQRIGVVV

SEQ ID NO: 56874 - protein, 329 aa, Bordetella petrii
MARVVRFHQHGGPEVLRIEHVEVPLPGPGQVRIRVKALGLNRAEALLRAGSYIERPAFPSGLGLEAAGLVDAVGAGVTAFAPGDAVSIVPPQSMVRWPTYGELITLPAELVIKHPPALGWEAAAAVWMPYLTAYGALIDIAHLGPEDFVAVTAASSSVGLAAIQIANRVGATPIAITRTSAKACALRAAGAAHVIATAEVELGARLLDITGGAGVRVVLDAVGGPIFEPLTTAMSRGGILIEYGGLSAEPTPFPLFSVLSKTLTLRGYLVHEITGDPAKLEAAKAFILDGLASGAFQPVIARTFEFDQIVDAHRFLESNEQFGKIVVTV

SEQ ID NO: 56875 - protein, 282 aa, Mycobacterium sp. JLS
MVTRPNDELQGRVAIVTGGASGIGRGVAERFVAEGAKVVIADVQDELGEALAEQCGPNALFHHTDVGDQEQMRRLVDVAVERFGALDVMVNNAGISSPLRRGLFNEDLEEFDRVMRVNLLSVMAGTRDAGRYMSEHGGGSIINLSSIGGIQAGGGVPVYRASKAAILHFTKCAAIELAHYDIRVNCIAPGNIPTPILQSSATGEDRERLEKFEARIRAQMRNDRPLKREGTPDDVAEAALYLATDRSRYVTGIVLPVEGGTIAGKIIPRKAEPGATVNGAQT

SEQ ID NO: 56876 - protein, 588 aa, Synechococcus sp. WH 7803
MESATESTTTRLPKAEQRKLDSHHLRDPLLDELANDLPFFSEDALQLLKFHGSYQQDDRDKREKGKDKTWQMMLRLRSPAGRIPAQLFLAMDDLSNRLGDGSLRATTRQAFQMHGIPKGDLKEVIGTIVENMGSTLAACGDINRNVMAPAAPYAKGAYPAARQLADEIADVLSPEAAESSYLDLWIDGDLSYRIRPSRSVKAARLRQRDAGVFSGSDDEPLYGDTYLPRKFKVAVTVPGDNSVDLLTQDIGLVAFTDAAGALLGCNVYVGGGMGRTHNKEETFARVADPLGYVAAGDVLDLVQSILALQRDHGDRQIRRHARMKYLLHDKGVSWFRTELTQNYFRGELKGLRNEPKAKLSDYLGWHRQQPGVWFVGIPLLCGRLEGSFKAGLRDIVDRYQLELRLTPNQDVLLCNIGSAQRNSVRDALSDLGMQMPEAPPPLARHAIACPALPTCGLAITESERILPKVLERLDAQLSRLEIEKSLLFRMTGCPNGCARPYMAELALVGSGVNQYQLWLGGSANLQRLAKPFLQRMPLDELESTLEPLLVSWKQAGGRRGFGDHVNRLGDERVAELLAAAHASPSTRP

SEQ ID NO: 56877 - protein, 300 aa, Oryza sativa
  misc_feature (277)..(277): Xaa can be any naturally occurring amino acid
MAVESPFRADVLRGKAALVTGGGSGIGFEIAAQLARHGAHVAIMGRRREVLDKAVAALRSHGLRAVGFEGDVRKQEDAARVVAATVQHFGKLDILVNGAAGNFLASPEDLTPKGFRTVVDIDTVGTYTMCYEALKYLKKGGPGKGPSTGGVIINISATLHYTAAWYQIHVSAAKAGVDSITRSLALEWGTDYDIRVNGIAPGPIEGTPGMRKLAPEEMAKGSREIMPLFKLGEKWDIAMAALYLASDAGKYVNGTTVVVDGGLWLSRPRHIPKEEVXKELSKVVEKKVRASGVGVPSSKL

SEQ ID NO: 56878 - protein, 295 aa, Picea sitchensis
MAMPIAAGAALSTLPSLSSSCSELNKWKPLNSNTHFHFNCNRSLNTARLSVRAMSSSTSVLTQDQLKKLAAEKAVEYVESGMVLGLGTGSTAAFAVARIGELMKAGELKDIVGVPTSKRTAEQAESLGIPLSVLDEHPKIDLAIDGADEVDPELNLVKGRGGALLREKMVEAASAKFVVIVDESKLVNGLGGSGLAMPVEVVPFCWKYNASRLQSLFQAEGCEAKLRMDGDGDKPYITDNANYIVDLYFKTPIKDSRAAAKAILGFEGVVEHGLFLDMATAVIIAGAEGVRVTTK

SEQ ID NO: 56879 - protein, 330 aa, Bacillus subtilis
  misc_feature (4)..(4): Xaa can be any naturally occurring amino acid
  misc_feature (63)..(63): Xaa can be any naturally occurring amino acid
  misc_feature (75)..(75): Xaa can be any naturally occurring amino acid
  misc_feature (77)..(77): Xaa can be any naturally occurring amino acid
  misc_feature (89)..(89): Xaa can be any naturally occurring amino acid
  misc_feature (127)..(127): Xaa can be any naturally occurring amino acid
  misc_feature (155)..(155): Xaa can be any naturally occurring amino acid
  misc_feature (210)..(210): Xaa can be any naturally occurring amino acid
  misc_feature (250)..(250): Xaa can be any naturally occurring amino acid
  misc_feature (255)..(255): Xaa can be any naturally occurring amino acid
  misc_feature (279)..(279): Xaa can be any naturally occurring amino acid
  misc_feature (316)..(316): Xaa can be any naturally occurring amino acid
  misc_feature (321)..(321): Xaa can be any naturally occurring amino acid
SNAXKELIKEHQKDINPALQLHDWVEYYRPFAANGQSANYIPALGKVNDSQLGICVLEPDGTXIHAGDWNVSFTXQXISKVISFIAACXSRGIPYVLDRVDVEPTGDAFNSIIRLEINKPGKPFNPXINAGALTIASILPGESAYEKLEFLYSVXETLIGKRPRIHEEVFRSEWETAHRNRALAYYLKETNFLEAEVEETLEVYLKQCAXESTTEDIALIGLILAHDGYHPIRHEQVIPKDVAKLAKALXLTCGXYNASGKYAAFVGVPAKSGVSGGIXALVPPSARREQPFQSGCGIGIYGPAIDEYGNSLTGGXLLKHXAQEWELSIF

SEQ ID NO: 56880 - protein, 530 aa, Synechococcus sp. WH 5701
MIVVVDDENRENEGDLICAAQFATPEQINFMATEARGLICLAMEGERLDALELPLMVDRNTDSNQTAFTVSVDAGPENGVSTGISADDRARTIQVAIHPASRPADLRRPGHIFPLRARQGGVLKRAGHTEAAVDLARLSGLYPAGVICEIQNPDGSMARLPQLASYARRHGLRLINIADLISYRLETERFVRRQAEAEMPSAFGQFRAIGYRNELDDSEHVAIVKGHPELASGPVLVRVHSECLTGDAFGSLRCDCRPQLEAALRMIEAAGEGVVVYLRQEGRGIGLINKLKAYSLQDGGLDTVEANERLGFPADLRNYGVGAQILSDLGVHHLRLITNNPRKIAGLGGYGLRVEDRVPLVMDPGQHNAAYLLTKQTKLGHLMHSGPAREHTGAGGPTAVISWSATTMAPEQAEAEHWPQLRQWASQRGLELLREEHPRLLALLGQPQLALLLAQQAGGDQRLAEADLLSALTLMAGWAGTRAVSLLLSPDAQRSAHPSSTLEPERRPLQELTQVSPQLVTTPGAFVRWG

SEQ ID NO: 56881 - protein, 704 aa, Ashbya gossypii ATCC 10895
MLTAVSWADKPALKQVTVRATLVGLFIGSLVLISNFQFGLQTGWVSMMSLPSALLACGIFRHIWPLLFAEYPPFSDVENVYVQSIAVAVGTGPLAYGFVGVLPAIEKFMTREESGGLRDPGDPFTLRQLLLWSLGLAFFGIFLAVPLRKQVIIREKLAFPSGSSTALLISVLNSSEILQEVTPQELVQMRRYRLARQEDEQPLVASAASVSPVGSVLSPNYMERREEAPPRPGQYASNVSILLRTFAVSSAYTLLSYFVPYIKAIPLFGRHLSETYLWNVQFSPAYIGQGMIMGFNTVFFIMIGCVLGWGILAPLARHMGWVPPDADINDWEKGVQGWVLWSSLAVMVADSVVGFIVLTVKATVKFLLIDNKADALNSFLDDSIESMLLEEQRELDVKGEGSIPVKLVNADQEHEVDSKYLVRCTTVISGWIVSSLICVISMIYLFGKDCIPIYSLLLALLIAIFLSILGVRALGETDLNPVSGIGKLAQIIFALVVPRDHKAAVLINLVAGSIAEAGAQQAGDLMQDLKTGHLIGASPRAQFTAQIIGASWSIVLSSVMYIFYNKVYEIPSQQFRIPTAFVWIDCARLVMGMALPPYALECSIILGSIFAVISLVKNCIDKDKYRWAQWLPSGVALGVGMYNSPSFSIARFIGGMLSYYWLRTRRGDAGAKTNMIIFSSGMILGEGVCSIVSMTLASIGTPHM

SEQ ID NO: 56882 - protein, 429 aa, Physcomitrella patens subsp. patens
MDNGSVATTISVTPCGFTSALCGMVAHAVPTAMQQRTLGFAAGVVVLMLAWDPPLIGPLAGLNFDWSNWNSSDIRPMLGINEWPCDPDNKLLQAQKLILQDASGPESLAFDSTGAGPYTGVSDGRILRWDGDEARWHTFGVTSSIRTEVCDVHPPLVRNEPVCGRPLGLRFDKHDNLYIADAYFGLLVMGPQGGVAKPVSTQAEGVPFRFVNDLDLDENGTVYFTDSSSRRPRSQCNIVTFEQDRSGRVLRYDPKTQQTTVLARELFYPNGIAVSLDSSFMLLSHTSKSRIGKYWLKGPKLGTLEEFAEVPGFPDNIRRTKEGDFWVALHSRVTKLQNFLANHWYLLRILYSLPLRFDFISWLTTGTPDAMVIKFNPNGEAIEAFEDRKGQNARLLSFADERDGVLWMSSVFMPSIWTLPLNASAASHL

SEQ ID NO: 56883 - protein, 335 aa, Ashbya gossypii ATCC 10895
MSAFMARKSNIGPEQSASVEKNNVELEQKVAIQSIRMFLKSKTSYDVLPVSYRLIVLDTSLLVKKSLNILLQNNIVSAPLWDSGTSKFAGLLTSLDFINVIQYYFSNPDKFELVDKLQLNGLKEIEKAIGVEPPDRGSIHPFKPLYEACCKMIESRARRIPLIDQDEDTHREIVVSVLTQYRILKFVALNCREIRYLKRPLHELNIITSTKMLSCSMSTPVIDVIQLLTTGGVSSIPIVDEQGKLINVYEAVDVLGLIKGGIYNDLSLSVGEALMRRSDDFEGVYTCTMGDKLSTILDTIRKSRVHRFFIVDENGLLTGVLTLNDILKYILYAEN

SEQ ID NO: 56884 - protein, 124 aa, Opitutaceae bacterium TAV2
MSNITKDQVIEWLSAQPVLELAALVKDLEAKWGVSAAAAVAAAPAAAAAAPAEEKTEFDVILANAGANKIGVIKEVRAITGLGLKEAKDLVEGAPKPVKEGASKADAEEIKKKLEAAGAKVELK

SEQ ID NO: 56885 - protein, 279 aa, Klebsiella pneumoniae
MTTDSILLNDGYYMPRPGCGLWLIDNRDVDSLIRQALKAGFRHFDTAQAYFNEDGVGRALRYTEVPREQLFITSKIRGRDMGYARTLVSFNETLERLGVEYLELFLIHWPIPAKNLYVETWEASIELEASGLIRSIGVSNFTCQHIERLIEDTGVVPAVNQLELHPHFQQCDVRDYHHEAGIAIQSYSPFGSNGAAVLRNAVVMVLARRHDHSPAQIVLRWHLQQGLTPLPRTTNGARFSENVDVWDFELSEEEMKLLASLNTRTGNTQPLPDAMNMSF

SEQ ID NO: 56886 - protein, 131 aa, Methanocaldococcus jannaschii DSM 2661
MPTAKFVVADPKTGRCYQIEADNTPLVGKKIGEVFDGKIIGLEGYKLQIRGGTDSSGFPMRPDIHGSRKVRVLLSAPPGFKPKRKGERRRKTVRGNTIAPDIVQINVKVVEYGEKSIPELLGLEGGENQEQ

SEQ ID NO: 56887 - protein, 261 aa, Candida glabrata CBS 138
MVAPTAVKRQEEATAGPSRILGDGAPTAMIDEDDDEILIDQDMEEEAPKKSKKEAAGVVLDESGKPRFGAAKDQATTKVKLESRKVPVPPHRMTPLRNSWNKIYPPLVDHLKLQVRMNLKTRTVELRTHPKHTTDPGALQKGADFIKAFTLGFDLDDSIALLRLDDLYIETFEVKDVKTLTGDHLSRAIGRIAGKDGKTKFAIENATRTRIVLADSKIHILGGFTHIRMAREAVVSLILGSPPGKVYGNLRTVASRLKERY

SEQ ID NO: 56888 - protein, 136 aa, Echinacea angustifolia
LDAAGKTTILYELKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCA

SEQ ID NO: 56889 - protein, 437 aa, Physcomitrella patens subsp. patens
MTKVFSIILGGGAGTRLNPLTLRRAKPAVPLGGGYRLIDVPMSNCINSGINKIYVLTQFNSTSLNRHLARTYNFGNGCNFGDGYVEVLAAAQRPGSGGDKWFEGTADAVRQYLWLLEDAKNKDVEDVIILSGDHLYRMDYEDFVQKHKDSGADVTVSCVPIDDSRASDYGLMKIDGKGQIRHFSEKPKGDDLHAMQVDTTVLGLSGEEAKKKPYIASMGVYVFKKSVLAKLLRWRYPLANDFGSEIIPQAAKEFNVQAHLFNGYWEDIGTIKSFFDANLALTAENPKFSFFDAAKPIYTSARYLPPTKIEKCRVKDSIVSHGCFLRECSLENSVIGVRSRLESGCDVKRSMVMGADFYETDPEAAALLAEGKVPLGVGENTKLRNCIVDKNARIGSNVVITNADNVFEAARPNEGFYIRSGIVVVCKNAVIKHGTVI

SEQ ID NO: 56890 - protein, 136 aa, Echinacea angustifolia
LDAAGKTTILYKLKLGEIVTTIPTIGFNVETVEYKNISFTVWYVGGQDKIRPLWRHYFQNTQGLIFVVDSNDRDRVVEARDELHRMLNEDELRDAVLLVFANKQDLPNAMNAAEITDKLGLHSLRQRHWYIQSTCA

SEQ ID NO: 56891 - protein, 136 aa, Echinacea angustifolia
LDAAGKTTILYKLKLGEIVTTIPTIGFNVETVEYKNISFTVWDVGGQDKIRPLWRHHFQNTQGLIFVVDSNDRDRVVEARDELHRMLNEDELRDAVLLVFANKQDLPNAMNAAEITDKLGLHSLRQRHWYIQSTCA

SEQ ID NO: 56892 - protein, 425 aa, Flavobacteria bacterium BBFL7
MSTATKNGSQHYIDLEDAHGAHNYHPLPVVLEKGDGVYVWDVVGKRYYDFLSAYSAVNQGHCHPAIVGAMSQQAQTLTLTSRAFHNDKLGVYEKYMTEYFGFDKVLPMNTGAEAVETAIKIARKWAYEKKGVEEHEAKIIVAENNFHGRTTTIISFSNDEGARKNFGPYTPGFIKIPYDDTAALEEALQQDNVAGFLVEPIQGEAGVYTPDDNYMRASQELCKKYNALFIADEIQTGIARTGALLAVCGKCDCAGHCEKQAATYAQPDVLILGKALSGGAYPVSAVLASNDIMNVIKPGQHGSTFGGNPVAAVVGMAALDVVKDEKLAQNARALGNYFRARINEYIETTDTVTLVRGRGLLNAIVINDSEEGDTAWNICLKLRDNGLLAKPTHGNIIRFAPPLVMTQEQLDECIDIIIKTLKSFE

SEQ ID NO: 56893 - protein, 504 aa, Azoarcus sp. EbN1
MNKLDPARYGLNLKGRYGNYIGGQWLPPVAGRHFDNITPITGKPLCEIPRSDEQDVELALDAAHKAKAAWGRTSAAERAGVLNRIADRMEANLETLAQVETWDNGKPIRETRAADIPLAIDHFRYFAACVRAQEGSLGEIDHTTVAYHFHEPLGVVGQIIPWNFPLLMAAWKLAPALAAGNCVVLKPAEQTPLSILVFAELVGDLLPPGVLNIVNGFGVEAGKPLASSKRIAKIAFTGETGTGRLIMGYASQNLIPVTLELGGKSPNIFFDDVAAQDDAFFDKAIEGFVMFALNQGEVCTCPSRALIHESIYERFIERALKRVAEIRQGNPLDPATMIGAQASREQMDKIQSYLAIGRDEGAELLAGGERAHLDGELEGGFYIQPTVFRGHNKMRIFQEEIFGPVVSVTTFKDRDEALAIANDTPFGLGAGVWTRNINTAFHMGRHIEAGRVWTNCYHAYPAHAAFGGYKQSGMGRETHKMMLDHYQQTKNLLVSYSEDKLGFF

SEQ ID NO: 56894 - protein, 215 aa, Vitis vinifera
MANAWKRDRPPRLLSPRILLLLFSSSLLLLIFLFLSSRTSNPSPIPVSALKTLIPSRTIQPFDCFKCPQSHPVIANIVEGVKYPFLYSLSDFGTLPDKPHKNIVRILKGKPFRKPDISLTVQEILEKMKDQGKNGFVVDVGANVGMATFAAAVMGFRVLAFEPVFENLQRICDGIFFNRVGESVTVFEAAASDRLGNITFHKFFMGKSCDNYVEF

SEQ ID NO: 56895 - protein, 558 aa, Porphyromonas gingivalis W83
MIGSYFRPKLLDVFHGYNRERFMADLMAGVIVGIVALPLAIAFGIASGVSPETGLITAIIGGFIVSLLGGSSVQIGGPTGAFIVIVYGIIHKYGIEGLTIATIIAGILLLVMGVLRLGTLIKFIPYPIVVGFTAGIALTIFSTQMNDLFGLGITDMPGDFLGKWGAYFTNFKSVNLWAFGMGLLSIVIIMLSPRFTKKIPGSLIAIILMTVAAYLLRLQGIGEFETIGDRFTISAQLPKPTGVTLSLETIRQLFPPAFTIALLGAIESLLSASVADGVIGEKHNSNTELIAQGAANIVVPFFGGIPVTGAIARTMTNINNGGRSPIAGIIHAFVLLLILLFLGPLTAYIPMACLAGVLIIVSYNMSGWRSVANIGRGPRSDSLVMLVTFLLTVILDLTVAIEIGLLLAILLFMKRVTENTRITVATGRLDLTQTGEIAHHDEVLDIPKGVEVYEIEGPFFFGIANRFEEIMNTLGDHPDVRIIRMRHVPFMDSTGMHNLENLIKMSRKEGVSIVLSGVRKDVHEELATAGIVELLGEENVCADIQAALRQAQAIAQGA

SEQ ID NO: 56896 - protein, 382 aa, Oryza sativa
MGKIKIGINGFGRIGRLVARVALQSEDVELVAVNDPFITTDYMTYMFKYDTVHGQWKHSDIKIKDSKTLLLGEKPVTVFGIRNPDEIPWAEAGAEYVVESTGVFTDKEKAAAHLKGGAKKVVISAPSKDAPMFVCGVNEDKYTSDIDIVSNASCTTNCLAPLAKVIHDNFGIIEGLMTTVHAITATQKTVDGPSSKDWRGGRAASFNIIPSSTGAAKAVGKVLPDLNGKLTGMSFRVPTVDVSVVDLTVRIEKAASYDAIKSAIKGYRSVMSASEGKLKGIIGYVEEDLVSTDFVGDSRSSIFDAKAGIALNDNFVKLVAWYDNEWGYSNRVIDLIRHMGQDPVESFCLPWYSMAAEPEIPVCFVYAENKTWTVFIRTHPLC

SEQ ID NO: 56897 - protein, 162 aa, Porphyromonas gingivalis W83
MKKPFRIGFGFDVHRLSEGYPLWMGGVRLEHSKGLEGHSDADVLIHAICDALLGAAALRDIGYHFPPSDPQYKGIDSKILLARVMELVRSQGYELGNIDATIAAEQPKLNPHIPDMQRVLAEVIQVEVSDISLKATTTEKLGFTGREEGISAYAVALLIAAV

SEQ ID NO: 56898 - protein, 330 aa, Sinorhizobium meliloti 1021
MKPLDRIIDAARKAPRHVVLPEGEDPRIVAGAVQARREGLAAITLVGNREVITQRLAALDAIPQEFRIEDPACSPLTDDFATAYLERRRSKGVDAAAARAAVLSPLTFAAMMVREGIADGTVGGAVATTADTVRAALQVIGRAPGVGLVSSFFLMMLCEPHHARKGAFVFADCGLVVDPDAAGLADIARMSAKSYEMLAGERAKVAMLSFSTGGSAAHERVSKVVEATGMARRAEPDLIIDGELQFDSAFVEAVCLTKAPHSALRGEANVFVFPNLDAANIGYKIAQRIGGATAIGPILQGLSRPANDLSRGCTAADVFHMIAVTVVQAA

SEQ ID NO: 56899 - protein, 580 aa, Pseudomonas syringae pv. tomato
MDATTINSLFLIGALLVAASILVSSLSSRLGIPILVIILAVGMVAGVDGGGIIFDNYATAYLVGNLALAVILLDGGLRTRVASFRVALWPALSLATVGVLITTVLTGMVAAWLFNLSVIQGLLIGAIVGSTDAAAVFSLLGGKGLNERVTASLEIESGSNDPMAVFLTVTLIGMLASGQTGLHWGLLGHLIQEFGIGSFIGLGGGWILLQLVNRINLAAGLYPILVIAGGLAIFALTNAIHGSGFLAVYLCGLVLGNRPIRSRHGILHMLDGMAWLAQIGMFLVLGLLVTPHDLLPIAIPALGLALWMILVARPLSVMVGLLPFKAFHGREKAFIAWVGLRGAVPIILAVFPLMAGLPNAQLYFNLAFFIVLVSLLLQGTSLPWMAKLLKVTVPPDPAPISRAALEVHVTSEWELFVYRLGAEKWCIGAALRELKMPEGTRIAALFRGQQLLHPSGSTTLEVGDLLCVIGHEHDLPALGKLFSQAPQRGLDLRFFGDFVLEGDARLGEVAALYGLKLDGIDPGMPLSQFIVQKNRGEPVVGDQIEWNGTIWTVAVMDGNKIQKVGVKFPEGTRPGPGLFL

SEQ ID NO: 56900 - protein, 140 aa, Methanocaldococcus jannaschii DSM 2661
MKERTFVALKPDAVKRKLIGKIIERFENKGFEIVAMKMIKLDREMAEKYYEEHKGKEFYERLINFMTSGRMIVMVVEGENAISVVRKMIGKTNPAEAEPGTIRGDFALTTPDNIIHASDSKESAEREIKLFFKEDEIFDK

SEQ ID NO: 56901 - protein, 302 aa, Physcomitrella patens subsp. patens
MDEYEKLEKIGEGTYGKVYKARNKSTGRLVALKKTRLEMEDEGVPSTALREVSLLQMLSHSIYIVRLLSVESVDENGKPQLYLVFEYLDSDLKKFIDSYGRGSGNPIPAKTIQSFMYQLLKGVAHCHGHGVMHRDLKPQNLLVDKEKGLLKIADLGLGRAFTIPLKSYTHEIVTLWYRAPEVLLGSSQYSTSVDMWSVGCIFAELSRKAPLFPGDSELQQLLHIFRLLGTPTEESWPGVKKLRDWHEYPQWQPQNLSRAVPDMGPEALDLLTRMLMFDPAKRVSAKAALNHPFFDDLDKSQF

SEQ ID NO: 56902 - protein, 368 aa, Oryza sativa Japonica Group
MAAELPQQKAGGGLARRLVRLLRRKRSTSGSVAGGGEYDESSMDSSINSLSKLKLSAAKLDVLFRSAAQPAASPAVDAAAAHALVASLFAGVSAVKAAYAQLQQAQHPYDLRGDPVGGRRDGRRAHQTLRPQAEGRIRSFAKSMLGEMRRAGWDPVAAAAAAHPGVPLRHPGDAKFALESFVALKMFDGFHRRDFGLSALHDRSSYDRRRLFDEFAELKAAPAAEFLDARSSRYLSVVHERMEAAFFGSTAQRGAAASAGAALPGTPWFAEFAEMARRVWLLHCLFLAFDDGGASTIFQVAAGARFSEVYMESVGDGDGDGDDGGAGTAVAAAAAGDRVVGFTVVPGFKVGRTVMQCRVYLSRPARQP

SEQ ID NO: 56903 - protein, 237 aa, Desulfovibrio vulgaris subsp. vulgaris str. Hildenborough
MNTPLAERYAAVRHRLETAVRRAGRAPADVTLVAVSKYHPAEAVAAVAALGQRDFGENYVQEALQKQEALAGEDILWHCIGHVQSRKAKDVAGRFALIHTVDSEKLAHNLHKALWRPEDDTCPVVQDVLLQVNIGEEVQKSGIDAAETARLAETVLQLPTLRLCGLMCLPPFFDDGEAARPFFAALRKLRDDLELSLGVPLPHLSMGMSGDFEQAVEEGATIVRVGTDIFGPRPPRP

SEQ ID NO: 56904 - protein, 258 aa, Mycobacterium tuberculosis H37Rv
MAADLSAYPDRESELTHALAAMRSRLAAAAEAAGRNVGEIELLPITKFFPATDVAILFRLGCRSVGESREQEASAKMAELNRLLAAAELGHSGGVHWHMVGRIQRNKAGSLARWAHTAHSVDSSRLVTALDRAVVAALAEHRRGERLRVYVQVSLDGDGSRGGVDSTTPGAVDRICAQVQESEGLELVGLMGIPPLDWDPDEAFDRLQSEHNRVRAMFPHAIGLSAGMSNDLEVAVKHGSTCVRVGTALLGPRRLRSP

SEQ ID NO: 56905 - protein, 582 aa, Oryza sativa
TLHHHCHLLSRGRLANMHSANLLRASSKAINTPSVRCLSTSSTARLAQPAAAAAASSGAAKAQLSPLALSRAKDVGSKWQGTSMLGGTTKNYVDGKFVDSSTSSWLDVNDPSTQALLSKVPLTTPSEFDAAVANAHAAFPAWRETSLLSRQQVMFKLQALLRDHMDDIANAIVLEQGKTFADAKGDVLRGLQVVEVACGITSTLMEERVEVSKDMDTYARREPLGVTAAIAPFNFPAMIPLWSIPMATVTGNTLVLKPSERVPGASMIIAELCERAGMPKGVLNVVNGAVDVVNGICDDPRIKAISFVGSDRAGAHIYHRGTANGKRVQANLGAKNHAILMPDANKNFALNSIAGAAFGAAGQRCMALSVVVAVGEAQSWVPELVERAKQLKVSGGFEEGADLGPLISPQARERVRSLTGSVEQEGGRILLDGRDFVCADYPNGNFVGPSVVEAGPGMKAYDQEIFGPTLVVVKADSLDQAVDYINKNKYGNGAAIFTTNGATARKFEKNVNAGQLGVNVPVPVPLPMFAWSGNKGSVLGDIGFYGKSALNFYTSFKTSTSLWRSDDAQMSERASVNMPTMS

SEQ ID NO: 56906 - protein, 161 aa, Porphyromonas gingivalis W83
MATAYHNLSDYDYESVPCGKDLRIGIAVAEWNHNITEPLMKGAIDTLLEHGVSADNIIVQHVPGTFELTYASAYLAEQHEVDAVIAIGCVVRGDTPHFDYICQGVTQGITQLNIDGFVPVIFGVLTTETMLQAEERAGGKHGNKGTEAAVTALKMAGLERI

SEQ ID NO: 56907 - protein, 642 aa, Mycobacterium avium 104
MPVTTESARAAGPDPYDVGELRANLRQADPGVLVAVLAQLTGDPAVADRFAPKITHVPDPPEQAGVTDPETAAQLVDEIVTALRTPRRADAVPADDLDLFARVAPVALGGEVGPEYLGLLLEQGGFQPSQPVLPRTAKLPAGFRVVIIGAGIAGITAALACADAGIEYQIIERNDEVGGTWYTTRYPGIGVDTPSAYYSLSRDINGDWSSYYPQGAEYQAYLVSVADKNDLRKHTRFGTEVEALWWQERRRQWQIHSVGPDGTRDVSYANVVIPAAGYLNRPRWPELAGRETFSGISIHSAHWDLELDLTGKRVAIIGAGCTAVQIVDACVDQVAHLTVFQRQPHWVAPRRRASDDVPAYQRWLGTRLPYYANWIRLKSYWGTADTNYPVILHDPQWAAEHLSVSPANDVLLRMCLDYIDRVFGAGSELARKVTPDFAPYGKRIIRDPGGYYAALAREHVDVEASEPARVNQAGIVTADGRQIDLDVIIYATGYYLDFLSTVDIRGRDGKKLTDEWGDAPRAYRGGMVPGFPNMFISSAPNYSPGHGAGHNFGVEVMVHYVMECLQLMALRRATTVEVTQRAYEEYVADIDALMAGTVWCHTPSAHTYYRSGGGRIVTAFPYRLVDFWRDHRAPSEEDLELR

SEQ ID NO: 56908 - protein, 197 aa, Brassica napus
MAKTDAFDSDPTAIAKAKELKREMKKLLMNMEEEDGFSVQTIDHLQEALSAFKQATMRKMARSSSLEMLETVSCPEEFRCPLSKELMRDPVVLASGQTYDKLFIQKWLSSGNRTCPKTQQVLPHTALTPNLLIRDMISKWCKTVGLETTTYQSSLVDEEKAVTRSDREIFNSLLCKLSSSNLQDQKSAAKELRRLTK

SEQ ID NO: 56909 - protein, 508 aa, Magnaporthe grisea 70-15
MLSTRLISGPAARSAFRKSTLPTVVAPNSLSRWRRSYASEAEQKDLVIIGGGVAGYVAAIKAGQQGMKVTCIEKRGTLGGTCLNVGCIPSKSLLNNSHLYHQILHDTKNRGIEVGDVKLNLQQLMKAKDTSVGGLTKGVEFLLKKNGVEYLKGTGSFVNEHEIKIALNDGGETSRTAKNILIATGSEATPFPGLEIDEKRVVTSTGALALEKVPETMTVIGGGIIGLEMASVWSRLGAKVTVVEYLGQIGGPGMDTEIAKSAQKILKKQGIEFKLNTKVNGGDTTGDKIKLDIDAAKGGKAESIESDVVLVAIGRRPYTGGLGLENVGLETDDRGRVVIDSEYRTSHPHIRCVGDVTFGPMLAHKAEEEAVAVVEYMSKGYGHVNYAAIPSVMYTHPEVAWVGQSEQDLQKAGIQYRVGTFPFSANSRAKTNLDTEGMVKMLADPETDRILGVHIIGPNAGEMIAEGTLALEYGASSEDIARTCHAHPTLAEAFKEAAMATHAKAIHF

SEQ ID NO: 56910 - protein, 461 aa, Vitis vinifera
MGSSSSKRTSFRSASSSSRSNHGGYSQSDYGQEYQNYPPQQPSYPSYAPPQQPYPSYAPPQQYQSHEPPQQNYSSSQGNGDNRRRLERMYSRIADDYRSLDEVTAALARAGLESSNLIVGIDFTKSNEWTGARSFNRQSLHHVGDGLNPYQQAISIIGKTLAAFDEDNMIPCFGFGDASTHDQDVFSFYEDERFCNGFEEVLSRYREIVPRLRLAGPTSFAPIIEMAMTIVNHSGGQYHVLVIIADGQVTRSVDTAHGQLSPQEQKTVEAIVEASKLPLSIILVGVGDGPWDMMREFDDNIPARAFDNFQFVNFTEIMSKNVDLSRKETEFALAALMEIPSQYKATIELNILGGRKGDAPERVPLPTPMYYGATSFFNSSKPSRTTSFQPSVPPYPEDSSPVGTAPPATSSTFDNQLCPICLTNVKNMAFGCGHQTCCECGPDLETCPICRSPIQTRIKLY

SEQ ID NO: 56911 - protein, 315 aa, Arabidopsis thaliana
MVEPYETRNNGEASQMIRYQSYNHHNSRLPSSLSSPLLDLRVFYVRISNFKVDHSTPEVLTITHIPLDPDSLLEINGVRMSMYSEGVSSQLRRDRVDKKSEVATFISTDNIRLSGSVKFEVYDKDELVLSGTLEMPGSNGFTGESKHSVKRWNMNCEAEITAESGFLKEKHIGGSELSSPLPTIEVYVTGCFSGTPIILTKTLQLGFRKKHGRVTALDSIPEYETDEPHKGNSSELDYQVTEYGSYKQEYEGEHSDMYWNREYADGEDGEMSWFNAGVRVGVGIGLGVCVGLGIGVGLLVRTYQSTTRNFRRRII

SEQ ID NO: 56912 - protein, 405 aa, Arabidopsis thaliana
MDSVFSNVARAPEDPILGVTVAYNNDPSPVKINLGVGAYRTEEGKPLVLDVVRKAEQQLVNDPSRVKEYIPIVGISDFNKLSAKLILGADSPAITESRVTTVQCLSGTGSLRVGAEFLKTHYHQSVIYIPKPTWGNHPKVFNLAGLSVEYFRYYDPATRGLDFKGLLEDLGAAPSGAIVLLHACAHNPTGVDPTSEQWEQIRQLMRSKSLLPFFDSAYQGFASGSLDTDAQSVRTFVADGGECLIAQSYTKNMGLYGERVGALSIVCKSADVASKVESQVKLVVRPMYSSPPIHGASIVATILKSSDMYNNWTIELKEMADRIKSMRQQLFEAIQARGTPGDWSHIIKQIGMFTFTGLNKEQVEFMTKEFHIYMTSDGRISMAGLSSKTVPHLADAMHAAVTRLG

SEQ ID NO: 56913 - protein, 143 aa, Zea mays
  misc_feature (115)..(115): Xaa can be any naturally occurring amino acid
  misc_feature (118)..(118): Xaa can be any naturally occurring amino acid
  misc_feature (120)..(120): Xaa can be any naturally occurring amino acid
  misc_feature (127)..(127): Xaa can be any naturally occurring amino acid
MRAVAAASPPLRALLLLSRHPRAGFTNWPSLPRGQNAGPTAPPGATAPKPAPSRRGRGLTASLPRQVARISTPHLRAPATPPRCPDRRHQSHGVRALAGCPRKTAVRRDNKQRFXLLXEXGELLIRXNQGHTVTTVTSESLLK

SEQ ID NO: 56914 - protein, 403 aa, Arabidopsis thaliana
MNSILSSVLPAPEDPVLSVIFACRDDPSPVKLNLSAGTYRTEEGKPLVLDVVRRAEQQLANDLDKEYLPLNGLPEFNKLSTKLILGDDSPALKENRVVTTQCLSGTGSLRVGAEFLATHNKESVIFVPNPTWGNHPRIFTLAGLSVQYFRYYDPKSRGLDFKGMLEDLGAAPPGAIVVLQACAHNPTGVDPTFEQWEKFRRLVRSKSLLPFFDSAYQGFASGSLDADAQAVRMFVADGGECLIAQSYAKNMGLYGERIGSLTIVCTSEDVAKKVENQVLLVVRPMYLTPPIHGASIVATILKNSDMYNDWTIELKGMADRIISMRQQLYAALEARGTPGDWSHIIKHIGMFTFTGLSEEQVRLMAKEYHIYMTYDGRISMASLSSKTVPQLADAIHAVVTRIA

SEQ ID NO: 56915 - protein, 506 aa, Saccharomyces cerevisiae
MPTLYTDIEIPQLKISLKQPLGCFINNEFCPSSDGKTIETVNPATGEPITSFQAANEKDVDKAVKAARAAFDNVWSKTSSEQRGIYLSNLLKLIEEEQDTLAALETLDAGKPYHSNAKGDLAQILQLTRYFAGSADKFDKGATIPLTFNKFAYTLKVPFGVVAQIVPWNYPLAMACWKLQGALAAGNTVIIKPAENTSLSLLYFATLIKKAGFPPGVVNIVPGYGSLVGQALASHMDIDKISFTGSTKVGGFVLEASGQSNLKDVTLECGGKSPALVFEDADLDKAIDWIAAGIFYNSGQNCTANSRVYVQSSIYDKFVEKFKETAKKEWDVAGKFDPFDEKCIVGPVISSTQYDRIKSYIERGKREEKLDMFQTSEFPIGGAKGYFIPPTIFTDVPQTSKLLQDEIFGPVVVVSKFTNYDDALKLANDTCYGLASAVFTKDVKKAHMFARDIKAGTVWINQSNDEDVTVPFGGFKMSGIGRELGDNVVDTYLQTKSVHMDLSLDN

SEQ ID NO: 56916 - protein, 258 aa, Bacillus cereus ATCC 14579
MLKFLSVRVEDHIAVATLNNAPANAMSSQVMHDVTELIDQVEKDDNIRVVVIHGEGRFFSAGADIKEFTSVTEAKQATELAQLGQVTFERVEKCSKPVIAAIHGAAMGGGLEFVMSCHMRFATESAKLGLPELTLGLIPGFAGTQRLPRYVGKAKACEMMLTSTPITGAEALKWGLVNGLFSEESLLDDTLKVAKQIAGKSPATTRAVLELLQTTKSSHYYEGVQRESQIFGEVFTSEDGREGVAAFLEKRKPSFSGR

SEQ ID NO: 56917 - protein, 323 aa, Physcomitrella patens subsp. patens
MEPRVGNKYRLGRKIGSGSFGEIYLGTNVQTNEEVGIKLESIKTKHPQLLYESKLYRILQGGTGIPNIRWFGIEGDYNVLVLDLLGPSLEDLFNFCSRKFSLKTVLMLADQLINRVEYVHAKSFLHRDIKPDNFLMGLGRRANQVYIIDFGLAKKYRDPSTHQHIPYRENKNLTGTARYASINTHLGIEQSRRDDLESLGYVLMYFLRGSLPWQGLKAGTKKQKYEKISEKKMSTPIEVLCKNYPSEFASYFHYCRSLRFDDKPDYAYLKRIFRDLFIREGFQFDYVFDWTILKYQQSQISGGSSTRLVCEISRRVVLMISVR

SEQ ID NO: 56918 - protein, 241 aa, Arabidopsis thaliana
MEYVNPEGLRLDGRRFNEMRQIVAEVGVVSKADGSAVFEMGNTKVIAAVYGPREIQNKSQQKKNDHAVVLCEYSMAQFSTGDRRRQKFDRRSTELSLVIRQTMEACILTELMPHSQIDIFLQVLQADGGTRSACINAATLALADAGIPMRDLAVSCSAGYLNSTPLLDLNYVEDSAGGADVTVGILPKLDKVSLLQMDAKLPMETFETVFALASEGCKAIAERIREVLQENTKQLEYRRAA

SEQ ID NO: 56919 - protein, 139 aa, Oryza sativa Japonica Group
MDQEQGERELQLLLPAAASAAAAASRVLRRPAVPSPSPPPPPPPVVDVRAVRQQTADQMRQASAHRAYAERVREMARAELELAEREFARARAIWERAREEVERVERMKEIAARRLGIGPAAASAALEITCHACMQRFHP

SEQ ID NO: 56920 - protein, 378 aa, Trichodesmium erythraeum IMS101
MRSEKNRQRSELLGTQIITRDKGKRLGVVSQLWVDVDKREVVAIGLRDNILAVAGIPKFMFLKDVCEIGDVILVDDEEVIEEDIDTEAYSGLINSEVLTENGDFLGRVRDFKCDVRDGKVLSLIIASIGIPQIPDQIISTYEMPIDEIVASGPNRLIVFEGSEEKLQQLTVGVLERLGLAEAPWQKEEEGLYNPPTVNPDNQLGPGQLVSREPIRTARRSTQETWDDNWVEPEPVESRVIEPEPVYRKYYEQEMAPPPRQREQEAVYDNYYEPEPVAPPSARQVRVEPADNDYYEEEGNWGDSETGYDNEQDRYQKKEDGYQKKEDGYQKKEYKATSEYEYDEEIDRDAWADDEAPKPYQAPRVNIPEKTKVPEYEDY

SEQ ID NO: 56921 - protein, 182 aa, Shigella flexneri 2a str. 301
MQFNIPTLLTLFRVILIPFFVLVFYLPVTWSPFAAALIFCVAAVTDWFDGFLARRWNQSTRFGAFLDPVADKVLVAIAMVLVTEHYHSWWVTLPAATMIAREIIISALREWMAELGKRSSVAVSWIGKVKTTAQMVALAWLLWRPNIWVEYVGIALFFVAAVLTLWSMLQYLSAARADLLDQ

SEQ ID NO: 56922 - protein, 256 aa, Daucus carota
MSQQQPRRPQQEQPIKYGDVFDVSGQLSSQPVAPNDASAMQAAENMVLGKTQKGGPASVMQSAAAANLQRGVVGPHEGTPIASEQGVTISEAEIAGTRIITEAVGGQVVGQYLEPGKFKMPSPAGVLGSDSITIGEALETTALTAGDKPVDQSDAAAIQAAEVRASGYAYPGGVAAAAQSAADYNARTMNVASKTKLGDVLADRSIRLAEDKAVTREDAEGVVGAEVRNNPEMMTYPGGVASSMAAAARLNQDPTF

SEQ ID NO: 56923 - protein, 324 aa, Physcomitrella patens subsp. patens
MEPRVGNKYRLGRKIGSGSFGEIYLGTNLVTHEEVGIKLESIKAKHPQLLYESKLYRILQGGTGIPNIRWYGIEGDYNVMVLDLLGPSLEDLFNFCSRKFSLKTVLMLADQLINRVEYVHAKSFLHRDIKPDNFLMGLGRRANQVVYMIDFGLAKKYRDPTTHQHIPYRENKNLTGTARYASINTHLGIEQSRRDDLESLGYVLMYFLRGSLPWQGMKAGTKKQKYEKISEKKMSTPIEFLCKAYPSEFASYFHYCRSLRFDDKPDYAYLKRIFRDLFIREGFQFDYVFDWTILKYQQTHFSGGPLRPAVISLMQPEAFVFANL

SEQ ID NO: 56924 - protein, 653 aa, Desulfovibrio vulgaris subsp. vulgaris str. Hildenborough
MASSSAVDPKGEGEGAQARGSSSGQANQVGQAGEAGEAEEAHTATDAGARTGLSPWQRLRHAALPFLDDLQGYTSRTFRHDVLAALTVAVVALPQSMAYAVIAGVHPKYGLYAAMLPVIVASLWGSSRYLIAGPTNAIAMLLFASLAETAVDGVLIGAMPEETRMAYIFGVAILAGAIQVGMGLARVGELVHFISHSVIVGFTAGAAVLIAVGQLRNLLGVSFAAAPDFPTQVLRTLVHLPQTNPWALGVGLATIALALALRYAPRNLPGPFIAIVVAAAATQLLGLEAHGVRVVGDIPQGLPPLSLPPAPDGDAIRMLFMPALAIALLGAVEALSIAKTLAGAKGEPVDGSREFVAQGLANMAAGLTSGIPGSGSFTRSAVNFTAGARTRFSGAFTGVLTLLAVLAFAPLARAIPVASLAGILCIIAWGMIDRDGIRLSLRATRADRAVLLCTFGATLLLDLEKAVFVGVLLSLGLFLRKVSHPRVVRLDASGSSELRGLDGGPCCPNLAVYAIEGTLFFGAIDELEKKLYEYENFGHKAVVLHLRQVHWIDATGVHAFERFLRKCRDKGVTLVLSGARPQVRRVLVDAGLIEHIGEANVTADLSSALNHCYTTCLRDEVCATCKAGNHGECRRQGAAMCEVDAERHPVAQE

SEQ ID NO: 56925 - protein, 167 aa, Candida albicans SC5314
MKPTLIPELSHKGIKEIAAGEHHTLALTEDGQVYAWGRYDMKEIGIPKDKLPKSTFKDQHGNPRSVPVPTKLEFAVKIKTIGVGSHHSFAVTEDGVVYAWGFAETYGPGLGPSIDDVEKPTRIVNTATKNEDILLIGAGGQFSVSGGVKFEDEEKAEVRLDKYEDLE

SEQ ID NO: 56926 - protein, 148 aa, Rhizobium leguminosarum bv. trifolii
FYTNSGSESVETALKVALAYHRVKGNGSRFRLIGRERGYHGVNFGGISVGGIVTNRKMFGTLLTGVDHMPHTHQPGKNNFTRGEPEHGGDIATELERIVTLHDASTVAAVIVEPVAGSTGVLIPPKGYLQKLREICTKHGILLIFDEE

SEQ ID NO: 56927 - protein, 515 aa, Arabidopsis halleri subsp. gemmifera
SRQENSPKRPNDSNGEFKRLLVPETSHPEDERRESPPENQVLNVEEDRDKIYDSVPPFSWAKLWKFTGPGFLMSIAFLDPGNIEGDLQAGAVAGYSLLWLLLWATLMGLLMQLLSARIGVATGRHLAEICRNEYPSWARILLWFMAEVALIGADIQEVIGSAIALQILTRGFLPIWVGVIITSFDCFLISYLEKCGMRKLEGLFAVLIATMALSFAWMFNETKPSVEELFIGILVPKLGSKTIREAVGVVGCVITPHNVFLHSALVQSRKTDPKEINRVQEALNYYTIESSAALFVSFMINLFVTAVFAKGFYGTKQADSIGLVNAGHYLQEKYGGGVFPILYIWGIGLLAAGQSSTITGTYAGQFIMEGFLDLQMEQWLSAFITRSFAIVPTMFVAIMFNTSEGSLDVLNEWLNILQSMQIPFAVIPLLTMVSNEHIMGVFKIGPSLEKLAWTVAVFVMMINGYLLLDFFMAEVEGFLVGFLVFAGIVGYISFIIYLVSYRSSQSSSWSSLEMS

SEQ ID NO: 56928 - protein, 388 aa, Methanocaldococcus jannaschii DSM 2661
MESYYYVFFIILSIIFIVPNLLKKFNIPAITSIMIAGIIIGPYGLNILQVDETLKILADFGAIMLMFLAGLEVDNETLKQEFKNSLILSLFSLLIPGVGGYLIGQYLGLGFIGSLLYAVIFASHSVAIVYAILEELKMVKTRLGTIILSATIIVDLFTLLLLSVVIKLGIGGENVGTFLLETVLYIGVLLLAIPSLSKNILGVFEKLHAQRIHYVLFIIFIAIIVGEVIGIHPIVGAFICGVAVSEALTKEEHDELLNKNLNAIGYGFFIPIFFLVLGMETNIRVIFNLSNLELLLITLISAVALKFISGFIALRILGFDRIKNTIGGLLTVPKISASLVAASIGRELGLIGNEIFVTIVALSVITATITPIVVKHIFVAKCNKKAKN

SEQ ID NO: 56929 - protein, 383 aa, Ashbya gossypii ATCC 10895
MSQLLPQAYLTNFHNRIRNEDVPLFITAAPTRNHKRAKVVNYSEYDNDLLLDDFIEQDQNDDDEKVHSDNGKGEGEEVGHEDAVASNNNLPDLEQQDDPTGILRYPRIRETFLQSKIAVRYEQVLEAGVGGSGEAVGIAEDEGAGAYSSSSQPVVIPIRLNLEHNGHKIIDFFTWNLNDHSLTLEQFAQIYCQDLDFAHNLSLQNQIVAAINDQLQEYETLASVVVPDLHVIINLTCNLDSKLYEDNFEWNLNDQTLSPEQFAELVVQDLGLTREFMPAIAHALYESILKIKKDWLEGHLNPEHVANGAAFGCLSGIRLDIDTLGSNWCPKVEVLSQWEIEKREIEKERNMRRLKRESAKVDDRLARRRGKRRMDDLETTMRI

SEQ ID NO: 56930 - protein, 492 aa, Physcomitrella patens subsp. patens
MGSSWSNRLGFCNSPVLVAEASLRPGQFAEPSVTAEEMEIYEKQLTEEEGVIVYLNSIGVDTASLDELEVDLPTSLAIVRERVEFLLKIGLTVEDINDYPLILGYSVRRNLIPVLTFLEELGVTSQSLPILVRKYPQVLHSSVVVDLLPHVEYLEGLGIRRADMGSVLTRYPNLLGFKIEGTISTSTAYLVMLGVNPRRLGFVFTQMPEILGMRVGNNIKRKVDFLKSFGLTQSSIAKIIETRPHFLGLDLTNQMRPVVDSLIEVGVAQDAISRVITQFPDILSLDVKGKLAERLTWLTEDVGVSADAIGGIIARLPQILAINTTKASARVEFLRQAEFSAADIASMVTNCPQLLAASIEKSLKPNLDYLVEKMERELTEVIEFPAYLLYNLEEVVQPRHEEITKSGVECSLAWMLNCADDIFRQRLSLEYAEQSNHNEEPDLPEDEDESKSFVEPEGLEDSSDVPYVVTRRLRPVEEPLDDDDDAQSRFFE

SEQ ID NO: 56931 - protein, 160 aa, Glycine max
MEAALCSALALSPNQVFNAANPGDKNVPLKYSKDRSVVMTVAATGILGKGGGLLERPTIETTSPGRESEFDLRKSRKTSPPYRVLLHNDNFNKREYVVQVLMKVIPGMTIDSAVNIMQEAHYNGLAVVIVCAQVDAEDHCMQLRGNGLLSSIEPADGGGC

SEQ ID NO: 56932 - protein, 637 aa, Synechococcus sp. WH 5701
MHLSELSHPNQLHGLSIGELEAIARQIREKHLEVVSTSGGHLGPGLGVVELTLALYQTLDLETDRVVWDVGHQAYPHKLITGRYHQFHTLRQQGGVAGYLKRSECRFDHFGAGHASTSISAALGMALARDRRGEEFKCVAVIGDGALTGGMALEAINHAGHLPRTPLLVVLNDNDMSISPPVGALSTYLNRMRLSPPLQFLSGSAEEAFKHLPFMHGELPPELERLKESMRRLAVPKVGAVFEELGFTYMGPIDGHDIAEMVRTFSAAHRCEGPVLVHVATTKGKGYPYAEADQVAYHAQSAFDLKTGKAFPSSKPKPPSYSKVFGQTLVRICEHDPTVVGITAAMATGTGLDLLEKALPKQYFDVGIAEQHAVTMAAGMATAGLKPVVAIYSTFLQRAFDQLIHDVGIQKLPVTFVLDRAGIVGADGPTHQGQYDISYLRAVPNFTVMAPKDEAELQRMLVTSIGHNGPCAIRFPRGEGEGVPLMEEGWEPLEIGHGEQLADGDDLLIVAYGAMVAPAMATAGLLQEQGIRAAVVNARFLRPLDESLILPLARRIGRVVTMEEGALPGGFGAAVVESLNDHEVMVPVFRIGIPDQLVDHASPDESKKALGLTPPQMADRILQRFALLGIQRQPLAV

SEQ ID NO: 56933 - protein, 216 aa, Oryza sativa
MDAMAVLARTSRPAPTLLAATSPAVSRRPAAVSFAAAASPGSRGRVALSAAWGGRAARGRVSAAGRIVEQSYIMIKPDGVQRGLVGEIISRFEKKGFVLKGLKLFQCPKDLAQEHYKDLKEKPFFPGLIEYITSGPVVCMAWEGNGVVASARKLIGATNPLQAEPGTIRGDLAVQTGRNVVHGSDSPDNGKREIALWFKEGELCEWESVLTPWLVE

SEQ ID NO: 56934 - protein, 444 aa, Glycine max
MATIVSIKARQIFDSRGNPTVEVDLTCSDGTFARAAVPSGASTGIYEALELRDGGSDYLGKGVSKAVDNVNTVIGPALIGKDPTEQTAIDNLMVQQLDGTVNEWGWCKQKLGANAILAVSLAVCKAGASVLKIPLYKHIANIAGNKKLVLPVPAFNVINGGSHAGNKLAMQEFMVLPVGASSFKEAMKMGVEVYHNLKSVIKKKYGQDAINVGDEGGFAPNIQENKEGLELLKTAIAKAGYTGKVVIGMDVAASEFYKEDKTYDLNFKEDNNDGSQRISGDALKDLYKSFVSEYPIVSIEDPFDQDDWEHYAKLTAEVGANVQIVGDDLLVTNPKRVQKAIDTKACNALLLKVNQIGSVTESIEAVRMSKKAGWGVMASHRSGETEDTFIADLSVGLATGQIKTGAPCRSERLAKYNQLLRIEEELGAEAVYAGANFRTPVEPY

SEQ ID NO: 56935 - protein, 164 aa, Oryza sativa
  misc_feature (153)..(153): Xaa can be any naturally occurring amino acid
ILPSLGQVSLLLHPQIRRPAPPANAGLGVTAMSYIAVDYLRHLSPERHSRLQPALRSLLALAAVVRVPSYRHWSAEFRSAIPFIASMFFMLAALLYEKISVRSVTAELGLDWHLNTPPLPDTGQRLLLALKEKLPSPIVEILRARIIGLHHYXMLFMKLAFSVL

SEQ ID NO: 56936 - protein, 177 aa, Zea mays
RAAVAAPLARPTILPARQISPAVAVNATRSYHEKVLDHYSRPRNVGSMNKKDADVGTGLVGAPACGDVMKLQIRVDPETQKISEVKFKTFGCGSAIASSSYLTELVRGMSLDDAGKVKNTEIAKELCLPPVKLHCSMLAEDAIKSAISDYYTKNPNAKVSNLSGTGMKLPEADAAAA

SEQ ID NO: 56937 - protein, 527 aa, Hordeum lechleri
MAHVHVDEMLHGAAAAPRSLLIATAVLFSLVVLPLLLRIITKQGAASDAKLLSLLPSPPSKLPIIGHLHLMGDLPYVSLAGLAAKYGPELMLVRLGAVPTAVVSSPRTAEAVLRTHDHVFASRPRSMVFDIIMYGQTDSCFAPYGDHFRKARKLVTVHMLNARKIRSQRPAREEEVRLVIGKIAKAAAAREAVDMSELLHSYVNDLVCRAVSGKFSQEEGRNKLFRELTDINAALLGGFNILDYFPSLGRFELVCKVACAKARRVRKRWDLLLDKLIDDHAARMVSREDEAQGEQEEDKDFIDVSLSLQQEYGLTRDHIKAILIDMFEAGTDTSYMTLEFAMAELIRKPHLLNKLQEEVRRNVPNGQEMVAEDDLPNMTYLKAVIKETLRLHPPVPLMIPHFSLDACTVDGYTIPANTRVVINAWALGRHSSYWENENEFQPERFMNGAGVDLKPNEFHYLPFGFGRRMCPGVHSASATVETMLANLMYRFDWKLPPGLKEEDIDMTEVFGITVSRKEKLILVPVTV

SEQ ID NO: 56938 - protein, 881 aa, Streptococcus agalactiae A909
METKFVYHFDEGCKEMKELLGGKGANLAEMTSIGLPVPQGFTITTQACNDYYDNACHIRESILSQIDQAMAQLEVEQNKQLGSVDDPLLVSVRSGSVFSMPGMMDTVLNLGLNDRSVQGLVKKTEDERFAYDSYRRFIQMFADVVTGIPKYKFDTILDRLKTDKCYQDDTELTGSDLKRLVEFYKELYQKEAGEKFPQDPKRQLLLAIEAVFKSWNNPRAKIYRKLNDIPETLGTAVNIQAMVFGNMGNNSGTGVAFTRNPSTGAANLFGEYLINAQGEDVVAGIRTPQSISKLAEQMPIIYQEFVSVTQKLEAHYRDMQDMEFTIENGNLYMLQTRSGKRTAKAAIKIAVDQVNEGLISKEEAILRIEPKQLDQLLHPSFDLKSLKKAIILTTGLPASPGAAYGKVYFHAEDVVKEMKKGNPVLLVRQETSPEDIEGMVSANGIITARGGMTSHAAVVARGMGKPCVAGCSQLLVDEVRREISIGHQTIKEGEMLSIDGATGNVYIGQVPMAETSVDRDFEIFMKWVDENRDMMVCSNADNPRDAQKALDFGAEGIGLCRTEHMFFDDERIPVVREMILADEILSRRKALERLLSFQRDDFYQIFKVLKGKACTIRLLDPPLHEFLPHDKESIESMARQMGISTLAIEKRIQTLEEFNPMLGHRGCRLAITYPEIYQMQVRALVQGAILAMKEGYEAKPEIMIPLVTAHEEISIIRDLIEETIVEESKSKKINLSFPIGTMIETPRACMIADDIAKFADFFSFGTNDLTQMSFGFSRDDAGKFLGEYVDKGLLKKDPFQVLDQKGIGRFIEQAVRLGKEVKPNLKIGICGEHGGEPSSIEFCYQLGLHYVSCSPFRIPIAKLAAAQAKIKQSRNDITIDK

SEQ ID NO: 56939 - protein, 189 aa, Brassica napus
MTNYGAIPTSSHPSPPVDLEYISHVKHRLKAGLATRRPWRSMFDLESMTLPHGFFDAISRMKTNLVYFRANYAIAVLFMLFVSLLYHPTSLLVLAILVVFWIFLYFLRDEPLVVFGHQVDDRTVMISLSVLTIVMLLFTHATGNILGSLLTTVLLVLIHAAIRRSDNLYSDEEAAAATETSGLTSYPSS

SEQ ID NO: 56940 - protein, 155 aa, Nicotiana tabacum
MSSSKMIVLKSSDGETFEVEEAVALESQTIKHMIEDDCADTSIPLPNVTSKILAKVIEYCKRHVDATKTEDKASEDELKGFDSDFVKVDQATLFDLILAANYLNIKSLLDLTCQTVADMIKGKTPEEIRKTFNIKNDFTPEEEEEVRRENAWAFE

SEQ ID NO: 56941 - protein, 170 aa, Prochlorococcus marinus str. MIT 9312
MEKLEKLISTYENYPKAGVSFKDVIEIVQHPSIFRQLILEMAKSKIIKEAEALISIDARGFIFGSAISIQAAKPMIVARKPGKLPGELVTKKYSLEYGENSLSIQKKALKKYNSFAIIDDLLATGGTVNCVSELINNNNKKVVGLLVVAELSKFDGRSRFNFPVESSILF

SEQ ID NO: 56942 - protein, 493 aa, Brassica napus
  misc_feature (349)..(349): Xaa can be any naturally occurring amino acid
MAELTKETSLPKERSSPSPQALILGRYEMGKLLGHGTFAKVYLARNVKTNESVAIKVIDKEKILKGGLIAHIKREISILRRVRHPNIVQLFEVMATKAKIYFVMEYVRGGELFNKVAKGRLKEDVARKYFQQLISAVTFCHARGVYHRDIKPENLLLDENGNLKVSDFGLSAVSDQIRQDGLFHTFCGTPAYVAPEVLARKGYDAGKVDIWSCGVVLFVLMAGYLPFHDRNVMAMYKKIYKGEFRCPSWFSPELTRLCSRLLETNPEKRFTFPQIMENSWFKKGFKHVKFYVEDDKLCNVVDDDDELETGSVESDRSSTVSESDVEFFKPARRVGGLPRPASLNAFDIXSFSQGFDLSGLFDDDGEGSRFVSGAPVSKIISKLEEIAKVVSFTVRKKDCRVSLEGSRQGVKGPLTIAAEIFELTPSLVVVEVKKKGGDRTEYEEFCNKELKPKLQTLTADEVDDPVAVSAVVDETASGVANSPPVCFLPSDTE

SEQ ID NO: 56943 - protein, 392 aa, Roseovarius nubinhibens ISM
MIPSILPTYNRAPLSFVKGEGSWLIEADGRRFLDLGAGIAVNALGHAHPKLVAALTEQAGKLWHTSNLYHIPAQQALADKLVEHSFADTVFFTNSGTESCELAVKMARKYWYEKNAPERVEIIAFHGSFHGRSSAGIAAAGSEKMTKGFGPLLPGFKHLDWGDLEGLKGAIDSRTAAVLLEPVQGEGGIRPMADHDLRALRQICDEAGILLIFDEVQCGMGRTGRLFAHEWAGVTPDIMMVAKGIGGGFPLGAVLATEAAAVAMTAGSHGSTYGGNPLACAVGCAVMDEVTAPGFLETVNTRASQLQQKLGGLVEAYPEVFAELRGSGLMLGLKCVAPNTDVLQACYEAGLITVPAGDNVIRLLPPLTLSEDEVTEAVSRLDHAARAIKDRL

SEQ ID NO: 56944 - protein, 308 aa, Roseovarius nubinhibens ISM
MPDFLDIHKTDAGALRDILDQASQMKQARLGRKRGAPDDDQPLANHMVALIFEKPSTRTRVSFDAGVRQMGGQTMLLSGAELQLGHGETIADTARVLSRYVDLIMIRTFDESVLLELAEHSQVPVINGLTDRTHPCQIMADILTYEEHRGPIKGKKVVWSGDGNNVCASFLHAAGKFGFDFTYTGPQQLDPEEEFIGEARRAGVQVTIERDAAKAVEGADLVVTDTWVSMHDSQSTKERRHNLLRSYQVNDALMSHAKPDALFMHCLPAHREEEVTSKVMDGPQSVIWDEAENRLHAQKAVMRWCLGV

SEQ ID NO: 56945 - protein, 471 aa, Roseovarius nubinhibens ISM
METGMAKAQIGVYGLGTMGSALALNMAEAGIRVAVTNREADWIARFVTEAGALAENIVPQDGLEAFVASLVTPRVILFMIPSGAPMDAMIEAIAPLLSPGDTIIDGGNANFHDTRRRSAALATQDLHFVGMGVSGGEEGARHGPSMMVGGSDHSWAQLKPLLEAIAARYGEDPCVAHLGPDGAGHFVKTVHNGIEYADMQAIAEIYTLEHHGAAKIPEEIGAMFTRWDAGPLKSYLLEITGKLLTYTDPETGHPMVDVIWDAAGQKGTGRWTVIEALRMGQSASMIEAAVGARGWSSEKYTRVEAEKILGGARGAMECSEEVLADAFMAARILSYAQGFRILKAASEEYDWQLDMARIAEIWRAGCIIRSAILDDISEAFQGDIPHGELILAPRFAQTLAQCIPSLRQVVSQAVHSGHAVPALAAGLSWYDTMRQGWGSANIIQAQRDFFGYHGFEKFGVEGQFHGPWWDD

SEQ ID NO: 56946 - protein, 175 aa, Triticum aestivum
MAPTVMASSATSVAPFQGLKSTAGLPISRRSSSAGLSSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCEESGKA

SEQ ID NO: 56947 - protein, 535 aa, Azoarcus sp. EbN1
MSVLKSNINSRSEEFRANAQALKSLVADLRDKAAEVSFGGGAAARDKHTARGKLLPRDRVNHLLDPGTPFLEIGQLAAYGMYDNEAASAGVVAGIGRVKGLECMIVANDATVKGGSYFPMTVKKHLRAQEIAQMNRLPCIYLVDSGGANLPTQDEVFPDREHFGRIFFNQANMSAAGIPQIAVVMGSCTAGGAYVPAMSDEAIIVKNQGTIFLGGPPLVKAATGEVVSAEDLGGGDVHTRISGVADHLAENDAHALYIARRIVGNLNRTKPVEMNLGAGDEPLYDPEEIYGIIPSDTRKPYDVREVIARVVDGSRFDEFKARYGTTLVTGFAQLYGYPVGIVANNGILFGESAQKGAHFVELCAQRGIPLVFVQNITGFMVGRKYENAGIAKDGAKMVTAVATAQVPKLTMIIGGSFGAGNYGMCGRAYSPRFLWMWPNSRISVMGGEQAASVLATVRRDGIEAKGGAWSKEDEEAFRAPIREQYEVQGHPYYATARLWDDGVIDPAQSRRVLGLSLSATLNAPIPQTKFGLFRM

SEQ ID NO: 56948 - protein, 364 aa, Oryza sativa
MGSSCSRSHSLSEAETTKNAKSADIDRRILQETKAEQHIHKLLLLGAGESGKSTIFKQIKLLFQTGFDEAELRSYTSVIHANVYQTIKILYEGAKELSQVESDSSKYVISPDNQEIGEKLSDIDGRLDYPLLNKELVLDVKRLWQDPAIQETYLRGSILQLPDCAQYFMENLDRLAEAGYVPTKEDVLYARVRTNGVVQIQFSPVGENKRGGEVYRLYDVGGQRNERRKWIHLFEGVNAVIFCAAISEYDQMLFEDETKNRMMETKELFDWVLKQRCFEKIQKVPLSVCEWFKDYQPIAPGKQEVEHAYEFVKKKFEELYFQSSKPDRVDRVFKIYRTTALDQKLVKKTFKLIDESMRRSREGT

SEQ ID NO: 56949 - protein, 398 aa, Synechococcus sp. WH 7803
MVSGLPMTHSLPQIDSRHRRSVEPISTPDRLLLGPGPSNAHPTVLSALARTPIGHLDPLYVDLMGEVQELLRYAWQTDNRLTLPMSGTGSAAMEATLANTVEPGDRVLVAVKGYFGNRLADMAGRYRADVRVIEKPWGEAFTLDELDSALQHHKPAILAMVHAETSTGVCQPMEGVGDLCRKHDCLLLLDTVTSLGGVPLYLDEWKVDMAYSCSQKGLSCPPGLGPFTMGPRAEAKLAARKDKVPNWYLDVSLLNQYWGSDRVYHHTAPVNMNFGMREALRLLADEGLDNAWSRHRCNAEALWKGLESLGLEMHVPEALRLPTLTTVRIPDDVDGKAFSSYLLNTHGIEVGGGLGALAGKIWRVGLMGYNSTPENVNRLLNLFETELPRFREGSCVAA

SEQ ID NO: 56950 - protein, 712 aa, Saccharomyces cerevisiae
MLNSALLWKVWLRIDNSTDEVNQPIAVQFDEIDTVDDLKSRFFQKLSSTRWREINDNASIAIGLYAPKFDNQADNTSSNNTNDNSCRSKSNGAGSGANLSVNSNTKSSVSPTAGSFGLSKDLAKDRNVLQHPKPTQKRGALYDAFAAVPTVAATTNVDFPPNEAPMLSPQRPYSTSPKQFSATTKSPLLRFASVSPYPKFHSDNQIMASAGLTYVSPHNKNKYTRPLIRKGLNFTTESVNDCTYKIIFEPDELAINIYKELFGTMGSQPASQPLLIFSNVNLRQDVPPLDILNVVDYVPTNEEISQQKTQPTDHGAVGVFHLDDHISPGEQGLKQTIGDKADLKGKDGNSSPQEFKLITDEEQLRRASQELKDEEKDAESPWQAILLLPKGYKGGVDFRNKPVAHTDSSFNNEDTITHSELEVNTGSPSQESGSLNEAGIGITQPMSEVQRRKEDVTPASPILTSSQTPHYSNSLYNAPFAVSSPPDPLPNLFTTTSEKVFPKINVLIVEDNVINQAILGSFLRKHKISYKLAKNGQEAVNIWKEGGLHLIFMDLQLPVLSGIEAAKQIRDFEKQNGIGIQKSLNNSHSNLEKGTSKRFSQAPVIIVALTASNSQMDKRKALLSGCNDYLTKPVNLHWLSKKITEWGCMQALIDFDSWKQGESRMTDSVLVKSPQKPIAPSNPHSFKQATSMTPTHSPVRKNSNLSPTQIEL

SEQ ID NO: 56951 - protein, 128 aa, Triticum aestivum
  misc_feature (119)..(119): Xaa can be any naturally occurring amino acid
RGRGRGLHTLSPRHQAWGTQRGWSRSSLKTLTGTRKLGRGGGSPTKKEVGLPAVFGSHTAKWMQDTSKKSPMELINEVPPIKVEGRIAACEGDKNPALGHPSEYICLDLDAPAVCKYCXLRYVQDHHH

SEQ ID NO: 56952 - protein, 473 aa, Synechococcus sp. WH 7803
MASTAQDVLRQIKDEGIELIDLKFTDLHGKWQHLTICSDLLEADSFEEGLAFDGSSIRGWKTIDASDMAMVPDPSTAWIDPFYSHKTLSMICSIQDPRTGTLYDRCPRALAQRALAYLSGSGLADKAFFGPEPEFFLFDDVRYNSSEGGSFYSVDTIEASWNSGRLEEGGNLGYKIQLKEGYFPVAPNDTAQDIRSEMLLMMAQLGIPIEKHHHEVAGAGQHELGMKFAELIKAADNTMTYKYVVRNVAKKYGKTATFMPKPVFNDNGSGMHVHQSLWKAGQPLFFGEGTDANLSQTARWYIGGILKHAPSFLAFTNPTTNSYKRLVPGFEAPVNLVYSEGNRSAAVRIPLTGPNPKAKRLEFRSGDALANPYLAFSAMMMAGIDGIKNQIDPGAPTNEDLFELSAERLSAIDTVPASLNGALEALNADHHYLMEGGVFSKDFINNWIDLKYEEVQQLRQRPHPHEFTMYYDA

SEQ ID NO: 56953 - protein, 399 aa, Bacillus cereus ATCC 14579
MRLEVTVKIKPKFIKEIKSGYPLILKDAIQNLNDVREEGTIIKVVDEKNNFVGKGYYGKQNKGYGWILTRKESEQINQSFFESKIKSALHKRKQFYKSSDTTAFRVVNGEGDGLGGLIIDYYDGYYVVSWYSEGIYTFRDEIIAALQKVANFKGIYEKKRFDTKGKYIEGDDFVAGERGEFPLIVKENGVNFAVYLNDGAMVGVFLDQRNVRKQIRDKYAKGRTVLNMFSYTGAFSVFAALGGASKTTSVDLANRSLSKTIEQFSVNEVDYEAQDIIVEDVFLYFKYAAKKKMKFDMVVLDPPSFARSKKYTFSAAKDYKNLLKETIAITENNGIIVASTNCSAFDMKKFKGFIDTAFKEMNGKYKILEEHSLPEDFRTIDQFKEGDYLKVVFIEKIKG

SEQ ID NO: 56954 - protein, 257 aa, Vitis vinifera
  misc_feature (31)..(31): Xaa can be any naturally occurring amino acid
  misc_feature (242)..(242): Xaa can be any naturally occurring amino acid
MEMESLPNGNSVAAVVAAAAAAAAAAPSSKXNQLAESLKLEHQFLRKEMSAVISGVADAANADLSGDEAVHHLNSLVSRLQGLKRKLEEGSRTEHLQAQKCRARLDHLESADADNLSEWNNTRLKRILVDYMLRMSYYDTAMKLVESSNLQDLVDIEVFHEAKRVIDALQNKEVAPALAWCAENKSRLKNLLVEFYNCELQSVCAIRFLPSMPYRLKRKLGWRMFGIPWCKGITKYKNLFLXNIPRSECYADRCPYQ

SEQ ID NO: 56955 - protein, 367 aa, Porphyromonas gingivalis W83
MSLQCGIVGLPNVGKSTLFNCLSNAKAQSANFPFCTIDPNVGVITVPDERLNILADLCKPQRLIPTTVEIVDIAGLVKGASKGEGLGNKFLANIRETDAILHVLRCFDDDNITHVDGSVDPVRDKEIIDTELQLKDLETIESRIQKVQKQAQTGGDKQAKLAYQVLSKFKEALDEGRNARSVSFDTKDEQQIARELFLLTAKPVMYVCNVDEASALSGNKYVEAVREAVKNEDAEILVVAAKIESEIAELETYEERQMFLEEIGLKESGVSRLIKAAYHLLNLQTYFTAGSDEVRAWTFLRGSKAPQCAGIIHTDFEKGFIRAEVIKYNDFVSLGSEQAVKEAGKMSVEGKEYVVQDGDIMHFRFNV

SEQ ID NO: 56956 - protein, 139 aa, Zea mays
MPPSASMPATHTAVYVAAVPLRAPKGPAQLLMSAGYSLGMWDLQHFMVLLRPDPALAQALVFDFQPRDPEDVLAALAVLSRREIPGVVRRRTLRRVPDRRCWLVGHCCDAVGAATRFSERWTTGLVVGEHDCRDYTDDG

SEQ ID NO: 56957 - protein, 540 aa, Synechococcus sp. WH 5701
MGSTVTFPEADRSPARHTGAMDDTLQRILRARVYDVAIESPLEEAPNLSRRLGNTVLLKREDLQPVFSFKLRGAYNRMAQLTPAELKRGVIAASAGNHAQGVALAAERLGCHAVIVMPLTTPAMKVRAVAARGAEVILHGDTYDEACQQARVLEQERGLTFIHPFDDPEVIAGQGTVGLEILRQCSAPPDAIYVAVGGGGLIAGIAAFIKNVWPQVEVIGVEPVDADAMTRSLAAGRRVSLEQVGLFADGVAVHEVGVHTFALAQRYVDAMVTVDTDEICAAIKDVFEDTRSILEPAGALAVAGMKADVQRRGLKQRTLVAVACGANMNFDRLRFVAERAELGEEREAMLAVEIPERPGSLRQLCELLGSRSLTEFSYRMADHRLAHIFLGVQIDGHQDTEALISQLGAGGFPCLDLSSNELAKLHLRHMVGGRLPEAACHAGAATPRELLYRFEFPERPGALMAFVNALHPNWSISIFHYRNQGADVGRIVVGVQVEEQDSGAWELFLSGLGYRHWDETQNPAYRLFLGPASQPVPALA

SEQ ID NO: 56958 - protein, 136 aa, Brassica napus
MLCWKGSSVRRKEKTALLPVYLNVYDLTPMNAYGYWLGLGVFHSGVEVHGVEYAFGAHEAPSTGIFEVEPKKCPGFTFRKSILVGKTDMAAKEVRVFMEKLAEEYRGNKYNLISRNCNHFCNEVCVKLTQKPIPRW

SEQ ID NO: 56959 - protein, 214 aa, Oryza sativa Japonica Group
MEYYEQEEYATVTSAPPKRPAGRTKFRETRHPVYRGVRRRGPAGRWVCEVREPNKKSRIWLGTFATAEAAARAHDVAALALRGRGACLNFADSARLLRVDPATLATPDDIRRAAIELAESCPHDAAAAAASSSAAAVEASAAAAPAMMMQYQDDMAATPSSYDYAYYGNMDFDQPSYYYDGMGGGGEYQSWQMDGDDDGGAGGYGGGDVTLWSY

SEQ ID NO: 56960 - protein, 356 aa, Arabidopsis thaliana
MSYSTIISNTSFLSLASKFTTRGSRLQCTVSMARSAVDETSDSGAFQRTASTFRNFVSKDSNSQFPAESGRYHLYISYACPWASRCLSYLKIKGLDDAISFSSVKPIWGRTKETDEHMGWVFPGSDTEVPGADPDHLNGAKSVRELYEIASPNYTGKYTVPVLWDKKLKTVVNNESAEIIRMFNTEFNHIAGNPDLDLYPSHLQAKIDETNEWIYNGINNGVYRCGFAKKQGPYEEAVEQVYEALDRCEEILGKHRYICGNTLTETDIRLFVTLIRFDEVYAVHFKCNKKLIREYPNLFNYTKDIFQIPGMSSTVNMNHIKQHYYGSHPSINPFGIIPHGPNIDYTSPHDRHRFSK

SEQ ID NO: 56961 - protein, 527 aa, Hordeum lechleri
MALEAAYHYLQIAVGHGTSTPAALLTVLLLLIIRLAWVRTTTASTRLSKQQQLPPSPPGKLPIIGHLHLLGSQTHISIRDLDAKHGRNGLLLLRIGAVPTLFVSSPSAAEAVLRTHDQIFASRPPSMAAAIIRYGLTDIAFAPYGEYWRQARKLLTTHMLSAKVVHSFRHGRQEEVRLVINKTREAATRGTAVDMSELLSGYTNDVVCRAVLGESHRKEGRNRLFSELTEINVSLLGGFSLENYIPPNMIMADVLLRLVSVKAQRLNKRWDDLFNEIIEEHLHPSKPSSGEQQAADFIDLLLSLKEEYGLTTDNIKAILVDMFEAGIETSYLTLEYGMAELMNNRHILTKLQEEVRSQGKKLDMITEEDVSSMAYLRATIKETSRLHPPAPFLLPHFSTADCNIDGYVVPSNTRVLVNAWALGRDLSSWERPDDFLPERFLQDQAGDVDTQMRGKDLRFLPFGFGRRICPGMNFGFATMEIMLANLMYHFDWDVPNMMGTGAGVDMAESFGLTLRRKEKLQLVPQIP

SEQ ID NO: 56962 - protein, 595 aa, Synechococcus sp. WH 5701
MAQPDLSRRTKIVATIGPATESPQRLRDLIQAGATTFRLNFSHGDHSEHAARIATIRQVAHELGIHVGILQDLQGPKIRLGRFEGGPITLANGDPFALTSRPVSCNQSIATITYDRLADEVTAGSRILLDDGRVEMVVKSVDIPEQTLHCTVVVGGVLSNNKGVNFPDVQLSIRALTTKDREDLSFGLQQEVDWVALSFVRNPSDMQEIRELISSQGYSTPVIAKIEKFEAIDQIDAILPLCDGVMVARGDLGVEMPAEEVPLLQKELIRKANTLGIPIITATQMLDSMASCPRPTRAEVSDVANAILDGTDAVMLSNETAVGDYPVEAVETMARIARRIERDYPRRVVDSHMASTIPNAISQAVSTIARQLQAAAILPLTKSGATARNVSKFRPSTTILAITSEVKVARQLQLVWGVNPLLIGHQASTTSTFTLAMGVAQERGLLKEGDLVVQTAGTLSGVSGSTDLVKVGIVSAVLGRGLGIGNGSVSGRVRVATTAEEAARLESGEILVVRDTNAGYLDAIRKARGVIAEEHGCDSHAAVIAQRLGVPVIVGVANATSDLRLGEFVTLEVREGVVHRGARNHTQADRSETIL

SEQ ID NO: 56963 - protein, 593 aa, Sinorhizobium meliloti 1021
MAAESHGIDLLPVIALLGAAVVAAPLFKRIGLGSVLGYLAAGIAIGPFGLRLLQEPSSILHVAELGVVMFLFIIGLEMRPSRLWGLRREIFGLGIVQVALCALLLTGVGVLTGFPVAPSFVAGAGFVLTSTAIVMQLLEERREMAAPKGQRIVSILLVEDMAIVPLLALVAFLAPIVPGSVAASGAIDWLSIAIGLVTIAGLVLAGRYLLNPLFGLIAGVEAREVMTAAALMVVLGSAYVMQLGGLSMAMGAFLAGVLLSESTFRHQLEADVEPFRGILLGLFFLAVGMSLDLGVIARNWAMILFYVAAYMVVKAIVIYLVARLFRASNWEAIERAVFMAQGGEFAFVLYAAALGTGIISSEENAILTAIIIVSMMVTPLLIAALRLVERNIPLSTDGVERPENLSGNVLIIGFGRVGQIVSQVLLTRGHVISIIDTDVEMINTAREFDFKVYYGDGKRLDILHAAGAERASAIVVCVDKADDATKIVELIKAEFPLIPVLARASDRRHALDLITAGADFHIRETFESSLVLGQKALEALGADLPEVAEIIEKVRQRDEKRLELELVGGLYAGRPLFSGKLEPVEAVPPGGSA

SEQ ID NO: 56964 - protein, 408 aa, Arabidopsis thaliana
MKQRKKSYLSIFVIFFSLFFFGIFMYNDNLKSSIADFTSSNPFSSSFVELPPDECDLFTGQWVFDNKTYPLYKEEECEFLTEQVTCLRNGRKDSLFQNWRWQPRDCSLPKFNARVLLEKLRNKRLMFVGDSLNRNQWESMVCLVQSVIPPGRKSLNQTGSLTVFKIQDYNATVEFYWAPFLVESNSDDPEKHSIIDRIIMPESIEKHGVNWIGVDFLVFNSYIWWMNTVSIKVLRGSFDDGDTEYDEIKRPIAYERVLRTLGDWVDHNIDPLSTTVFFMSMSPLHIKSSDWANPEGIRCALETTPILNMSFNVAYGQFSAVGTDYRLFPVAENVTQSLKVPIHFLNITALSEYRKDAHTSVYTIKQGKLLTREQQNDPANFADCIHWCLPGLPDTWNEFLYTHIISRR

SEQ ID NO: 56965 - protein, 528 aa, Hordeum lechleri
MALEAAYHYLQRAVGHGTTTEALLLTVLLLLIIRLAWVRAFTSTTTSTKFKQQLPPTPPGKLPIIGHLHLIGSHPHVTFRDLAAKHGRDGLMLVHVGAVPTVVVSTPQAAEAVLRTHDHVFASRPRNPVADIIRYGSTDIAFAPYGDYWRRARKVVNTHLLSVKMVYSKRHDREEEVRLVVAKIHELAMAAPGKALDMTELLGGYASDFVCRAVLGESHRKHGRNELFRELTEISASLLGGFNLEDYFPRLANLDVFLRVVCSKAMGVSKRWDNLFNELIAEYEGGKEDNAEDFVHLLLSLKKEYNLSTDNVKAILVNMFEAAIETSFLVLEYSMAELINNRHVMTKVQKEVRESTPEGGKLDLIMEEDLSRMPYLKATIKEAMRVHPPAPFLLPHFSTNDCEVNGYTIPAGTRVIVNAWALARDPSHWERAEEFYPERFLQEGRDAEVDMYGKDIRFVPFGAGRRICAGATFAIATVEVMLANLIYHFDWELPSEMEAVGAKVDMSDQFGMTLRRTQRLHLVPKIYK

SEQ ID NO: 56966 - protein, 526 aa, Hordeum lechleri
MALEAAHHYLRHAVGHGTSAPAALLLVCVPLLLLLLLFASLRTSASTRKLRLPPSPPGSLPIIGHLHHIGAQTHISLQHLVDKYGHNGLLFLRAGAVPTVIVSSPSAAEAVMRTHDHILASRPWSMASHILRYNTTDVAFSPLGEYWQHTRKLVNTHLLSAKKVHSFRHGRQEEVSLVVDKIREAATNAPSTVVDMSEFLAAYTNDVVSRSVLGATHRKKGRNTLFREMTETNVDLLVGFNLENFIPRWPLTEVLFRLVCWKVQRHLNKWDALLEEVIKEHINLKQDNSADFIHVFLSLQQEYGLTDDNVKSLLMNIFEAAIETSYLVLEYAMAELINNRHVMKKLQTEVRTFASSKGKKLDMITEEDLSSLPYLKATMKEALRLHPPGPLLLPHYSTADCNIDGYDIPAKTRILVNGWAIGRDPTAWERQEDFMPERFLQEGQEKSSNLGQDFKYLPFGSGRRICPGANFALATMEIMLVNLMYHFDWEVPNEKEGTGGKVSMAETFGLMLRRNEKLYLVPRIVE

SEQ ID NO: 56967 - protein, 821 aa, Gibberella zeae PH-1
MAPQPDEHHPHKKVNLTDASGAEVKNEDDVATAILKKKKKPNQLMVTDAVNDDNSIIALSEATMDQLQLFRGDTVLVRGKKRKDTVLIVLADDELDDGSARINRVVRHNLRVKHGDMITIHPCPDIKYAKRIAVLPIADTVEGITGSLFDVFLAPYFREAYRPVRQGDLFIVRGGMRQVEFKVVEVDPPEYGIVAQDTVIHCEGEPIQRDEEENNLNEVGYDDIGGCRKQMAQIREMVELPLRHPQLFKSIGVKPPRGVLLFGPPGTGKTLMARAVANETGAFFFLINGPEIMSKMAGESESNLRKAFEEAEKNSPAIIFIDEIDSIAPKREKTNGEVERRVVSQLLTLMDGMKARSNVVVMAATNRPNSIDPALRRFGRFDREVDIGVPDPTGRLEILQIHTKNMKLGDDVDLEQIASETHGYVGSDVAALCSEAAMQQIREKMDLIDLDEDTIDAEVLDSLGVTMENFRFALGVSNPSALREVAVVEVPNVRWEDIGGLQEVKQDLKENVQYPVDHPEKYLKFGMSPSRGVLFFGPPGTGKTMLAKAVANECAANFISVKGPELLSMWFGESESNIRDIFDKARAAAPCVVFLDELDSIAKARGGSMGDAGGASDRVVNQLLTEMDGMTSKKNVFVIGATNRPEQLDPALCRPGRLDSLIYVPLPDEPGRLSIIKAQLRKTPIASDIDFGYIASKTHGFSGADIGFITQRAVKIAIKESIAIDIERQKAREAAGDEMDTDEDAEDPVPELTKAHFEEAMQMARRSVSDVEIRRYEAFAQQMKNAGPGAFFKFPEAGAEAAGGDAGNSFGDAGNDDDLYD

SEQ ID NO: 56968 - protein, 411 aa, Solanum lycopersicum
MNALAATNRNFKLAARLLGLDSKLELSLLIPFREIKVECTIPKDDGTLASFVGFRVQHDNARGPMKGGIRYHREVDPDEVNALAQLMTWKTAVANIPYGGAKGGIGCSPSDLSISELERLTRVFTQKIHDLIGIHTDVPAPDMGTNPQTMAWILDEYSKFHGYSPAVVTGKPVDLGGSLGRDAATGRGALFATEALLNEHGKSVAGQRFVIQGFGNVGSWAAKLIHEQGGKVVAVSDITGAIKNEKGIDIESLFKHVKETRGVKGFHDAQPIDANSILVEDCDVLMPAALGGVINKDNANEIKAKYIIEAANHPTDPEADEILSKKGVTILPDIYANSGGVTVSYFEWVQNIQGFMWDEKKVNDELKTYMTRGFKDVKDMCKTHNCDLRMGAFTLGVNRVARATVLRGWEA

SEQ ID NO: 56969 - protein, 354 aa, Oryza sativa Japonica Group
MAATDMSPKAGKPLVENDAGSYLAWSGKDQPAVAGEKLGCGLLVLKPLGFALPHYADSGKFGYVLGGSAVVGVLPAGVDARERVVRLEAGDVIAMRAGEVTWWYNDTDGEDVTIVFMGDTAGAVSPGDISYFVLAGPMGVLGGLDAGLLAKASGLTSPEQAATAFRSQPAALLTRLNGKLHGVRPREHDRHGLVVNAARVPADSNTGGAAAGTKTVTAAHLPVLAQLGFSVGLTRLDAGAAVRGPWVLRDAAAQAVYVARGSGRVQVAGAGGASTLLDAEVAAGSLLVVPRYGVSLAAADDAGGMELVSLIKSPRPATEHFTGKGSVIGGLTAEIVQAALNVSPEFVEQLRTKY

SEQ ID NO: 56970 - protein, 241 aa, Glycine max
MCSLEKRGNAWVLTLDGDDGDVQHRLNPTLIDSLLSTLNRLASQATPGSVLVTTATGKFFSNGFDLSWARAAASASAATDRLQFMVDSLKPVLAAIMSLPMPTIVAINGHASAAGFLLAVSHDYVLMRSDRGVLYMPEVDLGLPLPGYFAAVIRSKIRSPAVMRDLVLGGAKLTAAEAVRMGIVDSAHDSAESTVEAAMRLGEQLARRKWVGEVYAEIRKSLYPDACKVLGLTQKAIVSKI

SEQ ID NO: 56971 - protein, 105 aa, Zea mays
TEGTCLPLSSYMSSQAEISERMRAILIDWIIEVQYRLTLMPETLYLTVYIIDQYLSMESVPRKELQLVGISAMLIASKYEEIWAPLVKDLMCLCDNAFTRDQILT

SEQ ID NO: 56972 - protein, 690 aa, Opitutaceae bacterium TAV2
MFVAVLASAGIFFYLARVLGSSAGLSGLQNMFLAGALLVSSSIVVSRVLGATGTSHERSGQLALGFTLLEDLVGVLMLAVLTSVVKFSDAAAGGTGEAQGAGPWLSHGPELGTTLGHFGAFIVLAGIVGLLLVPWLLRRMSVSASTELQTLMVAGALFGVAVIAERAGYSLALGAFLLGMIVAETPQRVQVERTFAGMRDVLGAVFFVAVGMQVDPALLAEAWLQILGFTVFALVVRTLAPAAGLLIAGAPQREALRAGLQLVPIGEFSFIIAQLGVLSGVMPERFFPAVVGVSLLTTLAAPVLGRHSEGIAMWALSHQPVWLAAWIRYYRGWLERMRVRRQESRLWQLSRKRFIQIGVEAVFVTGVLLFADQLFDVSEQWLGKWLPFTHAPAVIFWLGLCLLLLAPLVALWRNIGALAIIYAQVSVRGHPHAARLTPVIVTCIKIIAGMAMFVWLAALLPGGGGARWVIASTVVFGAGALFLLRRKLIYWHSELEVELQGMLEKKISGEDGAAAPWLRTHREWNLRIGECVLPDLAQCQGKTLAELQLRTAFGCIVVSIERQGAVISLPSPDTALYPLDRVLLLGTPEQIRAGRHFLTGVSGEPAAADFESVSLDTVLVPEDSHAAGRALRELEDAGVPHMQVAGIHRGRERILNPGPDEVLLPGDELLVLGAPDKIRKLGKWLATTEA

SEQ ID NO: 56973 - protein, 359 aa, Ashbya gossypii ATCC 10895
MGKKIVFNISSEFQLKALLGEGAYGIVCSAVHKPSGEVVAIKKIEPFERTLFSLRTLREIKILKHFQHENIISIYDIQKPASFDTFNEVYIIQELMQTDLHRVIATQPLSDDHIQYFIYQTLRGLKALHGSGIIHRDLKPSNLLLNANCDLKICDFGLARIEHGGAADLEHPQAGMTEYVATRWYRAPEVMLTAAQYTKAIDIWSSGCILAELFMKRPLFAGKDYKHQLMLIFELLGTPQGDDLAAVKSRRAREYIATLPRYRRASLRAVIPHANPLGLDLLQRMLVFDPRRRITAADALRHPYLATYHDPRDEPDGTPIPASFFDFDHHKDKLTTRDLKRMLWDEVFRDTHAPVRPDA

SEQ ID NO: 56974 - protein, 564 aa, Vitis vinifera
  misc_feature (44)..(44): Xaa can be any naturally occurring amino acid
  misc_feature (154)..(154): Xaa can be any naturally occurring amino acid
MESFVLYTSSSSFSPSSRLSLLRRSPPSLKSPPSIFPSSASPRXLSNLRSPPSRLLPPLALFKSKPSPKPRTFLHPIQASPSPPPPPVEESPKGAKLIPFIISISIGLIVRFLVPKPVQVSMQAWQLLAIFLSTVAGLVLNPLPVGAWAFLGLXTSILTNTLSFSTAFGAFTNEVIWLIVISFFFARGFVKTGLGDRVANYFVKWLGKSTLGLSYGLTFSEILIAPAMPSTTARAGGIYLPIIKSLSLSVGSKPGDPSARKLGAYLVQSQFQSAGNSSALFLTAAAQNMLCLKLAEEVGVIVSSPWVSWFRAASVPALVSLLLSPFILYNLYPPEIKDTPDAPAMAAKRLEHMGSVTRDEWVMIGTMILAVSLWVFGEALGIASVVAAMLGLSILLLLGVLEWDDCLSEKSAWDTLAWFAVLVGMAGQLTNLGIVTWMSSCVANLLQSFSLSWPAAFGVLQASYFFIHYLFASQTGHVGALYSAFLAMHVAAGVPGVLAALALAYNTNLFGALTHYSSGQAAVYYGAGYVDLPDVFKVGFMMALSNAVIWVVVGSFWWKFLGLY

SEQ ID NO: 56975 - protein, 420 aa, Flavobacteria bacterium BBFL7
MNDKVLSIILGGGQGSRLYPLTESRSKPAVPIAGKYRLVDIPISNCINSGLKRMFVLTQFNSASLNRHIKNTYHFSFFSSAFVDVLAAEQTPDNKGWFQGTADAVRQSMHHALRHDFEYVLILSGDQLYQMDFNEMIQAHIDANAKISIATIPVTEKDATSFGILKTDDKNIITSFIEKPDASLLPDWTSPVSDEMKNQNKNHLASMGIYIFNRDLLVELMGDESTIDFGKEIIPQSIDKHKTLSYQFEGYWTDIGNIDSFFEANLGLTDDIPEFNLYDYKQRVYTNARLLPTSKISGTHLDKAVIAEGCIIHAAKIERSVIGIRSRIGKETTVINTYMMGNDDYESLNQIADSKIEILTGIGDRCFIKNTILDKNVRIGDDVRINGGPHLENQETDQYVVKDGIVVIKKHAVIPKGFSL

SEQ ID NO: 56976 - protein, 327 aa, Gloeobacter violaceus PCC 7421
MKAFVLAAGKGTRLRPFTDALPKPLMPVMNKPVMAHILGLCRKHGLDQVVANLHYKGEKISEYFGNGSQYQVSLGYSREEQLLGTAGGVRRQADFLAGGPFLVISGDVMTDLDLTALLQFHKQSGAVATMAVKEVGDPSRFGVVVSDSHGKVESFQEKPIRGTERSRWANTGIYVLEPEVFNYIPEATFFDFGNDLFPMLVAEGAPVFAMRTGAYWSDVGTLAQYLYTHWELLTHPEIVQRIGEGTVVEPGAVISDQALIGRHCTIEKGARVLGYSCVSDGCVIRAGSVVVDSVMWTSEQLGERLSGDLVRSIWGDGKHVCLGIPNL

SEQ ID NO: 56977 - protein, 119 aa, Zea mays
GLVPLAGSYNESRCQGLDGLTSREADYYQQGSRFAKWLTAVSMPNGPYELTVKEAAWRLERYSGISQDNGLVPIVEPEILLDCEHGIERTFEVSHKVWSETFYAMAVNNVMFQGILLKP

SEQ ID NO: 56978 - protein, 495 aa, Pseudomonas putida
MLQKLRQTWFSNVRGDVLAGLVVALALIPEAIAFSIIAGVDPKVGLYASFCICAVIAFVGGRPGMISAATGAMALLMVTLVKEHGLQYLLAATLLCGVLQILAGHLKLGSLMRFVSRSVVTGFVNALAILIFMAQLPELTNVTWHVYAMTAAGLGIIYLFPYVPKIGKLIPSPLVCILTLTAIAIYLGLDIRTVGDMGQLPDTLPIFLWPEVPLNFETLRIIFPYSAALAVVGLLESMMTATIVDDLTDTTSNKNRECKGQGVANIAAGMLGGMAGCAMIGQSIINVKSGGRTRLSTLCAGVFLLLMVVFLGEWLSKIPMAALVAVMIMVSIGTFSWDSLRNLKEHPLSTNLVMVATVVVVVATHNLAYGVLVGVLLASLFFANKVGHYLDIKSTLEETKSHRTYHVVGQVFFSSADKFTEVFDFKEALNKVTIDLTQAHFWDITAVAALDKVVIKFRREGAEVEVLGLNEASATIVDRFGVHDKPGAIDKLMSH

SEQ ID NO: 56979 - protein, 451 aa, Oryza sativa
MVLRRFAWPYGGQRASFCGSFTGWRECPMGLVGAEFQVVFDLPPGVYQYRFLVDGVWRCDETKPCVRDEYGLISNEVLVDNTHPVVQPETSIRVVSMDEGTILTTMPPDQLSQNSGVQIAIFRHRVSEILLHNTIYDVVPVSSKIAVLDARLPVKQAFKIMHDEGLSLVPLWDDQQQTVTGMLTASDFVLILRKLQRNIRTLGHEELEMHSVSAWKEAKLQFYGGPDVAAIQRRPLIHVKDSDNLRDVALAIIRNEISSVPIFKSSTDSSGMPLLGLATLPGIVKFICSKLQEQPEGYSFLQNQIVSMPIGTWSPHTGKASNRQLRTSRPSTPLNSCLDLLLEDRVSSIPIVDDNGALLDVYSLSDIMALGKNDVYTRIGLDQVTGEHALELQYQVNGRRHCHTCLSTSTFLEVLEQLSAPGVRRVVVIEPRSRFVQGIISLRDAFTFLIG

SEQ ID NO: 56980 - protein, 447 aa, Treponema pallidum subsp. pallidum str. Nichols
MEADLLCKYEVALRESEPVKYVGHVTAVRGLLIESRGPHAVVGELCRIVLRRQGRPLIAEVVGLAGSTVKLMSYTDTHGVEVGCAVVAEGAALSVPVGDALLGRVLNAFGKAIDGKGEIYAPLRSEVLRASSNPMERLPITRQMVTGVRVLDSLLAVGCGQRLGIFSGSGVGKSTLMGMIARNTDADVSVIALIGERGREVMDFVAHDLGPEGLKRSVIVSATSDESPLARVRGAYTATAIAEYFRDQGKQVLLLFDSLTRFAKAQREIGLASGELPATRGYTPGVFETLPKLLERAGSFSMGSVTAFYTVLVDGDDLDEPISDAVRGIVDGHIVLSRALAQRNHYPAIDVLQSVSRLAHRVLGADMKEAVRIVRRALAVYAEVEDLVRVGAYQQGSDAELDRAIAMRAELERFLTQGAQERVRFQDTVTSLSMLTGLSIAQPPSGV

SEQ ID NO: 56981 - protein, 314 aa, Cryptococcus neoformans var. neoformans JEC21
MSSGAFGSAAPPLVVAGHDDGYPSDILSCIHPSLTFIRSRPIAPDLSLFILSKSISILHSASTMNILDTLFGRSMTPAERLRQHQRSLQKAQRELEREKGKLEAQEKKTMADIKRNAKAGNMNACKILAKDLVRTRRYIQKFTQMRVQLQAVSLRMQTLRSNEQMATAMKGATRAMGQMNRSLNLPQIQKIMNDFERESSTMDMKEEMMSDAVDDAMEDEEEGEGEEVESDKILKEVLDEIGMNMNESLISAPTASPLVPEPLQASRVAVAEGLPSSAAAGGPTNVGNGGVGAGSGMSSEEADLQRRLDALRRD

SEQ ID NO: 56982 - protein, 325 aa, Azoarcus sp. EbN1
MSNWYSDNALSIGKTPLVKLNRVTDGATATVLAKIEGRNPAYSVKCRIGAAMIWDAEQRGLLGPGKEIVEPTSGNTGIALAFVAAARGIPITLTMPETMSVERRKLLVAYGAKLVLTEGAKGMNGAIAKAEEIAASDPGRYVLLQQFNNPANPAIHASTTGPEIWNDTDGNVDIFISGVGTGGTITGVSRYFKETRGKPIVSVAVEPEASPVLTQTRAGEPLKPGPHKIQGLGAGFVPKVLDLSLIDAVETVSNEDAILYAHRLAREEGILSGISCGAAVAVAARIAQRPENAGKTIVVVLPDSGERYLSSILFEGLFDASGVAI

SEQ ID NO: 56983 - protein, 452 aa, Azoarcus sp. EbN1
MRKTLISAAIGLAFGLAGQAWANPVNTVTDTTDDNTQTATANSTQSGPGPQANEYSNATDNTDNRVDNSDNSDNRTDNNSDNRVDNSDNSDNRVDDNSDNRVDNSDNSDNHIDDDSDNRVDNTNNSDQNNDKSAGDNRNNDGTARAEGYGTAAANNGSTSTATFTNAFNTTEVMAIATLNGTVSGVSVSNVGNIATNHGSAYGGNGAAGGAGNGGDGIGGNANGAGGAGGAAAGGEGGMGSNGGDGAGGAAASGTANGATGSTGGSAYSANGDGGDGSGGGGSGSASNGSSGGSGVPGGEGGLAGGAGNSGDSSAAANGGSGTGGAGGTATNTAGNGGNGGTATSGAATAGNGTAGNGGNGGNGGTNTAGNGGDGGTNTAGAGTGGAGTGGAGAAGGAGGTAYADAGAFNMSNTVGGGSLANSAGISMTSLNSGIGALVQQSANVQANLTVR

SEQ ID NO: 56984 - protein, 129 aa, Triticum aestivum
  misc_feature (2)..(2): Xaa can be any naturally occurring amino acid
  misc_feature (42)..(43): Xaa can be any naturally occurring amino acid
  misc_feature (80)..(80): Xaa can be any naturally occurring amino acid
  misc_feature (98)..(98): Xaa can be any naturally occurring amino acid
  misc_feature (106)..(106): Xaa can be any naturally occurring amino acid
  misc_feature (111)..(111): Xaa can be any naturally occurring amino acid
  misc_feature (114)..(115): Xaa can be any naturally occurring amino acid
  misc_feature (120)..(120): Xaa can be any naturally occurring amino acid
  misc_feature (123)..(123): Xaa can be any naturally occurring amino acid
  misc_feature (126)..(126): Xaa can be any naturally occurring amino acid
MXNNREREKIFVASQEKFHANADKQYWKSISDLIPHEIATIXXRGKKDKDKKPSVTVIQGPKPGKPTDLSRMRHILVKLXHAPPPHMLQSPPAPAAKXGAKDGSKXRWKGXWVXXDGAEXQAXDAXQPA

SEQ ID NO: 56985 - protein, 293 aa, Zea mays
MADDAGAAGGPGGPGGPGLGGRGGFRGGFGSGLRGRGRGRGRGRGRGRGARGGKAEDKEWIPVTKLGRLVKDMKIKSLEEIYLFSLPIKESEIIDFFLGASLKDEVLKIMPVQKQTRAGQRTRFKAFVAIGDYNGHVGLGVKCSKEVATAIRGAIILAKLSIVPVRRGYWGNKIGKPHTVPCKVTGRCGSVLVRLIPAPRGTGIVSAPVPKKLLMMAGIDDCYTSARGCTATLGHFAKATFDAISKTYSYLTPDLWKETVFTKSPYQEFTDHLVKTHTRVSVQRTQAPAVATT

SEQ ID NO: 56986 - protein, 168 aa, Oryza sativa Indica Group
MGAADDANHRHEEASPLLPPGGGGAGAGGKKLNQSPPPSPPEAAKCCADGVPVVMGEPLGAPAPPRESWNSGVLSCLGRNDEFCSSDVEGSFEAFTKQCGCCHGLVEDEGNREHLEVACDLATHYFCHPCALCQEGRELRRRVPHPGFNGRSVLVMTPPKEQTMGRGM

SEQ ID NO: 56987 - protein, 150 aa, Physcomitrella patens subsp. patens
ASTPVGNKRLDAAYLEALAKSNGDTKSFPVFLFFSVNASGQFCGVAQMTGPVDFSKSVDFWQQDKWNGRFPVVWHIIKDIPNCQFRHIILENNDNKPVTNSRDTQEVKFEQGFGMLNIFKNFASKTSILDDFQFYENRQRALSEKRARQQ

SEQ ID NO: 56988 - protein, 353 aa, Gibberella zeae PH-1
MGCGMSTEEKEGKARNEEIENQLKRDKMMQRNEIKMLLLGAGESGKSTILKQMKLIHEGGYSRDERESFKEIIFSNTVQSMRVILEAMESLELPLEDQRMEYHVQTIFMQPAQIEGDVLPPEVGSAIEALWKDRGVQECFKRSREYQLNDSARYYFDNIARIAAPDYMPNDQDVLRSRVKTTGITETTFIIGDLTYRMFDVGGQRSERKKWIHCFENVTTILFLVAISEYDQLLFEDETVNRMQEALTLFDSICNSRWFIKTSIILFLNKIDRFKEKLPVSPMKNYFPDYEGGDDYAAACDYILNRFVSLNQHETKQIYTHFTCATDTTQIRFVMAAVNDIIIQENLRLCGLI

SEQ ID NO: 56989 - protein, 424 aa, Blastocladiella emersonii
TLIDKLMEKTKKVVGSSDKDAPAPASPSSPSTAAGAGSASSTASSTTTAAASGNLSIPSPLVAGSTTSSSISHAQKMATAAHTNSDYSPSPAATPSAPLDAVAERRRRKTTLADLELRQTLGTGSFGRVHLVRLRSTGKYYAMKVLKKAEVVKHKQVEHTLNEKGILEQIDHPFLVALHSSFQDSANLYMVMEYVTGGELFTYLRRSQRFSNNVAKFYAAEVVLAFEYLHSKDIIYRDLKPENLLLDAQGHVKITDFGFAKHVPDITWTLCGTPDYLAPEIIQSRGYGRAVDWYALGVLIFEMLAGYPPFYDEDHVRMYEKILQGKVKWPSHFDPAAKDLLKRLLTTDLTKRYGNLKGGSKDIKMHKWFAGLDWTKLFNKQIPPPYTPPNRGDGDTSNFDAYPEETEPYGKVQPDPYAQLFKDF

SEQ ID NO: 56990 - protein, 343 aa, Oryza sativa Japonica Group
MAAAAAAPSSSTSGSPGAAAAAARPTMPYRSRFGDTTLTKVFVGGLAWETPSEGLRRHFEQYGEILEAVVIADRLTGRSKGYGFVTFREAEAARRAVQDPNPMIAGRRANCNIASLGPPRPAQPPRGRASPGAQFQAPPPAFQGPPYIARGTPPPPAQMMPQPQHHGPPATIYHPSQSWYWYPPDYQYQQGLMNSQVLQSYYAAALQAQAQAQAQLYGMAASPTAPSPYQYLGYMPAPAPAVTPTAVLPPAQQQITGPPPPFVQQPAQHVTAPPPFVHHPTAAAQIQGSFVPLPSLPHNFRLQLPPNAMSILPPTPTALQPADLQAAPAATGATNPNNTPTGA

SEQ ID NO: 56991 - protein, 321 aa, Zea mays
  misc_feature (225)..(225): Xaa can be any naturally occurring amino acid
MGRSVWAVPLASLLAFGLVLGSVEASLGDVDPRYRTCVRECQTTGIIGENVISHCQFKEDNTSVGGSWYNQEQIYIQWKELNCMTDCRYFCMTRREGERQALGLSPVKYHGKWPFLRVSVFQEPLSAALSAVNLLMHFTGWLSFFLLVNYQLPLRPQAKRTYYEYTSLWHIYAILSMNAWFWSSIFHTRDIELTEKLDYSSAVALLGYSLILSLLRAFNVKDEAXQGWNMKVCVVMAAVQLLTWAVWAGVSRHPSRLKLWTVVFGGALVMLLELYDFPPYMGFADAHSLWHASTIPLTYLWWSFIKDDAKFRTSTLSKKAK

SEQ ID NO: 56992 - protein, 604 aa, Arabidopsis thaliana
MGICLMKRCCSWFLLISFLSALTNENEAISPDGEALLSFRNGVLASDGVIGLWRPEDPDPCNWKGVTCDAKTKRVIAFMWCIFCRFLKFLVCRSLTYHKLRGPLPPELGKLDQLRLLMLHNNALYQSIPASLGNCTALEGIYLQNNYITGTIPSEIGNLSGLKNLDLSNNNLNGAIPASLGQLKRLTKFNVSNNFLVGKIPSDGLLARLSRDSFNGNRNLCGKQIDIVCNDSGNSTASGSPTGQGGNNPKRLLISASATVGGLLLVALMCFWGCFLYKKLGRVESKSLVIDVGGGASIVMFHGDLPYASKDIIKKLESLNEEHIIGCGGFGTVYKLSMDDGNVFALKRIVKLNEGFDRFFERELEILGSIKHRYLVNLRGYCNSPTSKLLLYDYLPGGSLDEALHKRGEQLDWDSRVNIIIGAAKGLAYLHHDCSPRIIHRDIKSSNILLDGNLEARVSDFGLAKLLEDEESHITTIVAGTFGYLAPEYMQSGRATEKTDVYSFGVLVLEVLSGKLPTDASFIEKGFNIVGWLNFLISENRAKEIVDLSCEGVERESLDALLSIATKCVSSSPDERPTMHRVVQLLESEVMTPCPSDFYDSSSD

SEQ ID NO: 56993 - protein, 140 aa, Fulvimarina pelagi HTCC2506
MAIERTFSMIKPDATRRNLTGAIVKMLEDGGLTVIASKRVWMSRREAEGFYAVHKERPFFGELVEFMSSGPTVVQVLQGENAIARNREIMGATNPADAAEGTIRKEFAQSIGENSVHGSDAPDTASEEIAYWFSETEIVG

SEQ ID NO: 56994 - protein, 462 aa, Gloeobacter violaceus PCC 7421
MKVGVIGTGYVGLVTGACLATIGHHVVCMDNNTAKVEGLRQGVMPIYEPGLDALVAAAVATGQLQFTTEMAETVRPSDVVFITVGTPSRADGSPDLSAVRAVARAIGAHLDGRFRVVVNKSTVPVGSGNWVRMLVEDGANLAAATAGSSHYTGNGLAVLSPGEPPNFSVASNPEFLREGSAVWDTFNPDRIVIGAEDVKAIAVMRKLYAYWLAPEQADREPVPMVVTDLASAEMIKYAANAFLATKISFINEIANICERVGADVTRIAEAIGLDKRIGRSFLNAGAGWGGSCFPKDVSALVSTAAEYGHDCELLKATLSVNEHQRQLVIEKLQRELRILKGRTVALWGLAFKPHTDDIRCAPALAVAEHLLNLGCRVVAHDPVVTAAQVQGQLPDLQVAGSALEAVQGADALLVMTEWPEYTRVNLGVVAAGLRQPVVIDARNCLDPQQVVQAGMRYSGVGR

SEQ ID NO: 56995 - protein, 334 aa, Flavobacteria bacterium BBFL7
MIVKLILYCKFHCIKQTIMSKNQFGKNGWTPDIIGSLKGKTYVITGTTSGTGLEAAKILLAKDAKVVMLNRNNTKAQDTIAKFKSELGNHIEVSNIQMDLAQLASVRKAAKQVLSTIPHIDALICNAAIAQVPKQVLTVDGFESQLGVNHYGNFLLQGLLFPLIDKSNGRIVTVGSEGYKMGIKTIKFDDMNWDNDYNPNTVYSQSKLAQIMSVYELQDRLKNAGKSNVKVYACHPGASRTSLIKTSGSLMTRFIWQMMKLSPFVQSAEKGSYPALMCATEPELDQKRYYGPTSGNYWKGPVGECNLEPHAKDKATMVKLWEVSEDATGFQWNL

SEQ ID NO: 56996 - protein, 449 aa, Salmonella enterica subsp. enterica serovar Typhi str. CT18
MTEIVVSKFGGTSVADFDAMNRSADIVLSDANVRLVVLSASAGITNLLVALAEGMEPGERFATLDAIRKIQFDILDRLRHPNVIREEIERLLENITILAEAASLATSAALTDELVSHGELMSTLLFVEILRERDVQAHWFDVRKVMRTSDRFGRAEPDVAALAELAAQQLLPRLSETLVITQGFIGSESKGRTTTLGRGGSDYTAALLAEALHAARVDIWTDVPGIYTTDPRVVPVAQRIDEIDFEEAAEMATFGAKVLHPATLLPAVRSDIPVFVGSSKDPQAGGTLVCNKTQNPPLFRALALRRNQTLLTLHSLNMLHSRGFLAEVFGILARHNISVDLITTSEVSVALTLDTTGSTSTGDTLLTQSLLMELSALCRVEVEEGLALVALIGNNLSKACGVGKEVFGVLEPFNIRMICYGASSHNLCFLVPGDDAEKVVQKLHQNLFE

SEQ ID NO: 56997 - protein, 549 aa, Salmonella enterica subsp. enterica serovar Typhi str. CT18
MKNINPTQTSAWQALQKHYDEMKDVTIAELFANDSDRFAKFSATFDDLMLVDFSKNRITEETLAKLQDLAKETDLAGAIKSMFSGEKINRTEDRAVLHVALRNRSNTPIIVDGKDVMPEVNAVLEKMKTFSQAIISGQWKGYTGKAITDVVNIGIGGSDLGPFMVTEALRPYKNHLTMHFVSNVDGTHIAEVLKKVNPETTLFLVASKTFTTQETMTNAHSARDWFLKSAGDEKHVAKHFAALSTNAKAVGEFGIDTANMFEFWDWVGGRYSLWSAIGLSIILSVGFDNFVELLSGAHAMDKHFSTTPAEKNLPILLALIGIWYNNFFGAETEAILPYDQYMHRFAAYFQQGNMESNGKYVDRNGNAVDYQTGPIIWGEPGTNGQHAFYQLIHQGTKMVPCDFIAPAITHNPLSDHHQKLLSNFFAQTEALAFGKSREVVEQEYRDQGKDPAQLEHVVPFKVFEGNRPTNSILLREITPFSLGALIALYEHKIFTQGVILNIFTFDQWGVELGKQLANRILPELGDDKAISSHDSSTNGLINRYKAWRA

SEQ ID NO: 56998 - protein, 315 aa, Zea mays
PTFRTCVRECQTTGIIGENVISHCQFKEDNTSVGGSWYNQEQIYIQWKELNCMTDCRYFCMTRREGERQALGLSPVKYHGKWPFLRVSVFQEPLSAALSAVNLLMHFTGWLSFFLLVNYQLPLRPQAKRTYYEYTSLWHIYAILSMNAWFWSSIFHTRDIDLTEKLDYSSAVALLGYSLILSLLRAFNVKDEASRVMFAAPILAFVTTHILYLNFYELDYGWNMKVCVVMAAVQLLTWAVWAGVSRHPSRLKVWTVVFGGALAMLLELYDFPPYMGYADAHSLWHASTIPLTCLLWSFIKDDAKFRTATLVKKAK

SEQ ID NO: 56999 - protein, 572 aa, Oryza sativa Japonica Group
MAGLAVAGRSLDEAFEVTSAVDNIGAWGWLDVQGCRRSLKRLGTRSSMRRAWLDRAVDSEGKAHARDIVREIISRGTDDWIVRRKYLSVDNGQAQKENTSSHTEDLGGDGEEDIPLPREPQPTPRSAVHRRGQQQLTKKKGLSGGKLGGPPVAPEIFLRWSLSDDQEKYYDELVSYLEEELGLKMHKARRFDLDCTNHLVKHHPMLPDRNLSAQAQIDSDTINESPQALPTNISSQIVSCSVDEAPQALPTSSSPISNNTEGLSLQALPTSSESAAGVTIDDLHSFCSQEFITDPVNRLSDRIDSEYVLLVNPAMPHLLGNSSDATDLDCTNQLVENHPKLPDQNLSAQAQIDGDTINEAPQALPTSVGSQIGGCSVDETLQALPASSSLISSNTENLSPQALPTSSESAAGVTIDDLRSLCSQEFFTDPVVVHAFNSQDPHLLGEGTHWSLLVFDRNLGGRPCLAHHDSSPGDANLRAARRLAASLLPYLPPETKCTKAPTPKQNNGTECALYMIKCAEVICGWWRNHAAGGSESHWLGVVARGVTMDSVDNLRAQLIHDIGQLLNGSSSS

SEQ ID NO: 57000 - protein, 515 aa, Oryza sativa Japonica Group
MTLRGGLRLHARTQPWNSLLPLLLTYASRAHGRRRRRRLHAAVLSPPPRDLAHAEDATTPARAAASGSGRIRCSPSAPSASSAPRSTPSRSPSSRRGSPGTSDHPFSAQAHYSQPDFPTIASCRAAVASSKWRRRHPSTTKESAGVEPAEPPVLVRIKNERDPVRLYELFRANAHNRLLIENRFAFEDAVARLAGARRNDLVEEILEQHKALPQGRREGFVVRIIGLYGKARMPDHALSTFREMGLYGCPRTAKSLNATMKVLLRARLFDEVLQLFESSETYGVELDDISYNTVVKMMCDLGELRAAFRVMQEMEKAGVRPDVITYTTLMDAFYKCGQREVGDGLWNLMRLRGCMPTLASYNVRIQFLVNRRRGWQANDLVRKMYASGLRPDEITYNLVIKGFFMMGEHEMAKTVFGAMHGRGCKPNAKVYQTMVHYLCERREFDLAFRLCKDSMEKNWFPSVDTINQLLKGLISISKDRNAREIMKLVIGRKPSYSNDEVKTFQDILSLGNTRR

SEQ ID NO: 57001 - protein, 671 aa, Oryza sativa Japonica Group
MKKKKSSHLGGPTCHTPTLSWAPDVWWYIPGPVFTSIRFSSLPWPGSKRGAAMEKRRRLVVAGDGEGDGGEASGSAARGLVESLPEGAPRGGGRQAGAEGRVLGRVVLRRPPRRRRRRLLAVTSLDLSMFPPTNAILNRILAGNGALRCLAVNCSLLDDSAVGAIAKGSLRELSLLKCSSFSSYLFVAVGERCKNLRSFVLEMAASDDDEHFGICRKSIAHIVKGCGYLENLSLKFFPLLGPGSVDFESLVPIPSTIKVLLLQPVSNWQAKRLFPISTSLKTSISNTLESLSLVLDIITDELVAFITGSLHNLVELCLEDNPMKEPDLHNDLTNVGLQALGLCHNLAHLSLTRGKQNCSSTFRRVTDFGIMMLADGCKQLKTIRLAGFSKVRDAGYAALLQSCKDLKKFEVSTGYLSDLTCLDLDEAAPKITEVRLLCCSLLTSETAISLSSCTKLEVLDLSGCRSIADSGLASISQLSKLTLLDLAGADITDAGLSALGNGRCPMSSLCLRGCKRISNNGIASLLCGSGTINKTLISLDIGNVPRISGRAVTLIAKNCEQISSLCLRNCLLINDSSLETLGSMRHNLGKSSLRMLDLSYCSRLSRNFLGLFEPPFFRGLRWLGVGKNMLERRGCSPTVAELLERKPGLTVCGNACEMGCRNQCHPDIRRQ

SEQ ID NO: 57002 - protein, 290 aa, Oryza sativa Japonica Group
MSAPSDPAVATHPQAGAAAAASSSSGLTFKLHPLVIVNVSDHHTRVKAQAACSGDGASSAAAGGQPPRVFGCVIGVQRGRTVEIFNSFELVLDPVSGTLDRAFLEKKQELYKKVFPDFYVLGWYSTGSDVRDTDMQIHKALMDINESPVYLLLNPAINLSQKDLPVTIYESELHVIDGSPQLIFVRANYTIEEYTVPSRCSIAGSVLSINILFPCRKVSTVNPFTITAGDMPLDNSLLRQVSSLEYNDTLLMTYLAMFTNCSSTMNELVEKFNATYERSTARRGGRGAFM

SEQ ID NO: 57003 - protein, 482 aa, Bordetella petrii
MSAAAAPVVERWETQLRIGSIRAASTEPWLASGRIIRATGLVLHATGLRLPVGAACRIEIARGHDHWADAEVVGFDGHTLYLMPQADISGLPPGARVVPGEPPVQRAIPLPRRAELNGNAKPQLGRHLPVGNALLGRVLDGAGRPLDGLGPLTGAELAPLSAHPINPLSRAPIDTVLDVGVRAINGLLTVGRGQRMGLFAGSGVGKSVLLGMMARYTRADVIVVGLIGERGREVKEFIEHNLGADGLARSVVVAAPADVSPLLRLQGAAYATRLAEHFRDQGLDVLLIMDSLTRYAMAQREIALAIGEPPATKGYPPSVFARLPALVERAGMGAPGPNGKAGSITAFYTVLAEGDDQQDPIADSARAILDGHVVLSRHLAEAGHYPAIDIEASISRAMTSLISDQQYAVVRRFKQTLSRYQRNRDLIAVGAYSAGNDPQLDDAIARYPRLEAFLQQDIGDSVSYDAAVDQLRAAFETKEAYA

SEQ ID NO: 57004 - protein, 213 aa, Zea mays
  misc_feature (165)..(165): Xaa can be any naturally occurring amino acid
  misc_feature (184)..(184): Xaa can be any naturally occurring amino acid
MVLSHAASAGSSDDSVRSTFASRYVRASLPRFRMPENSIPKEAAYQIINDELMLDGNPRLNLASFVTTWMEPECNKLMMDSINKNYVDMDEYPVTTELQNRCVNMIAHLFNAPLGETETAVGVGTVGSSEAIMLAGLAFKRRWQNKMKAAGKPCDKPNIVTGANXVRFAWEKFARYFEVELKEXKLSEGYYVMDPEEGVEMVDENTICVAAIL

SEQ ID NO: 57005 - protein, 364 aa, Zea mays
MDAKPRNLGGSLPVPNVQDLAARPGDELTPPVLSRYLRDDVDGADANGDAASSVPVVDLARLLDPSSHGDEESAKLKAACEEWGFFQVINHGVPDAVVADVKADLQAFFRLPLADKRAVAQEPGGIEGYGQAFVVSEDQKLDWADMLFLSTQPPEYRAPRFWPARPATFGDSLARYSAEVQRVAARLLASMAANLGVADAARLARVADAQAVRVNYYPACPHGRGRVLGLSPHSDAAGLTLLLQVSAVPGLQIRRRGAWISVDPIPGALVANVGDVVEVLTNGRYKSIEHRALVSPTHHRVSVAAFHSARFGDTYAPLEETIVDGDEPARYRSIGVEDYVRLVLSSKLQGKNIMDAMKINPVTE

SEQ ID NO: 57006 - protein, 462 aa, Streptomyces avermitilis MA-4680
MANDASTVFDLVILGGGSGGYAAALRGAQLGLDVALIEKDKVGGTCLHRGCIPTKALLHAGEIADQARESEQFGVKATFEGIDVPAVHKYKDGVISGLYKGLQGLIASRKVTYIEGEGRLSSPTSVDVNGQRVQGRHVLLATGSVPKSLPGLAIDGNRIISSDHALVLDRVPESAIVLGGGVIGVEFASAWKSFGADVTVIEGLKHLVPVEDENSSKLLERAFRKRGIKFNLGTFFSKAEYTQNGVKVTLADGKEFEAEVLLVAVGRGPVSQGLGYEEQGVAMDRGYVLVDEYMRTNVPTISAVGDLVPTLQLAHVGFAEGILVAERLAGLKTVPIDYDGVPRVTYCHPEVASVGITEAKAKEIYGADKVVALKYNLAGNGKSKILNTAGEIKLVQVKDGAVVGVHMVGDRMGEQVGEAQLIYNWEALPAEVAQLIHAHPTQNEAMGEAHLALAGKPLHSHD

SEQ ID NO: 57007 - protein, 468 aa, Staphylococcus aureus subsp. aureus Mu50
MTQQIGVIGLAVMGKNLAWNIESHGYSVSVFNRSSEKTDLMVEESKGKNIHPTYSLEEFVNSLEKPRKILLMVQAGKATDATIDSLLPLLDDGDILIDGGNTNYQDTIRRNKALAQSAINFIGMGVSGGEIGALTGPSLMPGGQEEAYNKVADILDAIAAKAKDGASCVTYIGPNGAGHYVKMVHNGIEYADMQLIAESYAMMKELLGMSHEDIAQTFKDWNAGELESYLIEITGDIFMKLDENKEALVEKILDTAGQKGTGKWTSINALELGIPLTIITESVFARFISSIKEERVNASKELNGPKASFDGDKKDFLEKIRKALYMSKICSYAQGFAQMRKASEDNEWNLKLGDLAMIWREGCIIRAQFLQKIKDAYDNNPGLQNLLLDPYFKNIVTEYQDALRDVVATGVQNGVPTPGFSSSINYYDSYRAADLPANLIQAQRDYFGAHTYERKDKEGVFHTQWIEE

SEQ ID NO: 57008 - protein, 424 aa, Staphylococcus aureus subsp. aureus Mu50
MEITMPKLGESVHEGTIEQWLVSVGDHIDEYEPLCEVITDKVTAEVPSTISGTITEILVEAGQTVAIDTIICKIETADEKTNETTEEIQAKVDEHTQKSTKKASATVEQTFTAKQNQPRNNGRFSPVVFKLASEHDIDLSQVVGSGFEGRVTKKDIMSVIENGGTTAQSDKQVQTKSTSVDTSSNQSSEDNSENSTIPVNGVRKAIAQNMVNSVTEIPHAWMMIEVDATNLVNTRNHYKNSFKNKEGYNLTFFAFFVKAVADALKAYPLLNSSWQGNEIVLHKDINISIAVADENKLYVPVIKHADEKSIKGIAREINTLATKARNKQLTTEDMQGGTFTVNNTGTFGSVSSMGIINHPQAAILQVESIVKKPVVINDMIAIRSMVNLCISIDHRILDGLQTGKFMNHIKQRIEQYTLENTNIY

SEQ ID NO: 57009 - protein, 464 aa, Methanocaldococcus jannaschii DSM 2661
MNKMNIDKNLLEKWDKEYIWHPYTQMKEYRESKNLIIERGEGNYLIDIYGNKYLDAVSSIWCNLFGHSRKEIIEAIKNQADKICHSTLLGCGNVPSILLAKKLVDITPKHLTKVFYSEDGAEAVEIAIKMAYQYYVLRGDKGRTKFISVKEGYHGDTVGAMSVGGSELFHGVFKPLLFKGYHANPPYCYRCKYHNFKDTDERNEKGCEMECLNEMISLIEKHAEEVFCVILEGGIMGSAGMIPYPDGYIEGVAKACKENDVIFILDEVATGFGRTGKMFFCDNEELKKLEKPDILCLGKGLTGGYLPLAATLTTDEIYNQFLGEFGESKQLYHGHTYTGNQLLCSAALATLEIFEKENVIENIQPKIKLFHKELRKLKELEHVGDVRGRGFMVGIELVKDKETKEPYPYGYKAGYRVAEKLLEKGIYMRPIGNVIILVPPLSITEKEIIYLCDALYEAIKEADL

SEQ ID NO: 57010 - protein, 445 aa, Arabidopsis thaliana
MAILSLRSSSSLPLICSTISPLCSKPMLSQLPSNFSSSIASVPVTKLKSSYSSSVSPISRPRVVSARAATESFTDYREDIGEILGDVSIFTASGQRVQFSDLWDQKDGIAAVVLLRHFGCVCCWELATALKEAKPRFDAAGVKLIAVGVGTPDKARILATRGGTFVFRGKKLLYGRKDEGTGDHPSLDDVINRLVTGDPNDEACLTNLRQSLEDPANNLRNWTKSFFINPCSGFSSYLHGVICNNGRIYKLSLTNLSLRGSISPFLSNCTNLQSLDLSSNQISGEIPPQLQFFVNLAVLNLSSNRLSGQISPQIALCAYLNVIDLHDNQLSGQIPFQFGLLARLTAFDVSNNKLSGQIPSNLAMRNGNLPRFNASSFIGNKKLFGYPLEEMKNKGLSIMAIVGIGLGSGIASLVISFTGVCIWLKITEKKMEEEEGKISHSMPVY

SEQ ID NO: 57011 - protein, 314 aa, Glycine max
  misc_feature (66)..(66): Xaa can be any naturally occurring amino acid
MAEHLASIFGTEKDRVNCPFYFKIGACRHGDRCSRLHTKPTISPTLVLSNMYQRPDMNMNIIFQPXQPQPQSLDPDKVQDHFDDFYEDLFEELSKYGPIQSLNICDNLADHMVGNVYVQFREEDHAANALMNLTGRFYSGRPIIVDFSPVTDFREATCRQYEENVCNRGGYCNFMHLKKISRDLRRKLFGRNRRWNGRSGSRSRSPPRNRNHGEHLHSGRGSGRRDFDRSHGHHGRRPRSRSPRYRGKRSRSPVGRDRSPPIRENSAERRAKIEQWNREKEQGETSNKNNTKSNDDYQEQSVAQNGSESGNHQI

SEQ ID NO: 57012 - protein, 473 aa, Staphylococcus aureus subsp. aureus Mu50
MSEKQYDLVVLGGGTAGYVAAIRASQLGKKVAIVERQLLGGTCLHKGCIPTKSLLKSAEVFQTVKQAAMFGVDVKDANVNFENMLARKEDIINQMYQGVKHLMQHNHIDIYNGTGRILGTSIFSPQSGTISVEYEDGESDLLPNQFVLIATGSSPAELPFLSFDHDKILSSDDILSLKTLPSSIGIIGGGVIGMEFASLMIDLGVDVTVIEAGERILPTESKQASQLLKKSLSARGVKFYEGIKLSENDINVNEDGVTFEISSDIIKVDKVLLSIGRKPNTSDIGLNNTKIKLSTSGHILTNEFQQTEDKHIYAAGDCIGKLQLAHVGSKEGVVAVDHMFEGNPIPVNYNMMPKCIYSQPEIASIGLNIEQAKAEGMKVKSFKVPFKAIGKAVIDSHDANEGYSEMVIDQSTEEIVGINMIGPHVTELINEASLLQFMNGSALELGLTTHAHPSISEVLMELGLKAESRAIHV

SEQ ID NO: 57013 - protein, 719 aa, Ashbya gossypii ATCC 10895
MFGQGYYQGNRDQDSPLQRPPAAQFSSAYMEQQGSHQSLQEHLAYEQLQLQQQQQQQQQHAAAPHANGDGYGAGFTDIPTMLGSVGAPSPAFQPPMVVGMQQQPINTPPPTATSIYSQNNNSFTNVNDTTLAPGHSSPGHYSNSSDYSGQQPASSAYKQFGGSESPLQPAALPGLLDGSLGDQTLVGNQSSQGAMLSRQSLQCSSVPQSPNGGQRQTSGVGNYMYFERRPELLSKSTQEKAAAVKLKVENFYQSSVNHAIERNQRRVELESQLLSHGWSEERKNRQLSSLGKKESQFLRLRRTRLSLEDFHTVKVIGKGAFGEVRLVQKKDTGKIYAMKTLLKSEMYKKDQLAHVKAERDVLAGSDSPWVVSLYYSFQDAQYLYLIMEFLPGGDLMTMLIRWQIFTEDVTRFYMAECILAIEAIHKLGFIHRDIKPDNILIDIRGHIKLSDFGLSTGFHKTHDSNYYKKLLQEDEQQQNGGNMGKYPASGGGGNGGGNRNTMLVDAIHLTMTNRQQMQTWRKSRRLMAYSTVGTPDYIAPEIFLYQGYGQECDWWSLGAIMYECLIGWPPFCSETPQETYRKIMNFEQTLVFPDDIHISYEAEDLIRRLLSHADERLGRHGANEIKNHPFFRGVDWETIRQVGAPYIPKLSSVTDTRFFPTDELENVPDSPAMAQAAKQREQMLKQGGSAANTAQAKEDLPFIGYTYSRFDYLTRKNAL

SEQ ID NO: 57014 - protein, 93 aa, Oryza sativa Indica Group
MASGGGGGGGMEAVEVRFRLDDGSDIGPSMHDQATTVTALKEFVLARWPQGKEIAPRTVNDVTIINAGQVLENNRTLAESRNLAAESPEGCLK

SEQ ID NO: 57015 - protein, 547 aa, Ashbya gossypii ATCC 10895
MNTSGAVAAASTALAVNNMANTKMNAASAAQQQASLSQSHTFSQQAGVAGSNVSTVSGRDDTTIVGLHFKIGKKIGEGSFGVLFEGTNMINGVPVAIKFEPRKTEAPQLKDEYRTYKILAGTSGVPQAYYFGQEGLHNILVIDLLGPSLEDLFDWCGRRFSVKTVVQVAVQMITLIEDLHAHDLIYRDIKPDNFLIGRPDQPDANKVHLIDFGMAKLYRDPKTKQHIPYREKKSLSGTARYMSINTHLGREQSRRDDMEALGHVFFYFLRGQLPWQGLKAPNNKQKYEKIGEKKRSTNVYDLSQGLPVQFGRYLEIVRNLGFEETPDYDGYRKLLLSTLEELGLEYDGEYDWMKLNGGRGWDLTINKKPNLHGYGHPNPPNEKGRRHRSKYPQPSAPQQMSSPQDPRYGSSQLQLQQRLDPTSYEAYQQQTQQRYAQQQLKLQHHQPRLNYQAQPLQQSSQQPQAQQQNQQTQNQQTQQQQTQYRTQQQAQYPFPSHSSQPGMHQKQGLLQGQNGSVTAGTTTANGKQQDVGSVSSGKGFFSKMGCC

SEQ ID NO: 57016 - protein, 222 aa, Flavobacteria bacterium BBFL7
MSIKDHLLRFRESIEPKATLVAVSKTKPISDLQEAYDAGQRHFGENKIQEMTEKWETLPKDIHWHMIGHTQRNKVKYMAPYVHLIHSVDSPRLLKEINKQAVKNERVIDCLLQIHIAEEETKFGFDQNELLELLSSDAFAGYKNVRITGLMGMATFTDNKEQVRKEFKSLKTLLDHINDNHLISDSHDLKTLSMGMTGDYEIALEEGSTMVRIGSAIFGSRA

SEQ ID NO: 57017 - protein, 322 aa, Euglena gracilis
MLTSKDQELAVLLSALSLACKATARACNKAGIALLFGLAGETNATGDDQKKLDVLSNDIFINTLTNSGTCAVLVSEENEEPIIIDPAHAGRFCVAFDPLDGSSNIDCNVSTGTIFGVYERISTGFATVDDIFRTGNDLIVAGYCMYGAATELVITFKNQGVHRFTLDPSLGEFIHTHSNVTFPEDGGKKIYSCNEGNSSNWDPAIKASVEYFKAGSKPYAARYVGSMVSDVHRTILYGGIYLYPADAKSKNGKLRVLYEGFPMAMIVEQAGGVASCGLFKGTIQRLLDLVPTSIHEKCPVILGGERDVKLVLSKYKELGLAA

SEQ ID NO: 57018 - protein, 597 aa, Oryza sativa Indica Group
MDTTIGSVPTASDAAAPPPAPAAATAPREATLGRHLARRLAEVGARDVFTVPGDFNLTLLDELEAEAGHGGVRLVGCCNELNAAYAADGYARARGGGVGACAVTFTVGGLSAINAVAGAFSENLPVVCIVGGPNSNDYGSNRILHHTIGLPDFTQELRCFQTVTCYQAVVNNLEDAHEQIDAAISTAIKESKPVYISISCNLPSIPHPTFSRHPVPFFLSPRLSNQMNLEAAVETAAAFLNKAVKPVLVGGPKMRVAKACKSFVELADACGYPVAVMPSAKGLVPEHHPRFIGTYWGAVSTPFCAEIVESADAYLFAGPIFNDYSSVGYSLLLKKEKAIIVQPDRVVIGHGPAFGCVLMKDFLHALSARLKKNTAAYENYRRIYVPPGEPPLSEPGEPLRVNVLFQHIQKMLSANSAVIAETGDSWFNCQKLKLPEGCGYEFQMQYGSIGWSVGATLGYAQAAKDKRVIACIGDGSFQVTAQEVSTMLRWGQKSIIFLINNGGYTIEVEIHDGPYNVIKNWNYTGVVEAFHNGEGKCYTAKVRTEEELKEAIEEAQGPKKDCLCFIEVIVHKDDTSKELLEWGSRVSAANSRPPNPQ

SEQ ID NO: 57019 - protein, 599 aa, Triticum aestivum
  misc_feature (343)..(343): Xaa can be any naturally occurring amino acid
MAQIPNLDNAALNLTALREQSQKELLSIIKSIRGKKCLVIDPKLAGTLSLILQTSVLKEYGTELRILSADPLQTECPKVVYLVRSQLNFMKFVANQIKNDESKGLQREYHLYFVPRRIVACEKILEEEKVHQKLTIGEYPLYLVPLDEDVLSLELDYSLQECLIEGDTSSVWHVAKAIHKLEFAFGVIPNIRAKGVASTKAAELLNHMQLEDPVSMDNMGIPEIDTVILLDREVDMVTPGPSQRSYEGLLDEMLEIHNGSVEVDASIMGAQQDGKKVKVPLNSSDKLYKEIRDLNLHVVVVRQKATSIQQDYAEVKSTNTQSVSELKDFVKRLHSLPEIARHXVNLAQHLQSFAAKPAFHARVEIEQIILEAQTYETCYEYIEEIIQKQEPIETVLRLLVLFSLTNAGLPKKNFDYLRREILHSYGFEHMPLLYNLEKAGLVKRQESRTNWPVISRALQLIVDIKDPENPDDIAYIFAGYAPLSIRLVQHAVRSGWRSIEELLKLLPGPHMDLKRGVSTISSSELLPGSGSQQSTDRVGHRSLVLVVFIGGVTSAEIAALRFLSAQEGMGYDFLVATTKVITGNTLLRPIIASSKEGMI

SEQ ID NO: 57020 - protein, 736 aa, Methanococcoides burtonii DSM 6242
MSEDITVRVAEANHRDAGRGIARLPNALMQTIDARSGDIIEIRNKKNTYARVYPAGLDDEGKNIIRIDGNLRGNARVGIDDPVTVKRILEKDAEKITLAPTHPVLNERISRSVHLSLEGRPVDKGQRIRVENINNPLIFVVKATKPHGPVVVTRTTKIEIVEPIAETDMGEEVSYEDIGGLKRELGLMREMIELPLRHPELFDKLGVDPPKGVLLYGPPGTGKTMIAKAVASESEANFIPISGPEIISKYYGESEQKLREIFEEAEKEGPTIIFIDELDSIAPKRDDVVGEVERRVVAQLLTLMDGLTSRGKVIVIAATNRPNSIDQALRRGGRFDREIEIGIPDRGGRLQVLYVHTRGMPIEQGLNLENIADITHGFVGADLASLCKEAAMHALRRMLPLISIEEEIPPEIMETLEVTETDFIEAHRNIEPSALREVFVEIPHVRWEDIGGLNKVKQELIEAVEWPLKYPEMFTALNTTPPRGILLFGPPGTGKTLLAKAVANESEANFISIKGPELLSKYVGESEKAVRETFRKAKQAAPTVVFFDELDSMVPKRGMGSDQQATERVVSQILTEIDGIEELKDIVIVAATNRPDIIDPALLRPGRFDRLIYVRPPDKEERAKILDIHLSGKPIAEDVKLEELAELTEGYVGADIEAICREAAMMTLREIIRPGMTKDEVYETVKNVVIQRSHFSTAIKRVRASTSLDEMKRYDETARMFSNPDADENKDLREKA

SEQ ID NO: 57021 - protein, 662 aa, Photobacterium profundum SS9
MNYFITGATGFIGSHLLQRLAKRPGVFYVLARSESSEKKLQDLIEKHAFPQDKFHTVRGSITESNLGLSTENIKHLTGKITHFFHLAAVYDLEADENDLMRANVEGTDNALRLAERIQAGCFHHVSSIAVAGLFRGWFREDMLEQATDLEHPYFKTKHEAEKLVQETATIPWRAYRPGIVIGDSKTGEAERVDGPYYFFKILQKLRRSLPEWMPMLGLEGGRLNLVPVDYVVDSIDHIAHKDELDGQAFHIVDPDPYRAGEVINIFAEAGHAPRMAMRLDMRLFRMIPTHLWKELSQLPVLRRFMEALSQEMQVPKEALCLFNYPTQFDCHNTLKALEDSTINCPRLTDYAPKIWDYWERNLDPSLHIDRTLKGTVENKVIVLTGASSGIGYTTALKLADTNATLVLIARDLDRLQQTRNDVESRGGRAFIYQADLSKEEESNKVMDEIKRHHGNIDILINNAGRSIRRSVMHSTDRLHDYERTMQINYFGALRLILGSLPGMVEQQSGHIINLSSVAVLTNQPRFSAYAASKSALDSFTRTASAELCGQGVNFTTINMPLVETPMIADHYRKAKGGIPLLSSDEAADLIIKAIIEKPKRIANRIGLFAALVHGVYPKLGELVMNTGFNMAPETDGKKHDSDPKQNSADVMALSNLIREIHM

SEQ ID NO: 57022 - protein, 382 aa, Cryptococcus neoformans var. neoformans JEC21
MSAPESSPSTFYTVPTKHILSKAHLAAFQRSKTHSDIFNFIEELNEDIVGKKLTEAGQGSERTRPLISILDSVREIAESTPPVDNKLSRFGNPAFKTFYDKVGDASLELHKRIPGLPEEAIQEVEVYFKESWGNKQRVDYGSGMELNFLSWLLCLAKLGVVTKEDYPFLVLGVFWRYIEVMRYLQSTYWLEPAGSHGVWGLDDYHFLPFLWGSGQLRNHKYLRPKAIHDPEILGEFSKDYMYLSCIEFINSIKTASLRWHSPMLDDISAVKTWEKVNQGMKKMFVAEVLGKLPVMQHALFGSLLPFPTPEEDPELKRALEEEDGQSATDMHGHIHDPSEKGWSMDCCGIPVPSAFAAAQDANSHKGVPTLGNRPGIKPIPFD

SEQ ID NO: 57023 - protein, 293 aa, Staphylococcus aureus subsp. aureus Mu50
MTNLPMNKLIDEVNNELSVAINKSVMDTQLEESMLYSLNAGGKRIRPVLLLLTLDSLNTEYELGVKSAIALEMIHTYSLIHDDLPAMDNDDYRRGKLTNHKVYGEWTAILAGDALLTKAFELISSDDRLTDEVKIKVLQRLSIASGHVGMVGGQMLDMQSEGQPIDLETLEMIHKTKTGALLTFAVMSAADIANVDDATKEHLESYSYHLGMMFQIKDDLLDCYGDEAKLGKKVGSDLENNKSTYVSLLGKDGAEDKLTYHRDAAVDELTQIDEQFNTKHLLEIVDLFYSRDH

SEQ ID NO: 57024 - protein, 142 aa, Methanosarcina mazei Go1
MKNEYKGRKWGNFVYNKKVMDHFMNPRNVGEIENADGIGEAGNPHGDQMKIFLKIRDNRIEDVKFKTFGCAAAIASSSMATEMIKGKTLEEAWELTDEAVAEALEGLPPGKLECSVVSREATHRAINDYRKKQGLEPLEEKT

SEQ ID NO: 57025 - protein, 198 aa, Zea mays
SREPLAVSELRRRRPRGRRTRLGSDDGDLGQRRLPPPPPRPSGAALAPHPARFAAKRRTLRLVNVSVSCSAEALRSDGAGAEPAVPRSVPVRVAYELQQAGHRYLDVRTEGEFSAGHPEGAVNIPYMNKTGSGMTKNAHFLEQVSRAFGKDDEIIVGCQSGKRSLMAATELCSAGFTAVTDIAGGFSTWRENELPTVQ

SEQ ID NO: 57026 - protein, 604 aa, Porphyromonas gingivalis W83
MKTFEELGIAKPFLKAIAELGFEQPMPVQEEVIPYLLGEDIDLIALAQTGTGKTAAFGLPLLQKIDLSGGRPQALVLCPTRELCLQIADDLNSYSKYLSDVHILPVYGGTPIDAQIRALRRGVQIVVATPGRLLDLMRREAVSLSDIHTVVLDEADEMLNMGFAEDLEQILADIPSERHLLLFSATMPKEISKIATSYMKDPKEIVIGNKNEGNANIKHLYYMVSARHKYLALKRIADYYPNIYGIVFCRTRKETQEIADQLIQDGYNADSLHGDLSQAQRDYVMQKFRVRNLQLLVATDVAARGLDVNDLTHVIHFGLPDDVESYTHRSGRTARAGKTGLSIAICHVKEKGKIKNIERTMQKQIERARIPSGAEICEKQLFNLADRIERVDIENTTAIDSVLNEVNKKLEWIEKDELIRRVMALEFNRMLDYYQRAEDVEEVVERKKDEVSGDRKNRKRGAGEAEEGMTRLFINFGKMDQMFPNRLIELINRCIPGRVNIGRIDLMPRFAFFDVDEFEAKNVVETLNRYEVDGRRIHVEYADTKKDYAGGKKGGDKNFSARRKDFDGRRSENPTSRKNKGRKEKPTEGRFYDKFDSKQRKRRK

SEQ ID NO: 57027 - protein, 405 aa, Porphyromonas gingivalis W83
MDYQLYTLPSGLHVVYKPHAGEVTYAGFAIGVGTRHESSRHHGLAHLTEHMLFKGTSLRNSLQIIRRMEEVGAELNAFTEKESTYVYCIFPKAHFNRATNLLFDIVQHSRFPEEELTKEKTVVIDEIDSYRDNPSELIFDEFENILFRHHPLGHNILGTEASVSRITGQIGRNFLRRHYRPDNMIFFLAGEADLSDWPLNPAEKVSIRNTDGTPLHTLREGFLPRTIRRHKDTYQHHILMGGPAYSLHDDRRIPLSLLNNILGGPGMNSRLNLSLREEHGYVYNVESNYTPYSDTGVFNIYLGCAPRYAEAAMELVRKELRYLIEHPLSPIELESAKRQFKGQLIVSADNKESTFLSLGKSMLLYGKYDPLSDIFHRIDAITSDRLREIAAEVLNPDSMLTLIYC

SEQ ID NO: 57028 - protein, 222 aa, Bifidobacterium longum DJO10A
MSNIAIAPSILSADFCNLERDLKAIANADLVHVDVMDHHFVPNLTLGEPIVGRICQVTDLPVDVHLMIEDPDRWAPEYAKLGAASISFHMGATHAPVRLARQLREMGCKACFAVRPAEPVEPIFDILDEFDMVLIMTVEPGFGGQKFLDNQMAKVRRLRDEITRRGLKTRIQVDGGVSPKTAHIVAEAGADVLVAGSAVYGAENPAQAIDDIRAKAEAAFKA

SEQ ID NO: 57029 - protein, 313 aa, Bradyrhizobium japonicum USDA 110
MSPRPLMFFGTTNLDLCFNVERLPTPGESLMGSLKQNAGGKGANQAVAAARLGLRPSFYTRLGDDDAGRSLLQALREAGVRLDAIEVCPGEISGSALVLVGDDGSNMIVIDPGANANVTPSMVEKAAEFIERDAIVVAEMGMPVPALNHLFALKSVKEFDLIFNPAPVRAGLSPAAWRSVDFVTPNQTEAFELTGVEVHDFDGAAHAAGKLLDLGPKAALITLGAQGAYYADASATFALRAFPVKVVDTTAAGDAFNGAFAASLAHRLPIREAIKKALAVAALYVTRRGAQRSMPSSWAVDEFLNSQSILELE

SEQ ID NO: 57030 - protein, 385 aa, Physcomitrella patens subsp. patens
MVNGVSTSNSHDRQTKVPSQDFQAPVISGLSLGSGEYFIRVSVGTPPRGMYLVMDTGSDILWLQCAPCVSCYHQCDEVFDPYKSSTYSTLGCNSRQCLNLDVGGCVGNKCLYQVDYGDGSFSTGEFATDAVSLNSTSGGGQVVLNKIPLGCGHDNEGYFVGAAGLLGLGKGPLSFPNQINSENGGRFSYCLTGRDTDSTERSSLIFGDAAVPPAGVRFTPQASNLRVSTFYYLKMTGISVGGSILTIPTSAFQLDSLGNGGVIIDSGTSVTRLQNAAYASLREAFRAGTSDLVLTTEFSLFDTCYNLSDLSSVDVPTVTLHFQGGADLKLPASNYLVPVDNSSTFCLAFAGTTGPSIIGNIQQQGFRVIYDNLHNQVGFVPSQCD

SEQ ID NO: 57031 - protein, 168 aa, Triticum aestivum
  misc_feature (27)..(27): Xaa can be any naturally occurring amino acid
  misc_feature (47)..(47): Xaa can be any naturally occurring amino acid
  misc_feature (76)..(76): Xaa can be any naturally occurring amino acid
  misc_feature (96)..(96): Xaa can be any naturally occurring amino acid
MLSKPRVTRAILGHSQRRSFMGESSEXVGQNVPYALAQGLKSMPCLXESLQQRQGGSTLLVVSCQTKAIADKIKEXPDVISAYEPVWPIGTGRGAXRTKAQGAHPSLRDWLKTNVSPKQTASTRIICRGSVNGANCKELAAQIDVDAFLVVGAPLKPEFIDIINSRTV

SEQ ID NO: 57032 - protein, 437 aa, Gibberella zeae PH-1
MSPHAEKTVSRFHATSTDKAIAIEEEYAAHNYHPLPVVFSRAEGVNVWDPEGNHYYDFLSAYSAVNQGHCHPELIKTLTEQAGRLTLSSRAFYNDVFPKWAEKVRSVFGYDMVLPMCTGAEAVETAIKIARKWAYKVKGVPQEKAWIFGVSENFHGRTMTAITLSVDPESRENYGPYVPNVGAINPTTGKAIRYNNIADLEEVLEAHGKETAAFICEPIQGEAGVVVPDDDYLAKVQALCTKHNVLFICDEIQTGIGRTGRMLCSEWANIKPDLVTLGKAISGGMYPVSCVLSSKEVMLVVEPGTHGSTYGGNPLGSAVSIRALEIMEEEDLTAKADKLGNMFRDGLKALNTPILKVIRGKGLLNAVVIDESAANGRTAWDLCLLLKSKGLLAKPTHGDIIRFAPPLVISEEDLKKGLNIIAEAIKELPTVEPAKHH

SEQ ID NO: 57033 - protein, 340 aa, Magnetospirillum magnetotacticum MS-1
MVSEYHQYLSSIEDIIEEARQGRMFILVDDEDRENEGDLVIPADMANADAINFMARFGRGLICLSLTRGRCEHLGLKPMSSDNGTRMETAFTVSIEAREGVTTGISAADRATTIKAAIDVDKNRYDIVSPGHVFPLMAREGGVLVRAGHTEAAVDISRLAGLNPSGVICEIMNDDGTMARMPDLVKFAQHHGLKIATIADLIAYRRRNDKIVAREVETPFHSKWGGDWTMVVYTNTVAYAEHIALVKGDLNAAGPVMVRVHAVNILDDVLGDQGVGQGGRASFRHGNDCGSRQWRGGSNPRAAPHQPVGHGARPSGTPPGGSGFARLRRRRSDPAGSWGP

SEQ ID NO: 57034 - protein, 300 aa, Fulvimarina pelagi HTCC2506
MQPVRKAVFPVAGLGTRFLPATKSIPKEMLTVVDRPVIQYVVDEAIEAGIEHLIFVTGRNKGVIEDYFDVQVELANTLAERGKVEQLTLLEQLQPKPGTTSFTRQQSPLGLGHAVWCARELVGDEPFAVLLPDMIMQSTKGCLSSMIDLYRKTGGNVISVERCAPLETQKYGIVAKGRNVGEGFEITDMVEKPEPAKAPSNFSISGRYILQPDIFDVLVEQEKGAGGEVQLTDAMRRLVRRLPFHAFPFEGRTFDCGSKEGFVEANMAFALWRSDIRGNVFNNLAHYMETIEPPKKANAA

SEQ ID NO: 57035 - protein, 348 aa, Triticum aestivum
MGYDGAPSPASAAARDAKKKRGNRSSAKLKQCKLDARREQWLSQVKDGKEATAKPLPAGAGSGAGSNAGSPILASPHPPLPRRRADARSRGGALEDDKEDAGATGQEVGGSDLDSPMHSPCSDNSRGGGCAQSKRCSSNGGGPSLSSVSSLWSSSRSVSDAEDDDTGSGPEEENGVLDDWEAVADALSVDDNSHCHQSLGTTMPPAATSESAPLANTSKRTEPIRSNARAWTPDDTFRPQSLPSISKQSSFPARIGNCWGMGMSAAHQSILSMPLSCPICYEDLDPTDSSFLPYPCGFHLCLFCHKRILEADARCPGCRKLYNAGSAGEGGAPAPVRLSRSCSMGPRH

SEQ ID NO: 57036 - protein, 880 aa, Zea mays
MRRRRCPLLAAVLFLFLLPLFHRHHAASGTDTDTVTLAAPLMGNRTLVSAGSAKYVLGFFAPDPDATGSGRAYLGIWFNGIPARTVVWVANRESPVLGSVGAAALRVLANGSLAIVVVDETDYDHDQQPVVWATPPPATSSGSNATAQLLDNGNLVLRVPGAGVVWQSFDHPTDTLLPGMKLGIDFRTGLDRRMVSWRAAGDPSPGEYSFRLDPSGSPELFLYRGSARVYGSGPWNGYQFTGVPNLKSNSLLTFRFVSAADEAYYSYGVVDSAAVLTRFVLDSSGQIQRLMWIDMTRSWSLFWSYPLDECDGYRACGPYGVCSVERSPICGCAPGFDPRFPKEWALRDGSGGCRRRTDLACAGDGFAALTNMKLPESANATVDMSLTLDQCREACLRNCACRAYAGANVSAPGATGCFLWTGDLLDMRQFGKGGQNLFVRLAASDLPLSSSSPADTDGRTKRLVEIIVPSVAAPALLLLAGLCICAVRTRRRRTKEKEAIPLALLRDAQRQSAPFGRRNQIAASTDAQDESLHDGQQGGSQDCDLPSFDVETIQAATGNFSAHSKIGQGGFGPVYMGKLDSGQDIAVKRLSRRSTQGLREFKNEVKLIAKLQHRNLVRLLGCCIDGSERMLVYEYMHNRSLNTFLFNEEKQPMLSWEKRFSIINGIARGILYLHQDSALRIIHRDLKASNILLDKDMNPKISDFGVARIFGTDQTAAYTKKVVGTYGYMSPEYAMDGVFSTKSDVFSFGVLVLEIVSGKKNRGFYHTELDLNLLRYAWRLWKDGESLEFMDQSIADTSNAAEVLKCIQIGLLCVQEQPKRRPTMSAVTTMLTCENPTLPEPCEPAFSTGRNHDDDDEDPEAKACRSNSASSWTCTVVEGR

SEQ ID NO: 57037 - protein, 332 aa, Salmonella enterica subsp. enterica serovar Typhi str. CT18
MQPETQSSALPAYRFSIAPMLDWTDRHCRYFLRLLSRQTLLYTEMVTTGAIIHGKGDYLAYSEEEHPVALQLGGSDPAQLAHCAKLAEARGYDEINLNVGCPSDRVQNGMFGACLMGNAQLVADCVKAMRDVVSIPVTVKTRIGIDDQDSYAFLCDFINTVSGQGECEMFIIHARKAWLSGLSPKENREIPPLDYPRVYQLKRDFPHLTMSINGGIKSLEEAKEHLRHMDGVMVGREAYQNPGILAAVDREIFGADTTDTDPVAVVRAMYPYIERELSQGAYLGHITRHMLGLFQGIPGARQWRRYLSENAHKAGADAAVLEQALKLIADKR

SEQ ID NO: 57038 - protein, 327 aa, Salmonella enterica subsp. enterica serovar Typhi str. CT18
MATRIEFHKHGGPEVLQTVEFTPTEPAEHEIQVENKAIGINFIDTYIRSGLYPPPSLPAGLGTEAAGVVSKVGSGVEHIRVGDRVVYAQSTLGAYSSVHNVPADKAAILPDAISFEQAAASFLKGLTVFYLLRKTYEVKPDEPFLFHAAAGGVGLIACQWAKALGAKLIGTVGSAQKAQRALDAGAWQVINYREESIVERVKEITGGKKVRVVYDSVGKDTWEASLDCLQRRGLMVSFGNASGPVTGVNLGILNQKGSLYATRPSLQGYITTREELTEASNELFSLIASGVIKVDVAENQRYALKDARRAHEVLESRATQGSSLLIP

SEQ ID NO: 57039 - protein, 101 aa, Arabidopsis thaliana
  misc_feature (10)..(10): Xaa can be any naturally occurring amino acid
  misc_feature (18)..(18): Xaa can be any naturally occurring amino acid
  misc_feature (37)..(37): Xaa can be any naturally occurring amino acid
  misc_feature (46)..(46): Xaa can be any naturally occurring amino acid
  misc_feature (55)..(55): Xaa can be any naturally occurring amino acid
  misc_feature (58)..(58): Xaa can be any naturally occurring amino acid
  misc_feature (63)..(63): Xaa can be any naturally occurring amino acid
  misc_feature (69)..(69): Xaa can be any naturally occurring amino acid
  misc_feature (72)..(72): Xaa can be any naturally occurring amino acid
MASSMLSSTXVVTSPAQXTMVAPFTGLKSSASFPGTXKANNDLTSXTSNGGRVSXMKXVWPPXLVKKKXGTXFLTDLGGGWKTLKFAEFGLWPLLCSHLKL

SEQ ID NO: 57040 - protein, 425 aa, Methanococcoides burtonii DSM 6242
MNSISEEAKYTIQKVHAREILDSRGNPTVEVDIYTGCGFGRASVPSGASTGSNEALELRDKDADRYNGKGVLKAVDNINKTLSKELLGMDARNQREIDELMIALDGTENKKTFGANAILGISMATAKAAADSLGIALYRYLGGTNAFALPVPTMNVINGGKHAGNDLSIQEFMIQPKGADTFSNALRMGAETYHALGKVLEDKYGASATNVGYEGGYAPPISTTADALDALVSAIEEAGYTESEISIGLDSAASEFFDGDKYFIDGNKLAPAELVDYYLDLIETYPILSIEDPFHEESFEDFAALTSEAWDTIIVGDDLFVTNVNRLAKGIEMEAANALLLKVNQIGTISESFDAANLAQRNGYSVVVSHRSAETEDTMIADISVAIGGDLIKTGAPARSERTAKYNQLLRIEEDLGDAARYVQL

SEQ ID NO: 57041 - protein, 514 aa, Arabidopsis thaliana
MAAIIGDCFIFILLCLFSLLFYYLIFRKPKNSRLVAYGCDLPPSPPSLPIIGHVHLLLSSLAHKSLQKLSSKYGPLLYLRVFNFPVVLVSSASVAYEIFKAHDLNISSRDNPSIDDSLLIGSSVFGSAPYGDYFKFMKKLLVTKLLGPQALERSRGIRADELERFHSSLLDKAVKKEIVEIGKEATKLSNNSLWRMSIGRSFSEKNGEAERVRGLVTELDGLTKKVLFATLLHRPLEKLGISLFKKEIMCVSDSFDEVLERVLVEHEQKLDDHQDRDMMDVLLAAYGDENAEHKISRNHIKAFFVELFFAGTDTSAQSIQWTMAEIINNPNILKRLREEIDSVVGKTRLIQETDLPKLPYLQAVVKEGLRLHPPLPLFVRTFQEGCKIGGFYVPEKTTLIGNAYVMMRDPSVWEDPEEFKPERFLSSSRSTQEEERREQALKYIPFGSGRRGCPGSSLGYIFVGTAVGMMVQCFDWSIKGDKVQMDEAGGLNLSMAHSLKCTPVPRNRPLLADQ

SEQ ID NO: 57042 - protein, 387 aa, Oryza sativa Japonica Group
MEQVSASSDLIRFLFLGDSGVLILQTFACFCGCVCGGGGAQYEKEEKIGEGTYGVVYRARDKVTNETIALKKIRLEQEDEGVPSTAIREISLLKEMHHGNIVRLHDVIHSEKRIYLVFEYLDLDLKKFMDSCPEFAKNPTLIKSYLYQILRGVAYCHSHRVLHRDLKPQNLLIDRRTNALKLADFGLARAFGIPVRTFTHEVVTLWYRAPEILLGSRQYSTPVDMWSVGCIFAEMVNQKPLFPGDSEIDELFKIFRVLGTPNEQSWPGVSSLPDYKSAFPKWQAQDLATIVPTLDPAGLDLLSKMLRYEPNKRITARQALEHEYFKDLEMIQIALRCCYTHLSGVPLGLGSTGGHASLVLSKILSRLVACVRHHQTRVPQRLIMNMH

SEQ ID NO: 57043 - protein, 205 aa, Zea mays
MDLLWKKESSQVNRGNVFFCCCLVFDGNTQVVKAIENAIPVRHAAVAAAAAEIDPAREEELRAMEAEKAEIDRAAAARVRRELWCGLTYLVIQTAGFMRLTFWELSWDVMEPICFYVTSMYFMAGYAFFLRTKKEPSFEGFFESRFAAKQKRVMRARGFDLRRYEELRRACGVAAAPPPLQARTPCAGAGAARESGHCHSYCHCH

SEQ ID NO: 57044 - protein, 342 aa, Bacillus cereus ATCC 14579
MTRVAINGFGRIGRMVFRQAIKESAFEIVAINASYPSETLAHLIKYDTVHGKFDGTVEAFEDHLLVDGKMIRLLNNRDPKELPWTDLGVEVVIEATGKFNSKEKAILHVEAGAKKVILTAPGKNEDVTIVVGVNEDQLDITKHTVISNASCTTNCLAPVVKVLDEQFGIENGLMTTVHAYTNDQKNIDNPHKDLRRARACGQSIIPTTTGAVKALAKVLPHLNGKLHGMALRVPTPNVSLVDLVVDVKRDVTVEAINDAFKTVANGALKGIVEFSEEPLVSIDFNTNTHSAIIDGLSTMVMGDRKVKVLAWYDNEWGYSRRVVDLVTLVVEELAKQENVQHI

SEQ ID NO: 57045 - protein, 339 aa, Oryza sativa Japonica Group
MLSDQELARYVESFVRQAAAVPGAVAAAGGISAESVARQLGPQLGLDLTPKAPLIRDILLALFSPPPQGAPFTSSAPSPSASASASASAAAAGHFFSQQQQQQQLQTFLTASQQYQHRGGAGAAAAPPSAYGVAAAAAGYSASTGVKRRGGPGGLNKVCGVSPELQAIVGEPTMARTEIVKQLWAYIRRNNLQDPNNKRKIICNDELRLVFETDSTDMFKMNKLLAKHIRPLEAKMLKILAEDSNRDSKKLKPVDSEPISPAETDVNQLPIILSDALASFFGTGEKEMPSSEAVKRVWDHIKSNNLEDPANPTMILCDSKLKQLFGCESLTAMNRLTGL

SEQ ID NO: 57046 - protein, 797 aa, Oryza sativa Japonica Group
MGGKNLVVLFLVSVVMAMVPGSTQLQASQTWSLLKIQQMLGYPAVLGHWHNYTDFCYGGDYKTTSAFVECYGDSVTQLHIIGGGGGSPTPPPLPKTFSIDSFFTTLSRLPDLRVLTLTGLGLWGPLPGKVSRLAALEIVNVSGNYLYGELPLALSRLGNLQTFIADDNMLSGELPAWLGRLPVLAVLSLRNNSLEGTLPGSVSDMASLRSLSLASNNLSGNLPDMSGAKNLQVIDLANNSLGPEFPRLGRKVASVVLAGNRFSDGLPPELASFYLLERLDVSRNRFVGPFMPALLSLPSIEYLSVAGNRFTGMLSGNMSCGNNLKFVDVSSNLLTGSLPTCLAAGAVGKAADSDSDSSKTVLFSANCLATGDDTQHPSPFCKNQAIAVGIVPDQARRKPSGARSGLVAGVVAAAIAAAVLAGVAVFLAVRKASMRRAQARPPRRLVEHASSAYPSKLFADARYISQTVKLGALGIPAYRSFSLVELEAATNDFEVSNMMGQDSHGQMYRGRLSNGTPVTIRSLKVKRSQTSQSFNHHIEMISKLRHRHLVSALGHCFEYNLDDSTITQLYLVFEYVQNGNLRGRISQGTEGRKLTWVQRISTAIGVAKGIQFLHGGIIPGLFANNLKITNILLDQNLVAKIGSYNIPILSETMKSEGGSGNKYPSDSVPNGDKLDIFDFGVILLEVISGRPITSIYEVEIMKEQLQSALTAEGTAKRRSFVDPAVSKGCSDESVKTVMEICLRCLAKEAVQRPSVEDVLWNLQFAAQVQDDWRGDSRSSEESPLSPSQIPRDLEDDQ

SEQ ID NO: 57047 - protein, 232 aa, Ashbya gossypii ATCC 10895
MKSFSARPAPRAAQHQMSATPSNNVHLLPQTNQLLGLYTIIRDRRTKRPDFIFYADRIIRLLVEEGLNQLPVMPATVETHTAQKYDGVSFLGKICGVSIIRAGESMEQGLRDCCRSVRIGKILIQRDEETALPKLFYEKLPEDIADRYVFLLDPMLATGGSAIMATEVLIKRGVRPERISFLNLICCQEGIDAYRARFPDIKIITGAIDKGLDEQKYLVPGLGDFGDRYYCI

SEQ ID NO: 57048 - protein, 496 aa, Vitis vinifera
MARKMLIDGELSKPNEEETHYDFDLFVIGAGSGGVRAARFSANFGAKVAICELPFHPVSSEVIGGVGGTCVIRGCVPKKILVYGASFRGEIEDAKNYGWELNDKVDFNWKKLLHKKTEEIVRLNGIYKRLLTNAGVKLYEGEGKIVGPNEVEVTQLDGTKLCYSAKHILIATGSRAQRPTIPGQELSITSDEALSLDELPKRAVILGGGYIAVEFASIWNGMGVAVDLFFRKELPLRGFDDEMRAVVARNLEARGINLHPRTTLSELVKTEDGIKVITDHGEELTADVVLFATGRAPNTKRLNLEVVGVELDKMGAVKVDEYSRTNIPSIWAIGDVTNRMNLTPVALMEGTYFAKTVFGGQPSKPDYKDIPCAVFCLPPLSVVGLSEEQATDQAEGDILVFTSTFNPMKNTISGRQEKTIMKLLVDAETDKVLGASMCGPDAPEIMQGIAVALKCGATKAQFDCTVGIHPSAAEEFVTMRSVTRRIAAGNKPKTNL

SEQ ID NO: 57049 - protein, 218 aa, Campylobacter coli RM2228
MNDRFTRIKWLVGEEKFQKISQTKVLVCGLGGVGGICVDALYRSGFQNLTLIDADKFEITNQNRQIHSENLGEEKAKVFARIYNAKGIVSKIDNEFLANFDLSEFDLIIDAIDDIPAKVALANLIDFKRQIFISSTGGARKLDPTRIKTTSIFKTHGDALAKKFRYELRKSGFKGNFDVVFSDEEAHCKDLGSFMGVTASFGLALASLALRKVLAKKN

SEQ ID NO: 57050 - protein, 187 aa, Zea mays
  misc_feature (176)..(177): Xaa can be any naturally occurring amino acid
DELIANAAYIGTPGKGILAADESTGTIGKRLASIKVENVESNRRALRELLFTAPGALQYLSGVILFEETLYQSTAAGKPFVDVLKEAGVLPGIKVDKGTVELAGTNGETTTQGLDGLAQRCQKYYEAGARFAKWRAVLKIGPNEPSQLAINENAYGLARYAVICQENGLVPIVEPXXLVDGPHDIHK

SEQ ID NO: 57051 - protein, 61 aa, Magnetospirillum magnetotacticum MS-1
MRAHLEHRPAVPALRDYGVGAQILLDLGVREMILLSNTKRSIIGLDGYGMKLVEQRPIPVG

SEQ ID NO: 57052 - protein, 464 aa, Kineococcus radiotolerans SRS30216
MSEQHEGGTHDVVDPSTGVAFTTVEMAGTAAVDAAVERAAAAFPAWRDVAPADRARLLRRVAAAVDADLDHLADLEVREAGHPTANARWEAGNLRDVLEYSAAAVERHLGDQIPVAGGIDVTFHEPLGVVGVITPWNFPMPIAGWSVGPALAAGNTVVLKPAELTPLTSLRFAELAREAGLPEGVLQVLPGRGDVAGQRLVEHPAVRKLVFTGSTAVGRGVMAGAARHVKRVTLELGGKSANIVFADSDLERAAATAPDGVFDNAGQDCCARSRILVQRSVHDRFLELLEPAVKGVRVADPRSPDAQMGPLISAAQRERVAGFLTEESLGASAEVAFTGTAPEGAGFWFRPTVVLAPDPRVRVATEEVFGPVVTVTPFDDEADAVRIANDSRYGLSGSIWTRDLGRALRVSRAVEAGNLSVNSHSSVRYGTPFGGVKESGLGRELGPHALDAFTDVKNVFISTT

SEQ ID NO: 57053 - protein, 439 aa, Gibberella zeae PH-1
MGSEKRKRGGDTTSKPKKKVAIDASPSTTVSSVLRPKHCPPVIATAVGFDVPKNIPFHSYAPKDAAKSKAKQAKSAGEKDFLLHSNAHRTMDYTVKADGARGVKPALNHFLGIYDPKTGKLEVVEAKKMTMRAAVRAKQSAAAAAGERDASQTMMQLKTDLGQTFGTKKAKKAIQENVLNAIAPQKKTGEAPTKIDAAARAMLSSVGEVTSTMASREELQAVVDEARPVPIPNLEATEIQDVYDPKRIIGADILKLVPVREWQEKVQHKESIQVPSRFVAARVTRVAGNEDATDRLRVLRYFFFVLLFYLHSKPGKARGTRSIPPRDKLREFLAPAPEAVVESIRRKFSERGEMRKFHIDLLITHCCVFASIIDNFEVDTQNLRDDLKIDQKTMNSYFHEIGGRVKPVTNKETKTTVSLARLALPLNFPKQRHIAPKRR

SEQ ID NO: 57054 - protein, 693 aa, Magnetospirillum magnetotacticum MS-1
MTNLFVIACGVLALLYGVYAIRSVMAASAGTARMQEIAAAVQEGAAAYLNRQYTTIAMAGVVVAIILAAKLGLYQAVGFVIGAVLSGAAGYVGMNVSVRANVRTAEAARSGGMQQALDVAFKSGAITGLLVVGLGLIGVAGYYMVLKNVGIDSRALLEALVALSFGASLISIFARLGGGIFTKGADVGADLVGKVEAGIPEDDPRNPAVIADNVGDNVGDCAGMAADLFETYAVTVVGTMLLGSIFFTGVAQEQMMMLPLVICGVCIFASIVGTFFVKLDAGLNIMKALYKGVIVTALLSAVLIAGIIQINLGGFDAKFVAAGKEITGMSLYICAIIGLIVTGLLVWITEYYTGTDYRPVKSVAQASTTGHGTNVIQGLAVSMEACALPVIVISVAIIVSYKIAGLFGISVAATTMLALAGMIVALDAYGPVTDNAGGIAEMAELPKEVRKVTDALDAVGNTTKAVTKGYAIGSAGLASLVLFAAYTEDLHHYFPQLNITFSLEDPFVVVGLFLGGLLPYLFGAMGMQAVGRAAGSVVVEVRRQFKEIPGIMEGTAKPDYGRAVDMLTKAAIKEMIIPSMLPVLSPVVLYFVILLAADQKAAFTAMGAMLLGTIVTGLFVAISMTSGGGAWDNAKKYIEDGHHGGKGSDAHKAAVTGDTVGDPYKDTAGPAVNPMIKIINIVAILLLAMVAGH

SEQ ID NO: 57055 - protein, 308 aa, Candida albicans SC5314
MNIVKNLFKGTTTNNLDKEIQQKGFEISQCSEICESCTSKFPKHLKFEGESEGTSLWNTTKPYGMHIIIATGKKDWSHDAINEDGKKKDTLKYKIGKWAENNTNSPLGTIKVNVSSMSSDELYINENYKLEKQGDLLILPYFLNIKGITIDEVDTYLNELESLLINSTNNNDSTIIIDEIITKLPKISPNLNQSFVFFCSHTTRDKRCGITAPIMKREIDNYLQELDLIRNFGDYRPNGIQTEFINHIGGHKYAANVIIYLKKSGKNIWLGLCKPNNIKPIVDECILGDGKVWPNKVRLLQKFDPIEW

SEQ ID NO: 57056 - protein, 483 aa, Kineococcus radiotolerans SRS30216
MLEMVRQRTIRAGPAPADHEEAPVGRTSTDASTGAPLSLQDLRHDITSGRIDTVLVAMTDMQGRLQGKRLTGRFFLDEVLEHGTEGCNYLLGVDVEMNTVDGYEITSWSRGYGDLLLRPDLSTLRRIPWHPATAMVLCDVLQLDDEPVRPSPRQVLRAQLQRLEGHGLRPLVATELEFNLLRVTYEEAHANGYRDLRPASTHNIDYSLLGTGRVEPVLRRIRNEMDGAGLYTESAKGECNLGQQEIGFRYADALTTCDQHSVFKLGAKEIAAQEGMSVTFMAKLDQREGNSCHIHLSLTDLDGSPVFAAGAGSEMAPVMRSFLAGQLAALRELTLLLAPNVNSYKRFADGSFAPTAVAWGYDNRTCALRVVGRGPSLRMENRVPGGDANPYLAVSALIAAGLHGIEEGLELEEVTTGNAYTGGAPRVPTTLLAAAELFAGSALARRAFGDDVVDHYARAAHVELEAFQTAVTDWERARGFERL

SEQ ID NO: 57057 - protein, 483 aa, Kineococcus radiotolerans SRS30216
MSAQRSSTPSRVGYDDVSVEYLQQRQLKRGAAGWVLLAGLGVAYVISGDFSGWNLGLAEGGWGGLLIAFVLMGVMYTCMVFGLAELSSSLPVAGAGYGFARRALGPLGGYATGIAILIEYAIAPAAIATFIGGYVQALGFMTDANPWPIYLAAYVVFVGVHLWGVGEAMKVIFGITALAVVALVAWAVGMVGHFQWSNLFDIAPDGSAGSSSFLPFGYAGVLAAFVYGIWFFLAVEGVPLAAEEARDPRRDMPRGIIAAMLILLVFGAAVLLLAPGAAGSSAMQASGNPLPEAARIAAGGDSVLATVVNWVGLAGLVASFFSIVYAYSRQLFALSRAGYLPRWMSVTGRRKTPYVALVVPATIGFALAAITGNGALLINIAVFGATVSYVLMNLSHIVLRRREPDLERPYRTPGGVVTTGIALVLSATAVVATFFVDELAAGITAAVFVAFLAYFWFHSRHHLVASAPEEEFAAVQAAEAGLK

SEQ ID NO: 57058 - protein, 331 aa, Rubrobacter xylanophilus DSM 9941
MRQNGYLSQAAEKRLMLFSGGGYPELAERIADRLDLELGSVELVQFSNGEVYARYLESVRGSDVFIVQSLCDPVNKNLMELLVMVDAAKRASAESIVAVIPWYAYSRQDRKTKPREPITARLVAEMLKVAGADRIMTMDLHVGQIEGFFSFPVDHLTAMHTFVDHFVDEGFQNAPDTVVVAPDTGEVKMAKRLADHLGLPWAIVNKIRRGPGESEVTHVIGEVSGRRAILIDDIIDGGGTMVGAAEALLSEGATEVYAAATHAVFSGRAYERIEESPIREVVVTDTLPLKPGKPRSKIRTLTIAPILASTIRNVFTDDSVSAVFMGENQLF

SEQ ID NO: 57059 - protein, 177 aa, Triticum aestivum
MAGAQTGSSATPCASCKLLRRRCARDCVFAPYFPPEDPHRFATVHRVFGASNVSKMLQELPAAQRADAVSSLVYEATARMRDPVYGCAGAISYLQQQVSQLQVQLAVAQAEILQRINHPSPASAFHLQELQQRQVQQQQQMQMDDDDKAYSSLVMQNDLMSTLLLQEACLKKESLWT

SEQ ID NO: 57060 - protein, 230 aa, Arabidopsis thaliana
MEADRKADNGNAGFSLVCHPEERITYRVGNKVICCLDGSRIGIQFETSTAGETYEVYHCVLESKSFLEKMIVLEHTIPFFLPLSDLENDLLFSNAKKFIDNVGDLLQAYVDRKEQVRLIKELFGHQISEIYHSLPYHMIEFSMDDCDCKFVVSLRYGDLLCELPTKVRILVWPMHHLSKKQCTSPGSPAIPVRLPFAEDAFRIQSLPEAYAEIMPNMPNEIRQLFQTSPS

SEQ ID NO: 57061 - protein, 205 aa, Neisseria meningitidis
MPYTEDMRPGDTANPYGASKAMVERMLTDIQKADPRWSMILLRYFNPIGAHESGLIGEQPNGIPNNLLPYICQVAAGKLPQLAVFGDDYPTPDGTGMRDYIHVMDLAEGHVAAMQAKSNVAGTHLLNLGSGRASSVLEIIRAFEAASGLTIPYEVKPRRAGDLACFYADPSYTKAQIGWQTQRDLTQMMEDSWRWVSNNPNGYDD

SEQ ID NO: 57062 - protein, 674 aa, Cryptococcus neoformans var. neoformans JEC21
MPDTPPHKHHYTSLRSLMHSPDPGNPAKRDSLTPRQPRPSRNSSSSRSRERRLDPPRKADKDKGRLSTWKLMCLTVSMGGSQIAWTVELGYGTPYLLSLGLSEQLTSLVWLAGPISGLIAQPLIGAISDSSHSRYRRRYWIVTSTMLLVFSGLGLAFTEPIAKALVDLIGGGQGDWDPKTIRLVKNTAIGIAVFSFYCLDFALNALQASLRNLVLDITPGEQLATANAWHGRFNHVGNIVGFTMGFLNLSHVPIIRLVGGGQFRKVCIVALVLLVMTVWITCWTQEEKETDSIFGERRSKIRDVVGTIYEAVLHLPKPIRRVCIVQIAAFMGWFPYLFYSTTYVAEVMAKELHHKPDIDRATRAGSLALLIYSFVAIIAGTLLPYLAARDRRLLKPTSEKLRDGEIEIENEDEEDEEHVEMERIREMVQQWKAEAAREGRPLKLPTMPFMLRNIWTAGLVIFGCLMMSTFFITKVWQATVMIALVGICWAIACWVPFAIIMEFLKELDDKPPPRISDGRPRPTHARTASTPLGWRSHPTSPAGRASPDERTPLARSYSTADLDGANEMEYTGQGPVAGGTIMGIHNLAIVFPQFIIAVVASIIFKLADTQPDIQPTSPEIGGPHGQDKNGVAWVLRFGGLMAFVGALVSRKVPPTKTEKAMRRRLADMREESAE

SEQ ID NO: 57063 - protein, 420 aa, Vibrio vulnificus YJ016
MSFETISVIGLGYIGLPTAAMFASRKKKVIGVDVNQHAVDTINQGKIHIVEPDLDMMVHAAVSGGYLKATTTPEAADAFLIAVPTPFLPCAEGDIPPPDLSYIEAASKAIAPVLKKGDLVILESTSPVGATEKMAAWLAEARSDLTFPQTYGEEADVNIAHCPERVLPGHVVRELVENDRVIGGLTPKCSARAVELYKTFVQGECVITNARTAEMAKLTENSSRDVQIAFANELSIICDKLDINVWELIALANRHPRVNILQPGPGVGGHCIAVDPWFIVSKTPEEAQIIHMARKVNDSKPQWVINKVKLAIADFLQANPEKTAKDMTIACYGLAFKSDIDDLRESPSLEIAKKVSEFHRGKVLVVEPNIAQLPSELDGNVDLVDISDTNYADLHVVLVGHKEFGSNLFDKKNTIFAVNV

SEQ ID NO: 57064 - protein, 182 aa, Burkholderia pseudomallei K96243
MKTVGDKLEAFTVVAAKPGFNNHEENGQSAFETVTEASFPGKWKIIYFYPKDFTFVCPTEIVEFAKLAKQFEERDAVLLGGSSDNEFVKLAWRREHKDLDKLNHYSFGDVKGELIDQLGVRDKEAGVALRATFIVDPDNTIQHVSVNNLNVGRSPEEILRILDGLQTDELCPCNRAIGGATL

SEQ ID NO: 57065 - protein, 162 aa, Burkholderia pseudomallei K96243
MDFRIGQGYDVHQLVPGRPLIIGGVTIPYERGLLGHSDADVLLHAITDALFGAAALGDIGRHFSDTDPRFKGADSRALLRECASRVAQAGFAIRNVDSTIIAQAPKLAPHIDAMRANIAADLDLPLDRVNVKAKTNEKLGYLGRGEGIEAQAAALVVREAAA

SEQ ID NO: 57066 - protein, 430 aa, Bacillus cereus ATCC 14579
MTTGEKITVTNGVMNVPNNPIIPFIEGDGIGPDIWAAASRVLEAAVEKAYDGEKKIVWKEVLAGEKAFNQTGEWLPEETLNLIREYLIAIKGPLTTPVGGGIRSLNVALRQELDLYVCLRPVRYFEGVPSPVKRPEDTDMVIFRENTEDIYAGIEYAQGSPEAEKVLAFLKEAMGVNKIRFPETSGIGIKPISEEGTKRLVRAAIQYAINEKRSSVTLVHKGNIMKFTEGAFKNWGYEVAEQEFGDKVFTWAEYDRIVEKDGKDAANKAMADAEVAGKIIVKDSIADIFLQQILTRPREFDVVATMNLNGDYISDALAAQVGGIGIAPGANINYVTGHAIFEATHGTAPKYAGLDKVNPSSVLLSGVLLLEHLGWNEAAKLVTASVEKTIASKVVTYDFARLMEGATEVKCSEFANELIKNMDVAIIKNA

SEQ ID NO: 57067 - protein, 314 aa, Synechocystis sp. PCC 6803
MFNSPVRPMRYGFYTLDVFTDQLFGGNPLAVFPDAEGLTDGQMQKIAAEINYSETVFVLPPVTETGNFRLRIFTPKRELDFAGHPTIGTTYLLGLLQPPSPLVTTTWQLEEPVGLVPVTLHYKQGQLVQTELTVAQLPQTKDSAPSCEDLALLLGLSIDQLQQGEYEPQAYSCGLPFLFIPLINEEALNRISFNPSVWQNLLAGQWADCVYCLAPGDPSLGLSDNKLIHGRMFAPGLGIAEDPATGSGVAALGGYLDDRLDTPGSHHWQIEQGKALGRPSQLQLTVVKDGQGIRAVKVAGRSVLVSEGFMNLGN

SEQ ID NO: 57068 - protein, 402 aa, Porphyromonas gingivalis W83
MRKACFMGLGYIGLPTAIVTAKSGIEVLGVDINTNIVAKTNSGKLHFVEAGMEDLLQEVIQKETFRASTTPEDSDVYLVVVPTPFKANHEPDITCVEAATRSILPLLKKGDLFIIESTSPIGTTEQMADLIYRERPELKDQLYMAYCPERILPGNVIYELEHNDRVIGGLSAEATERAKEFYAHFVKGTLHGTNARTAELCKLTENASRDVQIAFANELSFICDKAGINVWELIELANKHPRVNILQPGSGVGGHCIAVDPYFISSAFPLESKLIAGAREINNYKAFWCAEKISKAIQDFEIRHGHTPVVAMMGLAFKPDIDDLRESPAKYIATRVMQGLNKAEILIVEPNISKHNTFKLTDYRDAYEQADIVAFLTAHTPFKFLEYRTDKVILDFCGVFKK

SEQ ID NO: 57069 - protein, 427 aa, Physcomitrella patens subsp. patens
DDVVFRILCPAPKIGSVIGKGGSIIKTLRQESGAKIKIADAIPGVDERVILISSTDRGNDRGRGKDGNSEELTPAQEALFKVHARIIADVETSGIDGSDQEEEPSQQVVTRLLVPNNQIGCLLGKGGKIIEQMRQTTGAQIRVLPKDQLPGCALPTDELVQVSGDVSTLKKALLFISARLQENPPRDRPQSYAAPAPAFVPVTDYLAKDSYRSKGTGHVFGLGPEPLEGRSWTISSGNLSLDRQDNRRSKEGRDSGENELVFRLLCPSDKIGSVIGKGGSIIHNLRKDTGARIKIANAVPGSDERVIIVSALELPGDSFSPALEAMIQVQSRITAEMGGDKDGIITTRLLVPTNQIGCLLGKGGSIIEDMRRATRANIRVLPKDTLPRCALDTDELVQIVGDTTVAREALFQVISRLRNNAFRESGS

SEQ ID NO: 57070 - protein, 270 aa, Lactuca sativa
MTSITKRLEGKVALITGAASGIGECTAKLFAEHGAKVVIADIQDQLGQAVCEAIGTSNSIYVHCDVTNEEDIKNAVDTAVTTYGKLDIMFNNAGVVDPIKARIIDNEKTNFERVLNVNVTGVFLCMKHAARVMVPQRSGTIISSSSLSSHLGGIASHAYCCSKHAIAGLTKNLAVELGQFGIRVNCLSAYGIATPLTKKITGLEKEAFESAMNLTANLKGVTLKTDDAAYAALFLVSDEAKYISGQNLLIDGGLSYANTSFNFFKYGEEL

SEQ ID NO: 57071 - protein, 402 aa, Synechococcus sp. WH 5701
MVTLSSSPSTAAAGTVSDRHRLRLGPIATPDRLLLGPGPSNAHPTVLKALSRTPIGHLDPLYIELMGEVQDLLRYAWQTENRLTIPMSGTGSAAMEATLANTVEPGDKVLVAVKGYFGLRLVDMAGRYRAEVATIERPWGEAFTLEEIEQALASHRPAILAMVHAETSTGVCQPMEGIGELCRRYDCLLLLDTVTSLGAVPLHLDAWGVDLAYSCSQKGLSCPPGLGPFTMGERAEAKLAARSSKVPNWYLDVSLLNQYWGSNRVYHHTAPVNMNFGMREALRLLAEEGLENAWSRHRSNAERLWTGLERLGLELHVPEHLRLPTLTTVRIPEGIDGKAFSLHLLNTHGIEVGGGLGALAGKVWRIGLMGYNSQPENVDLLLNLLETELPAFRQSPPVAAVA

SEQ ID NO: 57072 - protein, 539 aa, Physcomitrella patens subsp. patens
MQTGGKEAETARLATNDGSAQSASPVSAKDESRVAGSQNGVAVATETTVSITVVGASGDLAKKKIFPALFALYYEGCLPKHFTVFGFARSKMNDESLREMISGTLTCRIDQRENCGDKQEEFLKRCFYHSGQYSSEESFGELSKKLHEHEGDRVANRLFYLSIPPDVFVDVARCSSLAASSANGWTRVIVEKPFGRDSESSAELTRGLKTYLNEDQIYRIDHYLGKELVENLSVLRFSNLVFEPLWSRQYIRNVQFIFSEDFGTEGRGGYFDNYGIIRDIMQNHLLQILALFAMEPPVSLDAEDIRNEKVKVLRSMRVLDTDNVVVGQYKGHTRGGVRYPAYIEDKTVPNNSITPTFAAAALFIDNARWDGVPFLMKAGKALHTKRAEIRVQFRHVPGSLYKRSFGADIDQATNELVIRVQPDEAIYLKINNKVPGLGMRLDRSNLNLHYADRYNREIPDAYERLLLDAIEGERRLFIRSDELDAAWALFTPLLKELEKRKVAPELYPYGSRGPVGAHYLAAKYNVRWGDNSSETSDSV

SEQ ID NO: 57073 - protein, 375 aa, Arabidopsis thaliana
MSASSSSFEQPQVITCNAAVAWRAGEPLVMEEVEVSPPQPLEIRIKVVCTSLCRSDLSAWESQSLLPRIFGHEAAGIVESIGEGVTEFEKGDHVLAVFTGECGSCRHCISGKSNMCQVLGMERKGLMHSDQKTRFSIKGKPVYHYCAVSSFSEYTVVHSGCAVKVDPLAPLHKICLLSCGVAAGLGAAWNVADVQKGSSVVIFGLGTVGAKLRGAAQILGVDINPAKAEQAKTFGVTDFINSNDLSEPIPQVIKRMTGGGADFSFECVGDTGIATTALQSCSDGWGMTVTLGVPKAKPEVSAHYGLFLSGKSLKGTLFGGWKPKSDLPSLIDKYMNKEIMIDEFITHNLSFDEINKAFVLMREGKCLRCVLHMPK

SEQ ID NO: 57074 - protein, 387 aa, Pasteurella multocida subsp. multocida str. Pm70
MSLDLSEIRQQITQLDRNLLKLLSERHRLAFDVARSKEITQKPLRDLEREQQLLQELIQFAENQNYQLEAQYITDIFQRIIEDSVATQQVYLQKKLNAQREQNIHIAFLGKRGSYSHLAARSYATRYQETFVELSCRSFDEIFEKVSAGEADYGVLPLENTTSGAINEVYDLLQHTDLSLVGELAYPIRHCVLVNGQDDLNQIETLYSHPQVIQQCSQFIKGLERVHIEYCESSSHAMQLVASLNKPNIAALGNADGGALYGLTVLKSDIANQPNNITRFIVVAKKPLQVSPQIHTKTLLLMTTSQQAGALVDALFVFKKHQINMTKLESRPIYGKPWEEMFYLEIEANIHNPETQQALDELKQYSHYLKVLGCYPSEIIKPVELTP

SEQ ID NO: 57075 - protein, 239 aa, Streptococcus pneumoniae TIGR4
MKIVEKPIKKSAKKFQNKEKPMSQYKIAPSILAADYANFEREIKRLEATGAEYAHIDIMDSHFVPQISFGAGVVESLRPHSKMVFDCHLMVSNPEHHLEDFARAGADIISIHVEATPHIHGALQKIRSLGVKPSVVINPGTSVEAIKHVLHLVDQVLVMTVNPGFGGQAFLPETMDKVRELVALREEKGLNFEIEVDGGIDDQTIAQAKEAGATVFVAGSYVFKGEVNERVQTLRKQLD

SEQ ID NO: 57076 - protein, 306 aa, Pasteurella multocida subsp. multocida str. Pm70
MKKLTVLGSVNADHVISVPHFAKPGETLTGNHYHIAYGGKGANQAVAAARLGANIDFIACIGDDAIGQAMKKAFQQDGINTQAVVEIADQMTGIAMIQVNAHGENSIVIAAGANAYLTETVVEQFADKITQADTLLMQLETPLRAVIFAAKLAKSANTKVVLNPAPAQPLPDELLTQLDMITPNETETEILTGVKVVDEHSAAQAAALFHQKGIETVLITLGSKGVYASQKGTPGKMVAGFRVDAKDTTAAGDTFNGALMTALLEDKPLADAIRFAHAAAAISVTRAGAQPSIPTRQETLNFLQSH

SEQ ID NO: 57077 - protein, 385 aa, Thermoplasma acidophilum DSM 1728
MKQIQLSRNVVDDISFGAIVKIRDQLLEMQRAGKKVYRLESGDPSFPIPEHVRLAIEDALKKNRTHYTDSTGIPELRKAIAEKLVKKNGIRSATPENVLVSNGGMNALYITFRSLIAPGEKVIIPDPMWTEIAEIIKLADGIPIRIPVERYVEEMRKYENDDRVRAVFINSPHNPTGYVFGEKQISDIIDFAESKGIFIVSDEAYEDVIFDGLKHLSPGSLYDDTISLFSMSKSYAMSGLRIGYAHTSNEILYDRMKKLLRCTINGVNSATQYGAVAALTGPQDYIGEMRKEYQKRRDIIYEAVSESRYLEPIKPHGTFYLWNRIKEYPPGVSDSWGMTSYLLEKTGVGSSPGPVFGPAGEGYIRFAFSAATDHIQEAADVLRNF

SEQ ID NO: 57078 - protein, 453 aa, Kineococcus radiotolerans SRS30216
MSAQLVSHRLAAGVREILAPQVARAVEAARPEVRGRVSGIVGLSVEVSGLEAAVGETVRLGDERYSIPAEVVAAEGSRLRCLPLGHLTGLAAGAPAVAVRRPSDVPVGPALLGRVVDALGNPLDGGPPLHTAPRGPLHATPPPAMTRGRVDAPLSLGVRALDTLVPAGRGQRFGIFAGSGVGKSSLLSMIARGTSADVSVLALVGERGREVREFLEDDLGPEGLARSVVVIATSDEAPVLRLRASLTATTVAESFRDMGADCVLMMDSLTRVAMAQREIGLSVGEPPATRGYPPSVFALMPRLLERAGPGVTGSITGIYTVLVDGDDHNEPIADNARSILDGHVVLDRRLATAGHFPTIDVLESVSRVAGRVTTPEQKSAATALRRVMAAHRDAKELIDVGAYQPGANPEVDAAVAQLPAINAFLRQDIHDITPAPQAWAQLQQLVSTFGGVR

SEQ ID NO: 57079 - protein, 183 aa, Prochlorococcus marinus subsp. marinus str. CCMP1375
MSSIHLARRIFGIFIVLTFIFSPASSVEAVLNVGDEVPNYVRSQITGIDLHGQDLSKSSIAGATARDSNLSDVDLHGTVVTLADLKGSNLNGINLTDTLSDRVNFQKTDLRNAVLVNMIASGSSFAGAQIEGADFSYAVLDSDDQRNLCEIAEGTNPQTGISTRESLECSERGVGYKPPMPGS

SEQ ID NO: 57080 - protein, 598 aa, Oryza sativa Japonica Group
MEAPSASASAEERQRIERVARFVARDRDGDMAEALLLRLLKITRNARRWGFLDRDHPLHPYYLQQKVSEQCRILRPRPAAAAAGQTDTQMGLISSAQAFQGKPTQYTLLSDFVTEIANSFIPCHSVADPSVRPQRQLFRRLPHLVTLVTGAGVGQTLGELEGLELGLRHGWEEPVVSNLAKQQQLIVHRYSLLALQFCLVLRSHVCGIRYGLRSRCGPGSRRWPLAGYVEVEDAVNFFSELPNDSAVWSGGRDVCGWPRLMDPLESEGGSQKSNNKPKYSKFTQQELPACKPLLTPGIVVATFLLIGIIFVPIGLASLSASQEIVELVDRYDTNCVSTLDKVGFIQNTDTDKTCTRTLTVPKHMKSPIQIYYQIGDFYQNHRRYVKSRSDKQLRYKNAVHLTKDCDPEGNTVDGAPIIPCGLIAWSLFNDTYTISVNKKAIEVNKKDIAWKSDKTDKFGSDIYPSNFQKGSLIGGAKLNESIPLSEQEDLIVWMRTAALPTFRKLYGRIETDIMANDQLTVVIQNNYNTYSFGGSKALVLSTTSWIGGKNNFIGVAYLTIGGLCIFLAVGFVVLLYMVKPSGSHLKVKKLPYTPSIYF

SEQ ID NO: 57081 - protein, 469 aa, Vibrio vulnificus YJ016
MILPIIMAGGSGTRLWPLSRDNYPKQFLKLHGENTMLQETILRLNGLEHSPAMLICNEEHRFIAAEQVRQIGVAHSGIFLEPVGRNTAPAIALAAFKAVENNQDALLLVLAADHVIENQAAFQESVNNAKLLAEQGKLVTFGIVGNTPETAYGYIKRGKEVEHGFVVDSFVEKPDLQTAQEYIASGNYFWNSGMFLFKASRYLEELKAYRPDIYEACEKAVQVQNNDIDFVRVDKDAFEACPDESVDYAVMEHTQDAVVVPMNANWNDVGGFAALWEVSDQDENGNAFVGDVKSVDTKNTLVFAKDKLVTTVGVEDLVIVNTKDAVLVAHKDESQKVKEIVSQLKADERSEVTFHREVYRPWGKYDSVDNGERFQVKRITVKPGAKLSVQMHHHRAEHWIVVSGTAKVQIDDTEQFVTENESVYIPITAVHALENPGKVDLELIEVQSGSYLGEDDIVRFEDRYGRVKD

SEQ ID NO: 57082 - protein, 164 aa, Pleurochrysis carterae
MSDLCPPTAPFFGFMGAAVALIFANLGAAYGTAKSGVGVSSMGVMKPDLVMKSIIPVVMAGVLGIYGLIIAVIIGNGVKGPEGGKPQYSSFTGFAHLAAGLACGLSGMAAGIAIGIVGDAGVRASAQQAKLYVGMVLILIFAEALGLYGLIVGLILTSKEAPCS

SEQ ID NO: 57083 - protein, 585 aa, Bacillus cereus ATCC 14579
MRKTKIVCTIGPASESIEKLEQLIEAGMNVARLNFSHGSHEEHGARIKNIREASKKTGKTVGILLDTKGPEIRTHDFVDGQAELVTGAEVVLSTEQVLGTAEKFSVSYAGLYDDVDPGSRILIDDGLIELEVIEKADGNIRTKVLNSGTVKNKKGVNVPNVSIKLPGITEKDVKDIIFGIEQKVDFIAASFVRKASDVLEIRELLEEHNAQYIQIVPKIENQEGIDNIDSILEVSDGLMVARGDMGVEIPPEEVPLVQKRLIKKCNVLGKPVITATQMLDSMQRNPRPTRAEASDVANAIFDGTDAIMLSGETAAGQYPVEAVTMMANIAVRVEKSLQYEDMFKKRIKEFTPTITDAISQSVAHTALALDVAAIVAPTESGYTAKMISKYRPKSPIVAVTSDEQVGRRLALVWGVQAFMAEKRAASTDEMLDTAIQTGMDAGLIGLGDTVVITAGVPVAETGTTNLMKIHVVGEEIAKGQGIGRKAAKGKVVVAKTAAEAVANVNEGDILVTTSTDKDMIPAIEKAAALVVEEGGLTSHAAVVGVSIGIPVIVGVNGVTATLKNGQEVTVDAARGIVYNGHAEVL

SEQ ID NO: 57084 - protein, 145 aa, Porphyromonas gingivalis W83
MLNAIYFYRLSHWLYRHHIPILPKLITLLIFLIYNSKIPPQAKIGKGSKFGYGGISVVVHHDSVIGENCSIGHVVTIGGGNSKYPGVPVIGNNVQISRGSVVFGGITIGNNVVIGANTVVNFPVPDNAVVVGNPGRIVHIKESTC

SEQ ID NO: 57085 - protein, 271 aa, Lactuca sativa
MATTTRRLEGKVALITGAASGIGECAAKLFAEHGAKIVIADIQDQLGQAVCEAIGSSNSIYIHCDVTNEEDVRKAVDIAIATYGKLDIMFCNAGIIDPNKDHIIDNEKSDFERVLSVNVTGVFLSMKHAARVMVPTRAGSIISTASVVSNIGGLCPHAYTCSKHAVAGLTKNLAVELGQFGIRVNCLSPYAIDTPQATGFTGLKGEDFKNKVNSVANLKGVTLTTDDVAKAAVFLASDEAKYISGHNLFIDGGFSIVNPSFNMFQYPENPL

SEQ ID NO: 57086 - protein, 387 aa, Synechococcus sp. WH 7805
MTDQRQLSELTSDERGRYARHLTLPELGLAGQTRLKAASVLCIGAGGLGSPLLLYLAAAGIGRLGIVDDDRVDLSNLQRQVIHGQASVGEAKTSSARWRIQDLNRHCQVEEHSCRLTAENALQLIEAYDLVVDGSDNFPTRYLISDACVMLGRPFVYGSVQRFEGQVTVFNQGPQSPDYRDLVPQPPPRDLVPSCAEGGVMGVMPGLIGLLQATEVIKVITGLGDTLDGRLLLVDSLSMRFRELRLERRPDRAPVENLVDYEQFCNPGVPVEDEESQGMNSISVRELKALLDERTDLVLLDVRQQAEADVAVIPGSQLIPLASIESGDAIERIRLLASGQAVYVHCKLGGRSAKAVDLLARSGILAVNVTGGIDAWSQDVDSSVPRY

SEQ ID NO: 57087 - protein, 471 aa, Hyphomonas neptunium ATCC 15444
MSTQYDLIVIGSGPGGYVAAIRASQLGMKTAIVERESLGGICLNWGCIPTKALLRSAEVLHLAKHAKSFGLKIEKPEFDLEAIVKRSRGIAAQLSGGVKFLMKKNKIDVIEGAARLEKGAPAPKVIVKGKDGKDTPYTAKHVMLATGARARDIPQAGLKADGKLVWTYREAMTPDVMPKRLLVIGSGAIGIEFASFYNELGSDVTVAEVMDRILPVEDAEISGLAEKDFKKQGLNILTGAKVENVKPGKNTVTADITTKDGKKETKEFDRVILAVGIVGNVENLGLETLGVKVEKTHVVVDGFGRTGVPGLYAIGDLTGPPWLAHKASHEGVMCVEGIHGKNHAEPFDASNIPGCTYSHPQIASVGLTEAAAKEKGYDIKVGRFPFLGNGKAIALGAENGLVKTIFDKKTGELLGAHMIGAEVTELIQGYVIARQGELTEADLIHTVFPHPTLSETMHEAVLDAEGRVLHI

SEQ ID NO: 57088 - protein, 429 aa, Synechocystis sp. PCC 6803
MTYSPVVESVEAQAFAVTDLSPAAEFKTADFDTYVMNTYGRFPIAIARGQGSTLWDTEGKSYLDFVAGIATCTLGHAHPALVRAVSDQIQKLHHVSNLYYIPEQGELAKWIVEHSCADRVFFCNSGAEANEAAIKLVRKYAHTVLDFLEQPVILTAKASFHGRTLATITATGQPKYQQYFDPLVPGFDYVPYNDIRSLENKVADLDEGNSRVAAIFLEPLQGEGGVRPGDLAYFKRVREICDQNDILLVFDEVQVGVGRTGKLWGYEHLGVEPDIFTSAKGLAGGVPIGAMMCKKFCDVFEPGNHASTFGGNPLACAAGLAVLKTIEGDRLLDNVQARGEQLRSGLAEIKNQYPTLFTEVRGWGLINGLEISAESSLTSVEIVKAAMEQGLLLAPAGPKVLRFVPPLVVTEAEIAQAVEILRQAIATLV

SEQ ID NO: 57089 - protein, 209 aa, Triticum aestivum
  misc_feature (195)..(195): Xaa can be any naturally occurring amino acid
MSAAVGGAEFHGFGGAAQLPRSRMLGRPVRVAPPGATPAGGGGPSAASIRAVSTPLKKDAKEVKRSKVEIIKEKSNFLRYPLNEELVSEAPNVNETAVQLIKFHGSYQQSDREVRGQKNYSFMLRTKNPSGKVPNQTYLAMDTLADEFGIGTLRLTTRQTFQLHGVLKKNLKHVISTVIKNMGSTLGACGDLTRXVLAPAAPYARKVSL

SEQ ID NO: 57090 - protein, 412 aa, Bacillus cereus ATCC 14579
MSTLREEALHMHKVHQGKLETVSKVKVENAKDLSLAYSPGVAEPCKEIYDDKSKVYEYTMKGNMVAVVTDGTAVLGLGNIGPEASLPVMEGKAVLFKSFAGVDAFPIALNTNDVDKIVETVKLMEPTFGGVNLEDIAAPNCFIIEERLKKETNIPIFHDDQHGTAIVTVAGLVNALKLVGKKMSDIKVVANGAGAAGIAIIKLLYRYGVRDIIMCDRKGAIYDGRPTGMNPVKDEVAKYTNKNRIEGSLADVVQGADVFIGVSAEGALTEEMVRTMNDDAIIFAMANPVPEIMPELAKAAGAAVVGTGRSDFPNQVNNVLAFPGIFRGALDVHATQINEEMKMAAVQAIAELVAEDELNADYIIPAPFDARVAPQVAAYVAKAAMETGVARRQVDPNEIAEKTKQLALIGKE

SEQ ID NO: 57091 - protein, 502 aa, Medicago truncatula
MGSCFSTESRSPHPNSPSSSSSSFRKNRKNSKKKLGSRTSSFEYWRNEPLHKIHDRIFLNGSSQFASLFTQQGKKGTNQDAMLVWENFCSREDTIFCGVFDGHGPYGHMVAKRVRDSLPLKLNTQWELNVSGDDVLKEISVNAAASMNSEDATFASADEESRVSIDTEEMEKLPEIFHTLKESFLKAFKVMDRELKMHQTIDCFCSGTTAVTLVKQGRDLIIGNIGDSRAVLGTREKDNSLVAVQLTVDLKPNLPAEAERIRKCKGRVFALHDEPEVCRVWLPNSDSPGLAMARAFGDFCLKDFGLISVPEVSYRRLTEKDEFVVMATDGIWDVLSNKEVVDIIAAAPRRATAARSLVETAVRAWRYKYPTSKVDDCAVVCLFLDKGMQKISTASHANKSKEHCPGSGIQVGNNGDDEEGVSEPNALERSGTCRKANDNNNTSHEDKEEEEFKEEEEIDPDLEKEWSALEGVSRVNTLLNLPRFTPDKEDKAAAAARSKKLK

SEQ ID NO: 57092 - protein, 426 aa, Campylobacter coli RM2228
MKMNLKELDLKHIWHPCTQMKDHENLPLIPIKRAKGVWLYDFDDKAYMDCVSSWWVNLFGHCNEKIANAIKKQVDELEHVILAGFTHEPIIKLSARLCEKVGRNFNKCFYADNGSSAIEVALKMSFHYHLNKGMKKSKFLSLSNSYHGETLGALSVGDVALYKDTYKPLLLECLSTPVPQGKDYTKELEILKDILEKNASEICAFILEPLVQCAGNMHMYQAGFIDEAIKLCHKFGVQVIFDEIAVGFGRTGTLFALHQCKQSPDFICLSKGITGGFMPLSVVLTRDEIYNAFYDTYESQKAFLHSHSYTGNTLACAAANAVLDIFEDENILVKNQILSEFIKKEFSRLEKFDFLGNFRTCGMISAFDILSTKYKRVGLFVFQKALEKGLLLRPLANTIYFMPPYIITKEQIVYVLESLEQIFKEF

SEQ ID NO: 57093 - protein, 442 aa, Pseudomonas fluorescens Pf-5
MNERSMSTAIRPSACPGLLRIVPALDGGICRIKLAGGVISAEQAVAVAEAAQAYAGGVIEATNRANLQIRGIGPEHQALIAALLAAGLGPTTAAGDDVRNLMLSPCAGIDRQCLMDTRPLAAQILDTLQGHPRFHQLSAKFAVQLDGGEALAMLEHHHDLWLSALERDGQGLLAFGLAGCPVDEPLAAVAQDQGHELLVAVLELFLDLARPEQTRMRHLLMDMSREDFLAQLEPRLSRPLLNIGGWRRQTSDAGLHIGTYPQAAPGQVYVGAGTPLGRLDPAMLKGAAQLAREYGDASLRLTPWQSLLLPSIAAADAPAATAALEQLGLLCSPQQALAHLIACTGSSGCGKALADTKSDALQLAGLLQRHGRQLDVHLSACPRSCAAAHVAPATLLAVAPGRYDLYLRDATQPGFGTLHARNLSIEAAEALLDARPRSNLDA

SEQ ID NO: 57094 - protein, 369 aa, Synechocystis sp. PCC 6803
MKSRAAVAFEVGKPLQIVEIDVAPPQQGEVLVKITHTGVCHTDAFTLSGDDPEGLFPVVLGHEGAGIVVEVGEGVTSVQLGDHVIPLYTAECGKCLFCRSGKTNLCVAVRATQGKGVMPDGTSRFSYNGQSLYHYMGCSTFSEYTVVAEVSLAKINPEANHEHVCLLGCGVTTGIGAVHNTAKVQPGDSVAVFGLGGIGLAVVQGARQAKAGRIIAIDTNPAKFELAKQMGATDCINPKDHDQPIQQVIVEMTGWGVDHSFECIGNVEVMRSALECAHRGWGQSVIIGVAGAGQEISTRPFQLVTGRKWMGTAFGGVKGRSQLPGMVEQSMRGEIQLAPFVTHTMELKDINQAFDLMHDGKSIRSVIHY

SEQ ID NO: 57095 - protein, 425 aa, Synechococcus sp. WH 5701
MPLPSRPPLEAADSFEDPCLLRLANGVDVVSLKQEQAPLVCIDFWCQAGSAGEGPGQEGMAHFLEHMVFKGSEHLEAGQFDHRIESLGGSSNAATGFDDVHYHVLVPAEAVAEALELLLDLVLKPRLDPGDFRMERQVVLEELAQSEDQPEEVAFQSLLHLACPQHPYGRPILGNRGALKAQTPEGMASFHSGAYRPRRCSLALAGALDQLPIESLLEASALASLEPLASADPPGPTLELRPGVHELRLPRLEAARLLMAWQLPAADDLEAVAGADLLTSLLAEGRRSRLVQRLREELRLVESIDLDLNVLEAGSLALLEAVCAPEQVAAVEEQIAVVWQQICCTLPPESELERARRLVANGYRFGLESASSVAGLIGHQCLWGRLRPLRHPLELLERWSVERLGAELLPLLAPERACRLLALPA

SEQ ID NO: 57096 - protein, 175 aa, Brassica napus
MSAFVGKYADELIKTAKYIATPGKGILAADESTGTIGKRFSSINVENIESNRQALRELLFTSPGALPCLSGVILFEETLYQKTSDGKPFVEFLQENGVIPGIKVDKGVVDLAGTNGETTTQGLDSLGARCQEYYKAGARFAKWRAVLKIGATEPSELSIQENAKGLARYAIICQE

SEQ ID NO: 57097 - protein, 820 aa, Ashbya gossypii ATCC 10895
MKYYSKKGHREQAEAMGVPPDVNNPPFYIPLKPVEGRYKLIQELGNGSFGSVTLAKAQFEISQINGKEGTLMDQSIIPTIREENWNNKNKGLVAIKTMMTRLPTLNDYTRVREIKFILQIPAHAHLVQIYELFIDDSLYQLHIVMECMEQNIYQLMKCRKRRVFSLPTLRSILSQILSGIRHIHAHNFYHRDIKPENILISPANRYYSKEWISAGHYPDNYVVKIADYGLARHVTNKSPYTAYVSTRWYRSPEILLRQGSYSRPLDIWAFGCVAVEVATFKPLFPGADEMDQIWKILELLGTPHPCHESKISGYVPHGGAWLQAEHLASRLNLKFPYVEGKDISWVMCNPQLESLCDVVRACLVWNPDDRATVEDLSQMPYFAGTIVQETKQPPLSTAQSALMFAGLLPSSGLQHRRLIFNDNANNHNSNNSNGSNNATTTTTTTMTTNMTAATTKKTTRTGGPVNRKRETNDENDVESLAHPIPIKRTLANLLSFNKEEPQLSFREFLKETSADKAKPNASNSNSGNCAANQLGHSNHNINNYLNRNNNSGTQHGPSYNNYGQNLNQQSGSSNHSGNGRNPTNNTHAVNTAITQTNTNKTNPTNNNTNNNNNTPTPTTTTTTTTTTPTPATTTTTITNHNGQHDDNDNDKSNFRNVGDGRAASDSTLSGPEELTKEISANIELYQEPPPLAEEQPLYDDIFGTTENIELDEDGDDDDPEDEDVSFILMYKNAVNQGGAGATQRENIEPLARNYIHESTHQNCHAIDEMSIDDASTDSHSQIPRDFIMEPTTIPQHDILPPAQVRHEPTPNHSFEDGLSF

SEQ ID NO: 57098 - protein, 430 aa, Rubrobacter xylanophilus DSM 9941
MTEIVAVRGREILDSRGNPTLEVEVVTAAGFVGRAAVPSGASTGQNEAVELRDGEGGRYGGKGVLRAVANVEGELAEAVVGMDVTDQRALDLAMIEADGTENKGRLGANAMLGVSLAAARAAAEYAGLPLYRYLGGPGAHVLPVPCANILNGGAHAANNVDFQEFMVVPVGFESYREALRAVAEIYAALKKLLAERGLAGGIGDEGGFAPDLSSNGEALGLLSEAVERSGYSLGEQVCFALDPAASEFYEGGRYELSGEGRSLERGEMVDYYVRLCGEYPIISIEDGLAEDDWEGWEMISARLGGRVQLVGDDLFVTNPKILRKGIERGIANSILVKVNQIGTLTETFETMDLAHKSGYTAMVSHRSGETDDTTIADLAVAVNAGQIKTGAPARGERVAKYNQLLRIEESLGEAAVYPGLGAFNPRMREG

SEQ ID NO: 57099 - protein, 205 aa, Vitis vinifera
MQGAIQAIVSHGSIVKNAVLHQIRLVNPIMPSVVFSRLQSVTSARMEEHGFESTTIADVLKGKGKSADGSWLWCTTDDSVYDAVKSMTHHNVGALVVVKPGEQKSIAGIITERDYLRKIIVQGRSSKSTKVGDIMTEENKLITVSPNTKVLRAMQLMTDNRIRHIPVIDDKEMIGMVSIGDVVRAVVTEHREELDRLNAYIQGGY

SEQ ID NO: 57100 - protein, 477 aa, Rubrobacter xylanophilus DSM 9941
MRVRRTKIVATLGPATSSEESIGALVRAGVDVMRLNFSHGTHDMHLDNARTVREAAAEAGRNVAIMQDLQGPKIRTGEVEGGTELVEGSRVVIAPGDFVGDASRLSTSYDRLAQDVKPGHRLLIDDGLIGLRVESIKENGEIVCEVLEGGPVSSHKGLNFPDSSLSISGLTEKDLEDLRFGLEELRPDWVAISFVRTGEEVLDVKERIRELGGDVPVISKIEKHEAIDNIEEVIEASDGVMVARGDLAVELSAERVPIEQKRIVARCRRRGRPVIVATQMLDSMMRNPRPTRAEVSDVANAIFDRTDAVMLSGETAVGRYPTQSVMEMDRICRAAEGAIDYGRDIAASTAWGRGDRYDAVTHAACELAEVLEAQAILTSTQTGLSCIRVARFRPPNRILAVSPIEATVRRLALVWGVTAVRGEQAGSIEERFRESVEAAEARGHLKKGDRLVFTGGTAGSLPGSTNLLQVHTVGENG

SEQ ID NO: 57101 - protein, 419 aa, Thermoplasma acidophilum DSM 1728
MTYMPENMDPFEMALQQLEKAAAVLKLDEQALEILKQPEKILQVSIPVRMDNGRIKVFTGFRVRYNTARGPGKGGIRYHTEETLSTVKALAAWMTWKCAIVDIPFGGAKGGVICDPKSMSQGELERLSRGYIRAIADFIGPEVDVPAPDVYTNPQIMAWMMDEYENVVRHSAPNVITGKPLEVGGSEGRGDATAKGGMYVLREGAKRIGLDLSKARVAVQGFGNAGQFAVKFVHEMFGSKVVAVSDTKGGIYVKDGIDYAALLEHKKKTGSVVGFPGSEPITNEELLESDVDVLIPAAIEEQITGKNADRIRAKIVLELANGPTTPEADEILYKRGILDLPDFLSNSGGVTVSYFEWVQNNYGEYWTADDVYKKLDQKMTKAAHDVFDAMDKYKVNPRTAAYVVSVKKVADAMKARGMY

SEQ ID NO: 57102 - protein, 523 aa, Arabidopsis thaliana
MATIVVDFQKIHFHPQILLSIFTVICIFVFFFMTEKPKGSRGCDLPPSPPSLPIIGHLHLLLSALPHKAFQNLSSKYGPLLRLRFFNVPVVLVSSASVAYEIFKTHDVNISSHGHPPIDECLFFGSSSFVVAPYGDYWRFMKKLMVTKLFGPQALERSRRARADELERFHANLLSKEMKGETVQIAKEAIKLTNNSVCKMIMGRGCLEENGEAARVRGLVTETFALVKKLFLTQVLRRLFEILGISPFKKETLGVSRKFDELLERILVEHDEKPDFDHGGDLMDVLLAAYRDGKAEYKITRDHLKSLFAELILGGTDTSAQTIEWTMAEIIKKPNILERLRKELDSVVGKTRLIQEKDLPNLPYLQAVVKEGLRLHPPAPLLGRKVPDGCTIGGCYVPKNTALVVNAYAVMRDPHSWEDPDEFKPERFLASSSGKEEEREQELKYIPFGSGRRGCPGVNLGYIFVGTAIGMMVHCFDWRANGDKVNMDETAAALTLNMATRVHPLRCTPVSRMQLQKSQFVSS

SEQ ID NO: 57103 - protein, 191 aa, Zea mays
  misc_feature (29)..(29): Xaa can be any naturally occurring amino acid
  misc_feature (172)..(172): Xaa can be any naturally occurring amino acid
  misc_feature (180)..(180): Xaa can be any naturally occurring amino acid
KRPTTRSLASSMFFSADAITSPAQATMVXPFTGLKSSAAFPDTPKRNNYITSIASNAGRVSCMKERPPVGKKKFETLSYLPDLTEVELDKEVDYLLRNKWIPCVEFELEHGFVYREHVCTPGYYDGRYWTMCKLPLVGCTDSAQVLKEFQECKTEYPYAFIRIIGFDNTRQXQCIRFIDXEPPSFTGAKLV

SEQ ID NO: 57104 - protein, 363 aa, Pasteurella multocida subsp. multocida str. Pm70
MGFKCGIVGLPNVGKSTLFNALTKAGIEAANYPFCTIEPNTGVVPMPDPRLDALAEIVKPERVLPTTMEFVDIAGLVAGASKGEGLGNKFLANIRETDAIGHVVRCFENDDIVHVAGQINPAEDIDTINTELALADLDSCERAIQRLQKRAKGGDKDAKFELSIMEKILPVLENAGMIRSIDLDKDELQAIKGYNFLTLKPTMYIANVNEDGFENNPYLDRVREIAEKEGAVVVPVCAAIESEIAELDDDEKIEFLQDLGIEEPGLNRVIRAGYKLLNLQTYFTAGVKEVRAWTIPIGATAPKSAAVIHTDFEKGFIRAEVIAYDDFIQYKGEAGAKEAGKWRLEGKDYIVQDGDVMHFRFNV

SEQ ID NO: 57105 - protein, 128 aa, Brassica napus
DFFPTMQMRPNPQCSNVACLERQKEYMLAKPARDAAAKAKKEAEAATAVDDGPLHDDNEWNISVVDDENEKDTTKASSSSGALPEGLTRELPEADEYEKAIAIGSGEAEEEEDDLEELKKQLEALNAA

SEQ ID NO: 57106 - protein, 261 aa, Hypocrea lixii
MDHRPQAWGRPRDDVYGAYDHSYMQDNGPKQNTQQPIVTGTSVIGIKFKDGVVMAADNLASYGSLARFTDVKRLRTFADSSIVGFSGDISDMQYLDRHLIDLSLSEAYESPDKPRLNAANLHRYLSKLLYNRRSKFDPLWNHLLIGGLDDNGEPFLAAADLLGSTYSAPSLATGFGAMLAQPIMRRYVPDEESAKKLSREEAINIVKEAMKVLFYRDARSLDSYSLAVVTKEGVELKQDEKLEDQSWAFADRIKGYGTQTV

SEQ ID NO: 57107 - protein, 430 aa, Xylella fastidiosa Ann-1
MVADKQGELTLARIAVVGLGYVGLPLAVAFGRQRPTLGFDIDICRVQQLCAGHDITCEIELEELQAARHLRYSSDPRELSDCQIFIITVPTPIDVVEQPDLGPLRSASMLVASVLKPGDLVIYESTVYPGTTEEVCVPLLEAGSGLRFNVDFHCGYSPERINPGDRKRRLQDICKIISGSTPDITAVVDALYSQIIVAGTWCAPSIRVAEAAKVVENIQRDVNIALVNELALIFDRLGIDTLDVLEAAETKWNFLPFRPGLVGGHCIGVDPYYLLHKSESVGYYPDLIHTARRVNSRVSRHVVDRVVALLGELSVPMTRAVVLVLGVTFKEDCPDLRNSRALDLVRMFRTLGAQVDVCDPCADPQQALEHEAVTLCTEPKAGAYDAIVLAVAHAQYRMYDVATIAALGKSQAVVYDVKSVWPRAAVTDRL

SEQ ID NO: 57108 - protein, 567 aa, Hordeum vulgare
MASPALISDTDQWKALQAHVGAIHKTHLRDLMADADRCKAMTAEFEGVFLDYARQQATTETVDKLFKLAEAAKLKEKIDKMFKGEKINSTENRSVLHVALRAPRDAVINSDGLNVVPEVWAVKDKIKQFSETFRSGSWVGATGKPLTNVVSVGIGGSFLGPLFVHTALQTDPEAAECAKGRQLRFLANVDPVDVARSIKDLDPATTLVVVVSKTFTTAETMLNARTIKEWIVSSLGPDAVSKHMIAVSTNLKLVKEFGIDPNNAFAFWDWVGGRYSVCSAVGVLPLSLQYGFPIVQKFLEGASSIDNHFHTSSFEKNIPVLLGLLSVWNVSFLGYPARAILPYSQALEKLAPHIQQLSMESNGKGVSIDGVRLPYEAGEIDFGEPGTNGQHSFYQLIHQGRVIPCDFIGVIKSQQPVYLKGETVSNHDELMSNFFAQPDALAYGKTPEQLHSEKVPENLIPHKTFQGNRPSLSFLLSSLSAYEIGQLLSIYEHRIAVQGFIWGINSFDQWGVELGKSLASTVRKQLHASRMEGKPVEGFNPSSASLLTRFLAVKPSTPYDTTVLPKV

SEQ ID NO: 57109 - protein, 410 aa, Sinorhizobium meliloti
MQGEEQFSCGVVIVAAGRGERAGQSAEGPKQYRTIGDRPVIAHTLDIFATWPGAGPVVVVIHPDDEELFAAARKRMAGALELTVVHGGATRQLSVLAGLEAVAATGVEYVMIHDAVRPFFDHTLLDRCGAALRDGAQALLPAIAVADTLKRTKAAGLVAETVPRTDLYAAQTPQCFRLEPILSAHRRAAASGRSDFTDDASIAEWAGIPVLLVEGAVDNFKLTLRRDLSMADEKLTRMAIPDVRTGNGYDVHQLVDGDGVTLCGVFIPHGRKLSGHSDADVALHALTDALLATCGAGDIGDHFPPSDPQWKGAPSRIFLEHAARIVRERGGTVTNADISLIAEAPKVGPHRQQMRENLAAILGISLDRCSIKATTNEKLGFVGRNEGIAAIATATVVYASRSKPDVDDRY

SEQ ID NO: 57110 - protein, 439 aa, marine gamma proteobacterium HTCC2143
MLTFWDVFFIAIGQIIGAGVVALTGIAIGMTGPSVFIAYFFAAVLVLIVSLLIIIAGTTLPVTGAYYTWVSRLRSGWLGSVVLSLILLASISLSLYGSSFGLYLNPLFPMLSVNGWGIVVIVLLFLANLFGLKIASKLQIVLVILLISALAIYAGFAMPKIQIELLTPMFPKGIVGFITAVFLLKFATGGAHMIVGLSGEMHNPKRTIPLVMISATLIVAVIYGFVALASVGVVPWTEMINQPLTLAGKQFLPAWAMTYFLIAGAGLAICTTLNSQYIQLPRTFIVASWDKLLPPWVGRLNRYGAPYYILFVMLVVGIVPLLTGLDVSDIARAATIAASLPAFIVYWAIIRIPKDYPDQYGQAVFKPNQFWMWVLFVVAELSTAIGVVFLARDLPVPVIGTLIVWIVISIGYYPLRKRYLARQGVDLDELTSNPAIFEH

SEQ ID NO: 57111 - protein, 208 aa, Xylella fastidiosa Ann-1
MDDVTKALNLVPMVVEQTSRGERAYDIYSRLLKERLIFLVGPIDDYMANLVVAQLLFLEAENPEKDINIYINSPGGVVTAGMAIYDTMQYIKPAVSTICVGQAASMGALLLASGASGKRYALPNSRVMIHQPLGGFQGQATDIDIHAREILALRARLNEILAKHTGQSLETIAHDTERDNFKSAVDAQAYGLVDQVFGQRQEELIQSS

SEQ ID NO: 57112 - protein, 487 aa, Xanthobacter autotrophicus Py2
MNELNPVMLAKGVFINNAWRPAASGRVIDVYAPAEGRVFAQIAAGTAADVDAAVKAARHAAEEGAWSRLTATERGRLLSRLAVAIADHAEELAKLEARDTGKPMKQARADIAAASRYFEFYGGAADKLHGETIPFLAGYFVPTERVPHGVTAHIIPWNYPAQMFGRTIGPALAVGNATVIKPAEDACLTPLRLAELAAEVGFPDGAINIVPGLGEEAGAALSAHPDIDFIAFTGSPEVGILIQTAAAKNHIGCTLELGGKSPHVVFADADLDAAIPVIANTVVQNAGQTCSAGSRLLVERKVYEEVVSRLNARFASLRAGSPEMDLDLGPVINAKQKERVESFFAKASADDVGVVAEGLVAEGVPAGGFYVPPRVYGPVPRSHILATQEVFGPVLAVLPFDDEADAIALANGTEFGLMAGIWSTNASRAIRVARKVKAGQVYVNAYGAGGGIELPFGGMKKSGHGREKGFEALYEFSTLKTLIIKHD

SEQ ID NO: 57113 - protein, 303 aa, Synechococcus sp. WH 7805
MLAAAFRCLWMRDQLEQILSKERDLLRGRCVTSIGPVSGGERGACWRAVLSDGSAWFLKVSDPALLDAERRGLRSLRRWADADLVEVVEVLAWLPLEHRAVLVLPWWEMGNGDQFNLGRGLARLHRMSSLNGPARFGCDEDGFIGLGPQPAGWRDGWGEAFVELRLEPQLRLAEAWSLNENDWSSLLAPLAQWLGEHAPEPCLVHGDLWAGNAGVLADGRGLLIDPASWWADREADIAMTQLFGGFSRRFLEGYNKEWPLPEEVEQRYEALNLYHLLNHANLFGGGYQQRCRRVLNSLRSTLL

SEQ ID NO: 57114 - protein, 255 aa, Xanthobacter autotrophicus Py2
MSTAGNLRLSGKTALVTGAASGFGAEIARVFAREGAKVAIVDLNGEGARKVAEEIGPAAIAVTADVTSRADIEAAVAATIAHGGKLDIVVNNAGWTHRNKPLMEVTEEEFDRVYAINVKSIYYMTHTIVPIMSGQGGGVVVNVGSVAGIRPRPGLTWYNSSKGAVNLATRSLAVELAPQKIRVNCVAPVMGATGLLDSFMGVPDTPENRARFIATIPLGRLSEPKDIANACLYLASDEAEFITGVVLEVDGGRTI

SEQ ID NO: 57115 - protein, 911 aa, Cytophaga hutchinsonii ATCC 33406
MCLSRFIINPAGKKYGIVMPKTHYNIYHPPGLYSQAPDFNPGIPGLTNLLCFQQCGKNGIIIQRNQYLEAYFPIHQFYSSMTKVFSIILLCSAFISSSVSVYAQFNRSDTRRSVPYTANYQRMATGNNSDHSFEIRSGELWGWGYNSNGQLGDGTTMDRRTPVKIGIDINWVAVATGSSYTLALKADGTLWSWGKNQRGQLGDGTTIDRHSPVQIGTEQTWTGIAACFSSGIGIKANGTLWTWGFNNGGELGIGNNDEKHTPVQVGADQNWLYAVAGSNHIVALKVDGSLWGWGLNEAGEIGNGNTVQQDSPVRVGTDNDWTTLAAGSNHTLAIKSNGTLWAWGHNVRGNLGNGTATLDPATLPVQVGTDADWIRVSAGLDHSVALKANGTLWAWGYNVRGQLGYGSGTDKHLPVQIGTAHTWVAINAGTYHTIGVKADGSLWTWGDNTNAQLGDGGTADQPVPHSIRTAPDDWISIAASNAFSMGLKANGTIWTWGLNPFETDGQYKNSSPVQTGSDQNWKSIATGSNYILALKADGTLWAWGDNFSGQLGDGTEQPRMLPKQIGTATTWVSIAAASGVQSFGIQADGSLWSWGHNYDGELGLGTNLKTLVPTRVGTGTDWISIKTGVGHTLGIKSDGTLWGWGTNRQGQLGDGTLVNKYVPVQLGTDRDWINIAGGTIHNICLKSNGTLWAWGRNNYGQVGTGNLITQDRMVQISAEQNWIDVYASLDQSFAIRADGSLWACGLNSSGQLGDGTSVDRAAMVAVGTNQKWISLAAGNYHTLALPVNRIQYCGTGTAYYGELGDHVFDNPNKTAFDCLDNNITTPINIQDNNHAPVLLVYPNPSAGSCTIIGNRDAMYIITNELGQMIRSVSLTENNQYAVTIEGLNTGMYFVTGINNPHAGNLKFIVLQ

SEQ ID NO: 57116 - protein, 482 aa, Synechococcus sp. WH 7805
MLEVQAHQQLKHLLRADAGQWEHQLTLSRLVGRSLRRRDQTRIQLSAGSNERWWLALLVPLCLQSRNTVLVLDQQQRQRFLNLERPRLLQSDLRLGCWSGIHPPKGDQLWLLTHDQLITAYRLGHLRHDDHLVIPEAEHLATRLRDAMTVKLEARHWEELRTAFPATGQGLLDLHERLSRQLFARGSGNFRQLCMPESALTSVRDLLQLTGPAPEPWCQLTTMGMDTWASWARLDHEHLQWQWTLQPLEPLEEIQDLFNTRPWTLIHGDGGCRRAANETPPDRDDPVIRIDLREPPRSEPIPIYAPRRQPLPNTEIYASHLLDQCRRLILGRSGLTLVLADDTALRQRLTSELAAEFGSRVTLDHASDKPNGVICTSWSWWMTHQSTLPEPEQLITALLPIASLGDPLTAARVQVLKKQGRDWFRDLLLPEALAILIPAIAPLRRNGGRLALLDGRVRSRSWGEQVFRALEPWSSLQRLLPD

SEQ ID NO: 57117 - protein, 298 aa, Oryza sativa Japonica Group
MGRVLSCVGVRHPRHQHPARPSKLRDKSPPREDAGADSALGPSPYPEATLLVRAPPPQVVVATASLARLLFLLLLLDMVSEQTAPVATAEAELESSAAPPVKPDEAAAKAQPEDDAPVVEDAKDDDDDEEDDDDDEDEDEDGEQGAIGNEGSKQSRSEKKSRKAMMKLGMKPVTGVSRITIKRAKNILFVVSKPDVFKSPTSETYVIFGEAKIEDLSSQLQAQAAQQFRMQDLSKVMSKPDAAAAAPADEEEEVDETGIEPRDIDLVMTQASVSRAKAVKALKAHDGDIVSAIMELTA

SEQ ID NO: 57118 - protein, 393 aa, Vibrio vulnificus YJ016
MTGNVMRITVVGAGYVGLANAALLAQYHSITLLDVDSKRVEQINAQSSPIVDADIERFLSSGALQLTATTSPQIAYHDAQLIIVATPTNYDPITNGFDTASVEQVIKDAIQISPNATILIRSTVPVGFTERMRAQAKRCNILFAPEFLREGKALYDNLFPSRIVIGEQSERGQKIAELFANAAEKRDVPILLTNPTEAEAIKLFSNTYLAMRIAYFNELDSYAEAHGLDARQIIQGVGLDPRIGNHYNNPSFGYGGYCLPKDTKQLLANYQDVPNNIIGAIVDANRTRKDFVAESILKRNPKVVGIYRLIMKAGSDNFRASSIQGIMKRIKAKDIEVVVYEPVLKEAEFFHSRVIKDLNEFKQTADVIVSNRMVEELVDVADKVYTRDLFGSD

SEQ ID NO: 57119 - protein, 485 aa, Oryza sativa Japonica Group
MERDAWLLCAALAAATVVYYLACTTSRRAQRRRLPPGPTPLPVIGNVLSLRGNMHHALARLARERYGPVMALKLGLVTAVVVSSPDAAREAFTKHDRRLAARAVPDTSRVRGFADRHVFSPGSIAAARGFRERKVRDIVGYFAAHVGEVVDVGEAVYSGVVNLVSNAFFSGDVVDVGEESAHGLREAVEDIILAIAKPNVSDLFPFLRPLDLQGWRRWAEKRYDTVFDILDNITNSRLADASAGNHAGDFLDSLLGLMSYGKIARDDVTTIMFDVFGAGTDTIAITVQWAMAELLRNPSIMAKARTEMEDVLAGKKTIEENDTEKLPYLRAVIKEAMRLHPVAPILLPHQAAEDGVEIGGYAVPKGSTVIFNVWAIMRDPTAWERPDEFMPERFLQRAEVDFRGKDFEFMPFGAGRRLCPGLPMAERVVPFILASLLHAFEWRLPDGMSAEELDVSEKFTTANVLTVPLKAVPILASSASELQAS

SEQ ID NO: 57120 - protein, 247 aa, Methanosarcina acetivorans C2A
MNESTVYECLKYGNENINRALEVLRAGKMIQIYDSDSREGETDLVIPAKAVTYKDVKWMRKDAGGLICVAVDPVASKQLKLPFMADLVREASRTSESLGEVVEKDGDLKYDSHSSFSIWVNHRDTRTGIPDLERALTIRKIGEITEKSLSGNGIRFGNEFRTPGHVALLRAAEGLLDERMGQTELSVALARMAGITPAMVVCEMLDDESGRALSKENSKDYGKDHGLVFLEGQEILEAYMLWTGSEC

SEQ ID NO: 57121 - protein, 360 aa, Campylobacter coli RM2228
MPNLNLEDFRNKIDMVDDKILELLNERMSYVKSIGEIKQTSGGAIYRPERERAIINRLKNANLGLLDQNAIEAIYQEIFAVSRNLEMPQIVAYLGPEGTYTHQAARSRFGAMSRYIALATIEDVFKELSNKEAKYGVVPIENNTEGAVGVTLDCLGKYNELKIFGEIYMDIHHSFVGINENLKEIKRIYSHPQGYNQCRKFLESHELSNIEFVPSKSTANAAYLASQDKYSAAICSKIAAKLYNVPVLFDKIEDNAANRTRFLILSDIKNPKMPNCKTSILAHTAHKPGGLSSLLEQFKKENINLTKLESRPVKSKEFLHSFYIDFEGHIDDENVQRALKNADEVVWLGSYLSGEKNEIQ

SEQ ID NO: 57122 - protein, 248 aa, Porphyromonas gingivalis W83
MKRIVLIRHGESLWNKENRFTGWTDVDLSEKGIEEAKKAGELMKKEGFQFTKAYTSYLKRAVKTLNGVLDVMDLDWIPVEKTWRLNEKHYGMLQGLNKAETAEKYGDEQVLIWRRSYDVPPTPMEKEDPRSPFMDPRYKGVCEKDLPLTEALCDTVNRILPYWNETIFPTLKEHDEVLVAAHGNSLRGIIKVLKNISDEDIISLNLPTAVPYVFEFDDNLRLVKDYFLGDPEEIKKLMEAVANQGKKK

SEQ ID NO: 57123 - protein, 420 aa, Ostreococcus tauri
MQPQVLNRGISYALKGEQSLFAYFRPKSTPTRSGHFGSHRTAHSTSTCRASLKTGIVGLPNVGKSTLFNALVENSRAQAANFPFCTIEPNFGIVPVSDKRLETLAAISRSSNIVPATVEIVDIAGLVKGASEGEGLGNKFLANIRECDAIVHVVRCFNDDNIVHVNGIVDPRRDAAIINTELALADMGQIQKRMEKIQKAKGKVSVTGQTAESELKVLADILSQLEQGKQVRQMELNDDDRYIITELRLLTAKPCIYAANVPEGDLATNGADNVHFKALADFAVESGAGITCVSAQVAAELKDLTEEDRVDYLLCIGTNSDGTSELIETAYRQLELLTYFTTGEKETRAWTIRRGFTAPQAAGVIHTDFEKGFIKAETVHYDDFVSSGGFTGAKENGLLQLEGKDYVVQEGDVMVFKFNV

SEQ ID NO: 57124 - protein, 279 aa, Zea mays
MTSGAAAAGGLGRTPTWKERENNKRRERRRRAIAAKIFTGLRALGNYKLPKHCDNNEVLKALCREAGWVVEDDGTTYRKGCRPPPGMLSPCSSSQLLSAPSSSFPSPVPSYHASPASSSFPSPTRLDHSSGGSSTHNPAAAAAAAAASLLPFLRGLPNLPPLRVSSSAPVTPPLSSPTAAAASRPHNIVRRPNWDAAAAVVAADPFRHPCSRFQATTAPASPTYNLVHPASDSMELDGTTAAVEEFEFDKGRVVTPWEGERIHEVAAEELELTLGVGAK

SEQ ID NO: 57125 - protein, 235 aa, Brassica napus
MPTFSLSILKVCQVQIFTQKVSLQVTPSPADSISSLSFSPRADILVATSWDNQVRCWEISRSGTSLATAPKASISHDQPVLCSAWKDDGTTVFSGGCDKQAKMWPLLSGGQPVTVAMHDAPIVDMAWIPGMNLLVTGSWDKTLKYWDTRQQTPVHTQQLPDKCYSLSVKHPLLVVGTADRNLIVFNLQNPQTEFKRIVSPLKYQTRCVTAFPDQQGFLVGSIEGRVGVHHLDDSQ

SEQ ID NO: 57126 - protein, 202 aa, Brassica napus
MTLFSFPISTSTEMFPWLLLLLLPPLLILFKTYLLPSSKNLPPCPPKLPILGNIHQLGNLPHRTLRDLSLKYGPVITVYLGSVRTVVVHSPETAGEVLKAHDSDCCTRPRLSITKSFFYDGLGLGFTQWGDYYKDVRKLCVLELFSVKRANSFRNIREEELSRLVGSLSDSAKSGSQVDLTGKLAKYVASFTCRMGFGVSFV

SEQ ID NO: 57127 - protein, 625 aa, Campylobacter coli RM2228
MNEIIKKDYQFAYTKEELEKLNLTQLEDLAARIREKIIDVVSKNGGHLSSNLGAVELTIAMHTVFDNGIDPLIFDVSHQSYTHKLLSGKENVFESLRQFGGLSGYTKPNDGDYFVAGHSSTSISLAVGACKAIALKGEKRTPVALIGDGALSAGMAYEALNELGDSKFPCVVILNDNEMSISKPIGAISKYLSQAMATQFYQNFKKRVAKMLDALPDSATYMAKRFEESFKLITPGLLFEELGLEYIGPIDGHNLSEVISALKQAKAMQKPCIVHAQTLKGKGYSLAEGKNAKWHGVSAFDVDSGESVKKSDTKKSATEIFSKNLLDLVSKYENIVGVTAAMPSGTGLDKLIEKYPNRFWDVGIAEQHAVTSMAAMAKEGFKPFIAIYSTFLQRAYDQVIHDCAIMNLNVVFAMDRAGIVGEDGETHQGAFDVSFLAPLPNLTLIAPRDELMMKNIMEYAYTHEGCLAFRYPRGSFILDEEFNPTKIELGKAQWLVKNQSNIAFLGYGQGVGKAWKVLRKLQDEGQNANLIDLIFAKPLDKLLLKELAKQSQIWFVFSENARIGGVASLLESFVQENDLKIKIVSFEYEDSFIEHGKTNEVEKALKLDIDGLVQRVKINWVDNIL

SEQ ID NO: 57128 - protein, 765 aa, Vigna radiata var. radiata
MGAAILPDLGTEILIPVCAVIGIAFALFQWLLVSKVKLSAVRDASPNAAAKNGYNDYLIEEEEGINDHNVVVKCAEIQNAISEGATSFLFTEYKYVGIFMVAFAILIFLFLGSVEGFSTSPQACSYDKTKTCKPALATAIFSTVSFLLGGVTSLVSGFLGMKIATYANARTTLEARKGVGKAFITAFRSGAVMGFLLAANGLLVLYIAINLFKIYYGDDWGGLFEAITGYGLGGSSMALFGRVGGGIYTKAADVGADLVGKVERNIPEDDPRNPAVIADNVGDNVGDIAGMGSDLFGSYAESSCAALVVASISSFGLNHELTAMLYPLIVSSVGILVCLLTTLFATDFFEIKAVKEIEPALKKQLVISTVLMTIGVAVVSFVALPTSFTIFNFGVQKDVKSWQLFLCVAVGLWAGLIIGFVTEYYTSNAYSPVQDVADSCRTGAATNVIFGLALGYKSVIIPIFAIAISIFVSFTFAAMYGIAVAALGMLSTIATGLAIDAYGPISDNAGGIAEMAGMSHRIRERTDALDAAGNTTAAIGKGFAIGSAALVSLALFGAFVSRASITTVDVLTPKVFIGLIVGAMLPYWFSAMTMKSVGSAALKMVEEVRRQFNTIPGLMEGTAKPDYATCVKISTDASIKEMIPPGALVMLTPLVVGILFGVETLSGVLAGSLVSGVQIAISASNTGAWDNAKKYIEAGASEHARSLGPKGSDCHKAAVIGDTIGDPLKDTSGPSLNILIKLMAVESLVFAPFFATHGGLLFKIF

SEQ ID NO: 57129 - protein, 379 aa, Triticum aestivum
MATAGKVIKCKAAVAWEAGKPLSMEEVEVAPPQAMEVRVKILYTALCHTDVYFWEAKGQTPVFPRILGHEAGGIVESVGEGVTELVPGDHVLPVFTGECKECAHCMSEESNLCDLLRINVDRGVMIGDGQSRFTIDGKPIFHFVGTSTFSEYTVIHVGCLAKIDPEAPLDKVCLLSCGISTGLGATLNVAKPKKGMTVAIFGLGAVGLAAMEGARMSGASRIIGVDLNPAKHEQAKKFGCTDFVNPKDHTKPVQEVIVEMTDGGVDRAVECTGNADAMISAFECVHDGWGVAVLVGVAHKEAVFKTHPMNFLNERTLRGTFFGNYKPRTDLPGVVDMYMRKELELDKFITHSVPFSQINTAFDLMLKGEGLRCVIRMDE

SEQ ID NO: 57130 - protein, 227 aa, Streptococcus pneumoniae TIGR4
MPKKILVLHTGGTISMQADASGAVVTSSDNPMNHVSNPLEGIQVHALDFFNLPSPHIKPKHMLVLYQKIKEEADNYDGVVITHGTDTLEETAYFLDTMEVPHMPIVLTGAMRSSNELGSDGVYNYLSALRVASDDRAADKGVLVVMNDEIHAAKYVTKTHTTNVSTFQTPTHGPLGLIMKQEILYFKTAEPRVRFDLDHIQGLVPIISAYAGMTDELIDMLDLEHLD

SEQ ID NO: 57131 - protein, 482 aa, Gibberella zeae PH-1
MPPPQLRGFGGGPAVAAPYHQGGFPSHGQPQGGMPGANQYMNANAQLGPFSANGNAFTSGLNSLNTQGFADTGFGSQSARMGFHGPAAALQQSQHGLHQNMLMEHPTIRSQPNKGRIREVWKHNLHEEMAVLRDLVDKYPYIAMDTEFPGVVSRPMGGFRGKSDYHYQCLRTNVDMLKVIQIGLTFFNEDGETPPARPTNDLKLGTAAQKAATNAPFPCSWQFNFKFSITDDMYNEKSIESLQQAGINFELLDRDGIDPHEFASLLIPSGLVCFDNVRWISFHGGYDFGYLTKLLICLPLPNDEVDFDHKMKLYFPTTYDVKHLMKHAIRLHNSGLLTPSDPSSAEILQKFEHKSGLENIAETLKIKRVGSAHQAGSDSLLTGKVFFSMRDKIFAGDIPDEHVGKVWGLGFPDSNSNIISMNQQNNNDGQTNGNAPSTPNTTSVGLATTPGPQGHNGILNTGPMTPGGGGGVFGSFAFGGNR

SEQ ID NO: 57132 - protein, 649 aa, Triticum aestivum
  misc_feature (637)..(637): Xaa can be any naturally occurring amino acid
MNSSMDEINLLRQHQRHQQHHLSVRGIGEEIDLEIDQCEDPTFSGAALEGVTSHHPQDPVVPADDHKSFLIPCSQPGAVDGQPQPTPPQAEERAGMLRLSAHTKKKKKVVKKWRDEWADTYKWAYVAVHDNTSRIFCTVCNARGRKHRRNPYGNEGSRNMQMSALEEHNNSLLHREALRLQSASKEKVQTPEKERLVYVKALSKTAASILESLFKKDPYEAEFIQSIQEVVHSIEPVLVKNSQYVQILERLLEPERCFIFRVPWVDDRGEAHVNRGFRVQFSQALGPCRGGLRFHPSMNLSVAKFLAFEQTLKNALSLYKLGGAAGGSDFDPKGKSEIEVMRFCQSFMDELYRYLGPDQDFPAEDVGVGPREMGFLFGQYRRLSGHFQGNFTGPKIFWSGSSFRTEATGYGLVFFARVVLADMNKELKGLRCAISGSGKIAMHVLEKLLSCEAIPVTVSDSEGYLFDGDGFDYVKYTLIRNIKAQQRSLKEYLKTFPRAKYINDAKPWGEQCDIAFPCASQNEIDQGEALSIISSGCRVLIECSNMPCTGQAVDILRKAKVHVAPAKATAAGGVAVGELELNPEFSLMQWSVEDFENKIQEAVKQTYDRSMKAAQEYGILKENPESLVHGANISAFXNIAQAMTDQGCV

SEQ ID NO: 57133 - protein, 587 aa, Gibberella zeae PH-1
MKARPVDQDTSWNRVNLAIPEQHSSSRVTTTFECGMFAARTMRSQSLSLSGLIWRHLQLLYVLFMQPTDFGVLDGHWKFIPETASCHTKFQYLQPSLKHIGILKLIQHHIIHHITDIAHSLSPSSAYSGISQSIRGPTYPCSERHGSVRLADDYQTNQRILTMGDHKLSQIKHDEHLLLDQPLLRLPSELLRKNFRTAHFAIEKDTTSLKTLLKDSATATVSGRASQEDVLRNVDAMITRMRGLKRKLTTSAAEEALLHTQAAARIAHLDELYKMDSVEDVKYETWSRKRLDRLLADYLLRHGYNETAKQLADQRGIKDLVDVYTFVAASRIRDSLMRESVVEALAWCTENKKELRKMDACQPQSRFNNVALIFCRQYIELVRSQSPSKVNEAIAHAKKHLIPYRTTFRREVEQACGLLAFPPGSMAYGELYKPSRWAELAELFTKTHNQLLALPAVPLLHIALSSGLSALKTPACHTNSANPPQSSNVSHTTSSTDVIETGASTLGHGVCPICSTELNELARNVPYAHHTQSHVEHDLRLLPNGSVYGRDRLETQARKNGLPADQIRDLRTGHIFPVESLKKVYIT

SEQ ID NO: 57134 - protein, 239 aa, Arabidopsis thaliana
  misc_feature (137)..(137): Xaa can be any naturally occurring amino acid
MSSQICRSASKAAKSLLSSAKNARFFSEGRAIGAAAAVSASGKIPLYASNFARSSGSGVASKSWITGLLALPAAAYMIQDQEVLAAEMERTFIAIKPDGVQRGLISEIISRFERKGFKLVGIKVIVPSKDFAQKHYXHDLKERPFFNGLCDFLSSGPVIAMVWEGDGVIRYGRKLIGATDPQKSEPGTIRGDLAVTVGRNIIHGSDGPETAKDEISLWFKPQELVSYTSNSEKWLYGDN

SEQ ID NO: 57135 - protein, 401 aa, Rubrobacter xylanophilus DSM 9941
MVYPSGRHFLQIPGPTNIPDRVLRALAAPTIDHRGPGFSRLAREVLEGLGRVFGCSGPVVVFPSSGTGAWEAALVNTLSPGDRVLMFETGHFAALWCGVARRLGLEVEFVPGDWRHGVDPGEVRRRLAADWRGETKAVAVVHNETSTGCTSRIAEIREAMDEAGHPALFLVDVISSLGSIEYRHDEWGVDVAVGCSQKGLLLPPGLGINALSERALEASRGARLPRSYWDWRPMLESNEEGYFPYTPPTNLLFGLREALAMLFEEGLENVLARHRRHAEATRRAVRAWGLEVLCLEPAEYSASLTAVLMPEGHDADLLRRLVLEGFNMSLGAGLGKLAGRVFRIGHLGDLNDLMLVGALGGVEMGLSVAGVPHSKGGVMAAMEYLVETAPVAGRRAVAAGG

SEQ ID NO: 57136 - protein, 394 aa, Oryza sativa Indica Group
MLIGIGVVKEGVGLIFCVCTKAVSNSDGTPGTSSSPHVVCFGELLIDFVPTVNGVSLAEASAFKKAPGGAPANVAVGIARLGGSSAFIGKPQFELGRNIEKVFQPSSFSFKIKRLFFHYTLFNIQHMQVGDDEFGYMLADILKENNVNNQGLLFDAHARTALAFVTLRNDGEREFMFYRNPSADMLLEEKELDLDLIRKAKIFHHGSISLITEPCKTAHIAAAKAAKDAGVLISYDPNLRLPLWSSADDARDGILSIWETADVIKISEEEVSFLTKGEDPYDDSVIKKLMHPNLKLLLVTEGPEGCRYYSKEFNGRVGGLKVNAVDTTGAGDAFVAGILSQLSVDFSLLQDEGRLKEALKFANVCGALTVTERGAIPALPTRQQVVDALTKVVA

SEQ ID NO: 57137 - protein, 579 aa, Oryza sativa Indica Group
MVPLYVAMILAYGSVKWWRIFTPDQCSGINRFVALFAVPLLSFHFISTNNPYTMNLRFIAADTLQKLIVLALLTLWSHLSRRGSLEWTITLFSLSTLPNTLVMGIPLLKGMYGEFSGSLMVQIVVLQCIIWYTLMLFMFEYRGARILITEQFPDTAGAIASIVVDADVVSLDGRRDMIETEAEVKEDGKIHVTVRRSNASRSDVYSRRSMGFSSTTPRPSNLTNAEIYSLQSSRNPTPRGSSFNHTDFYSMVGRSSNFAAGDAFGVRTGATPRPSNYEEDAAAPNKAGSKYGQYPAPNPAMAAPPKPKKAANGQAKGEDGKDLHMFVWSSSASPVSDVFGNGAEYNDAAAVKEVRMAVASPRKADGVERDDFSFGNRGVAERDAEAGDEKSVAAAVSGEHGKPGLTPAPTAMPPTSVMTRLILIMVWRKLIRNPNTYSSLIGLIWSLVCFRWNFEMPAIILKSISILSDAGLGMAMFSLGLFMALQPRIIACGNKVATFAMAVRFLTGPAVMAAASIAVGLRGTLLHVAIVQAALPQGIVPFVFAKEYSVHPDILSTAVIFGMLIALPITLVYYILLGL

SEQ ID NO: 57138 - protein, 591 aa, Thermoplasma acidophilum DSM 1728
MMNEDTNFGNAKLRRSLGMWDLFFLSITGMIGSGWLFAALDAADYVGPASIFTWIIAALFFFVIALTYAELSGIIPYSGSIVRFNQYSHGSMSNFLIGWAYLIGAVSTVTVEAISVVTYTSTYMPQFYNSSAGVLTPLGILVSIVLIGFFFFIQFIGVNVYGKLNTIMTAWKLAIPVITVVLIMSLSFNPRNFYVAHGFLPYGSAAIFAALIPSGVVYAFEGFRQGIEYAGEARNPQRDVPISLIAAMLATIGIYVALEIAFIGSIKWGAIGISPGDWAALSTSSWASGPFYYATKYSGVLILSVFAVVILIDAFISPFASLGVYEGTSARSFYGMARLNVIPEFFGSIHPRFRTPWVGLIFTLILSSLFLAPFPSWYLIVGINASFTVYAYLSAGITNTVIRKNAPDIHRPFRLPAASVLSPIAFVVASMLVYWSGFSIIDFLILVVYAGLPLILLSKFREKLNLSLRASIIISAVYWILIAVVGFSGYTGRLPFVYYWPLISAIPSATFAYAYLKSRSIEIVSSVWIIVYNILIGAVSYYGSLGTGVIAYPYDYAIFAVISLGIYFLAVRTGYSTEELKNLVTYGPVAE

SEQ ID NO: 57139 - protein, 184 aa, Prochlorococcus marinus str. AS9601
MDLSSIPPSPMKGIVNIVVEIPAGSRNKYEYCSDAGIMALDRVLHSSVRYPFDYGFIPNTLADDGAPLDAMVIMDEPTFAGCLIKARPIGVLDMYDCGAYDGKLLCVPMANPRQANIVSINQIAPNQLEDVAEFFRTSKGLDGRTVQIDGWRDFDVVENLLKSCLPSKKKKFKVLKKSNISKLN

SEQ ID NO: 57140 - protein, 397 aa, Arthrobacter nicotinovorans
MSPTTDRIAVVGGSISGLTAALMLRDAGVDVDVYERSPQPLSGFGTGIVVQPELVHYLLEQGVELDSISVPSSSMEYVDALTGERVGSVPADWRFTSYDSIYGGLYELFGPERYHTSKCLVGLSQDSETVQMRFSDGTKAEANWVIGADGGASVVRKRLLGIEPTYAGYVTWRGVLQPGEVADDVWNYFNDKFTYGLLDDGHLIAYPIPGRENAESPRLNFQWYWNVAEGPDLDELMTDVRGIRLPTSVHNNSLNPHNLRQFHSKGESLFKPFRDLVLNASSPFVTVVADATVDRMVHGRVLLIGDAAVTPRPHAAAGGAKACDDARTLAEVFTKNHDLRGSLQSWETRQLQQGHAYLNKVKKMASRLQHGGSFEPGNPAFAFGLPKVDEPSVVTNS

SEQ ID NO: 57141 - protein, 263 aa, Glycine max
MAELPAPEAQLNGGAPATTANSSEPIGSKRQRRPSVRLGDIGDQPYDSHPRRAAAKTWRLAFDHPRHSSSAAAAARPSKIRPLTNLTPAAAVAELGETLESDGNVDSVLIGSWKVKDSKKRGGGAKRIRSNWISRIDGGEEDDKDVDVGVVDGYHHRDFSAEHSQSPLREEQSPIMENLGVDEEREVLHYHERNGNSGRGDGVRVWLNGLGLGRYAPVFEIHEVDDEVLPLLTLEDLKDMGISAVGSRRKMFCAIQKLGKGFS

SEQ ID NO: 57142 - protein, 442 aa, Prochlorococcus marinus str. AS9601
MTIRLVLVRHGLSSFNAKGLIQGRTDDSLLTDEGYKQARKAGKALSKINFDKIYSSPLVRAAETAKTIKKTFKKEQNIVFDDNLLEVDLGEWSGLKIDEIKKKFPEIYPIWKNDPENLILERKDYKTYKPIQELFLQATNFVENILKIYLDKDDVNILVVGHNAILRCLILFLIGKPKQGFRKIRLENASFSILNISRKDNSYKTQIECLNQTSHLNKNIPNQIGDSRIFLIRHGETNWNKEGRFQGQIDIPLNENGKNQARKTFEYLRNISFNKAFSSSMHRPFETAQIILQNRKDLKIERTDSLIEISHGLWEGKLEAEIREEWPALLKNWHDKPEEVIMPEGESIKDVSQRSVEAFDKICLSQKDNDLSLLVAHDAVNKTLICNILGINYSNIWMIKQGNGGITIIDLFNDPNKPPVISALNITTHLGGIIDSTASGAL

SEQ ID NO: 57143 - protein, 276 aa, Vibrio vulnificus YJ016
MLNMIKKCLFPAAGYGTRFLPATKSMPKEMMPVVNKPLIEYGVEEAIEAGMNGMCIVTGRGKHALMDHFDKNYELEHQISGTSKEALLGDIRQLIDSASYTFIRQREMKGLGHAILTGKELVGDEPFAVVLADDLCVNQDEGVLAQMVALFNQFRCSIVAVQEVPEDETHKYGVISGEMIKDGICRVDNMVEKPEPGTAPSNLAIIGRYILTPDIFELIEQTEPGKGGEIQITDALLKQAKSGCVLAYKFKGQRFDCGSVEGYIEATNYCFENLYK

SEQ ID NO: 57144 - protein, 238 aa, Methanococcoides burtonii DSM 6242
MTNENYTDNIKKAIKAAQNGEMFFIYDSDSREGETDFVITASSVTPDDVRWMRRDGGGLICVAIDSENSKKLGLPFISDVLRDEAKANPALGNTVEKGGDLAYDTRSSFSIWVNHRKTRTGIPDNDRALTINELSNITEKCMKGEDVIFGSEFRTPGHVALLRAADHLVHDRKGQTELSIAIAKMADVTPAMVVCEMLDDSNGRALSKKDAKEYAELHGLVFLEGQEIVDAYEQWEQA

SEQ ID NO: 57145 - protein, 582 aa, Zea mays
IGYLEAGRELCSSAASVPCRTQRAPTHALVINAPRSALVLHTISTSVEATSSPFRHAAMGNRASRHHRHATEQQPETPTLPKPQIQPPPPPTQTQQYQQAPPPPKPKPAADARAVGRVLGRPMEDVKATYTFGRELGRGQFGVTYLVTHRETGQRFACKSIATRKLVHRDDIEDVRREVQIMHHLTGHRNIVELRGAYEDRRSVNLAMELCEGGELFDRIIARGHYTERAAAALCREIVAVVHSCHSMGVFHRDLKPENFLFLNNKEDSPLKATDFGLSVFFKPGDTFKDLVGSAYYVAPEVLKRHYGAEADIWSAGVILYILLSGVPPFWAENEDGIFDAVLHSHIDFSSDPWPSISNGAKDLVKKMLRQDPKERLTAAEILNHPWIREDGEAPDKPLDITVISRMKQFRAMNKLKKVALKVVAENLSDEEIMGLKEMFRSLDTDNSGTITLEELRSGLPKLGTKISESEIKQLMEAADVDGNGTIDYAEFISATMHLNRLEKEDRILKAFEYFDKDHSGYITVDELEEALKKYDMGDDKTIKEIIAEVDTDHDGRINYQEFVAMMRNNTPEIVPNRRRMF

SEQ ID NO: 57146 - protein, 182 aa, Brassica napus
  misc_feature (126)..(126): Xaa can be any naturally occurring amino acid
MASSMLSSAAVVTSPAQATMVAPFTGLKSSSAFPVTRKANNDITSIVSNGGRVSCMKVWPPVGKKKFETLSYLPDLTEVELGKEVDYLLRNKWIPCVEFELEHGFVYREHGSTPGYYDGRYWTMWXKLPLFGCTDSAQVLKEVQECKTEYPNAFIRIIGFDNNRQVQCISFIAYKPPSFTGA

SEQ ID NO: 57147 - protein, 511 aa, Nicotiana tabacum
MDGSTVQGGSSVESFLRNYKLGKTLGIGSFGKVKIAEHTLTGHKVAVKILNRRKIKNMEMEEKVRREIKILRLFMHPHIIRLYEVVETPSDIYVVMEYVKSGELFDYIVEKGRLQEDEARKFFQQIISGVEYCHRNMVVHRDLKPENLLLDSKWNVKIADFGLSNIMRDGHFLKTSCGSPNYAAPEVISGKLYAGPEVDVWSCGVILYALLCGTLPFDDENIPNLFKKIKGGMISLPSHLSAGARDLIPRMLIVDPMKRMTIPEIRMHPWFQAHLPRYLAVPPPDTMQQAKKIDEDILQEVVKRGFDRNSLVASLCNRVQNEGTVAYYLLLENQFRASSGYMGAEFQETMEYGYHQINSSEVLLPCWQHLPGIMDFQQVGARQFPVERKWALGLQSRAHPREIMTEVLKALQGLNVRWKKIGPYNMKCQWVPGVPGHHEGMSNNSIHIQFFGDDSTVIENGGVTIPNAVKFEVQLYKTREEKYLLDLQRVQGPQFLFLDLCAAFLAQLRVL

SEQ ID NO: 57148 - protein, 547 aa, Burkholderia pseudomallei K96243
MFLSPSAAMHDKILILDFGSQVTQLIARRVREAHVYCEIHPNDVSDDFVREFAPKGVILSGSHASTYEDHQLRAPQAVWDLGVPVLGICYGMQTMAVQLGGKVEWSDHREFGYAEVRAHGRTRLLDGIQDFATPEGHGMLKVWMSHGDKVGEMPPGFALMASTPSCPIAGMADEARGYYAVQFHPEVTHTVQGRKLLERFVLDIAGAKPDWIMRDHIEEAVARIREQVGDEEVILGLSGGVDSSVAAALIHRAIGDQLTCVFVDHGLLRLNEGKMVLDMFEGRLHAKVVHVDASEQFLGHLAGVADPEHKRKIIGREFVEVFQAEAKKLTNAKWLAQGTIYPDVIESGGAKTKKATTIKSHHNVGGLPETLGLKLLEPLRDLFKDEVRELGVALGLPAEMVYRHPFPGPGLGVRILGEVKRDYAELLRRADAIFIEELCGTLATEQDAAAGLCEPSQVGKSWYDLTSQAFAVFLPVKSVGVMGDGRTYDYVAALRAVQTTDFMTAHWAHLPYALLGRASNRIINEVRGINRVVYDVSGKPPATIEWE

SEQ ID NO: 57149 - protein, 135 aa, Hyphomonas neptunium ATCC 15444
MAKPKIQRSEREWREMLTDQEYAVGFQEGTERAFTPGNYESEKRKGVYHCKGCETPLWSSEHKFDSGTGWPSYWQPIGEGVVATKTDFKMIYPRTECHCANCGMHMGHVFKDGPPPTGQRWCINGIVLDFRPEGE

SEQ ID NO: 57150 - protein, 235 aa, Campylobacter coli RM2228
MQKQDKIIKMFNEIAPTYDKANRILSFGVDVSWRKFACKRVLKLYQKDNLNIVDVACGTGDMIEIWQESAKKLNKNIAHIKGIDPSEGMLNIAKQKFPNIEFIEAGAQELPLQSESVDIVSISYGIRNVVEREKALREFSRVLKQDGIFVVLEFTKREKGGFVASCRDFYLKNILPSLGGMISKNKSAYEYLPNSIEGFLSKEEFIAELKQVGFEMLEFKSFSFGVSSMFIAKKV

SEQ ID NO: 57151 - protein, 268 aa, Zea mays
MARRRLLALASRLYGRPQATQPWRRPPPRFLSSAASGTLDHLKSPPFARPAARNPASYPWDRFGGGQKRTMFIQTQSTPNPQSLMFYPGKPVMEIGSSDFPNARTAMTSPLAKSLFAIDGVTRVFFGSDFVTVTKSEETSWDCLKPEVFAAIMDFYSSGQPLFLDSNAAASMDTAIHEDDSEIVAMIKELLETRIRPAVQDDGGDIEYRGFDPETGTVKLKMQGACSGCPSSSVTLKSGIENMLMHYVPEVKGVEQEFDGDEEAEVAG

SEQ ID NO: 57152 - protein, 466 aa, Zea mays
  misc_feature (326)..(326): Xaa can be any naturally occurring amino acid
MHAVQASAPLPPPQDLLSPETMYRAAGSHLRSLKHHGASMLASTSVAKQSSGGLFSWLLGGKSSELPPLDVPLPGISIPSPLPDFVEPSKTKVTTLPNGVKIASETSSSPAASVGLYIDCGSIYETPASSGVSHLLERMAFKSTVNRTHLRLVREVEAIGGNVSASASREQMSYTYDALKSYTPEMVEVLIDSVRNPAFLDWEVKEQLQNIKSEIADASANPQGLLLEALHSVGYSGALAKPLMASESAVNRLDVSSLEEFVAEHYTAPRMVLAASGVDHDALISVVEPLLSDLPCVKRPEEPKSVYVGGDYRCQADSPNTHIALXAFEVPGGWNQEKTAMVVTVLQSPDFSSKAVDLAAGELLEIATPGKVTQEQLDRAKEATKSAVLMNLESRSIASEDIGRQVLTYGERKPIEYFLKTVEEITLNDILSTAKEMMSTPLTMASWGDVIHVPSYESVSRKFHSK

SEQ ID NO: 57153 - protein, 789 aa, Oryza sativa Japonica Group
MGSACEAGTDEPSRDDVKGTGNGILENGHSHKPEEEEWRNGMGEDLPNGHSTPPEPQQTDEQKEHQVQIVRWERFLPVKTLRVLLVENDDSTRQVVSALLRKCCYEVIPAENGLHAWQCLEDLQNHIDLVLTEVVMPRLSGIGLLSKITSHKICKDIPVIMMSSNDSMGTVFKCLSKGAVDFLVKPIRKNELKNLWQHVWRRCHSSSGSGSESGIRTQKCTKPKVDDEYENNSGSNNDNEDDDDNDEDDDDLSVGHNARDGSDNGSGTQFSLNVGQLCQCILMPSACFKTQSSWTKRAVEIDSPQQMSPDQPSDLPDSTCAQVIHPTSEICSNRWLPTANKRSGKKHKENNDDSMGKYLEIGAPRNSSMEYQSSPREMSVNPTEKQHETLMPQSKTTRETDSRNTQNEPTTQTVDLISSIARSTDDKQVVRINNAPDCSSKVPDGNDKNRDSLIDMTSEELGLKRLKTTGSATEIHDERNILKRSDLSAFTRYHTTVASNQGGAGFGGSCSPQDNSSEALKTDSNCKVKSNSDAAEIKQGSNGSSNNNDMGSSTKNAITKPSSNRGKVISPSAVKATQHTSAFHPVQRQTSPANVVGKDKVDEGIANGVNVGHPVDVQNSFMQHHHHVHYYVHVMTQQQQQPSIERGSSDAQCGSSNVFDPPIEGHAANYSVNGSFSGGHNGNNGQRGPSTAPNVGRPNMETVNGIVDENGAGGGNGSGSGSGNDLYQNGVCYREAALNKFRQKRKVRNFGKKVRYQSRKRLAEQRPRIRGQFVRQSGQEDQAGQDEDR

SEQ ID NO: 57154 - protein, 579 aa, Cucurbita maxima
MLQMGKAREPNFLILFFFGLILAFGISSEGSQIRHYKWEVEYMFWAPDCNENIVMGINGQFPGPTIRANAGDTVVVELINKLHTEGVVIHWHGILQRGTPWADGTASISQCAINPGETFFYNFTVDNPGTFFYHGHLGMQRSAGLYGSLIVDPPQGKKEPFHYDGEINLLLSDWWHQSIHKQEVGLSSKPIRWIGEPQTILLNGRGQFDCSIAAKYDSNLEPCKLKGSEPCAPYIFHVMPKKTYRIRIASTTALAALNFAIGNHPLLVVEADGNYVQPFYTSDIDIYSGESYSVLITTDQNPSENYWVSVGTRGRHPNTPPGLTLLNYLPNSVSKLPTSPPPETPAWDDFDRSKNFTYRITAAMGSPKPPVKSNRRIFLLNTQNVINGYVKWAINDVSLALPPTPYLGAMKFNLLHAFDQNPPPEVFPEDYDIDTPPTNEKTKIGNGVYQFKIGEIVDVILQNANMMKENLSEIHPWHLHGHDFWVLGYGDGKFTAEEESSLNLKNPPLRNTVVIFPYGWTAIRFVADNPGVWAFHCHIEPHLHMGMGVVFAEGVEKVGRIPTKALACGGTAKSLINNP

SEQ ID NO: 57155 - protein, 174 aa, Triticum aestivum
DLPLSSLLFTTQTQHSSKEADGRVMGSNNPGGAGGGMAPGMGAGSSDGRHDDEAVLTEFLSSLMDYNPMIPDELVEHYLGRSGFHCPDLRLTRLVAVATQKFISDIASDSLQHCKARVAAPIKDNKSKQLKDRRLVLTMDDLSKALREHGVNLKHPEYFADSPSAGMGPSTREE

SEQ ID NO: 57156 - protein, 379 aa, Staphylococcus aureus subsp. aureus Mu50
MAKRDYYEVLGISKDASKDEIKKAYRKLSKKYHPDINKEEGADEKFKEISEAYEVLSDDNKRASYDQFGHDGPQGFGGQGFNGSDFGGFSGFGGGGFEDIFSSFFGGGRQRDPNAPQKGDDLQYTMTLTFEEAVFGTTKEISIRKDVTCETCHGDGAKPGTSKKTCSYCNGAGHVAVEQNTILGRVRTEQVCPKCNGSGQEFEEACPTCHGKGTENKTVKLEVKVPEGVDNEQQIRLAGEGSPGVNGGPAGDLYVVFRVKPSETFKRDGDDIYYKLNVSFPQAALGDEIKIPTLNNEVMLTIPAGTQTGKQFRLKEKGIKNVHGYGYGDLYVDIKVVTPTKLTDRQKELMKEFAQLNGEEINEQPSNFKDRAKRFFKGE

SEQ ID NO: 57157 - protein, 134 aa, Brassica napus
  misc_feature (87)..(87): Xaa can be any naturally occurring amino acid
MEDPDNKKLRSTPRNADDVISIVMPYVTDPKDRESASLVNRTWLRADSETRDHVTMALCYASAPDRLARRFPNLRSLKLKGRPGSGXPRAAMFNLIPDNWGGFVTPWVNEIALSLRRIRSVHFRRMIVRDLDLD

SEQ ID NO: 57158 - protein, 215 aa, Acinetobacter baumannii
MRCNVMKILIIDNYDSFTFNLYQLLGEILISLKSRKEISDFEIVVKRNNEISLDEIRKLEFDRIIISPGPGSPDDERYFGISKQVILQLGKEIPILGVCLGMQGIAYCFGGKVIRAKLPMHGKISTINHSDSGVFSGIPQDVEVMRYHSLIVDSSTLPECFIVTARVNSAYSDSEEEIMGIKHQTYPIEGVQFHPESFASEAGKTLLQNFVHSKL

SEQ ID NO: 57159 - protein, 307 aa, Brassica napus
FCFDFTGRWVVSNWIGVHIRVPKVAPAPHTVSAVGDGGIDEAAEEASAQKKHVSLQRQAAVTVEAAEDYTRRFESSVNELSSNDQVGEELAQSGVNVMCRMCFLGESQGSERARRMLSCKICGKKYHKNCVKSWAQHRDLFHWSSWSCPSCRVCEVCRRTGDPNKFVFCKRCDAAYHCYCQHPPHKNVSSGPYLCPKHTRCHSCDSTVPGNGLSVRWFLSYTCCDACGRLFVKGNYCPLCLKVYRDSESTPMVCCDLCQRWVHCHCDGISDEKYLQFQADGNLQYKCATCRGEGYQVKDLQDAVQEL

SEQ ID NO: 57160 - protein, 262 aa, Oryza sativa
MENGGGDVPENANDHCPGTQSEAAGKADACTGCPNQQICATAPKGPDPGVMSIGFMLPNPDDAVIWRGPRKNGLIKQFLKDVDWGEIDYLVVDAPPGTSDEHISIVQYLQIAGIDGAIIVTTPQQVSLIDVKKEINFCKKVGVPVLGVVENMSGLRQAFSDMKFVKPSEAGETDATEWALNYIKEKAPELLSVVACSEVFDSSKGGAEKMCQEMEVPFLGKVPMDPQLCKAAEEGRSCFTDQKCSASAPALKSIIKKLVKTK

SEQ ID NO: 57161 - protein, 229 aa, Thermoplasma acidophilum DSM 1728
MAMMAKHQAVKKIFDQIATKYDLIDTIISLGLDQHWRRVLVSSLGLREGMRCLDCGAGSGKVTELIYFRCGGCDVTALDITDSMFNPELKKYVKFVVSPAESLPFPDASFDRVSSAFLTRNLADIDRYFAEVYRVLRPGGVFVNMDIYNPTRPVISEFFSLYFYRFVPFFGNRATGSKNYTYLANTVKYFHRPSVISQKLADRGFSVEATDLFFGAVYLHRSVKPEGRG

SEQ ID NO: 57162 - protein, 363 aa, Oryza sativa Indica Group
MASSSPVPPPRFFPGSGDVGRRSNYEIEYVAQIRSCNPLMFSVTLIVYDITDMESFNNVKEWMSEIDNYANDSVCKLLVGNKCDLAESRVVETAVAQAYADEIGIPFLETSAKDSINVEEAFLAIKSGSQAALERKASNLVQMKGNTIIALCLCGWSWEMFYCLLHIEVEMFSFGGWGGKGYLDEQFCQVEDLQDEANPNFAEEVVSLFFKDSARVMLNFEQAIEKHPKDFARWDAHMQQLKGSCSRKTLLGEGEPHIASIGASRVKNECTSFRNFCGEENAEGLAATAAVAVVNGCRLQLVSTAAAAVAVATRASNRPDHYGKTNKLHEILPESEEGACRPQAEVRVLLPAVATSWSCWDRD

SEQ ID NO: 57163 - protein, 493 aa, Panus rudis
AIGPVTDLHIVNDNIAPDGFTRAAVLAGGTFPGPLITGNKGDNFRIDVIDDLTEESMLKSTSIHWHGFFQKGTNWADGPAFVNQCPITTGHSFLYNFNVPDQAGTFWYHSHLSTQYCDGLRGAFVVYDPNDPHADLYDVDDDSTVITLADWYHTLARQITGVPTPDATLINGLGRSASGPQDSELAVITVEQNKRYRLRLVSISCDPNYIFSIDSHNFTIIEVDGVNSKPLTVDSAQIFAAQRYSVVLNANQPVGNYRIRARPNNGDTTFTNGRNSAILRYKGATVEEPATITPPVSQTPLIEANLKPLASMPVPGTHTPGVADVVKPLQFGFNPPAFTINGASFVPPTVPVLLQILSGAKTAQEIVPSGSIIELPLNSVVELSFPNPTGAPGGPHPFHLHGHTFFVVRSAGQTTYNYDDPIARDVVSTGTAGDNVTIRFATDNAGPWFLHCHIDWHLDAGFAVVMAEGINQTQAANPTPDAWNQLCPTYDAL

SEQ ID NO: 57164 - protein, 391 aa, Arabidopsis thaliana; identical to SEQ ID NO: 1115

SEQ ID NO: 57165 - protein, 97 aa, Hyoscyamus niger
ATYKVKLVTPDGPVEFNCPDDVYILDQAEEEGHELPYSCRAGSCSSCAGKVSAGTVDQSDGNFLDDDQIADGFVLTCVAYPQSDVTIETHKEEDLTG

SEQ ID NO: 57166 - protein, 493 aa, Thermoplasma acidophilum DSM 1728
MDTKLYIDGQWVNSSSGKTVDKYSPVTGQVIGRFEAATRDDVDRAIDAAEDAFWAWNDLGSVERSKIIYRAKELIEKNRAELENIIMEENGKPVKEAKEEVDGVIDQIQYYAEWARKLNGEVVEGTSSHRKIFQYKVPYGIVVALTPWNFPAGMVARKLAPALLTGNTVVLKPSSDTPGSAEWIVRKFVEAGVPKGVLNFITGRGSEIGDYIVEHKKVNLITMTGSTATGQRIMQKASANMAKLILELGGKAPFMVWKDADMDNALKTLLWAKYWNAGQSCIAAERLYVHEDIYDTFMSRFVELSRKLALGDPKNADMGPLINKGALQATSEIVEEAKESGAKILFGGSQPSLSGPYRNGYFFLPTIIGNADQKSKIFQEEIFAPVIGARKISSVEEMYDLANDSKYGLASYLFTKDPNIIFEASERIRFGELYVNMPGPEASQGYHTGFRMTGQAGEGSKYGISEYLKLKNIYVDYSGKPLHINTVRDDLFQ

SEQ ID NO: 57167 - protein, 97 aa, Hyoscyamus niger
ATYKVKLVTPDGPVEFDCPDDVYILDQAEEEGHELPYSCRAGSCSSCAGKVKAGTVDQSDGNFLDDDQMADGFVLTCVAYPQSDVTIETHKEEDLTG

SEQ ID NO: 57168 - protein, 517 aa, Mycobacterium smegmatis str. MC2 155
MTNKTTAELLAELREKLELAKEPGGEKAVAKREKKGIPSARARINALLDPGSFIEIGALAKTPGDPNALYGDGVVTGRGTIDGRPVGVFSHDQTVFQGSVGEMFGRKVARLMEWVAMVGCPIIGINDSAGARIQDAVTSLAWYAELGRRHEMLRGLVPEISLIFGKCAGGAVYSPIQTDLLVAVRDQGYMFITGPDVIKDVTGEDVTFDELGGADEQAKRGNIHKVVNSEAEAYQYVRDYLSFLPSNHFDNPPIVNPGMEPEITPHDLELDSIVPDADNMAYDMHEILLRIFDDGDVFEIAEQRGPAMITAFARVDGHPVGVIANQPMVLSGAIDNEASDKAASFIRFCDSYNLPLVFVVDTPGAMPGVAEEKGGIIKRGGRFFNAIVEADVPKVTVIIRKAYGGGYAVMGSKQLSADLNFAWPTARIAVIGAEGAAQLLVKRFPDPNAPEVQKIRDDFIEGYNLNMATPWIAAERGYIDAVIQPHETRLLLRKSLRLLRDKQNGPKVQRKHGLLPL

SEQ ID NO: 57169 - protein, 379 aa, Methanococcoides burtonii DSM 6242
MEENGKTKEEILLFLKKAKSADASYERVLSSMCTYPHEIAVLAHTQFIESNMGDPGLFPGTFNLEKQVLAMFGKMLHHKNSPEKAGYLTTGGTESNIQAIRSMHNFRHDISRPNIVMPESAHFSFDKVANLSGIEIRKASLDKLLKVDLDSVRSLIDKNTIGLVGIAGTTEFGQLDPINELSKIAIEKGIFLHIDAAFGGFVIPFMDIDYTYDFRLEGVTSMTIDPHKMALSTIPSGGLLFKEPEYFECLEIHTPYLSVNKQYSLTGTRSGAGVASTYAVMKHLGRKGYKKVVSDCMSVTKKLVDGAEKLGINTVIDPVLNIVALDVPEADLVRKKLLDEYGWHVSITRNPRALRIVIMPHIKNETIELFLKDLAKVIK

SEQ ID NO: 57170 - protein, 643 aa, Prochlorococcus marinus subsp. marinus str. CCMP1375
MTLISLINASKDFGVRTLFENLNLHINNKERLGLIGPNGAGKSTLLKIIAGLEPLMSGERKCSSLTKVALVGQEIHLNKHKSVLQEVLKGCGEKRELLIQFNEVTKQLASSPHDQILLNKLGRVSERMDVSKAWNLEQQCQEVLRRLGIRDVHKSINELSGGYRKRVGLASALVSNPDVLLLDEPTNHLDASAVEWLQDWLQNYKGALVLVTHDRYVLDKVTSQLIEIERGKSYKYIGNYSKYLNQKVQQKELEESSNKKFQSILKKELKWLKQGPKARSTKQKARLQRIADMQSNQFTETQTSLKMNSLSRRIGKKTINAEKLSITINGAILLEDFSYSFSSEDRVGIIGANGSGKSTFLDLLAGKREPCNGTIEVGETIQIGYLDQHTNELTAGKGLERKVIEFVEEAAQRIDIGGKQYTASQLLEQFLFSPSEQHSPIAKLSGGEKRRLTLCKMLIKAPNLLLLDEPTNDLDIKTLAVLEDFIEDFKGCVVVVSHDRYFLDRTVDRIFNFENNQLNRYEGNYSSFLEQRKIAKGNLEEPYKDKRIATKTKHSEKSNQLLKEKKFSVGKQKRCLSFKEKEELKELERELPLLEKEKSLLEKCIQENLNGSNIAIQSQKLADIIETIQNSEERWLYLSDIDI

SEQ ID NO: 57171 - protein, 278 aa, Arabidopsis thaliana
MAELQPVDGQQTNGGVVTIPASTSAEATAIAAAGSKRLRRPSVRLGEIGGDQYQQQHHHHAAAAAYDSQGRKSKWTPTTTSGNRKDTSKSSRTRTLTNLSSGYENIGTLDDEREGNVDSFGVGSWRVKKRVGSSAAAKRVRSNWVSKVGDGDEKISGGEELEGGFRDFSREDSESPIKEESLDRDGGGFYGRRRYESNNSSGNREFESNMDGGGKEGVKIWLQELGLGRYWPMFEIHEVDEEVLPLLTLEDLKDMGINAVGSRRKMFCAIQKLGREFS

SEQ ID NO: 57172 - protein, 455 aa, Gibberella zeae PH-1
MDDLHLAPEPHLMHRSLLTRPEAVSSASGVYLNLSSGRKILDGCAGAAVAIIGHGSTEVQDAVVAQASQVSYVHTLTYTTSSAEELADHLLENEPFGLTRAYLVCSGSEAMDSAMKLARQYHVENGQPERTRFVSRRQAYHGNTVGAMSVGSHLARRAPYEGAILLDNVSHVSAAYEYRTKKDGETEEEYSKRLVDELEAEFLSVGPEKIMAFIAETVGGATAGCITPPAGYFSGVSKVCKKYGILLILDEIMCGVGRCGTFFAFEQDGDVQPDMVTIGKGLGGGYMPIAATLVHKGIIETLKKGTASFNHGHTYQAHPVSCAAALAIQKIIRRDNLVSRCATLGERLHKSLVETFKDAEFVGNIRGRGLFWGIEFVQDKKTKMPFDSKIRFGVKVQERAFELGLAVYPGMGTADGLVGDHVIVSPPLTITEEEMDVLVGLLKRAYDDVASKYGV

SEQ ID NO: 57173 - protein, 398 aa, Ustilago maydis 521
MIATHTHTPHAPTNPLLASAFIASAPFQLIRGIGIKQSHPNLTSVLLWLVFDTFASTFVDTVQLKRMFRKHDKDTSKGSKKDSKSKPSMTDAAKGGRPGNLDASQQEALDTFRNTIQHKGIFNPERHDDACLCRFLRARKWDLAAAEAMFTEAEKWRKDFKVEELYHSFEYPEKEDVDKYYPQYYHKTDNEGRPIYIEQLGKLDLKALYQVTTPERQIQKLVVEYEKFQRERLPVCSAHKGGLVETSCTIMDLKNVGVSQFWKVSGYVQQASNIGQHYYPETMGKFYIINSPYIFTTVWSVIKGWLDPVTVEKIKILGHKYQDELLQQIPAENLPVDLGGKCQCSGGCSLSDAGPWNTDEGRKIIENVRAEEKQKREQHERDGPAAPPAVAENGSTAA

SEQ ID NO: 57174 - protein, 445 aa, Salmonella enterica subsp. enterica serovar Typhi str. CT18
MSSDADAHKVGLIPVTLMVSGNIMGSGVFLLPANLAATGGIAIYGWLVTIIGALALSMVYAKMSSLDPSPGGSYAYARRCFGPFLGYQTNVLYWLACWIGNIAMVVIGVGYLSYFFPILKDPLVLTLTCVAVLWIFVLLNIVGPKMITRVQAVATVLALVPIVGIAVFGWFWFKGETYMAAWNVSGMNTFGAIQSTLNVTLWSFIGVESASVAAGVVKNPKRNVPIATIGGVLIAAVCYVLSTTAIMGMIPNAALRVSASPFGDAARMALGDTAGAIVSFCAAAGCLGSLGGWTLLAGQTAKAAADDGLFPPIFARVNKAGTPVAGLLIVGVLMTIFQFSSMSPNAAKEFGLVSSVSVIFTLVPYLYTCAALLLLGHGHFGKARPLYLLITFVAFVYCIWAVIGSGAKEVMWSFVTLMVITALYALNYNRIHKNPYPLDAPVKQD

SEQ ID NO: 57175 - protein, 496 aa, Psychrobacter arcticus 273-4
MSTAAKNTQANTYTDFHLQYIAGEWKKGDDDSINTNTNPFNGETLVEIQQATDKQLDEAYQAASDAQKQWAKQTPNERAAILYKVVSIFDQRQDEIVDWLIKESGSTRIKAMVEFSSARAITLEAASFPNRVHGEIRPSNTPGKENFIYREPMGVIAVISPWNFPLHLTQRSIAPALALGNAVVLKPASDTPITGGLLLAKIFEEAGLPKGLLNVVVGSGSEIGDAMVTHHVPSLVSFTGSTSVGKHIGELANGGEYIKQVALELGGNSPFVVLKDADIEQAVKAAAFGKFLHQGQICIAINRIIVEDEIYDDFVTRFVAHVKTLNVGDPNKADTAVGPIINKKQVASLKEKIVKAKDEGAKMLLSGEIKGQVVPPHVFSDVTREMDLSCNEVFGPLVGIIRAKDEDDALSIANDSMYGLSSAVFTQDMAKGLRFARGIKAGMTHINDISVNDESNAPFGGEKNSGIGRFNGEWILEEFTTLHWISMQHTPRDYPF

SEQ ID NO: 57176 - protein, 229 aa, Oryza sativa Japonica Group
MQYQPLDSSGTDDDLPPTYQPRGPRVIFNGNGSLPQPNLHSNVDREIRQIEQQAYTGVLRAFKVQSDAITWEKESLITELRKELQISDKEHRVLLKGVTEEEAVCRIRQSGQTANQGLLYQGGRQASDRVLKRLPSNNSPMLGSSRRRGRLHPNELIKGYSPLDGFGIPNTGNVVMEVEKVLSNPNMLEIEKAMKLLRDQEQSLLDAIARLDEASDGENEITALKIERR

SEQ ID NO: 57177 - protein, 616 aa, Zea mays
MASISGAAAAPSSAACRLRLRRHLLLRPSHLRLRAPHSIADLSRSSSSSNSAPTRAQPLGSRPENGGVRAVEKDPIKLWERYVEWLYQHKELGLFVDVSRMGFTEDFLRQMEPRMQRAFAAMRELEKGAIANPDEARMVGHYWLRDPALAPNSFLRSKIETTLDRILAFSQDVVSGKIQSPSGRFTSILSIGIGGSALGPQFVAEALAPDNPPLKIRFIDNTDPAGIDHQIAQLGPELATTLVIVISKSGGTPETRNGLLEVQKAFRDAGLQFSKQGVAITQENSLLDNTARIEGWLARFPMFDWVGGRTSEMSAVGLLPAALQGIDIKEMLAGAALMDEETRNTVVKENPAALLALCWYWASEGIGNKDMVVLPYKDSLLLLSRYLQQLVMESLGKEFDLDGNRVNQGLSVYGNKGSTDQHAYIQQLREGVHNFFVTFIEVLRDRPAGHDWELEPGVTCGDYLFGMLQGTRSALYANDRESISVTVQEVTPRAVGALVALYERAVGLYASLVNINAYHQPGVEAGKKAAGEVLALQKRVLTVLNEATCKDPCEPLTIDEIADRCHCPEDIEMIYKIVQHMAANDRAIIAEGSCGSPRSVKVYLGECNVDEDLQAA

SEQ ID NO: 57178 - protein, 799 aa, Burkholderia pseudomallei K96243
MTNAANVAKDQAYVIPFEQLRMTDVEIVGGKNASLGEMISQLAEAGVRVPTGFATTALAFRDFLQHNNLTERIAQRLESLDIDDVKALAEAGAEIRKWIVDAPLQPRLEQEIRAQFEILKNGSPGELSFAVRSSATAEDLPDASFAGQQESYLNVVGIEDVLDRMKHVFASLYNDRAISYRVHKGFTHAEVALSAGVQRMVRSDVGAAGVMFTIDTESGFKDAVFITASYGLGETVVQGAVNPDEFYVFKTTLAQDKYPIIRRSIGSKLIKMEFTQPGEPGRVKTVDVPHEQRNRYSITDDDVIELAKYAVIIEKHYQRPMDIEWGKDGRDGKIFILQARPETVKSQAHGKVEQRFKLKGQSQVLATGRAIGQKIGAGPVRVIHDPSEMERVQPGDVLVADMTDPNWEPVMKRASAIVTNRGGRTCHAAIIARELGVPAVVGCGDATDVLKDGALVTVSCAEGDEGKIYDGLLETEVSEVQRGELPSVPVKIMMNVGNPQLAFDFSQLPNAGVGLARLEFIINNNIGVHPKAILEYPNVDADLKKAVESVARGHASPRAFYVDKLTEGIATIAAAFYPKPVIVRLSDFKSNEYKKLIGGSRYEPDEENPMLGFRGASRYIAEDFAQAFEMECMALKRVRDEMGLTNVEIMVPFVRTVKQAERVVGLLGKFGLKRGDNGLRLIMMCEVPSNAILAEEFLQHFDGFSIGSNDLTQLTLGLDRDSGMELLAVDFDERDPAVKFMLKRAIDTCRKLDKYVGICGQGPSDHPDFAKWLADEGIASISLNPDTVIETWQALAAKQ

SEQ ID NO: 57179 - protein, 137 aa, Campylobacter coli RM2228
MEKTLSIIKPDAVKKGVIGKILDRFESNGLRIAAMKKVQLSKEQAEAFYAVHKERPFFKDLVEFMISGPVVVSVLEGEGAVLKNRDLMGATNPKEAQPGTIRADFAESIDANAVHGSDSLENAKIEIEFFFKSNEIC

SEQ ID NO: 57180 - protein, 198 aa, Campylobacter coli RM2228
MIVTKKALDFTAPAVLGNNEIVEDFNLYKNIGPKGAVVFFYPKDFTFVCPSEIIAFDKRYQEFKNRGIEVIGISGDNEFSHFAWKNTPVNQGGIGQVKFPLVADLTKQIARNFDVLYAEAVALRGSFLLDADGTVRHAVVNDLPLGRNIDEMIRMVDTMLFTNEHGEVCPAGWNKGDAGMKANPKGVAEYLDKNEDKL

SEQ ID NO: 57181 - protein, 532 aa, Daucus carota
MGGCFSKKEYQADGNGYRSAPTAYHTVTDQSYEKSSQRSQPQAQPQPQVQQTGPSLKPRQVHRPESNTILGKPFEDIRGKYTLGKELGRGQFGCVYQCTENSSGQLYACKSILKRKLVSKNDKEDIKREIQILQHLSGQPNIVEFKGVFEDRQSVHLVMELCAGGELFDRIIAQGHYSERAAATICRQIVNVVHVCHFMGVMHRDLKPENFLLSSKDKDAMLKATDFGLSVFIEEGKVYRNIVGSAYYVAPEVLRRSYGKEIDIWSAGVILYILLSGVPPFWAENEKGIFDAILEGVIDFESEPWPSVSNSAKDLVRKMLTQDPRRRITSAQVLDHPWMREGGEASDKPIDSAVLSRMKQFRAMNKLKQLALKVIAESLSEEEIKGLKSMFANMDTDKSGTITYEELKSGLARLGSKLSEVEVQQLMDAADVDGNGTIDYLEFITATMHRHKLESYEHQAFQYFDKDNSGFITKDELESAMKEYGMGDEATIKDIISEVDSDNDGRINYDEFCAMMRRARNRRKLFSVSLTS

SEQ ID NO: 57182 - protein, 316 aa, Haemophilus somnus 2336
MTIYADNSYSIGNTPLVRLKNFGNNGNIIAKIEGRNPSFSVKCRIGANMVWQAEKDGILTKDKEIIDATSGNTGIALAYVAAARGYKITLTMPETMSSERKRLLRGLGVNLVLTEGVNGMKGAIAKAEEIVASNPNHYVMLKQFENPANPAIHQQTTGPEIWSGTEGKIDVLVAGVGTGGTISGISRYIKQDQGKKIITVAVEPEESPVITQTLAGEETKPGPHKIQGIGAGFIPKNLDLSLVDQIEKVSSETAIITARRLMAEEGILGGISSGAALAVADRIAQRPEFSDKLIVVILPSASERYLSTALFDGFEG

SEQ ID NO: 57183 - protein, 341 aa, Arabidopsis thaliana
MAVFQLPSLSPEIPFRFTPTPLKFSNRRRINFFRPLSATDDSRSGAPDPESPNQMFILGMGFVGGFFAQQLKESDWSDISVSLLISISIYFHLSPMVWSLLDSVKDYTHLLISIPPLADIGDPMLRNVELVRDKLSSGNLRWLCYLSSTSVYGDCGGAWVNENHLPNPKTQSAKVRLAAEQGWLSLGRDLGVSTQILRLGGIYGPGRRLFTASDCERLSEGQKRRASRKFTSRVHVEDICQVLKAATEKPASGEIYNIVDDDPAAREEVFEYALELIEKRWPGNITTKPFPFLYESREESSLRGEKRVCNERMKDKLGVKLLYPSYKSGLQSIVENMDNRF

SEQ ID NO: 57184 - protein, 537 aa, Gibberella zeae PH-1
MASTPPQADYGKEAVLDVSENQDVETGEVKNGGLQRDLKNRHMQMIAIGGAIGAGLFVGSGGALQKGGPAALLIGYLIIGIMLLCTCLALAEMAVLYPVNGAFFTYICRFVDPSWGFAMGWQYALAWLTVLPFELIAASITIKFWREDINMAVWVSVFLVTLIGIQFFGVRGYGEVEFVLSIIKICACVGFIILGIVINCGGVGDQGYIGVKYWQDPGAFTSFKGFCAVFVVAAFSFGGTEMVGLAAAESADPRRSIPMASKQVFWRIAIFYILNLFIVGLILPANDPRLMGASGANTKASPFVLAIQDAGIKVLPSIMNAVITVAVLSVANSCTFGSTRTIQAMAERNMAPGFFKYIDSKGRPLYCVLLQIAFGLLAYIGAAPQGMEIFGWLLALTGLGFLFVWGSICLAHIRMRAGMKAQGVNLGLIPYKTPFGVAGSYLGLGLNILALIASFYTALYPASGASPAAEAFFSSYLAFFSVTLLYVGYKVCTRKWQMYVRPSEMDLSTGAVFLEEEEPKEPFVWADAPKRVLRSFF

SEQ ID NO: 57185 - protein, 452 aa, Staphylococcus aureus subsp. aureus COL
MNYTQQLKQKDSEYVWHPFTQMGVYSKEEAIIIEKGKGSYLYDTNGNKYLDGYASLWVNVHGHNNKYLNKVIKKQLNKIAHSTLLGSSNIPSIELAEKLIEITPSNLRKVFYSDTGSASVEIAIKMAYQYWKNIDREKYAKKNKFITLNHGYHGDTIGAVSVGGIKTFHKIFKDLIFENIQVESPSFYRSNYDTENEMMTAILTNIEQILIERNDEIAGFILEPLIQGATGLFVHPKGFLKEVEKLCKKYDVLLICDEVAVGFGRTGKMFACNHEDVQPDIMCLGKAITGGYLPLAATLTSKKIYNAFLSDSHGVNTFFHGHTYTGNQIVCTVALENIRLYEKRKLLSHIETTSSTLEKQLHALKRHRNVGDVRGRGLMFGVELVTDKDSKTPLEIEKVERIVRNCKENGLMIRNLENVITFVPVLSMSNKEVKTMVRIFKKAVHNILDRKC

SEQ ID NO: 57186 - protein, 97 aa, Atropa belladonna
ATYKVKLVTPDGPVEFDCPDDVYILDQAEEEGHELPYSCRAGSCSSCAGKVSAGTVDQSDGNFLDDDQMADGFVLTCVAYPQSDVTIETHKEEELTG

SEQ ID NO: 57187 - protein, 718 aa, Arabidopsis thaliana
MKLYEHDGVDLEDGKTVKSGGDKPIPRKIHNRALLSGLAYCISSCSMILVNKFVLSSYNFNAGIFLMLYQNFVSVIIVVGLSLMGLITTEPLTLRLMKVWFPVNVIFVGMLITSMFSLKYINVAMVTVLKNVTNVITAVGEMYLFNKQHDNRVWAALFLMIISAVSGGITDLSFNAVGYAWQIANCFLTASYSLTLRKTMDTAKQVTQSGNLNEFSMVLLNNTLSLPLGLLLSYFFNEMDYLYQTPLLRLPSFWMVMTLSGLLGLAISFTSMWFLHQTGATTYSLVGSLNKIPLSIAGIVLFNVPTSLQNSASILFGLVAGVVFARAKMRENHLMIKNDGKMMRVRIAKERSDLCDLTAAAIKATYNTRNPCEVERCIDVLNHLKSLSLSVKDIRLSESIVKLETLRSHRNPRIRKEAQALFHSWLKTFYAHGSDNSFTAALTKDRLKMKKHVLKMCSELKKKEEPGTMARQVTAFSVLKNKEDERSQTTVEAVESKTTIKLSELNRKEDQRSLTRETEKNKARNSFLALKQKEDHRSETCVEKYFKKETKTNLKQLNMKTRRVSLEDVTTKKPHEDGSLIKKTKTEKELKKKKVDEMVKLFEAAKKAADVANAKGVLSGKPEVSRCIDALSLLMKINITPKPKEPRRMMDKLEGLTKHKDRKICHVASALLHLWRQRIREQERKKSVTKASSKTRKLSYVKIIWLEQIKVSCGFKRF

SEQ ID NO: 57188 - protein, 324 aa, Rubrobacter xylanophilus DSM 9941
MKAVRVHEPGGPEALRYEEVPTPEPGPGEVRVRLEACGVNFIDVYHRKGLYPRQTPFVLGQEGAGRVDAVGEGVEEFSEGDYVAFASAPGGAYAEYAVVPADRLVPVNVTLVEARVAAAAMLQGMTAHYLTHSTFPLEEGHVALAHAAAGGVGLLLIQMAKMRGATIIGTAGTPEKARLAREAGADEVILYTERDFVEETRRITGGQGVHVVYDSVGRATFEGGLDVLRLRGYMVLFGQSSGPVPPVDLQILNQKGGLFVTRPSLAHYTATREELLWRAESVLSWIGNNTLKVRIGGTYPLAEAARAHADLEGRRTTGKLLLIP

SEQ ID NO: 57189 - protein, 346 aa, Prochlorococcus marinus str. AS9601
MFGLIGHSTSFEDAKRKASMLGFDHIADGDLDVWCTAPPQLVENVEVKSATGISIEGSYIDSCFVPEMLSRFKTARRKVLNAMELAQKKGINITALGGFTSIIFENFNLLQHKQIRNTSLEWERFTTGNTHTAWVICKQLEINAPRIGIDLKKATVAVIGATGDIGSAVCRWLINKTGISELLMVARQQEPLALLQKELDGGTITSLDEALPQADIVVWVASMPKTIEINTDNLQKPCLMIDGGYPKNLDEKFQGENIYVLKGGIVEFFNDIGWNMMELAEMQNPQREMFACFAEAMILEFEKCHTNFSWGRNNISLEKMEFIGAASLKHGFSAIGLDKQPKVLTV

SEQ ID NO: 57190 - protein, 512 aa, Arabidopsis thaliana
MASIGLYEAFIGFLCFLISFYFLVKKPFRYLLIKKTHQSYPWNWPVLGMLPGILLRLQRIYDYSVEFLENSNMTFQFKGPWFVGMDILATADPTNIHYIMSSNFSNYIKGPIFHEIFEAFGDGIINTDAELWRDWRNASQLIFNHQRYQNFSASTTKSKVNDGLVPLFNVDLQDVFQRFMFDITFIFLTGTDPRSLSIEMPEIEFAKALDDVGDVIVYRHITPRFVWKLQKWIGIGTEKKMSKANATLDRVCEKLIAAKREELRSQGIIDNANGDSEDLLTSHIMLDATKYELLNPNDDKFLRDFTVSFMAAGRDSTSSALTWFFWNLTENPNVLSKILQEINTNLPRTGSDQDMSSYLNKLVYLHGALNESMRLYPPIPFERKSPIKDDVLPSGHKVKSNLNIMIFIYAMGRMKTIWGEDAMEFKPERWISETGGLRHEPSYKFFSFNAGPRTCLGKNLAMNLMKTVIVEILQNYEIKIVSGQKIEAKPGLVLHMKHGLKVTMTMKCSSLE

SEQ ID NO: 57191 - protein, 129 aa, Helianthus annuus
GCDFVTDFSIRCPMKDKKYTKECADEVIKSLGIDLKKIDECVGDTEADTDNAVLKAEQETQIGKGSRGDVTILPTLVINNRQYRGKLAKQAVLKAICSGFEETTEPAVCLTDEIQTNECLDNNGGCWQD

SEQ ID NO: 57192 - protein, 291 aa, Zea mays
  misc_feature (239)..(239): Xaa can be any naturally occurring amino acid
MEKYEKLEKVGEGTYGKVYKAQDKATGQVVALKKTRLEMDDEGIPPTALREISLLRLLSSSLYVVRLLAVEQATKGGGAGRGGKPVLYLVFEFLDTDLKKFVDAYRRGPAPKPLPTQVVKSFLYQLCKGIAHCHGHGVLHRDLKPQNLLVDKEKMILKIADLGLSRAFTVPMKSYTHEIVTLWYRAPEVLLGATHYSTSVDIWSIGCIFAEMVRKQALFPGDSELQQLLHIFKLLGTPXTEEDWPGVTALRDWHEFPQWKAQRLTRAVPTLEPEGIDLLSKMLQFDPANRI

SEQ ID NO: 57193 - protein, 315 aa, Arabidopsis thaliana
MVEPYETRNNGEASQMIRYQSYNHHNSRLPSSLSSPLLDLRVFYVRISNFKVDHSTPEVLTITHIPLDPDSLLEINGVRMSMYSEGVSSQLRRDRVDKKSEVATFISTDNIRLSGSVKFEVYDKDELVLSGTLEMSGSNGFTGESKHSVKRWNMNCEAEITAGSGFLKEKHIGGSELSSPLPTIEVYVTGCFSGTPIILTKTLQLGFRKKHGRVTALDSIPEYETDEPHKGNSSELDYQVTEYGSYKQEYEGEHSDMYWNREYADGEDGEMSWFNAGVRVGVGIGLGVCVGLGIGVGLLVRTYQSTTRNFRRRII

SEQ ID NO: 57194 - protein, 264 aa, Triticum aestivum
  misc_feature (188)..(188): Xaa can be any naturally occurring amino acid
  misc_feature (219)..(219): Xaa can be any naturally occurring amino acid
  misc_feature (229)..(229): Xaa can be any naturally occurring amino acid
  misc_feature (243)..(243): Xaa can be any naturally occurring amino acid
NKFVQKSRLVPVRNSRDIVDPRVRENAKAMSLFEGVVQRNDEIEDGEKRAENLIRGILAGNIFDLGSAQLAEVFAKDGMSFLASCQNLLSRPWVIDDLDAFKSKWTKKSWEKAVIFVDNSGADIILGILPFARELLRRGTKVILAANDMPSINDITYLELVEIVNKLKDENGKLAGVDVSDLIVANSXGNDLPVIDLSSVAPELAYMASDADLVILKAXGKRIKTHLYXQMRCDSIKIGWASXSEMAHFWGERLYDWVFKFNKA

SEQ ID NO: 57195 - protein, 234 aa, Triticum aestivum
MAGRAGAATSPPASSPPGKQFAEVVVVRHGETSWNATRTIQGQMDPELNETGRRQALVVARRLSREAKPAAVYSSDLKRAAETAQTIATACGVSSLVLDPALRERHMGDLHGLVFDDAVRRNPEIFSSYSRTQEIPGGGESLDQLSKRCVSYLNTVAEKHKWERVIVVTHGASTEELCIHADPTSPVRGKLYNTSICVFRIGGGEWILEKTGDVGHLDQGEFLEDAFGGDGVSA

SEQ ID NO: 57196 - protein, 924 aa, Synechocystis sp. PCC 6803
MFDAATLAAITAEARQAFLEEDAPECLAQLTVGFQSLERVLGPAGDSQQRQKLIQDMGRAAHSLKGGAGMSALTPLQTLCHRLEDLFEALEQGRVEDKSMAVGLIAMTIEETQAMVELANSGRLQDTDEPPELALALGEFLETCQPQPSQEEAIAGDVSQFVRTSLTVELEACLERVERRLERGGTATELRESFSLLLEECTLLGQALSCDWLEEAGNRWRGELVRPQVDLLTLLPTAIAELRSLREQFLAGELTPPAPEIVAEPDPEPLPEVKPVTAVIAPPVPGVPIPAVVTAKASPAPSTRQTLRIPLDRLNKLSNTVSELLINQERLLEYDKQLRQASRNLKRRGQQLIPMREQVESLYDELSFSDQTKISPSNGGGNQNGDSQSSLGIAGLVDFDALEMDSYTAVHGILQRFQELMVQVQEIQEDVDLVERDLQETLIQMSQSLHQLDSELTQSRLVPFRGLAQSFAQPLEKLGDRHKKPVQFVIEGENTLVEVAILDQLRTPLTHLIRNAFDHGLEFVPERQAQGKLPEGTITLSASTANNQVLITVSDDGRGIDPEKISRKAMELGWLTPEQLGTIGEAQMLDFLFQPGFSTAAEVSNLSGRGLGLDIVKQMIESLRGTLTVETKLGQGSRFLIRIPLSLNIVPLLLVRYQQRLLAFPSESVLRILPLDDYPIKNGRVEWQSQIMEACPLDEVLPQIYPQGFSPSPGLPHKVGLMVNLGDRSALLTVEQIVDERTLVVKALDAITPIPSYVAGCTVLGTGEVVPVLIPNNFAVLWRTEPTLPQDAAGSAGGQTTILVIDDSVTVRRTLQRVLGGSFRLIQCRDGKEAWDLLNRQNQGIDLALCDIEMPNMDGFSLLQLVRAHRVWHSLTVVMLTSRENPLHRNRAKALGADGYLTKPFQPNQLLSTIDQFLAESAQR

SEQ ID NO: 57197 - protein, 460 aa, Methanosarcina acetivorans C2A
MTEISSMVISHKKAKIEEMESAWHGDLDGLLNNLYHHEYVYECVVLKTCNRVEIYVVSPKSSSVLFSFAKEMGASTHIIDFYGHDESLEHLLRLAGGLESMIVGEDQILGQIKDLYAYSKKAGTTGKILDTAFEKAIQVGKRIRNETRINKGSVSIGSAAVDLAEDIFGGLTGKSVLVIGAGEIGVLVAKALAEKDIEAIYIANRTFKKAEEIAYELGGYAVRLDDIRGHLPDADVVISGTGAPHYILTREMIEEALDGRERKLLLIDIANPRDIEESVAELENVELCNIDNLRVISERTLKMRKEEAKKAEAIIQEEIRLLNIQYKRQKADRLISELYRQVYDVRVREREKAVNRLSAYHTIGEIETEVLDDLTHSIVNKILAEPTKVLRQAAELGNEEFLDVVSRVFCLEKDKAKLEKINQAKFEQIEPGCAKEQAAVKEQTAVKEQAVVKEQAAVKD

SEQ ID NO: 57198 - protein, 108 aa, Zea mays
PTRAATRAIGTMIEITRAALVADEIAEQAKFLSFGSNDLTQMTFGYIKDDVGKLMLIYVADGIPQHDPLEVLDQRGVGKLVKLATERRRNASPNLKVVIGGEHGEEPL

SEQ ID NO: 57199 - protein, 530 aa, Campylobacter coli RM2228
MILLIDNYDSFVFNIKSMLENVYKGEILVVRNDKITLDEIKALNPNYIILSPGPKHPKDSGVCLEIFKSRLNIPTLGICLGHQALGFSFKAEIAKLQNPMHAKNSLIKIYNKDTIFKDFEDEVSVMRYHSLEVKNLPDDFEILALSDDNVIMAIKHKTLPYFGVQFHPESYFSEYGIKIFANFLNQEKAVQDKKHTLGFYLQKMSENHYLESEDFSEICKIIMSRDYEPLQAAALLVLISEKSLNQKSLSSLVREILRYSKTFSDESDMIDICGTGGDNFKSINVSTASAFILAALGVKVAKHGNRAISSSSGSTDVLDALDVKIPDNLECALNDLQNKNLAFFHAPYFHPLVGELRELRAKLGIRTVFNVLGPLLHPNLKLKYQMMGNYHAPVHKLLAEVLRSLGRKRALVVRGNDGMDEISICDETKIFEVREGEIYEYGVTPEQFGFKRAFHSEIMGGNAYENAKDLKDILSGKIQGAKFDIVVLNSMFALYTANKVSTPLKAKDIILEAIYSGKVMEYFRSLNDKA

SEQ ID NO: 57200 - protein, 797 aa, Xanthomonas oryzae pv. oryzicola
MNENILWLHELRLADLARVGGKNSSLGEMIGNLAGLGVSVPGGYATTAEAFKDFIAHNDLSKRIFDKLATLDAEDVNALTLAGKEIRGWVIDAPLQPELDRDIRTAYEQLCAENGGGDVAVAVRSSATAEDLPDASFAGQQETFLNVTGADDVVHKVKEVFASLYNDRAIAYRVHHGFKHEDVFLSAGVQLMVRSGVGAAGVLFTLDTESGFRDVVFVTSSFGLGEMVVQGAVNPDEFYVYKPTLTAGKPAILRRSLGSKAIRMVYSDVPGERVRTEDTPVELRSTFSISDEDVQELSKQALVIEKHYGRPMDIEWAKDGVSGKLFIVQARPETVKSRSHATQIERFSLDAKDAKILVEGRAVGAKIGSGVARVVRSLDDMNRVQTGDVLIADMTDPDWEPVMKRASAIVTNRGGRTCHAAIIARELGVPAVVGSGNATDVLSDGQEVTVSCAEGDTGFIYEGLLPFERTSTDLGNMPPAPLKIMMNVANPERAFDFGQLPNAGIGLARLEMIIAAHIGIHPNALLEYDKQDADIRKKIDAKIAGYGDPVSFYVNRLAEGIATLTASVAPNTVIVRLSDFKSNEYANLIGGSRYEPHEENPMIGFRGASRYVDPSFTKAFALECKAVLKVRNEMGLDNLWVMIPFVRTLEEGRKVIEVLEQNGLKQGDGADGKPGLKIIMMCELPSNALLADEFLDIFDGFPIGSNDLTQLTLGLDRDSSIVAHLFDERNPAVKKLLSMAIKSARAKGKYVGICGQGPSDHPELAEWLMQEGIESVSLNPDTVVDTWLRLAKLKSES

SEQ ID NO: 57201 - protein, 504 aa, Xanthomonas oryzae pv. oryzicola
MTQTNGFDALHAHAQRLRGAAIPALLAAEPERPTQYAWQVGPLYFNFARQKYDRAALDALFAIARERDLVGAFQRLFRGEQVNVTEQRAALHTALRGDLTDAPVASEAYATAAEVRQRMGALIQQLEATDVTDIVSVGIGGSDLGPRLVADALRPVSGARLRVHFVSNVDGAAMQRTLATLDPARTAGILISKTFGTQETLLNGSILHAWLGGSERLYAVSANPERAAKAFDIAPGRVLPMWDWVGGRYSLWSAVGFPIALAIGFERFEQLLEGAAQFDAHALNTPLEENVAVLHGLTAVWNRNLLGSATHAVMTYDQRLALLPAYLQQLVMESLGKRVKLDGSAVDSDTVSVWWGGAGTDVQHSFFQALHQGTSVVPADFIGTVHNDDPYAENHVALMANVLAQTEALANGQDSSDPHRSYPGGRPGTVILLDALTPQALGALISMYEHSVYVQSVMWGINAFDQFGVELGKQQASQLLPALKGESADVADPVTRELLSKLRG

SEQ ID NO: 57202 - protein, 255 aa, Methanosarcina mazei Go1
MKNLFDLTGRVAIVTGASSGLGVEFARALANQGADIAIVARREEKLKEVQKEIEKIGVTCRYYICDVMQTDQIKSAVEKIEKDFGKIDILVNNAGLGLVDAADKTSDEMWRNMIDTNLNGVFFFAREVGKVMLKQKYGRIINIGSIHSTVSMKGMPVTAYCSTKGGVLMLTKSLATEWAKEGITVNAIGPGYFALGMAEGVVADPEFAKIIEFMCPMGRAGQTGDLDTTVVYLASEASKYITGQIITVDGGWTAL

SEQ ID NO: 57203 - protein, 124 aa, Magnetococcus sp. MC-1
MATIDLTKDNFQETVTGDNIVIVDFWASWCGPCKAFAPIFEKVSESNPDVVFAKVNTDEQRELAMEFQIRSIPTLMIFRDNVIIFSQPGMLPEQALVELIGKAKELDMDEVRKEIANASQAEEH

SEQ ID NO: 57204 - protein, 431 aa, Glycine max
MWRCINGRIARRFLSTSSASARGWWDHVRPAPKDPIVRVNEAFLADPFPHKINLGIGTYKGDDGKAFIPQSVREAETKIQRCKLEESNASAVRSKFVQECVRLAYGNDSNVVREGLFAGVPTLSGTGACRLFAEFQRHFYPDSQMYLPDPTWSNHHNIWRQAEIPVKTFHYYHPDTKGLDFAALLNDVKNAPDCSFFLLHPCAHNPTGVDPTEEQWREISYQFQVKNHFPFFDMAYQGFSSGDLDKDAIALRIFLEDGHLIGCAQSFAKNMGLSEHKAGCLSVLCQSIKQVAALKSQLQLMSHAMYSSIPFQGISLVTMILSEPDTEALWRKEIKVMAKRIQTMRTTLRHCLENLHSSFNWEHITDQVGMFCFSGLTPDQVQQMEKLFHIYMTPDGRMSMSGVTSSNVDYLANAIHQVTRIDEEALRSCYV

SEQ ID NO: 57205 - protein, 301 aa, Rubrobacter xylanophilus DSM 9941
MAGVFVMGSINQDFVLRVERRPGPGETVTDAELSLHPGGKGANQSAAAALLGAEVAFLGRVGDDGLGEPLVRNLREKGVDAGLVERVAGRSTGAAFITVTPDGENAITVAPGANRALLPPDVEAARERIAASRVLVAQMEIPRETVFRGVEVASEAGTRVLLNLAPPFEVPGELLGLLDPLVVNEHEAAFLLGEPVEGVEGALAAAPELLGLGARSAVITLGPAGAVFALEGRAEHASAPRVRAVDTTGAGDAFVGALAARLAAGEALGEAVAYAVRAGAAAVTREGAQGALPTPEVVEGL

SEQ ID NO: 57206 - protein, 327 aa, Alkaliphilus metalliredigens QYMF
MIEVDMERGKDNMEVITFGESMVLFNPDSTGPLRYVHNFNKTIAGAESNVAIALARLKHRVGWFSRLGDDEFGRYIEAVIRGEGVDVSRIVTDPSNSTGLLFKERFAHVNPKVYYYRKNSAASNITFKDLDLEYIKSAKILHVTGITLALSQSAREAVYEAVKMAKANGVLISFDPNIRLKLWSAEEAKVAILEMIKLSDIVFPGVDEGRLLLGTEDPKEMIKQLLNMGCSTVAVKLGKEGCYIANRQEEKMVRGYVVERPIDTVGAGDGYAAGFLSGLLNQLSLEECGKLANAVGAMATLVRGDMEGFPTLSQVREFMGTDEYIDR

SEQ ID NO: 57207 - protein, 556 aa, Legionella pneumophila str. Lens
MAIKVTKRGMDLLRDPIVNKGTAFSLQERDEFALHGLIPTTVETLEQQVIRCLDAYSAKENPLEKHIYLRALQDRNEVLFYRFIIDNLVDILPIIYTPVVGQACEMFSHIYRQPRGVFLSYPERDKLDSIIQNIASTRSIKVIVVTDGERILGLGDQGAGGLGIPIGKLSLYTSCGGIHPSNTLPIILDVGTNNKERLDDPEYIGWRHARISGKEYDDFVDQFVQSIKRHMPHVLLQFEDFAQQHAYPLLERYKNQLCTFNDDIQGTASVAVAAILAATRVTNTPLKEHRVALLGAGSAGCGISEQLVHAMINQGLSEEEARSRFYLVDRYGLLHDEMTDLLPFQKGFVRSSTSLQNWKLEKKGEITLTDVINNAQPTILLGVSGQPNQFKEAMIKTMLSYCERPIIFPLSNPTSRAEAIPQDLLNWTAGKALIATGSPFEPVVINGHKIEIAQCNNSYIFPGVGLGVVAGQAKRVTDLMMMAAAVALSELAPAIRTGEGRLLPELNSIREVSQHIARAVILQGIKEGHIEPMNNNKIDESIKRTMWTPQYEPYVL

SEQ ID NO: 57208 - protein, 300 aa, Vigna unguiculata
MMSGFKLSTSGFIYIRTATKTKPLSWTPNTRTTPTQHRRRYIPSLSPSKNQILGFSRSHKLPCLGRAGLVTDLGSPVPSPQPQPQPQPQLQAQSKPEPEPESSKLLTLPTILTLGRVAAVPLLVATFYMDGWPGTAATTSIFVAASITDWLDGYLARKMKLKSSFGAFLDPVADKLMVSATLVLLCTRPLEVAVFGQLPWLLIIPSITIIGREITMSALREWAASQGSKLLEVAVNNLGKWKTASQMTALTILLATRDLSHGGGAAILVGSGVALLYTSAGLALWSLVVYMKKIWRVLLR

SEQ ID NO: 57209 - protein, 359 aa, Chondrus crispus
MQALMKEQEDGGLKPPTGLEGLDSVTLTRFVLHGQRKHHDASGDLTLLLAAVQLACKVTETCVRRAGIAKLYGLAGSGNVQGEDQKKLDIIANDTFKVNIESSERCGVMVSEEDELAIVCTKSSIDGTTGKYAIAFDPLDGSSNIDANVSIGTIFSIFKIDDPDSITDAKSAAAAISQPGRQMVAAGYAMYGSATNLVISVGTGVYGFTLDPSLGEFVLTHPDIKIPSRGKIYSVNEGNAKNWDKATTEYIQSLKYPEEGKSSYSLRYIGSMVADVHRTLFYGGVFIYPADKKSPNGKLRLLYEAAPMAFLMEQAGGKATTGKTEILDIVPEDIHQRVPVYMGSSEDIADFEALASKYA

SEQ ID NO: 57210 - protein, 490 aa, Psychrobacter arcticus 273-4
MRYQNTYAQLDTRLYHEQLPNPLDNPRAGHFNNQVADQLGWTKAADLMARWVEILGGQYVPAEFQPLSMAYAGHQFGQWAGQLGDGRGLLMTQVLDKNNQLQDLHLKGAGLTPYSRMGDGRAVLRSTIREYLCGHALTQLGIASSNALGFVVSDTKVRRERLEAGAALMRVADSHIRLGHVEWIASFAPDLLAEFTDYMIDTYYPECRDSEKPVLAFLQAVVERTARMIADWQLIGFAHGVMNTDNLSITGSTLDFGPFGFMERFNPAWINNHSDHSGRYAYQNQPAIGHWNLNVWLPHFMRLTQAGVTRETLADCLAPYEATFMQHYQQGLCRKLGLPHQRESLSLAFEWLTLLEDNLLDYTNSFRALLGLIAPNEHLYEQQLLATMTAELNPEAQQVWQVWSTRYLAQIQQVSITQAIEEMQASNPIYILRNSMAQRVIVAAEQGQFEELNRVFDLLAKPYTLQDSAIELDTLPPAPHAPQMPISCSS

SEQ ID NO: 57211 - protein, 779 aa, Psychrobacter arcticus 273-4
MAIIMNDDITLNTDTPTPSTEKEQFEQAALHYHEFPRPGKISVTPIKQLANQRDLALAYSPGVAVPCLEIQRDPSLAAKYTARSNLVGVITNGTAVLGLGNIGPLASKPVMEGKGVLFKKFAGIDVFDIEIAQNDPDKFIEAVASLEPTFGGINLEDIKAPECFKIERELRKRMNIPVFHDDQHGTSIIVAAAMLNALIITNKKIEDIKIICSGAGAAAISCLDIICALGVNKNNIYVSDSRGIISTTRENLDETKQRYARETTATTIEELMDDVDMFLGLSMPGTLTEDMVRRMAKDPIIFALANPTPEIMPEIAHAVRPDVIMATGRSDYPNQVNNALCFPYIFRGALDVGATTVNEEMKVACVRAIAAMAHVEATPISNIKNVESTPSFGRDYLIPGPLEPNLIIEIASAVAKAAMDSGVATLPIADMKAYRQRLSEFVYNSAFVMKPIFARAKADPKRIVYCEGEDRDVLLAVQVVVDEQLAYPILVGRPSVIENNITKLALRLKDGENITIVNVDDDPRYNDYWKGYYEKNKRTGVSIELARRDVRRKTSLIGALLVENGDADGMICGTFGHYQLHLKYVSRVINKKEGINDFYAMNAVLMQDRNIFIADTYIHEDPTAEQLAEMTVLATEQLRRFSITPRVALVSHSNFGTSDRASAVKMRKVHQLLTEMNVDFEFDGEMQGDAALDEHIRANDLPSSNLKGSANLLILPTLDASNIAFNLLKTATGSASIGPILLGASKPVHILTPSATARRVVNMTALAVTEAQDLENKQQ

SEQ ID NO: 57212 - protein, 151 aa, Triticum aestivum
SGGGARVRSSNRAAAADAPPSVLFAWAPGNSGGGWTINLNIANPTTGWQKKGEIDDYQKLGNLYDKRISQEGVGDLLGEGFKGYIFKIMGGCDKQGFPMKQGGVTSGRVRLLVHRGTPFLRGFGMRNGERRRKSVRGCIGSQDLAGVNFMI

SEQ ID NO: 57213 - protein, 317 aa, Zea mays
RSTCLHWPSGFRRTPPPTRTTGQSSSIKQVRSGPRLPRSLYSAVPGDFNLTLLDHLIAEPGLRLVGCCNELNAGYAADGYARARGVGACAVTFTVGGLSVLNAIAGAYSENLPVICIAGGPNSNDYGTNRILHHTIGLPDFSQELRCFQTVTCHQAVVNNLDDAHEQIDTAIATALRESKPVYLSISCNLPGLPHPTFSRDPVPFFLTPRTSNKMGLEAAVEATVEFLNKAVKPVLVAGPKLRVAKAGKAFVDMVDASGYAYAVMPSAKGLVPETHPHFIGTYWGAVSTAFCAEIVESADAYLFAGPIFHDYSSVGY

SEQ ID NO: 57214 - protein, 415 aa, Wolbachia endosymbiont of Drosophila melanogaster
MNVESKKIHDAKIKLPIFLDYQSTTKVDPRVLEVMIPYFGEFSNAHSRSHSFGWTAEEAVEKARKHIADLVNADSKEIIFTSGATESNNTAIKGVAHFYKNKGNHIITVCTEHKCVLDSCRHLENEGFKVTYLPVKQNGIIDLSKLEEAITDKTILISVMMVNNEIGVIQPVKEIGKICRKHNIFFHTDAAQSFGKVPIDVNEMCIDLMSLSSHKIYGPMGIGALYVRRKNPRVRLIPLISGGGQERGMRSGTVPTPLAVGFGEAARIAREEMKKETTGVEELRDILYNKIKEAFPDIVLNGDYENRIPGNLNLSFPYVEGESLIMAIKDLAVSSGSACTSASLEPSYVVRSLNNGHDLEHSSIRFGLGRFTTREEVLYAADLVAKNVGRLREMSPLWEMVQEGVDLNTVKWDSH

SEQ ID NO: 57215 - protein, 271 aa, Burkholderia pseudomallei K96243
MAITLKNEHDIAQMRIACRLASEVLDYITPFVVAGVTTGELDRLCHEYMTHVQGTVPAPLNYQPPGYPPFPKAICTSVNDVICHGIPGEKTLKNGDALNIDITVIKNGYFGDTSRMFIIGEGSILAKRLVQTTYECMWLGIDQVRPGAHLGDIGHAIQKHAEAQGYSVVREYCGHGIGTVFHEDPQVVHYGRPGTGIELKPGMIFTIEPMINAGKRDIRTMPDQWTVKTRDRSLSAQWEHTILVTDTGHEVLTVSAGTPARPTFAAPATAA

SEQ ID NO: 57216 - protein, 424 aa, Zea mays
  misc_feature (82)..(82): Xaa can be any naturally occurring amino acid
MAVEKTLPGASAGRTVLVTGGAGYIGSHAVLQLLLAGFRAVVVDNLNNSSELAVRRVAALAGDHSRNLSFHKIDLRDKGALXKMVFASTRFEAVIHFAGLKAVGESVQKPLLYYDNNVIGTINLLEVMSVHGCKKLVFSSSAAVYGSPKNSPCTENFPLTPNNPYGKTKLVVEDICRDIYRSDPEWKIILLRYFNPVGAHPSGYLGEDPRGIPNNLMPYVQQVAVGRRPALTVLGNDYATRDGTGVRDYIHVVDLADGHIAALQKLFENSSIGCEAYNLGTGRGTSVLEIVKAFEKASGKKIPLIFGERRPGDAEILFSETTKAERELNWKAKYGIEEMCRDQWNWASKNPYGYGSPDSIKQNGHQTNGSADSSKQNGHRTNGSTDSPKRNGHHAYGSADSPKRNGHCVFGSSDLKPNGNGHLR

SEQ ID NO: 57217 - protein, 237 aa, Pinus tabuliformis
MAREGEKGQVKLLGATLSPFVVRVRIALALKGIDYEFIQEDLETKSELLLQSNPVYKQIPVLVHNGKPVCESMIIVQYIEEAWDNKAPNLMPKDPYDRAIARFWAAFIDDKLFPSTRAVFTGQGEQLQKAVEDSVTNFLLIEEALRTNRCFAGKAYFGGDEIGLIDIALGGMSTFIKALEKATNTILIDPKKMPLLTAWMDRFCKSDGVKEVMPDPVKHAEYLCARRASMISPPTGN

SEQ ID NO: 57218 - protein, 579 aa, Methanosarcina acetivorans C2A
MFISGETPMTLSPEDLKTIEKYALQNAVKYEKAPQSKAVMGKVMGECPQLRANPGAVSTALKSIVSEIAKGNPEAWKTRLSEIAPELIEALNVKKEPEKGLKPLEGAEPGKVVMRFAPNPNGPGTLGSARGMVVNSEYVKMYKGKFVLRFDDTDPDIKRPMLEAYDWYLDDFKWLGVVPDRVVYASDHFPIYYDYARKLIEMGKAYVCFCKGEDFKRLKDAKQACPHRDTSPEENLMHWEKMLAGEYEDQQAVLRIKTDIEHKDPALRDWGAFRIRKMSHPRAEIGNKYVVWPLLDFAGAIEDHELGMTHIIRGKDLIDSEKRQGYIYKYFGWTYPKTTHWGRVKIHEFGKFSTSSLRKAIEAGEYSGWDDPRLPTIRAIRRRGIQAEALKKFMIEMGVGMTDVSISMESLYAENRKIVDPVANRYFFVWAPVELEIAGMEPTVAKLPLHPTDHSRGVREIAVGNKVLVCAEDVEKLELGSVIRLKDFCNIEITSLSPLQAKHSDVSLEALKKAKAKIVHWAPVDGISVKVRGPEGDLEGIGEKGIVGELDKIVQFERFGFCRIDAVSEEKVVAYFAHK

SEQ ID NO: 57219 - protein, 504 aa, Saccharomyces cerevisiae YJM789
MSEGPVKFEKNTVISVFGASGDLAKKKTFPALFGLFREGYLDPSTKIFGYARSKLSMEDLKSRVLPHLKKPHGEADDSKVEQFFKMVSYISGNYDTDEGFDELRTQIEKFEKSANVDVPHRLFYLALPPSVFLTVAKQIKSRVYAENGITRVIVEKPFGHDLASARELQKNLGPLFKEEELYRIDHYLGKELVKNLLVLRFGNQFLNASWNRDNIQSVQISFKERFGTEGRGGYFDSIGIIRDVMQNHLLQIMTLLTMERPVSFDPESIRDEKVKVLKAVAPIDTDDVLLGQYGKSEDGSKPAYVDDDTVDKDSKCVTFAAMTFNIENERWEGVPIMMRAGKALNESKVEIRLQYKAVASGVFKDIPNNELVIRVQPDAAVYLKFNAKTPGLSNATQVTDLNLTYASRYQDFWIPEAYEVLIRDALLGDHSNFVRDDELDISWGIFTPLLKHIERPDGPTPEIYPYGSRGPKGLKEYMQKHKYVMPEKHPYAWPVTKPEDTKDN

SEQ ID NO: 57220 - protein, 340 aa, Physcomitrella patens subsp. patens
MKESKKPKYTKFTQQELPACKPLLTPGWVMATFMVVGIIFIPIGAVTLLASNSVVEVVHRYDMECLPSTLATKADRVSYIQNSAVDHSCNVTLTIPKRMKPPVYVYYELTNFYQNHRRYVKSRNDQQLRGDEVSSLDSCKPLDKVGNQTIVPCGLIAWSLFNDTYSFTTASGGILVEKTGIAWKSDVQSKFGSDVKPLFFPNNDRNGSLGVIGGAALDPNKPLRDAEDLIVWMRTAALPNFRKLWGRINQQLEANQTVTVGISNVYNTYTFKGSKKLVLSTTSWLGGKNSFLGIAYLTVGLICMFLALVFFLIHLKNPRPLGDTSYLSWNRKNASNNSRG

SEQ ID NO: 57221 - protein, 395 aa, Vitis vinifera
MESGLSSLGSSLLVPCVQELVKEPLTAVPHRYVRPEQDSPVLSNATDSMPHVPIIDLHRLLSAAFTHSELEKLHRACQEWGFFQTKQSVGLQLMGGQGYCDEQVGEKTEKGRCYQLINHGVSSSLVEKVKAETQEFFNLPLEEKKKFWQKPREVEGFGQAFVVSEEQKLDWGDIFFMSTLPTHFRKPHLFPKLPLPFRDTLEVYVVEMRNLALTMLSFMEKALKIEVNEMRKLFEQGLQGMRMNYYPPCPKPEQVIGLTPHSDSVGLTILLQVNEVEGLQIRKDGMWIPITPLPNAFIVNIGDILEIFSNGIYKSIEHRAVVNSVKERLSIATFYNPHMDAEIGPVPSLITPEFPALFRRVGVADYVKKLFSRELGGKSYLEVLRIDGKEEGQNI

SEQ ID NO: 57222 - protein, 560 aa, Magnetococcus sp. MC-1
MASYQYIYSMHRVTKVVPPNKRTILKDISLSFFPGAKIGVLGLNGSGKSSLLRIMAGIDKDFNGEAKAADGVKVGYLPQEPQLDPDKGVRGNVEMGLAEVKAAVDRFNEVSALFGEEMSDDEMNALIAEQGELQETIDHLDGWDLDRKMEIAADALRLPDWDADVTTLSGGERRRVALARLLLSQPDMLLLDEPTNHLDAESVAWLEQFLANYAGTVVAVTHDRYFLDNVAGWILELDRGEGIPWKGNYSSWLEQKDKRLEQEKKEEDGLRKRLQTELAWVQSSPSARRTKSKARLAAYEDLAAQHREKRRETNTLFIPAGPRLGEIVMEVQNLSKGFGGRLLIDNLNFTLPRGGILGIIGANGSGKTTFLRMLTQQQSPDSGSVRLGETVKLTYVDQSRDALEAEKSVWEMISDGNELIELGDREVNSRAYVSWFNFKGSDQQKKVKHLSGGERNRMHMAHLVKSGGNLLLLDEPTNDLDVETLQALESALLEFPGSAVVVSHDRWFLDRICTHMLAFEGNSEVVFFEGNYQEYHADYKKRCGDDAEQPHRIKYKPVVR

SEQ ID NO: 57223 - protein, 421 aa, Amycolatopsis lactamdurans
MALVVQKYGGSSLESADRIKRVAERIVATKKAGNEVVVVCSAMGETTDELLDLAQQVNPVPAGAEMDMLLTAGDGISNALVAMAISAQGAQAWSFTGSQAGVVTTAVHGNARIIDVTPSRVSERLEQGYVALVAGFQGVAQDTKDITTLGRGGSDTTAVALAAALNADVCEIYSDVDGVYSADPRIVPDARKLDSVPYEEMLELAASGSKILHLRSVESARRYGVPIRVRSSYSDKPGTTVTGSIEEIPVEQALITGVAHDRSEAKITVTGVPDHAGAAARIFRVIADAEIDIDMVLQNVSNTSSGRTDITFTLSKANGPKAVASLEKIKEELGFSSVLYDDHVGKVSLVGAGMRSHPGVTATFCEALCKVGVNIEIINTSEIRISVLIRDAQLDDAVRAIHDAFELGGDEEAVVYAGSGR

SEQ ID NO: 57224 - protein, 1024 aa, Oryza sativa Japonica Group
MATPARFSTKPHVFDGTDFSHWCSRMKSYIMVEDYDIWRKVSHPYVIPEAINTAAEKTALEQNCKARNILLSGISRSDYDRVAHLQTAHEIWIALSNFHQGTNNIKELRRDLFKKEYIKFEMKPGEALDDYLSRFNKTLSNLRSVDSFYDANYPQSEISRHFLNGLDMSIWDMKVTSIQESVNMSTLTLDSLYTKLKTHEMNILARKFEEEDLVLLSNKSSRAMKNVRNKKRGKPNRCFECGALDHLRSHCPKLERGKKEDDGRVKDDDVNKKKNMKEKEKKNHCMQWLIQEIIKAFDESEDEDESKGKQVVDTAFIARNASSDVDESDDDNEEKLSYDQLEYAAYKFAKKLQTCSIVLDEKDNTIEILNAEIARLKSLIPNDDNCQSCEVLFSEINALRDVYSVNCKKLEFEIEKSKKLESSFALGFALHARVVDELILTNNEVSYLKSSLQRFSEGKKNLNMILDQSKKKEREITFAKRRWQKSGFNLRTTVRPALTSRSDRPAVRPQLNRRSDRLPGPVRPQVQQWSDRPRGNFSRNSNQAFVKRQDDSMPRESICGDGPGVGLVSNRQLTGGQTGGTAAVRPAGTRRSDRRRQESAAGNLGGSTDRSTSVRPTFIKRSDRRNNFGGRTRGRMCLENLPWGSCSGLDVPRAPLAGGCTQGWTYPEHHPRWLRSGANVLRHNLRERSNFNAEVFALGRCGPLRSDGNRSRLATTGSVSVYFRLYEELIAGHMRGTVRPRIQAAGPAGRRWLRLAATLRPISPATAAVRYPLFPLACGRGGQVPAVTMAKEVDRFVELVVVRHGETSWNASRIVQGQMDPELNEIGKQQAVVVARRLAREARPAAIYSSDLKRAAETAEIIAKACDVSNLMLTEALRERHMGYLQGLMWDDAVNKSPSVFKGFANFEVKNGLDFDDRNHELPGGGESLNQLSERCISYLNKVAQNHIGERVIVVGHGAAILELCRHTDPPNRSIRRKIPNTSLNIFRISGVTGRWILERCGDVGHLSENGFLENVFGGDGASA

SEQ ID NO: 57225 - protein, 273 aa, Colwellia psychrerythraea 34H
MNKIAFIGAGNMARAIIIGLVNSGITPQDIIVANPSETKRLNLATEFGVLQTNDNIKASEFADVIVLCVKPHFITDVCFQISQAIDIAGKLFISVAAGTTVAQIQSALSKDDTLNLAPVVRVMPNTPSQLGLGMSGLFASKEVAVEQKANAEKITNAVGKSIWLDTEDKINNIIAVAGSAPAYYFLFMEAMEQQAKQYGFSAEESRMLVQQTALGAAQMVAHNSAPISELRANVTSKGGTTHAAIERFKADGIEEIVKNAMNAAIARAVEMAK

SEQ ID NO: 57226 - protein, 259 aa, Alkaliphilus metalliredigens QYMF
MRNTEYLMEQFSLSGKVAMVTGGNSGIGFAIAKNFARAGADLFIYSHSTRNIDVVKAEIEAIGSQVKFAQGNLDQEEDAMEAVEKCIEAYGKIDILLNNAGTIHRAPLLEGDNEGWKNVIDLNLSSIYYLSKVAAKYMVANGRGKIINIASMLSFQGGKFVPSYTASKHGVAGLTKAFANELADKNIQINAIAPGYIETANTAPIRADEKRNAEILGRIPAARWGKPEDLGATAVFLASNASNYMNGHVLCVDGGWLVR

SEQ ID NO: 57227 - protein, 361 aa, Oryza sativa Japonica Group
MMRGKDDSRGYAFVNFRTKGLALKVVKELNNAKLKGKRIRVSSSQAKNKLFIGNVPHSWTDDDFRKAVEEVGPGVLKADLMKVSSANRNRGYGFVEYYNHACAEYARQEMSSPTFKLDSNAPTVSWADPKNNDSVSTSQVKSVYVKNLPKNVTQAQLKRLFEHHGEIEKVVLPPSRGGHDNRYGFVHFKDRSMAMRALQNTERYELDGQVLDCSLAKPPAADKKDDRVPLPSSNGAPLLPSYPPLGYGIMSVPGAYGAAPASTAQPMLYAPRAPPGAAMVPMMLPDGRLVYVVQQPGGQLPLASPPPQQAGHRSGSGGRHGGSGSRYGGGGGSSGSSRPGAKRQRGDDNSSSRHKGRRRPY

SEQ ID NO: 57228 - protein, 501 aa, Oryza sativa Japonica Group
MPRTDNAASANSVEPDKSEECLEFDDEEEEVEEEEIEYEEIEEEIEEEEEVEEDEDVVEEVEEVDEEEDEEEDEESDETEGVSKTKGVHQKDVTEKGKHAELLALPPHGSEVYVGGISSDVSSEDLKRLCEPVGEVVEVRMMRGKDDSRGYAFVNFRTKGLALKVVKELNNAKLKGKRIRVSSSQAKNKLFIGNVPHSWTDDDFRKAVEEVGPGVLKADLMKVSSANRNRGYGFVEYYNHACAEYARQEMSSPTFKLDSNAPTVSWADPKNNDSVSTSQVKSVYVKNLPKNVTQAQLKRLFEHHGEIEKVVLPPSRGGHDNRYGFVHFKDRSMAMRALQNTERYELDGQVLDCSLAKPPAADKKDDRVPLPSSNGAPLLPSYPPLGYGIMSVPGAYGAAPASTAQPMLYAPRAPPGAAMVPMMLPDGRLVYVVQQPGGQLPLASPPPQQAGHRSGSGGRHGGSGSRYGGGGGSSGSSRPGAKRQRGDDNSSSRHKGRRRPY

SEQ ID NO: 57229 - protein, 436 aa, Vitis vinifera
MPEIERGSGSGAASATSSEKALFGKYELGRLLGCGAFAKVYHARNIRTGQSVAIKAICKKKIVGSNLMANVKREISIMRRLQHPHIVKLYEVLATKTKIYCVMEFVKGGELFAKVAKGRFSEDLSRRYFQQLISAVGYCHSRGVFHRDLKPENLLVDENGCLKVSDFGLSALTDQIRLDGLLHTLCGTPAYVAPEILTKKGYDGAKVDVWSCGVILFVLNAGYLPFNDPNLMAMYKKIYKGEFRCPKWMSPDLKRFLSRLLDTNPNTRITVDEILQDPWFRKGYKEVKFHEEDFGLKSEKEDRSPTNLNAFDIISFSSGLNLSGLFNDSSKSSPDDDERFVSAEPVEKIIEKIEEIAEGENLTVNWKKEWGVDLQGPNGNFIIGVQIDRLTHDLVVVEVRRRAGDAAAYAAAWKDKLRPALAGLMFQGPETQVAGD

SEQ ID NO: 57230 - protein, 413 aa, Cryptococcus neoformans var. neoformans JEC21
MSFTNFWAGVPEGPPDPILGVTDAFKKDTSPKKVNLGVGAYRDEDGKPYVLDSVLKAEDILHKKRLDKEYLPITGAADFIKLASELAYGKDSKPLREGRVAVSQSISGTGALRIATGFLSSFYSGPKVIYLPNPTWGNHVPLAESVGIKVERYRYFDKKTVGLDFEGMKEDIKNAESGSIILLHACAQNPTGIDPTQEQWKELSDLLKAKKHLPLFDMAYQGFASGDIIRDAFAVRYFVEQGHQIILCQSFAKNLGLYAERAGTFSMVCASPEEKERVMSQIKRVVRPLYSSPPIHGAQLVATILGTPELYDEWLTEVKKMADRIIAMREKLYNLLIELKTPGEWGHIKSQIGMFSFTGISKEQVDDLAEYAHVYMTKDGRISMAGLNEHNIQYFAESLSKAVKGELRTKSAL

SEQ ID NO: 57231 - protein, 424 aa, Arabidopsis thaliana
MQAATSCDLKFRSTDPTSRNKCFSHAIPKRVAVTCGYRSESFSFPNGVSVSRSDWQSSCAILSSKVASVENTGGLADKIAAVNGHTNGSVNLGLVAVESTNGKLAPAQPLTITDLSPAPLHGSSLRVAYQGVPGAYSEAAAGKAYPNCDAIPCDQFDVAFQAVELWIADRAVLPVENSLGGSIHRNYDLLLRHRLHIVGEVQIPVHHCLLALPGVRTDCVSRVISHPQALAQTEHSLDVLTPHAAREAFHDTAAAAEYISANDLHDTAAVASARAAELYNLQILADGIQDDPGNVTRFLMLAREPIIPRTDRPFKTSIVFAAQEHKGTSVLFKVLSAFAFRDISLTKIESRPHHNRPLRVVGDGSFGTSKNFEYMFYVDFEASMAEPRAQNALAEVQEYTSFLRVLGSYPMDMTPWSMTSTEEA

SEQ ID NO: 57232 - protein, 745 aa, Thermoplasma acidophilum DSM 1728
MESNNGIILRVAEANSTDPGMSRVRLDESSRRLLDAEIGDVVEIEKVRKTVGRVYRARPEDENKGIVRIDSVMRNNCGASIGDKVKVRKVRTEIAKKVTLAPIIRKDQRLKFGEGIEEYVQRALIRRPMLEQDNISVPGLTLAGQTGLLFKVVKTLPSKVPVEIGEETKIEIREEPASEVLEEVSRISYEDIGGLSEQLGKIREMIELPLKHPELFERLGITPPKGVILYGPPGTGKTLIARAVANESGANFLSINGPEIMSKYYGQSEQKLREIFSKAEETAPSIIFIDEIDSIAPKREEVQGEVERRVVAQLLTLMDGMKERGHVIVIGATNRIDAIDPALRRPGRFDREIEIGVPDRNGRKEILMIHTRNMPLGMSEEEKNKFLEEMADYTYGFVGADLAALVRESAMNALRRYLPEIDLDKPIPTEILEKMVVTEDDFKNALKSIEPSSLREVMVEVPNVHWDDIGGLEDVKREIKETVELPLLKPDVFKRLGIRPSKGFLLYGPPGVGKTLLAKAVATESNANFISIKGPEVLSKWVGESEKAIREIFKKAKQVAPAIVFLDEIDSIAPRRGTTSDSGVTERIVNQLLTSLDGIEVMNGVVVIGATNRPDIMDPALLRAGRFDKLIYIPPPDKEARLSILKVHTKNMPLAPDVDLNDIAQRTEGYVGADLENLCREAGMNAYRENPDATSVSQKNFLDALKTIRPSVDEEVIKFYRTLSETMSKSVSERRKQLQDQGLYL

SEQ ID NO: 57233 - protein, 412 aa, Solibacter usitatus Ellin6076
MNIPAIPPLALMLDTSGSAHIPLSMLIIFVSAKLMAELFERVNQPGIVGEILAGVLIGPSVLGLIGPSEFLTALADLGAMFLLFRVGLDVRSSELLQVGGTATVVACSGVVVPFLFGWGILTAWGASANEAIFVGASMVATSVGITAQVLSAKGLLHAISSKIILAAAVIDDVLGLLVLAVVSSLTHGQLNIPALALTAVMAVGFTLVIAKWGTHAMGRVVPHVDQKLRVGEAQFALAMSVLFALSVAAVYIGVAAIVGAFLAGLALAESTGQRVRDLAHGVTELLVPFFLAGIGLHVSLAAFSSPRNALLAVVILLAAVVSKFIGCGLGALGLGKADALRVGVGMIPRGEVGMVVAQIGLGFGIITQNVYGVVVFMSVATTIVAPPLIKIAFRGLLKTGQAEAPEEVFRIG

SEQ ID NO: 57234 - protein, 101 aa, Arabidopsis thaliana
  misc_feature (60)..(60): Xaa can be any naturally occurring amino acid
  misc_feature (71)..(73): Xaa can be any naturally occurring amino acid
SLVPPPPPPRVKKVYGANINIIVTGHSMGGAMASFCGLDLVVNEGEENVQVMTFGQPRVXNAAFASYYSLXXXLTFFFLLKTPGFFFPPPPPAPLSHPFLY

SEQ ID NO: 57235 - protein, 336 aa, Thermoplasma acidophilum DSM 1728
MKAALLEKLNQPLSIVDREIPEPGENEVVIKQDYAGLCYRDILSATGFFPRIQLPIIPGHEIGGTVVKTGSEVRNFHVGDHVASLIYIPCGKCEYCRSGNENLCPYKKSIGEEVQGGFREYVNVPEISLISAPKEVDTRYLPIASCVTGMIYHALFKLAKVKEGQRVLITGAGGGVGSNAVQMAKAFGATVIAETTSESKKEMLEKIGADYIVDGNGKFNEDVKKIGGADIVLECVGIHTFERSLRSLNNGGKMIVIGNIKPDPVNLPLGLIILKGNTIRGSISSTRKDVSDALKMVAENRIKPVIGSEVSIDRINEAMEMMKNKQTEGRVLIKFS

SEQ ID NO: 57236 - protein, 201 aa, Mycobacterium smegmatis str. MC2 155
MPGQPSTDPVVPRARVANLANVLTGIRMALVPVFLVFLFTDGGHEFFWRMAAFTVFAVAVITDRFDGALARSYGMVTEFGALADPIADKALIGAALIGLSMLGDLPWWVTAVVLAREIGITLMRLAVLRHGVIPASRGGKLKTTVQAVAIGLFVMPLYAWSPVWTTVAWAIMWAAVVLTVLTGADYVVSAIRDSRGRPADN

SEQ ID NO: 57237 - protein, 502 aa, Arabidopsis thaliana
MLAKIVVDFQNCLIFILISLFSLLCLFVFVFKKPKDSRGCDLPPSPPSLPIIGHLHLILSTLPHKSFQNISSKYGPLLLLRFFNVPVVLKSSANVAYEIFKTHDVNISSHGHPPIDECLFFGSSSFVVAPYGYYWRLMKKLMVTKLFGPQALERLRHVREDELERFHTNLLSKEMKGETVQIAKEAIKLTNNSVCKMIMGRSCLEENGDAARVRGLVTETFALVKKIFLTQVLRRLFEILGISLFKKEILGVSRKFDEFLEKILVEHDEKPDFQGGDMMDVLLAAYRDENAEYKITRNHIKSLFAELILGGTDTSAQTIEWTMAEIINKPNILEKLRKELDSVVGKTRLIEEKDLPNLPYLQSVVKEGLRLHPPAPVFGRKVLEGCTIKGYYVPKNTALVVNAYAVMRDPHYWEDPDEFKPERFLTTSSKKEEEREQELKYIPFGSGRRGCPGVNLGYIFVGTAIGMMVHCFDWRVKGDKVNMDETAAALTLNMAVGRRDTC

SEQ ID NO: 57238 - protein, 74 aa, Clostridium thermocellum ATCC 27405
MFEKVRKIIAEQLGIEEDEITMESSFIDDLGADSLDIVELIMALEEEFDLEIPDSEAEKITTVGDVVEYIKNNS

SEQ ID NO: 57239 - protein, 268 aa, Wolbachia endosymbiont of Drosophila melanogaster
MHLFCFGYGYVAKFLSKKLLNLGWKVSGTSRSKNIQDVILFNYEKVSQDLLKSATHVLISIPPDGDDVVERYGDCLQNVKWFGYLSATSVYGDHSGNWVNEESETKPIEIRGEKRLRSEKRWLNSRLPVHIFRLAGIYGPGRNVLIDLQLGKARNVKKEGHFFSRIHVEDISNILFSSMQNIKPGEIYNCADDLPTTQSEVVIYATKLLNVSPPEPIELPDYAQSFYLGSKRVSNVKIKKDLNVSLIYPNYKVGLESLHVNKTEITSE

SEQ ID NO: 57240 - protein, 525 aa, Brassica rapa subsp. pekinensis
  misc_feature (6)..(6): Xaa can be any naturally occurring amino acid
MPLTEXIYNHLSLFDLSLALLGLFVFCCLREKLTNKHGPMLWPVFGITLEFFIHKNDVYAWVTKSLKKSRNTFLYRGFWLDGSHGAVTCSPANVEYMLKTNFKNFPKGTFFKDRFKDLLEEGIFNADDESWKEQRRVIITEMHSTRFMEHSFQTTQRLVRKKLLKVMESFARSQEAFDLQDVLLRLTFDIICIAGLGDDPETPAQDLPQVPFAKAFDEATESTLFRFMIPPFIWKPMRFLDIGYEKGLRKAIDVVHGFVNKMIMDRICMVNDDETLDNRSVLTRIIQIESHKKGNEIGPSTIRFFRQFCTSFILAGRDTSSVAISWFFWVIQRHPQVENKIIQEIREILKQRGDPSDSSLFTVRELNNMVYLQAAISETLRLYPPIPMEMKQAIEDDMFPDGTFIKKGSRVYFSIYAMGRMESVWGKDCEDFGPERWIHAGKFVSGDQSKYVVFNAGPRLCLGKTFAYLQMKMIAASVLLRYSIKVAQDHVVVPRVTTNLYMKYGLKVTITPRSLEEKILESFHM

SEQ ID NO: 57241 - protein, 127 aa, Colwellia psychrerythraea 34H
MAYSEKVLDHYENPRNVGSMDKNDPSVATGMVGAPACGDVMKLQLKISDDGIIEDAKFKTYGCGSAIASSSLVTEWVKGKSIEEAGEIKNTAIAEELALPPVKIHCSILAEDAIKAAIEDYKSKQSK

SEQ ID NO: 57242 - protein, 410 aa, Burkholderia pseudomallei K96243
MNPRLDTLQPYPFEKLRALFAGVTPSTPLPPISFGIGEPKHATPALIRDAAAAALDGLASYPATAGTDALRDTVARWLERRYGLPAIDATTQVLAASGSREALFSLAQAVIDSSPRENGATQDGERPIVLCPNPFYQIYEGAALLAGAAPYFVNSDPARNFAPDYSSVPADVWARTQLVYVCSPGNPTGAVLTLDDWRELFALSDEHGFVIASDECYSEIYFDETKPPLGGLEAAHRLGRDFTRLVMLSSLSKRSNVPGMRSGFVAGDAALLKRFLLYRTYHGAALSPVWQKASVAAWGDEAHVRENRALYAQKFATVTPMLAEVLDVRLPDAAFYLWANVARTGLSDNEFARRLYADYNVTVLPGSYLARDAHGANPGRDFVRIALVAGTAECVEGAQRIVDFCRGLAR

SEQ ID NO: 57243 - protein, 550 aa, Methanosarcina acetivorans C2A
MPETVIQYLLNRLKQLGIRDIFGVPGDYAFPINNAICDDKELRWIGCCNELNAAYAADGYARINGMSALSTTFGVGELSALCGIAGSYAEHNLVFHIVGMPATPVQERNALVHHTFGNGEFDQFMTMATPAVCAKTMLTPGNCIQEVERVIAAALGYRRPVYIAIPHDYVHENISHVHEKILSSQAPANVPVKSDPEVLEEAVSTIINRLSGAEKACIIPGIFVDRFGLKDLTTEVVNASGLPYVTMPMDKSVIDETNPSYLGLYMGQLVNPEIREFVESCDCVLTIGTILFDVNTGMFTAKLDRDRIISIVPYDVHIGYAGYTNLKMSDVLEELARRLRKRTDIRGPAARQPATPEVDAGSPITADYLYASCTKFFKPDDIIIADSGTSFYGLLPVFLPEGARLHSQTLWGAIGWATPASFGAALAAPDRRVILITGEGAHQMTAQEVSQFYRYGLKPIIFVLNNHGYLIERMLSRKLDYCYNDLAQWQYHKLPEALGCSGWVIRKATTCGDLDKIMAELDNAGTGAYVEITTPEMSAPPIMETVHSNL

SEQ ID NO: 57244 - protein, 129 aa, Zea mays
MQKIVVDETTTKRWVVDVAGAPGTLYTGETYKLQVDFSEHYPMEAPQVIFLHPAPMHPHIYSNGHICLDILYDSWSPAMTVSSICISILSMLSSSPAKQRPADNDRYVRNCRNGRSPKETTWWFHDDTV

SEQ ID NO: 57245 - protein, 205 aa, Clostridium thermocellum ATCC 27405
MNLPNKLTLSRIILVPVFMLLIIPIPEWIVNSNFLAFAHSQLENVNFFIKNYGNYMAAVLFFIAASTDGLDGYIARKRKQVTNFGKFLDPIADKLLVTAALVALVERGDLSSWAAIVIIAREFIITGLRLVAAGEGIVIAASKWGKIKTVTQIIAILTALLRGYLVDVLLGFPIDKVLMLVAVIATVYSAYDYIVKNGHVISQTR

SEQ ID NO: 57246 - protein, 338 aa, Vibrio sp. Ex25
MKVLVTGGMGYIGSHTCIQMIEAGMTPVILDNLYNSKSTVLERIEKVCGVKPTFIQADIRDKSTMVEVLKSHDIEAVIHFAGLKAVGESVAKPLEYYDNNVNGTLVLVDAMREAGVKSLVFSSSATVYGDPASVPITEDFPTSATNPYGRSKLMVEECLTDFQKANPDWSITLLRYFNPVGSHPTGELGEDPQGIPNNLMPFVSQVAVGRREFLSVFGSDYPTKDGTGVRDYIHVMDLSDGHVAALEKVGNKAGLHVYNLGTGNGYSVLEMVKAFETASGKDVPYQLVERRPGDIAECWADPSKAMNELGWKASRTLEEMTGDTWRWQSNNPQGYPDA

SEQ ID NO: 57247 - protein, 186 aa, Salmonella typhimurium
SLINTKIKPFKNQAFKNGEFIEVTEKDTEGRWSVFFFYPADFTFVSPTELGDVADHYEELQKLGVDVYSVSTDTHFTHKAWHSSSETIAKIKYAMIGDPTGALTRNFDNMREDEGLADRATFVVDPQGIIQAIEVTAEGIGRDASDLLRKIKAAQYVAAHPGEVCPAKWKEGEATLAPSLDLVGKI

SEQ ID NO: 57248 - protein, 62 aa, Methanosarcina acetivorans C2A
MIPVRCFSCGKVISNYWDEYKRRVTDGEGSAAVLDDLGITRYCCRRMFLSHVELVDVLSPYQ

SEQ ID NO: 57249 - protein, 314 aa, Pyrus pyrifolia
MATFPVVDLSLVNGEERVATLEKINDACENWGFFELVNHGISTELLDTVEKMTKDHYKKTMEQRFKEMVAAKGLDAVQSEIHDLDWESTFFLRHLPSSNISEVPDLEEDYRKTMKEFAVELEKLAEKLLDLLCENLGLEKGYLKKVFYGSKGPNFGTKVSNYPPCPKPDLIKGLRAHSDAGGIILLFQDDKVSGLQLLKDGEWVDVPPMHHSIVINLGDQIEVITNGKYKSVMHRVIAQSDGTRMSIASFYNPGDDAFISPAPAVLEKKTEDAPTYPKFVFDDYMKLYSGLKFQAKEPRFEAMKAKESTPVATT

SEQ ID NO: 57250 - protein, 590 aa, Saccharomyces cerevisiae YJM789
MKTCYYELLGVETHASDLELKKAYRKKALQYHPDKNPDNVEEATQKFAVIRAAYEVLSDPQERAWYDSHKEQILNDTPPSTDDYYDYEVDATVTGVTTDELLLFFNSALYTKIDNSAAGIYQIAGKIFAKLAKDEILSGKRLGKFSEYQDDVFEQDINSIGYLKACDNFINKTDKLLYPLFGYSPTDYEYLKHFYKTWSAFNTLKSFSWKDEYMYSKNYDRRTKREVNRRNEKARQQARNEYNKTVKRFVVFIKKLDKRMKEGAKIAEEQRKLKEQQRKNELNNRRKFGNDNNDEEEFHLQSWQTVKEENWDELEKVYDNFGEFENSKNDKEGEVLIYECFICNKTFKSEKQLKNHINTKLHKKNMEEIRKEMEEENITLGLDNLSDLEKFDSADESVKEKEDIDLQALQAELAEIERKLAESSSEDESEDDNLNIEMDIEVEDVSSDENVHVNTKNKKKRKKKKKAKVDTETEESESFDDTKDKRSNELDDLLASLGDKGLQTDDDEDWSTKAKKKKGKQPKKNSKSTKSTPSLSTLPSSMSPTSAIEVCTTCGESFDSRNKLFNHVKIAGHAAVKNVVKRKKVKTKRK

SEQ ID NO: 57251 - protein, 78 aa, Magnetococcus sp. MC-1
MSDIAERVKKIVAEQMGVDLDKVTDDAKFVEDLGADSLDNVELVMAFEEEFGCEIPDETAEKITSVSDAIKYIGENME

SEQ ID NO: 57252 - protein, 245 aa, Magnetococcus sp. MC-1
MQNRVAIVTGSTAGIGQEAAKLLAKRGCRVVITGTRETKIMETVEAIRAEGGVAAGVAANIGVDADLDKLVAFAQEQFGEVEILVNNAGITRDNLFMRMKDEEWDEVMALNLTSVFKLSKRVIRAMMKGRYGRIVNVTSVVGFSGNAGQANYTAAKAGLVGFTKSLAQEVATRGITVNGVAPGFIQTAMTDKLNEKTQEAILAQIPMGKMGSVEDIAAAIAFLASDEARYITGETIHVNGGMYMG

SEQ ID NO: 57253 - protein, 510 aa, Alkaliphilus metalliredigens QYMF
MKQELVLILDFGGQYNQLIARRVREHNIYCEVVPYKITAEEIKLKNPKGLILTGGPSSVYGESTPRCEEEIFQLDIPILGICYGGQLMAHTLGGKVNRAKNREYGKTALQVDGNSKLFKEVAQDSICWMSHTDFIETAPAGFKITGTTADCPVAAMENQEKALYAVQFHPEVEHTEKGKEILKNFLYEVCHCQGDWTMENYIEKEIEAIRNLVGDRKVLCALSGGVDSSVAAVLVHQAIGDNLTCVFVDHGLLRKDEGDWVEDIFRNQFEMNFIRVNAEERFLGKLKGVTDPELKRKAIGELFIRVFEEEAQKIGDFDFLVQGTLYPDIIESGTETAAVIKSHHNVGGLPEDMKFQLIEPFKFLFKDEVRIAGLELGVPEEIVWRQPFPGPGLAVRVLGEITEEKLHIVREADAIVRDEIIKAGLHRQIWQYFAVLPNIMSVGVMGDERTYAHTIGIRAITSSDAMTADWARIPFEVLENMSRRIVNEVEGANRIVYDITSKPPSTVEWE

SEQ ID NO: 57254 - protein, 349 aa, Yarrowia lipolytica
MTTIPKTQKAVIFETSGGPLMYKDVPVPVPADDEILVNVKFSGVCHTDLHAWKGDWPLDTKLPLIGGHEGAGVVVAKGKNVTTFEIGDYAGIKWINKACYTCEFCQVSAEPNCPKATMSGYTHDGSFQQYATANAVQAAHIPKNCDLAQIAPILCAGITVYKALKTAGLKAGEWAAVTGAGGGLGSLAVQYAKAMGYRVLAIDTGADKEKMCKELGAEVFIDFAKSKDLVKDVQDATKGGPHAVINVSVSEFAVGQSVEYVRTLGTVVLVGLPAGAVCKSPIFQQVARSIQIKGSYVGNRADSQEAIEFFARGLVKSPIIIVGLSQLESVYKLMEEGKIAGRYVLDTYK

SEQ ID NO: 57255 - protein, 181 aa, Magnetococcus sp. MC-1
MNLPNKLTVSRIVFIPFFIVTVYLSGRMGHLLSAGIFVLAAVTDWLDGYLARSRGQMTPFGKFLDPVADKLLVIAALMVLLAEQRIDIVVVLVLVAREIVVMALREFMAGKGGGVPVSQVGKWKTGVQMVAITMLLLGDALFGLPLQPVGLLLLYISALLAVWSAFLYVRSVWSHIIEGAV

SEQ ID NO: 57256 - protein, 302 aa, Cryptococcus neoformans var. neoformans B-3501A
MTSPPLPFYLLNAFAPTFHSGNQAAVVFFDSASDPQSTDEQFMTLVARDFNFAETAYLIPLDGNGEGCVGKYGLRWFTPEEEVALCGHATLAASQAVFSINPDFETIEFTTRFSGVLTARKIESKQVEITLPSLPKNILEAFDGKSSKEDLRKVSSVFGVEEEEIVAVSPFAFGSRSSVIVSLAPEVDLAKVEASEANLLAFSDGMIIVTQVAREQPDDQLHINSRVFAPGLGVIEDPVAINPYLEIADRIRPCPSHWVLRKFTIDCQASPEKVCRQPAHDCTQWDTVEQKRRKTHLYMGRL

SEQ ID NO: 57257 - protein, 132 aa, Triticum aestivum
MAAPSPAVAAVSSSAPSSGLLPPRRAAPCSAVPLPSMRSAAPGVRMATVAHAVGDVAAEGNTFLIDGAVAVALDGTAFTIFFSRKDTCPECDGAGFVRKSGSTLRANAARNDQAQIVCANCNGLGKLGQIDK

SEQ ID NO: 57258 - protein, 298 aa, Magnetococcus sp. MC-1
MSPARRQILRDRIAMSHANRVVAFQGAHGAYSEQACREKLPGYQSRPYKTFEDIFIAVEQGDAELGMLPVENSMAGVVSDSYDLLAVHNLHIIGEYYLPVRHCLMAHQGVNVERIHTVYSHPQALAQCHSFIKRHGWNRVAVYDTAGAAAALKEEHREGEAAIASALAAELYGLDLLAEQIQDSANNTTRFLIIAKDGIIPMPNVGCKISLLFEVRHIPAALYKCLGGFATNGINLTRLESRPVAGRDWSYHFYLDFQGRMDQVNVQQALEELKFYTHNMKVLGCYPESLRPESQGAL

SEQ ID NO: 57259 - protein, 363 aa, Prochlorococcus marinus subsp. marinus str. CCMP1375
MLKVGIVGLPNVGKSTLFNALVANAQAQAANFPFCTIEPNVGTVSVPDDRLKLLGALSDSKELVPTRIEFVDIAGLVKGASQGEGLGNKFLSNIREVDAIVHVVRCFEDENVIHVSGSVDPVRDIEIINLELGLSDLSQIEKRRERLKKQIRNNKESQVEDQILEKIHLEIEQGGVARSVTLLDEERQLIKPLGLLTAKPIIYASNLTEDELSLGNVFSKNVKELAENESSENVRISAQVEAELIELGEFERQDYLAGLGVQEGGLQSLIKASYNLLGLRTYFTTGEKETKAWTINSGMTAPQAAGVIHTDFERGFIRAQTINYEKLLTAGSLLEAKNKGWIRSEGKEYIVQEGDVMEFLFNV

SEQ ID NO: 57260 - protein, 191 aa, Solibacter usitatus Ellin6076
MRCYDSECMSLYDLEPGPDCPELVRMIVEIPKNSSNKYEYDGKLGVFRLDRSLYSAVHYPGDYGFIPGTLAEDGDPLDVLTLVDVPSFPGVLMMVRPVGVLAMVDQEEPDEKILAVPNHNPRFDQIHTIDQVFQHNLREIEHFFAIYKELEGKRTVMQGWKGPREARDVIRRSRERYLAAHPELQLDPEAS

SEQ ID NO: 57261 - protein, 562 aa, Cryptococcus neoformans var. neoformans JEC21
MTDLDKVLELLNNLTVKQEQLAQELKNHTCSCGAQYHYDPTAHHSPPTSPTAGGVDTFRASRGSISSLSALLGSSPTSTSGFSPAPNGVANNSGASNGSSTPYGNLSLDAAARGSGAPGGLVPPEKDAKKKHKGLYPSRVILTTYPSQAGINPIPINWGAGPTARERGPVVCSRIKSNLPIRNAIGAHAGSYSIYRALSIAMGQLRPDWRPDLTNTHPPFVLPPTDGWFGNKIVSFDPWGAMSQEVWAKEYAAGLDVRPTISQTKAHIKIQELDELFRKGEFPCDGEIVIKSPDLPAFPGADQGIEVNTYKAAIDPVWYLPGVADRLGIEEGVLRRALFEDTGGMYPELLTRPDIKTFLPPIGGMTVYIMGDPAKLQDPDTEVTCRPHDSCSGSDVFGSDICTCRPYLIFGISEAIKCAQRGGVGVIVYFQKEGRALGEVVKYMVYNRRKRGGDTAAEYFNNTERVAGVKDARHQALMPDVLHFLGIKHIHNLISMSNMKYDAIIGSGITVGKRYEIPEELIPADGRVEIDAKIQSGYFSKKEVTEELVKETKGRNWEDIIH

SEQ ID NO: 57262 - protein, 1063 aa, Burkholderia sp. 383
MKSSSLVPQPPLKPVIGHLMEVLGPSPLAKMMDLARTYGPVYWFEVFGQGYYVVSGQTLVDEVCDETRFQKCVHQSLLELRPAIGDGLFTAFGDEPNWAKAHRVLMQAFGPLSIWSMFDKMVDIADQMFLHWERFGPETPVDVSDHMTRLTLDTIALCAFDCRFNSFYREDQHPFVDAMVNTLSEAGKRELRPKLVSKLMVKRSRQFDADIEVMRSLATKMIEDRRKNPHVNEESMDLLDRMLNGIDPVTGEKLDDENIVFQMITFLIAGHETTSGLLSFATYFLLKNPDILQKARDMVDEVVGSETPRIEHLARLRYVEQILMETLRIWPTAPGFAVKPLADTTFGGKYAVSPDDIIMILTPMLHRDVSVWGEDVEAFRPERFAPENAEQLPPNSWKPFGNGARACIGRPFAMQEAHLVLIMLLQRFDFSFADPDYELDVAETLTLKPAGFRVNVKPRARGALKVPDTALHARSNAQSPSVAPVQSIAPGEDLSNLLVLFGGNTGSAESFARRIAGDASRHGFHATCAPLDDFAGKLGGYPAIVIVTASYEGQPPDNAKSFVPYVEALDEGALDGVHFSVLGCGNKQWARTYQAIPKRVDEALEKAGATRVHFRGELDSGGDFFGEFDRWYTEMWNRFAISAGKEIPVIQHDDVALKVSFAGSSREKVLNLGDMAHASIVDNRELVDISVAGSRSKKHIELKLPEAMTYRSGDYLAVLPRNAKNNVDRVLRRFRVSWDTQVVIEGTSSNPRLPLGQAIGCGELFSSYVELAVPATRSQVSSLAAATRCPPEKVELERLSADGFECEILGKRTTVMDLLERFGSVDLSLEKFLDMLPALKARQYSISSSPLWKADHVTLTVAVVDAPALSGNGRHEGVASSYLARLNTGDSLSVAVRPSNARFRPPAEPDLPMILICAGSGIAPFRGFLQERALQKQRGENVGTSLLFFGIDDPDVDFLYRDELDEWARCGVVEVMPAYSNRPEEGARFVQDKVWLERERISALFSQGATVFVCGDGKNMAPAVRATLGRIYQETTGENDESASAWIDTMEREHGRYVADVFA

SEQ ID NO: 57263 - protein, 552 aa, Cryptococcus neoformans var. neoformans B-3501A
MPSGAVTSEQIRAADIGTTILKAGGSAADAIIATVLAVNTLSPYHSDIGGGGFAIVKEPGDSGQVKCLDFRQCAPEGATPELFKTSNTSTSVGGLAVAVPGELKGLEELHKAYGTLPWSRLFKESIELAEGGMEVRGDLYDFITQEANPAGSSNMRGTWMMEDPTYTSLITKDGQAIPIGSIWKRPEYATTLRKIAAEGAAAFYQGEIAEGLVKAVRARDGVMTVDDLKNYKLKWREPLSTKFKDYTLYAPPAPASGAIWLSVMGMLSQFEPAGYGSVTDLHRLTEALRLAYGQRTALGDPAYIDGVEEKQRDWLTEKRIKARARMIDENHTKEPDYYKPPKVALDFDNGTSNITATDSSGLTISITTTVGLGWGSRIMVPGYGFVLNGSMDDFSVEGRPNGFGYEPQVTNYVAGGKRPLSSSCPYIITNSTGKVIASGGAAGGSTIISSNAQVALFVLVYGFSASQALAANRLHNQILPNVTKVERGSNVRGVRVEGFSEEQVEGLKQKGHVIEWVDKSFSTPCVMVWTDDGWEGDGDPRKHDSGGSVYHE

SEQ ID NO: 57264 - protein, 454 aa, Prochlorococcus marinus str. AS9601
MEFEFDLIVVGAGSGGLAAAKRAASYGAKVAIIEANQIGGTCVIRGCVPKKLMVYAAKSKKNMDSSEGYGLKNEGINFESNILLKNVREEVSRLSNLHRSSLKKLNITIFEGLGRFITQNELEIICSNTKKIKNKISSKKILISVGGKPKKLNIPGVDLAWTSDDIFELEKFPKSILIVGGGYIACEFASIFRNLGTEVTQLIRGQHLLNGFDEDLSSCLEESPTFADINIIPNTQLNSIKKVNGNLESTLDSGDKLLTNNILIATGREPNLLPLNLDFLNLKMDGQYLDVDELNQTSNANIFAVGDIINKPNLTPVAIEQGRVFSDNFFNDQKRKVNYEYIPKAVFTIPEISTVGLSEKRAKEIYSEKNIKIFKCKFTPMSNTFKKNKSKCMLKIVVHKLTDKVLGCHMFGETSSEIIQMVSISLNAGITKKDFDITMALHPTISEEFVTMYG

SEQ ID NO: 57265 - protein, 560 aa, Psychrobacter arcticus 273-4
MPNQRPLYIPFSGPALLETPLLNKGSAFSSEERDSFNLTGLLPHNIETIEEQSLRAYHQLRSFTTDIDKHIYLRNIQDTNETLFHHLIEQHIEEVMPLIYTPTVGQACEKFSQIYRRKRGLFISYPDRHKIDDMLQNATKQKVKVIVVTDGERILGLGDQGIGGMGIPIGKLALYTACGGISPAYCLPILLDVGTNNQQLLDDPMYMGWRNQRISGDEYNEFVDLFIQAVKRRWPEVLLQFEDFAQENATPLLNRYRDQLCCFNDDIQGTAAVSVGTLIAACLNKGQKLSQQKIAFLGAGSAGCGIAEHIIRQMQREGLTEEQARKQVFMVDRYGLLTDSMTELQKFQAPLVQKESAIESWDKSQKLGLAQVVKQAKITVLFGVSGQKGLFTREVIEALCVNTEHPIVLPLSNPTSRVEATPQEVTSWSRGKAIVATGSPFPNTTFEDQSFEISQCNNSYIFPGIGLGVLAAHATGISDNMLMSASQALADISMEYEKAPGAILPPIKFIREISEKIAYAVALQAIEDKLALPVTAENLERRLKANFWLPRYHNYRRTSF

SEQ ID NO: 57266 - protein, 391 aa, Psychrobacter arcticus 273-4
MSLQNPIFIPGPTNIPDRLRRAMNVPTQDHRAPDFSDTFLPVLADCKKVFGTQDSEIILFTSSGTGGWEAAISNTLSPGDKVLIARYGMFSHRWIDMCQRHGLDVQVIECPWGTGAPADQFQAILSEDTAHEIKAVMVTHNETATGVLSDIGAVRKAIDSSNHPALLFVDGVSSIASVPFEMDEWGVDVAVAGSQKGFMLATGMAILGVSQKALSHMDEAKLPRTYFDFRDMLKANANGGFPYTPPLNLIYGLRESLEMLFDEGLENVYARHYRLAEGVRQAVSAWGMILCAKTPDLYSNTVSAIFVPEGFNSNKLTDHAFNKYGISFGIGLGEMNGKAFRIGHLGSLTEVMVLAGLAAIEMAMVDLDYPIKLGQGVAAAQEYYRNTATTK

SEQ ID NO: 57267 - protein, 506 aa, Antirrhinum majus
MSTLVYSTLFILSTLLLTLLTRTRRKTRPPGPLALPLIGHLHLLGPKLHHTFHQFSQRYGPLIQLYLGSVPCVVASTPELAREFLKTHELDFSSRKHSTAIDIVTYDSSFAFAPYGPYWKFIKKLCTYELLGARNLSHFQPIRALEVNSFLRILYEKTEQKQSVNVTEELVKLTSNVISNMMLGIRCSGTEGEAEVARTVIREVTQIFGEFDVSEIVWFCKNLDLQGIRKRSEDIRRRYDALLEKIISDRERLRLRGGGGGGGGEVKDFLDMLLDVMESEKSEVEFTREHLKALILDFFTAGTDTTAITTEWAIAELISNPNVLKKAQEEMDKVIGSQRLLQESDAPNLPYLNAIIKETFRLHPPIPMLTRKSISDVVVNGYTIPAKTLLFVNLWSMGRNPNYWENPMEFRPERFLEKGTGSIDVKGQHFELLPFGTGRRGCPGMLLGMQELFSIIGAMVQCFDWKLPDGVKSVDMTERPGLTAPRANDLVCQLVPRIDPVVVSGP

SEQ ID NO: 57268 - protein, 388 aa, Arabidopsis thaliana
MMISDLPHDLESEILSRVPAKSLAKWKTTCKRWYALFRDPSFVKKNFDKAGGREMIVLMNSRVYSNSVNLQGINNRFDPSMEVTGKLIKLNDSKGVDISAIFHCDGLILCTTTESTGLVVWNPCTGEIRCIKPRIFYRCNDRYALGYGNSKSSCHSYKILRSCCYYVDQNLSLMAAEFEIYDFSTDSWRDLGDITRDMIVYSSGVSLKGNTYWVSGSKEKGFFMRYFDFSKEVFGRLPLPYQSFNANHTAALSAVGNEKIAVLQQKILAMSDEMRIWVTNKIDEAKDLSWSNFLLTVDYGKFNLPCLVNVTSFLLDEENKVAVCSDVDTKDGLRSRIYIVGKDFYKEVFKDTRGSDNNWPLLLCYVPSLVSIQENIPNKAEENEIKGG

SEQ ID NO: 57269 - protein, 426 aa, Oryza sativa Japonica Group
MATADEVGGGGGGGGAGVGAGDQVRRAKTAALFLAAVALPCLVLYRAAVSPAGLFLRPAALPGPPRGDVDPVNSEDARLERVLRAAAMANGTVILTTLNSAWAEPGSVVDVFLESFRIGDETRWLLDHLVMVSLDLTAHRRCLQIHRHCFALTTDDGFDFSGEKNFMTDGYLKMMWRRIDFLGHVLAKGYSFIFTDTDIVWFRNPLPHLHHDGDFQIACDHFTGDPDDLSNSPNGGFAYVRSTSATAAFYRYWYAARERHPGLHDQDVLNLIKRDAYVARLGVRIRFLSTDLFAGLCEHGRNLSTVCTMHANCCVGLRRKVDDLGLMLQDWRRFMATPGSDRHSVTWSVPRNCSMKKLGRLEPTLAVVCTIDEMLTGTNEHAVLSKLGSDSTNLVKTWSRMTEMLRVWCNNRKVSPTAADADAMDD

SEQ ID NO: 57270 - protein, 512 aa, Torenia hybrid cultivar
MDTVLITLYTALFVITTTFLLLLRRRGPPSPPGPLSLPIIGHLHLLGPRLHHTFHEFSLKYGPLIQLKLGSIPCVVASTPELAREFLKTNELAFSSRKHSTAIDIVTYDSSFAFSPYGPYWKYIKKLCTYELLGARNLGHFQPIRNLEVRSFLQLLMHKSFKGESVNVTDELVRLTSNVISHMMLSIRCSEDEGDAEAARTVIREVTQIFGEFDVTDIIWFCKKFDLQGIKKRSEDIQRRYDALLEKIISDRERSRRQNRDKHGGGNNEEAKDFLDMLLDVMESGDTEVKFTREHLKALILDFFTAGTDTTAIATEWAIAELINNPNVLKKAQEEISRIIGTKRIVQESDAPDLPYLQAIIKETFRLHPPIPMLSRKSTSDCTVNGYKIQAKSLLFVNIWSIGRNPNYWESPMEFRPERFLEKGRESIDVKGQHFELLPFGTGRRGCPGMLLAIQEVVSIIGTMVQCFDWKLADGSGNNVDMTERSGLTAPRAFDLVCRLYPRVDPATISGA

SEQ ID NO: 57271 - protein, 646 aa, Burkholderia pseudomallei K96243
MIRFNQFSLARGTKPLFDATSFTLNPGEKAGLVGANGAGKSTLFAVLRGELHADAGDFSMPPAWRIAHVSQETPAVERSALDYTLDGDAALRAIEARIAQASAAHDGAAEADAHAAFADADGYTAPARAEALLLGLGFTLAQTREPVASFSGGWRMRLNLAQALMCRSDLLLLDEPTNHLDLDAIVWLEDWLHRYPGTLVIISHDREFLDAVCDVTLHLENRQVKRYGGNYSQFEVLRAQQLELQQSAYEKQQKTIAHLQSFVDRFKAKASKAKQAQSRVKALEKMERIAPAHIASPFTFEFRTPDSAPNPMLVMENVRCGYRADDGGEIPIVERVALSIQNGQRIGLLGANGQGKSTLIKTLAGTLAPLSGELRTGRGLTIGYFAQHQLETLREDDSALAHLARLAPDTREQELRDFLGGFNFSGEMATAPIAPFSGGEKARLALALIIWRKPNLLLLDEPTNHLDLETRHALTMALAQFEGTLILVSHDRHLLRATTDQFMLVAKHRLQPFDGDLDDYRDWLLQHAAEQRAAAKAACGPAGDADDGAPAVNRKDQKRQEAEARQRLSQLKKPLQARITKIEKEMERLHAQKAELDAFVADPASYAADQKTRLTEAIRKLGDVNGQLETLEADWLGAQDELEKIG

SEQ ID NO: 57272 - protein, 233 aa, Clostridium thermocellum ATCC 27405
MAIKTRIIFVRHAEAEGNLNRVFHGWTDSSITERGHLQAQRVAQRLKDVDIDVIYSSSLKRTLQTAQYIADVKNLPIIRTDKLKEINGGDWENREWEELPKLWPEEYDSWENRPHEHKMPGGESMVEFQKRLIDEVKYIIDNNKGKNICIVTHGTAIRSMMCYFKNCDLTEMINIQWYDNTSVTILDYEDGKFNIVLEGDTSHLEKELCTVQNQEWWQEYNKKYEERIKKESM

SEQ ID NO: 57273 - protein, 722 aa, Psychrobacter arcticus 273-4
MIKKIVLIFAVLIGVIGFFYFDLNELLTLEGLKGSMDQFEQYKTQSPWLVIGGFFVVYILVTALSLPGAVILTLAAGALFGLVQGILVASFASSIGATLAFLTSRYLLRDTIKQRFPDRLASIDSGVKKEGGFYLFTLRLVPIFPFFLINLLMGLTAIKVRTFYWVSQIGMLAGTFVFVNAGTQLAKIEQLSGILSFNLLASFALLGLFPLIAKGILTILKKRRIYKNHTKPKKFDRNMIVIGAGAGGLVTSYIAATVKAKVTLIEAGEMGGDCLNYGCVPSKALVKSAKVVEQIRHGKRYGLNNTQPDFAFKNIMSRIHEVIADIAPNDSVERYTSLGVEVLKGYAKLIDPWTVEIALNDGGTQTLTARSIVIATGARPFVPDLPGLEETGYVTSDTLWDKFAKFDKVPSKLVVLGGGPIGCELAQSFARLGSAVTQIERGARLMKKEDVDVSVFAQEALTESGVNILTSQQAIRCETRNGKKYIIVAPKGGNDDQQETAIEYDELICAVGRSARLEGYGLDTLGIDTERTISTDEYLETLYPNIYAAGDIVGPYQFTHVAAHQAWYAAVNGLFGHLKKFKVDYRVIPWSTFIDPEVARVGLNEQEAINKGIDFEITRYDFKDLDRAVTESANHGFIKVITPKGKDKILGVTIVAEHAGDLMAEFVLAMKHNLGLNKILGTIHIYPTWAEGNKYAAGEWKRNHAPKKALQLLEKYHTWRRG

SEQ ID NO: 57274 - protein, 446 aa, Pyrus pyrifolia
MAIDIEQQQQPSPGLSKIAVSDTHGEDSPYFAGWKAYDENPYHESSNPSGVIQMGLAENQVSFDLLEKHLEENSEASNWGSKGSKGVSGFRENALFQDYHGLLSFRKAMASFMEQIRGGRAKFDPARVVLTAGATAANELLTFIIADPGDALLVPTPYYPGFDRDLRWRTGVNIVPIHCESSNNFQITPQALEAAYKEAEAKNMRVRGVLITNPSNPLGATIQRAVLEEILDFVTQKNIHLVSDEIYSGSAFSSSEFISVAEILEDRQYKDAERVHIVYSLSKDLGLPGFRVGTVYSFNDKVVTTARRMSSFTLISSETQHLLASMLSDKEFTGNYIKTNRERLRRRYDMIVEGLKKSGIECLKGNAGLFCWMNLSPFLDEPTRECELTLWDSMLHEVKLNISPGSSCHCSEPGWFRVCFANMSEQTLGIALTRIHNFMEKRERAC

SEQ ID NO: 57275 - protein, 357 aa, Clostridium thermocellum ATCC 27405
MKAILALEDGTIFHGESFGAQGEVIGEIVFNTGMTGYQEVLTDPSYCGQIVAMTYPLIGNYGVNSEDIESEKPQVKGFIVRELCQNPSNWRAEETLNNYLKRNNIIGIEKIDTRALTRILREKGTMKGMISTDPNFNLDDKIDEIKAYVIKDPVMCVTTKEVLHYKGDGFKVALIDLGLKKNIVRSLLKRGCDVHVFPANSKAEDILAINPDGIMLSNGPGDPKDCVETIETIKKLMGKKPMFGICLGHQLTALANGADTEKLKYGHRGANHPVKDLEKDLTYITSQNHGYTIVESSMDKSRMTVSHRNMNDGTVEGVRYKDMPVFTVQFHPEASPGPEDTAYLFDEFIDMMKKYSR

SEQ ID NO: 57276 - protein, 324 aa, Methanosarcina acetivorans C2A
MMLMMLIDEIKKRSSHVDAAINELLPVTHPEELYKASRYLVDAGGKRLRPAVLILAAEAVGSDLKSVLPAAVAVELVHNFTLIHDDIMDKDNIRRGMPAVHVKWGEAGAILAGDTLYSKAFEILSKVENDPVRILKCMDVLSKTCTEICEGQWLDMDFEKRDRVTELEYLEMVEKKTSVLYAAAAKIGALLGGASDEVAESLSEYGRLIGIGFQMYDDVLDMVAPEEVLGKVRGSDLMEGKYTLIVIEAFGKGVTLDIFGKGEATVEETEAAVRTLTECGSIDYVKNLAISYINQGKAKLDVLRDCPEKDLLLQIADYMIAREY

SEQ ID NO: 57277 - protein, 579 aa, Polaromonas sp. JS666
MTFEELKLAPAILKAVLEQGYDTPTPIQAQAIPAVLAGSDLLGGAQTGTGKTAAFTLPMLQRLSTEPRLTNRRGVNAVRALIMTPTRELAAQVEESVRTYGKYLDLTSMVMFGGVGMGAQIDKLRRGVDILVATPGRLLDHAGQGTLDLSQVQILVLDEADRMLDMGFIHDIKKVLALVPKHKQSLLFSATFSDEIRELANGLLRDPLHIQVTPRNTTVQRITQTIHPVGRSKKKALLTHIINEHNWSQVLVFTRTKFGANNVAEHLTKNGIEAMALHGNKSQTARTQALQGFKDGTIRALVATDIAARGIDIDELPHVVNYEIPNVSEDYVHRIGRTGRAGNSGEAVSLVCLDEEGFMQDIERFTKQNIEKVLVPGFEAEPGERAEPLAMGRQTIWGGLGKPPSRDVMQAAAKAARSEMMQRIRDTKGAQPARGASGGGNGGNGGNGGGRGRGPAGGGNGSGNGSGRGPRTPNPGQPRQNSGYSQGGQPAQPRHAQARQRDEQPRAPRNDSRSEPRNDFDNQQPASHASSGFPSSGQPTGNRNNFRGNRSGGGGGSGGAGGRGNGPRRPGGPGSFTGR

SEQ ID NO: 57278 - protein, 386 aa, Hyphomonas neptunium ATCC 15444
MDSATGALALEDGTIFAGFGAGAAGIKVGELCFNTAITGYQEILTDPSYASQLVLFTFPHIGNVGANAEDHEESTVEAADAARGAIFREPITAPSNWRSTEDFGVWLARRGIIGLSGIDTRALTKRIREKGMPKAAICHKPDGKIDFDALVELARSWNGLDGADLADVVDQDAPFEHTEGLWQAATGHQTALANAEFHVAVIDFGVKKNILRNLASAGARATVVNGNVSAEEVLALKPDGIVFANGPGDPAATFERSGEMIKTLVASGLPILGICLGHQLLGLALGAKTKKMAQGHHGANHPVKDLATGKVEIVSMNHGFTVDPDTLPPGVEESHRSLFDGTNSGLAVKGKPIISVQHHPEASPGPQDSFYLFTRFAGLMRDYRAK

SEQ ID NO: 57279 - protein, 883 aa, Methanosarcina acetivorans C2A
MSKFVYFFGKDVTDGKSSMKDLLGGKGANLAEMANLGVPVPPGFTITTEVCVLYLNEKKYPEEVLSQVEEAIDKLEALNGKKLGDPEDPLLVSVRSGARVSMPGMMDTVLNLGLTDKSVIGLANKVNDERFAYDCYRRFIAMFGDVVLGVEFRKFDSLIGDKKKELGAKSDTELDSKALKELAERFKEVIKLEKGFEFPQDPKVQLQMAVDAVFDSWNNQRAITYRKLNNIGDGWGTAVNVQTMVYGNRGNTSGTGVAFTRNPSTGEKKFFGEYLINAQGEDVVAGIRTPDYIDTLGNKIPEAYAQLVDICQKLESHFKDMQDIEFTIQEGKLYMLQTRTGKRTAAAAVKIATDMVEEGLIDKETAVNRVNAEHIDLLLHPRIDPEAKLEIIATGLPASPGAAVGKVVFTAEAAEEMAEIGEKTILVRTETSPEDIGGMAAAQGVLTVRGGMTSHAAVVGRGMGKPCVVGCGEISIDIKSSLFMVNGFTIKEHDYITIDGSIGSVILGKTDLIDAEINEDLKKLLIWADEIRTLGVRTNADNPADAALARELGAEGIGLCRTEHMFFGEDRIPAVREMIMSEDEKARKKALKKLLPMQKEDFLGIFRSMEGLPVTIRLLDPPLHEFLPDKEELDEKLRELETSGDCGKIEDVKKVIQRVVSLKELNPMLGHRGCRLGITYPEIYNMQVRAIMEAACELTAEGLKVIPEIMIPLVGLVKELSLTKEEVCKTAETVMTEKGMKIDYKVGTMIELPRATIVADQIAREADFFSFGTNDLTQTTFGFSRDDVSKFVPIYQKAGILEHDPFAVLDQEGVGELMKIGIQKGRSVKPKLKMGICGEHGGEPRSITFAHGIGIDYVSCSPYRVPIARLVAAQSTMQMRNAK

SEQ ID NO: 57280 - protein, 100 aa, Vitis vinifera
MASSSSSGLTFKLHPLVIVNISDHYTRVKSQTQPPHLSSNGGEGAAAAASPPPPPPRVFGCVIGVQRGRTVEIFNSFELLYDPSTHSLDRSFLEKKQELC

SEQ ID NO: 57281 - protein, 351 aa, Yarrowia lipolytica
MTTIPKTQKAVIFETSGGPLMYKDVPVPVPADDEILVNVKYSGVCHTDLHAWKGDWPLDTKLPLIGGHEGAGVVVAKGKNVTTFEIGDYAGIKWINKACYTCEFCQVAAEPNCPKATMSGYTHDGSFQQYATANAVQAAHIPKNCDLAQVAPILCAGITVYKALKTAGLKAGEWAAVTGAGGGLGSLAVQYAKAMGYRVLAIDTGADKEKMCKELELGAEVFIDFAKSKDLVKDVQEATKGGPHAVINVSVSEFAVNQSVEYVRTLGTVVLVGLPAGAVCKSPIFQQVARSIQIKGSYVGNRADSQEAIEFFARGLVKSPIIIVGLSELESVYKLMEEGKIAGRYVLDCSK

SEQ ID NO: 57282 - protein, 295 aa, Colwellia psychrerythraea 34H
MKAVIPVAGLGTRMLPATKAIPKEMLPIVDKPMIQYIVNECVAAGIREIVLVTHSSKNAIENHFDKSFELETTLESRVKRQLLDEIQAICPKGVTILHVRQGEAKGLGHAVLKARPIIGDSPFVVVLPDVILDEASADLKTENLSAMLTRYHEVGHSQIMVEPVPMDMVSNYGVADCNGDELTAGESKAMTAVVEKPPVDEAPSNLAVVGRYVLSEKIWDMLEFTPPGAGDEIQLTDAIASLMKIETVEAFHMTGKSHDCGSKLGYMKANVEYGLRHAELGDDFKAYLQETVKNS

SEQ ID NO: 57283 - protein, 305 aa, Bacteroides fragilis NCTC 9343
MVFSGTNSRYLAEKICASLNCPLGNMNITHFADGEFAVSYEESIRGAHVFLVQSTFPNSDNLMELLLMIDAAKRASAKSVVAVIPYFGWARQDRKDKPRVSIGAKLVADLLSVAGIDRLITMDLHADQIQGFFNIPVDHLYASAVFLPYIQSLKLDELVIATPDVGGSKRASTFSKYLGVPLVLCNKSREKANEVASMQIIGDVKGKNVVLIDDIVDTAGTITKAANIMLEAGANSVRAIASHCVMSDPASFRVQESGLTEMVFTDSIPYSKKCAKVKQLSIADMFAETIKRVMNNESISSQYII

SEQ ID NO: 57284 - protein, 255 aa, Magnetococcus sp. MC-1
MRRALIAGNWKLNGTTQAATALATAVRDGVAANKPDCDVLVCPTFTVLSAVQGVVAGSGVDLGAQNMAVASSGAFTGEISGEMLKDVGCSYVILGHSERRTLFGETNEQVAQKVASAYRDGLTPILCVGETLEQREAEQTMQVLEQQLLACLPVLPADAAKQQQLVVAYEPVWAIGTGKVASTAQAQEAHAFIRGLLAKELGANVADAVRILYGGSMKPDNAKELLGQADVDGGLIGGAALKANDFLAIMDGLTA

SEQ ID NO: 57285 - protein, 590 aa, Deinococcus radiodurans R1
MTDRPRPKKSSPKKSGPEKALAKESAAQGEAAKATRQATQQTEAAKKVGVAQPGAPAQSRKAARKSRQRVPKHAGDNAPKSDAPGADGQNPFRTAMRRSRAPEPATLVIFGATGDLARRKLLPAVFGLWQDGLLGSAFNIVGVGRQEMDDEQFKDYAIDALKTSKETDEIKEGSLEKFRELLYYEYGEFGEDEVYDKVRSELDRAETARGGGKNALFYLSTPPSLFEPISSGLGRQGLQDETEGWRRIVIEKPFGRDLQSARELNDAIHRVWDESQVYRIDHYLGKETVQNLMAIRFGNAIFEPLWNRGFVDHVQITASEDLGLEGRAGYYEEAGIVRDMLQNHLMQLFTLTAMEAPSAFEADAIRDEKVKVLRAVKRIPADRVPEVAVRGQYGPGALDGQTVPGYKQEPDVKRGSRTPTYVAVKLEVDNWRWQGVPFFLRTGKRLPKKVTEIAVVFKRPPLGLFPGGLERNVLAFRIQPDEGVSLKFSSKSPGQEMVLREVVMDFRYDAFGAQLESPYSRLLLDAMLGDATLFPREDEVDHAWQIVSGILQAWEGADAAAPKFPNYAAGTWGPDAADELLGPGRRWRRL

SEQ ID NO: 57286 - protein, 330 aa, Arabidopsis thaliana
MGGKGVMMVAILFLWALSATSEAVTETEPGLMMNFYKDTCPQAEDIIREQVKLLYKRHKNTAFSWLRNIFHDCAVESCDASLLLDSTRRELGEKEHDRSFGLRNFRYIEEIKEALERECPGVVSCSDILVLSAREGIEAVGGPYIPLKTGRRDGLKSRTDMLESYLPDHNESISVVLEKFKSIGIDTPGLVALLGSHSVGRTHCVKLVHRLYPEVDPSLNPDHVPHMLHKCPDSIPDPKAVQYVRNDRGTPMVLDNNYYRNILDNKGLLLVDHQLAHDKRTRPIVKKMAKDQAYFFKEFTRAIQILSENNPLTGSKGEIRKQCNLANKNH

SEQ ID NO: 57287 - protein, 396 aa, Magnetococcus sp. MC-1
MNKRTIRDIDIKGKRVFMRVDFNVPLNEDGTVRSDKRIQGALPTIRYAIEQGAKVILASHLGRPSGDKFEPEFSLKPAGEALAALLGQPVKLAPDCVGAEVEAMVAAMQDGDVVLLENVRFHKGETKADVELSKGFAKLADVVVNDAFGTAHRAHSSNVGITEFVRPAVAGFLMADEMDYFDKVLGAPERPVMAILGGAKISGKIDVIEALLDKMDKIIIGGGMSFTFFKAMGYEIGNSLCEDEMLPVAEKTLAKAKEKGVSLILPVDCVAADAFREDANTQICSVEALPAGWMGLDIGPESVKLFAKALEGVKTVIWNGPMGVFEMAPFASGTNHLAHLLAESDCLSVIGGGDTAAAVKQAGVAKQLSYISTGGGASLELMEGKQLPGITSLDDK

SEQ ID NO: 57288 - protein, 221 aa, Escherichia coli
MKQYLIAPSILSADFARLGEDTAKALAAGADVVHFDVMDNHYVPNLTIGPMVLKSLRNYGITAPIDVHLMVKPVDRIVPDFAAAGASIITFHPEASEHVDRTLQLIKENGCKAGLVFNPATPLSYLDYVMDKLDVILLMSVNPGFGGQSFIPQTLDKLREVRRRIDESGFDIRLEVDGGVKVNNIGEIAAAGADMFVAGSAILTSQTTKKSLMKCAVNWQR

SEQ ID NO: 57289 - protein, 135 aa, Glycine max
  misc_feature (48)..(48): Xaa can be any naturally occurring amino acid
  misc_feature (120)..(120): Xaa can be any naturally occurring amino acid
  misc_feature (124)..(124): Xaa can be any naturally occurring amino acid
MQQGVDEVSIEELASNLSLYKDQLNQVRELLNDDPANSEYVDMERELXRVIALTEELLATAKQNEISAPPNNAAASPTLSIHNENQLLDSSSDHQEKLPVGTKVQAVWSEDGEWYDATIXAYTXNGYYVSYDNWG

SEQ ID NO: 57290 - protein, 254 aa, Glycine max
EPQDLCLNLHLCFLPSADELHLAPVANVVPPKETPNSVPISYHSSHSHPPLNERIISSMTRRSVAAHPWHDLEIGPGAPTIFNCVIEIGKGSKVKYELDKKSGLIKIDRVLYSSVVYPHNYGFIPRTICEDSDPLDVLIIMQEPVLPGCFLRAKAIGLMPMIDQGEKDDKIIAVCADDPEYRHYNDIKELPPHRLAEIRRFFEDYILSKNFKMSKKNENKEVAVNDFLPASAAYEAIKHSMTLYAEYVVENLRR

SEQ ID NO: 57291 - protein, 436 aa, Vitis vinifera
MPPFDYSPPPYTGPSAAEILKKRQEYLSPSLFHFYSNPLNLVDGKMQYLFDENGRRYLDAFGGIATVCCGHCHPDVVEAIVSQTQRLQHSTVLYLNHAIAEFAEALASKMPGDLKVVFFTNSGTEANELAMMIARLYTGFHDIISLRNAYHGNAAATMSATAQCNYKFNVVQTGVHHALNPDQYRGVFGSDGLKYAKDVQDLIDYGTCGNVAGFLAEAIQGVGGILELAPGYLAAVYGTIKKAGGLCIADEVQSGFARTGSHFWGFEAHGVVPDIVTMAKGIGNGVPIGAVVTTPEIAKVLTYRTYFNTFGGNPVSTASGLAVLRVIEKEKLQENAHVVGSYLKDRLTSLKEKHEIIGDVRGRGLMLGVELVTDRQLKTPAKVETLHVMDKMKEMGVLIGKGGFYGNVFRITPPLCFTKEDADFLVDVMDYTMSRM

SEQ ID NO: 57292 - protein, 413 aa, Arabidopsis thaliana
MRSEITRETKLLFDLPQDVIEEIFSKVPVTCLRRIRSTCKRLYALLKDRGFIRKHFAKSARQYHALMLKNFRFYSVSFNPNGTEMDVASLFNGERSLIDPYSSSEAIISQAFHCDGLLLCTTKENRLVVLNPFSGQTKWLQPQNRCKIDEAYVLGYDNSDLCHSYKILSFPDLYEQELETIKNAGRDLDVTPEGDLELKTDDFSSNSWRRNLGVTPHGGLGLKIYDFSSNSWKKLDVITPEGCLKSYGVSLKGNAYWVYMSKRRGVNDYSLLSFDFSTESFQHLCVPFHQEADCFGTMALSVVREEHLSLLYQSCETLKVEIWMTKEIDTTFVSWKKFLTVDLEPHLPHLLMFSCRMSFFIDEEKKVAVCCDRDNKVHVVGEDEYRVSSGFYFLDFEGITCCLTVFGYVPRLV

SEQ ID NO: 57293 - protein, 354 aa, Bacillus cereus ATCC 10987
MKSMFNKIFLIVALIGVPLSVLGKTLHWPQTIMFAVYCITIIALAGFMGRATESLAIVSGPRIGGLLNATFGNAVELIISIFALQAGLIEVVLASLTGSVLGNLLLVGGLSFFVGGLKYKRQSFNVYDARHNSALLIFAVVVAFVIPEIFSMKMDAGKTYQLSIGVSIIMIIMYLAALLFKLVTHRGVYQHKSDEVAHEEEPEWSKGKALLILAIATIAVAYVSEALVHTFETVAKSFGWSELFIGVIIVAIVGNAAEHASAIIMAYKNKVNIAVEIAIGSTLQIAMFVAPVLVLLSMFFTQRMPLVFTIPELVSMITAVFLTIAISNDGDTNWFEGGTLLAAYVIMGIGFYLL

SEQ ID NO: 57294 - protein, 723 aa, Psychrobacter arcticus 273-4
MSTNSVNAINELNSFSAESDNGIITVTIDQADRKMNVIGDGFNEAFAALTDAFISDAEAKGLILTSGKSTFVVGADIDQLATIETAEQAFDLVEDLKASLRKLETSGKPVVAAITGTALGGGLELALACHYRIAIDSPKTKLGLPEVKLGLLPGGGGTQRLPRLVGIQKALELMTQGKELSPQQAVEIGLIHDVAYDNEELIKKAKKWINNNPQASQPWDNKGFKIPGGDSKNPKIVPIFSIAPAMANQKSHGNYPAITHILSSVFEGCLTDIDNGLKIESRFFVACALSDVSKNMINTLWTQLNSIKKGQSRPEGFEKSKVSKVGILGAGMMGAGIAYVSAKAGMEVVLLDTALEGAEKGKNYSTKLLDKAISRGQSTEEKKQALLDLIKTTTSYDDLEGCDLIIEAVFEDVDIKAECTRKSEVVIPETAVYASNTSTLPITELARASTRPKQFIGLHFFSPVDKMPLVEIIVGEETDDATLAKGFDYVGQIGKTPIVVNDSRGFYTSRVFGTYVSEGIAMLGEGVHPRSIEVAGMKSGMPMPPLALQDEVSLSLSLHVMQQTKRALESEGKTFTPHPAMPVVEKMVNELGREGKKVTKGFYDYPENGEKRLWPKLTELYPTKDEQPSQQDLVDRLLYVQANETAKCFEENVVRTVADANVGSIFGWGFAPNQGGTLQFVNSVGVDKFVERSRELASKYGKRFEPAKILVEMAESGQEFSDE

SEQ ID NO: 57295 - protein, 312 aa, Streptococcus thermophilus LMG 18311
MDSLVSFSKWLSKWFTAAVILWAVFNYAFPATSSWVIPNTAYLLGLILFGMGLTLTTEDFKRIAKRPIPVILGTVAHYVIMPGLAWLLCIIFHLKGATAAGVILVGSCPSGTSSSVMAFLSGGDVALDVSIETLSTLLAPLMIPMLLSFLADQYVSVPAQNLFLSTLRIVVVPIILGVVIHSIFGKKIDAIIKIMPLISQVAILLIVGAVVSANHANIFTAATTLVIPVVMLHNLCGYVLGFGFSKLLGLEEPQQKAITFEVGMQDSSLGATLAMKYFVPQAAIPSTIFSIWHNISGSILSSWWKNHSKKSH

SEQ ID NO: 57296 - protein, 516 aa, Burkholderia pseudomallei K96243
MTSSHSLSPLNAIADEALGLPAAAAQPAASEAGDACDAASDEPTFASLGLSPEIVSALQAAGYVKPTPVQQRAIPAGIAGRDLLVSSPTGSGKTAAFMLPAIERFAQLQKAQAQQPRAPREGQPGERRGRRPQPVARPGLLVLTPTRELAMQVTTAASTYGKHLRRLRTVSILGGVAYGQQLMLLAKNPEILVATPGRLLDHLERGRIDLSELKMLVLDEADRMLDMGFIDDIDTIVAATPATRQTMLFSATLDGKIGSLTNRLLKDPERIEITQKIESRSNIAQTVHYVDDRDHKDRLLDHLLRDVALDQAIIFTATKIDADQLAGRLADAGFQSAALHGDLPQGARNRTIRALRERRVRVLVATDVAARGIDIPGITHVFNYDLPKFAEDYVHRIGRTGRAGRSGTAVSLVHHAEQGALKRIERFVRAPLPVNVVEGFEPRKAPPPRNDRGNGRGRPGGNGNGGRRFGGKPGGGHGGGRSGGWSGKPGGGNREAYGARRGDGQRNGPRRGNSAA

SEQ ID NO: 57297 - protein, 397 aa, Wolbachia endosymbiont of Drosophila melanogaster
MSDLAKRMSLIKPSPTIAVTDKANKLKNEGKKICVLAAGEPDFDTPDHIKKAAIQAISEGKTKYTAVDGTRELKEAIINKLRKDNNLEYTLNQICVGTGAKQVLFNLFMATINSGDEVIIPAPYWVSYVDMVSLFGGLPVVVECKQNFKLTVELLKSRITKKTKWLILNSPNNPAGAVYTCDELKDIAQILLEYPHMNVVTDDIYEHIIYDEKFFTIAQVEPKLYDRVFVVNGVSKAYAMTGWRIGYIAGRSDVVKAISTLQSQSTSNPNSIAQAAAAAALNGDHSFLKERTRIFKSRRDFMVKELNSAPGLSASVPQGAFYLFVSCEGLLSKSTKSGKIINNDLDFTEYLLGDHLVAVVPGIAFGLENFIRISYATSQEQLEIGCDSITKACQELK

SEQ ID NO: 57298 - protein, 880 aa, Candida albicans SC5314
MIDLEGSDSDSSSLSIHENILFPSLGNSKNNKTRNTQKSSRDDVNSLETNSDSVNHLRSTFIARDRQLPSSTNDDYALEEVDLSDVSPLASRQHVVSPFSTTSISDTVSLDSSILNKIASNIGGNTDGIDQTGKFKYLRLYEKWKKIKIKTQDQKLTKPGQDIPLQTMSSRASSVFNLSQLDDFTRYVKETSLNDRIFHDLQERLPQRNQGGQSGRQDENFQNYLDLDLDVVDEKDLADKFYPTQEDEEKETDRNKRRLFPKRSKKKSLGMSAESRTATNDFLDSYQSSSSDVVSDDPRFLQRKLSVRHLQMISFGGTIGVGLFLNSGKAIAMAGGFGASLAFTIVGTLVLCTIMSFCEMVTFVSVIDGVSGLSSRFIDDAFGFAAGWLYFLSFSTGVAGEVVAGVIMLSYYPHLNTATNTGSTAGFVTLFLALILGSNLVHIQFFGELEYISSLVKMIWAIIMMIVMVVLNRGGFPNTPVMGFKYWQYSKSDFANNIIFGLFRPAFNLHDDGTSSPSEGIGGDKGRFMSLLTAILVVCYAYSGTEIVCIAACEAKNPRKALPSATRRVFWRIIIFYVLSAFLVSLNVYAGDPRLLRYYSGSTGISPSEFATNPAVIQAGGEHCSIDYKVVAGYGSGAQSPWIVALQSSSLCQFSSITNGFLVFFAVSCGNAQLYVSSRTAYSLALQGKAPKFLTYCNRFGIPYNAVLFAGSFGLLAFACVNESATVVFQNLTSLIASSGIFVWFTMCLTFIRFYYGLKRRPDILDRNDKSYPYKSPFQPYSAIVGCIGTLFILFSMGFVVFLKGEWDTMFFFSSYGSIMIFTVLYVGYRFIKGTSVPSLDKLDFDSGRTEMDRYIWDGGRSYNKRNVKEVAHKLVSFLA

SEQ ID NO: 57299 - protein, 398 aa, Psychrobacter arcticus 273-4
MFERIDYYAGDPILGLMDKFAADNNPDKVNLGVGVYYDEDGKMPVLECVKTAEQRIADPISPRPYLPMAGLPGHRKGCQELLFGKDAQVLQDGLVATIATIGGSGALKVGAEFIHEWFPQSKCYVSDPTWGNHIAIFEGSDVEVGKYPYYDTATGGIKFDEMIAFFETLNKDDVLLLHPCCHNPTGVDLTREQWDQVLNVIQARELIPFMDIAYQGFGEDMDSDAYAIRKAVDMGLPLFVSNSFSKNLSLYGERVGGLSVVCPTVDETNRVFGQLNSMVRRIYSSPPSHGGRVVDIVMNDEALHEQWVGEVYAMRDRIKSMRTKLKSVLEEKISGRNFDYLTAQNGMFSFTGLTPEQVAQLQSKYGIYMVSNSRMCVAGLNSSNIDYIANAMVDVLKD

SEQ ID NO: 57300 - protein, 254 aa, Salicornia herbacea
MPINRIAVGTTEDARHPNTLKAGLAEFISTLIFVYAGQGSGMAFAKLTAGAANTPAGLVAAAISHGFALFVAVAVGANISGGHVNPAVTFGAFIGGNITLLNGIVYWIAQLLGSTVACLLLKFSTGGLQTSAFALCEGETVWGAFVMEIVMTFGLVYTVYATALDPKKGNIGIIAPLAIGLIVGANILAGGAFDGASMNPAVSFGPALVSWNWANHWIYWAGPLIGAGIAGLIYEFIFMGSTDSTSTDYQRLSA

SEQ ID NO: 57301 - protein, 458 aa, marine gamma proteobacterium HTCC2143
MGLLQLSRLCEQLLLLLGQPSLKFIHLIDAGTAMHLSKTPKLAIIGLGYVGLPLAVEFGKQLDCVGFDIQQQRINELRSGIDNTLETSPEELRQATGLSYSRDAADIRDCDIYIVTVPTPIDGSNQPDLTPLIKASELVGSVISANNVVIYESTVYPGCTEESCIPVIEEVSGLTFNTDFFAGYSPERINPGDKTHRVTNIVKVTSGSNPTVANYVDQLYRRIVKVGTHLASSIKVAEASKVIENTQRDVNIALVNELALIFNRLQINTEDVLEAAGTKWNFLPFRPGLVGGHCIGVDPYYLVHKAEQAGYHPQIIAASRRINDKMGSLVATEVMRLMTQKRIHIVDANVLILGLAFKENCPDLRNTRVTDIAGELEQCNVNVDIYDPWVSSQEAKHAFDITMVETLEAERYDAVILAVAHEQFQAMGIDEIRQLTRNKGIIFDIKYLFPADVVDGRL

SEQ ID NO: 57302 - protein, 294 aa, marine gamma proteobacterium HTCC2143
MKRARLDRLLGHVNYHHFEFCISDYSALDNLFKQHRPDRVVHLAAQAGVRYSITNPHAYVTSNLAGFVNILECCRHHTTEHLVYASSSSVYGANTEQPFSTAHGVNHPVSLYPATKKSNELMAHTYSHLYNIPTTGLRFFTVYGPWDRPDMAPMIFARKILAGEPVDVFNYGNHRRDFTYIDDIVEGVIRTLGHVATSNPEWDSGKPDPASSKAPYKIYNIGCNKPVELMRFIELLEQGLGREAKKNLLPMQPGDVPDTYADVEDLVADVGYQPETTIETGVDRFVTWYRHYYH

SEQ ID NO: 57303 - protein, 173 aa, Zea mays
  misc_feature (145)..(145): Xaa can be any naturally occurring amino acid
VRLQFSVRSRLDPASVQNCASNMVNNREREKIFVASQEKFHANADKQYWKSISDLIPHEIATIEKRGKKDKDKKPSVTVIQGPKPGKPTDLSRMRHILVKLKHAPPSHMLQPPPAPAAKEGAKDGSKEGGKDGGAKDGAAAPAKXAKQPAEGQETSTANGPSEAEKEQPAASE

SEQ ID NO: 57304 - protein, 639 aa, Agrobacterium tumefaciens
MTGMPQTPLLDRVNFPSDLKEIDDRDLPELARELRDEMIDAVSSTGGHLGAGLGVVELTIAIHKVFNTPEDRLIFDVGHQCYPHKILTGRRERIRTLRQEGGLSGFTRRAESEYDDFGAGHSSTSISAGLGMAVAAGLDESDRKVIAVIGDGSMSAGMAFEALNNAGALDARLIVILNDNDMSIAPPTGAMSAYLARLASGRTYMGFRDFGKKLTAYLGKTIDRAITRAVTHARGYVTGGTLFEELGFYHIGPIDGHSFDHLLPVLRNVRDNQKGPVLIHVVTQKGKGYAPAEAAADKYHGVNKFDVITGAQAKAKPNAPSYTSVFAEALIQEATLDDKIVGVTAAMPNGTGLDKMAELFPSRTFDVGIAEQHAVTFAAGLAADGYKPFCALYSTFLQRGYDQLVHDVAIQSLPVRFPIDRAGFVGADGPTHAGSFDTTFLATLPGMVVMAAADEAELKHMVRTAAAYDEGPISFRYPRGEGVGVEMPARGEILEIGKGRIIKEGTKVALLSFGTRLAECLAAAEDLDAAGLSTTVADARFAKPLDLDLIRQLAAHHEVLVTIEEGSVGGFGAHVLHFMASAGLLDHGPKVRTLTLPDQWVEQAKPETMYANAGLDRAGIVSTVFNALGQRQAGVGFAG

SEQ ID NO: 57305 - protein, 886 aa, Magnaporthe grisea 70-15
MAPKRKTKASSRSGAAARPAKRPRQAKENGIPAEALDVYAFGTGVAGELGFGPGPPLSSDPESHTQLRAPLLNPALSGVVQVSAGGMHCAALTAAGKILTWGANDTGNLGRDTAWEPEDGDDDGAVVNPLESTPMEVDEEWFGGAGKRPDFVQVVAIDNATFALAKDGKVWGWGSFRDEKGLLGFIKANLDRKPNPTDADKIQTKPIIVPGLPGNVKQLAGNTNHMLALTHSSQIWAWGGSSTCGELGRRIRSTRSASRYNSLVPTRVALPRSAAREVRAVYAGPHHSFAIDGDGSVFAWGANHFGQTGVVVPRAGGGVEAAQDCITAPTLAPLLGRGRVVHIAAGTHHSVACAADGGVWAWGRCDEGQVGLDLSRFPAGELLVDRRGRRVALLVPSIVPLGVGENATRVAAGVDCSFAVTGSGRVYAWGYAEGYRLGLPSEVTGLEPKRLVRDAHGNPIRNDGFSWAGCGGQFGVIAGPVVKDAAQASTQGGIESADADMVKAKNGAGEEDIVDVDQVDMDEMEDVISFEKQTNQREGGAAETGDGMVENDAHSHKVTHGRDPVQPLDAVTGSGNNIDNNLPRLTNANAAHVQAIPENLLPDGPVERPRITRNNIQYLIDNPGQGDDDCDDYSSDGGSFAPETDDEDDTDEWMSGSDESDESDDSSGGGGAALASTSSGGESTPDEDGESEGSSESSSSDATPEPPSSSESEDVDYSEGTNDDNGASSGRESTPELSSSFSGSEENESNEENTEDSSDSDSPRLRPLPARPTCYDDTDHIEQNTQPVPTWGMPLVDGNGLPVPGWTNANPGGYDDDERSSLFSSEEEGEDSHVDQNARPLRARGWSHVDGNGLPEPGRGYAPDFAVYAGQEDGEEGEDAGGAALE

SEQ ID NO: 57306 - protein, 602 aa, Glycine max
MEALRVAPTTPPLLRRHHPLRQMARHPLTARPRRAPLIAATLSTPPEAAHSSVAGGVAEDPSEAAPPPRPRVLPDSLQYPPGFVGAIPARSRSDGGGGGIDAMTYLTNILSSKVYDVAIESPLQLAPKLSARLGVKVWLKREDLQPVFSFKLRGAYNMMAKLPRELLERGVICSSAGNHAQGVALAAKRLNCSAVIAMPVTTPEIKWKSVEALGATVVLVGDSYDEAQAYAKKRGVEEGRTFVPPFDHPDVIMGQGTVGMEIVRQMQGPIFAIFVPVGGGGLIAGIAAYVKRVNPEVKIFGVEPTDANAMALSLHHDQRVILDQVGGFADGVAVKEVGEETFRICKELIDGVVLVSRDSICASIKDMFEEKRNILEPAGALALAGAEAYCKHHGVQGKDIVVITSGANMNFDKLRVVTELANVGRKQEAVLATVLPEEPGSFKQFCELVGQMNITEFKYRYNSNEKAVVLYSVGIHTVSELRAMQERMESSQLKTYNLTESDLVKDHLRYLMGGRSNIQNEVLCRFTFPERPGALMKFLDPFSPRWNISLFHYRGEGETGANVLVGIQVPKSEMDEFHDRANKLGYDYKVVNNDDDFQLLMH

SEQ ID NO: 57307 - protein, 423 aa, Picea sitchensis
MFSPSKSYKKKMRQRLIYWGSLSDNCSKRRFGKMRIIIGAIVLGLGIYAALDPFHHSPIADFPDFKAHTIECPPWAEFSIFPTDSNNRLQKADLKSLNGVSGPESLAFDPENKGPYTGTADGRILRWDGPNLGWSQFAYTSPNRSEICDKAHKSSLAYVKHEHICGRPLGLRFNNITGDLYIADAYFGLLVVGPQGGLATPLATEAEGVPFKFTNDLDIDMDGNVYFTDSSTIYQRKNFIVLVFSAEDSGRVLKFDPRTGQTQVLARGIRLPNGLSLSKDQSFFVFTESVTGRLLRYWLKGPKSGEIDLFAMLPAYPDNVRINDKGEFWVAIHGRHNYLAFFLASHPRIRMFLLRLPIPARIQYIVYLGGRLHAMVVKYSPEGELLEVLEDKTGKVVQSVSEVEEREGTLWLGSVLSNYIALY

SEQ ID NO: 57308 - protein, 523 aa, Oryza sativa Japonica Group
MDVPSVVIPILVVLVSRLLTSALVHLLWKPYAITKLFRGQGITGPKYRLFVGSLPEIKRMKAAAAADEVAAGAHSHDFIPIVLPQHSKWATDHGKTFLYWLGAVPAVSLGRVEQVKQVLLERTGSFTKNYMNANLEALLGKGLILANGEDWERHRKVVHPAFNHDKLKFMSVVMAESVESMVQRWQSQIQQAGNNQVELDLSRELSELTSDVITRSAFGSSHEEGKEVYQAQKELQELAFSSSLDVPALVFLRKLPIIRGNTRAHQLVKKSRTMLMEIIEGRLAKVEAAEAGYGSDLLGLMLEARALEREGNGLVLTTQEIIDECKTFFFAGQDTTSNHLVWTMFLLSSNAQWQDKLREEVLTVCGDAIPTPDMANRLKLVNMVLLESLRLYSPVVIIRRIAGSDIDLGNLKIPKGTVLSIPIAKIHRDRDVWGPDADEFNPARFKNGVSRAASYPNALLSFSQGPRGCIGQTFAMLESQIAIAMILQRFEFRLSPSYVHAPMEAITLRPRFGLPVVLRNLQG

SEQ ID NO: 57309 - protein, 406 aa, Alkaliphilus metalliredigens QYMF
MNIVVQKFGGTSVSTKERRTQVINKILQTKQKQKNIVVVVSALGRKGDAYATDTLRNLLLEENPLCSLKTLDLLMSCGEIISATLLGSALEALGEKVIVLTGAQAGILTDDHFSNAEIIAIDEKRSLSYLEKDYIVVVPGFQGATASGEVTTLGRGGSDTTATALAVALNAEYVEIYTDVDGIMTADPNVVPRARILDQVNYNEVFQMAEKGAKVIHPRAVEIAQKKNIPVNIRNTMSEHPGTRIHSFTGDKESLYCSQPKKNLLTAITHKDGISQVSVHMENNLAHDSLLLSTLAESKVSIDMINFFLDKKIFTISTEQINIVQIQLKKLNFSHEIRTHCSKVTVVGNRITGIPGVMATIVGALSSEDIQILQSSDSHSTISCLVDESDAKKAVNALHSAFHLDC

SEQ ID NO: 57310 - protein, 781 aa, Mesorhizobium loti MAFF303099
MEYGPAPEARNEADAWLAARDFGKALFIDGAWKAASGGKTFDTSEPSSGKLLAKVSDASAADIDAAVAAATKALPKWSASSGYARAKVLYAIGRAMQRHQRLFAVLESIDNGKPIRESRDIDVPLAIRHFIHHAGWAQALDRDFPGHKGVGVVGQIIPWNFPLLMLAWKIAPALAAGCTVVLKPAEFTPLTAILFAEICERAGVPKGVVNIVQGGPEAGAAIVNHPGIQKIAFTGSSEVGKIIRKATAGSGKKLSLELGGKSAFIVFEDADLDSAVEGLVDGIWFNQGQVCCAGSRLLVQEGIAEALIAKVKTRMSRLRVGSPLDKNTDIGPLVDLTQLDRVKGLVAEGAKQGAVCWQPDAALPSSGYYHLPTLATGVSPANILAQEEVFGPVLATMTFRNTEEAIELANNTRYGLAASVWSENVNLALHVAPQLKAGVVWVNGTNMFDAACGFGGYRESGFGREGGREGMFEYLTAKLPLGPVIKPAAVSAQPVEQADGAAIDRTAKLFIGGKQVRPDGNYSLAVATAKGKLAGEVGFGNRKDIRDAVSAARACKGWPEATAYNRSQVLYYLAENLSGRAGEFAARLTELTGATPKAAREEVDQSIERLFLYAGLADKFEGRVHQPPARAVTLALHEPVGVVGIVAPDASPLLGLISLVAPALAMGNTVVAVPSERYPLLATDLYQVIEYSDVPAGAINIVTGRSAELAGVLAKHDDVDGLWVFADAETCARAEAESIGNLKRVWSGNGRSLDWASDEAAGDAFLRRAVEVKNVWVPYGD

SEQ ID NO: 57311 - protein, 524 aa, Burkholderia sp. 383
MAIFELMIALLLAILVLHYVGHKLGLPPAVALIIGGGFIAFLPGLPEVHIDPELVLVIFLPPLLMDSALGISLDHLRRHMLGVGALAIGAVLFTTVVVALVTHWLVPSLPWAACAALGALVAPPDAVSARAALQQVKLPRRLLILLEGESLFNDATGLVLFRFAVAAGVTGLFSPAEALGSFTLLALGGVLIGAVVGGAWVILMRHLDEDSLVIAASPLCAWGSYLLAERFHVSGVIATVTTGLICAWFQHRVLSASARLYGTGFWTVTIFILEAFVFLIIGSSLHELIQRGDGLDAMLAEMGVPVLIVVVSVIVARFAWVYVSDAALILLRQLGVTRFHPLGLADATVLSWAGMRGVITLALAASLPDSFPGRDFILVTAIAVILATVLVQGQTLGAVIRWTGLAAPESDKPRLSMSEAEAVIAKVQYELMAKRAYNAAGELVHPMLLDIHKHKAEDMARYARHADEYKSELDARSDTVLELIAAGRTELMRLYRAGDIDEHTLHELTRDLDLEELRAISAKA

SEQ ID NO: 57312 - protein, 135 aa, Beta vulgaris
MSTVFNGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMI

SEQ ID NO: 57313 - protein, 427 aa, Rhodococcus opacus
MIAGARTSFRIDTWNQLARNFRYIRGTFDDQSAFEDLKRVLAQLDTIHSAIGHAFYMSISPAHFSLVCAQLNSVGLNQDRHGYRRIVLEKPFGNDLASSRELGATVDEVFGAGSVFRVDHYLGKETVQNILALRFANGLFEPLWNHRHIDNIQITMAEDIGVEGRAGYYDGVGAARDVIQNHLLQLLALIAMEEPVGVDAASLSAEKVKVLSATSAVSPLADTTARGQYSATVRGETYLPGLLEEDGFDPCSTTETYAAITVQIANRRWAGVPFYLRAGKRLARRTTEVAVTFSSPHHLTGSAEAGPPPQNVLVVRVQPDDGISLRIGAKTPGEGMRIQDVDLNMSFADSFGGSSPEAYERLILDVLRGDASLFPSQAEVDASWAIVDPVIAFWAEQGRPDTYQSGSAGPSSAIPVVTRTGRAWRPL

SEQ ID NO: 57314 - protein, 420 aa, Glycine max
QTHEWRWESAVLGCCFIFFLLVTRYFSKRQPKFFWVSAMAPLTSVILGSLLVYVTHAEKHGVQVIGELKKGLNPPSLTNLVFVTPYMTTAVKTGIVVGIISLAEGIAVGRSFAMYKNYNIDGNKEMIAIGTMNVVGSFTSCYLTTGPFSRSAVNYNAGCKTAASNIIMSIAVMLTLLFLTPLFHYTPLVVLSAIIVSAMLGLIDYEAAIHLFKVDKFDFVVCMSAYVGVVFGSVEIGLVIAIAISVLRVLLFIARPRTFVLGNIPNSAVYRNVEQYPNANHIPGILILEIDAPIYFANASYLRERITRWIDEEEDRIKATEQTSLQYVIMDMTAVANIDTSGISMLEECKKTVDRRGLQLALVNPGSEVMKKLNKSKFLDELGQKWIYLTVEEAVGACNFMLHSYKPNPMKDESEGWNNA

SEQ ID NO: 57315 - protein, 82 aa, Arabidopsis thaliana
MYDAESLRAGYAIFASGIIVGFANLVCGLCVGIIGSSCALSDAQNSTLFVKILVIEIFGSALGLFGVIVGIIMSAQATWPTK

SEQ ID NO: 57316 - protein, 283 aa, Nocardia farcinica IFM 10152
MTFRSETSAVPSIVLNDGNVIPQLGFGVFQVPPDDVFDVVTTALRAGYRSIDTAAVYGNEEGTGRAIRAFGLPRDEVYVTTKLWNSEQGYDSTLRAFDDSMSKLGLDYLDLYLIHWPVAAAGKFVDTFRAFQELKRQGRVRSIGVSNFTVDNLRTLIAETGEIPAVNQIELHPALAQRELREFHAENAIATEAWSPLGQGTLLEDATITRIAQEVGRTPAQVIIRWHLQLGNVVIPKSVTPARIEANFDVFGFELSREQMAAIDGLDRGGRIGPDPDTFSAGL

SEQ ID NO: 57317 - protein, 314 aa, Capsicum annuum
GINGFGRIGRNFLRCWHGRKDSPLDVIAINDTGGVKQASHLLKYDSTLGIFEADVKPVGTDGISVDGKVIQVVSNRNPSNLPWGDLGIDLVIEGTGVFVDREGAGKHIQAGAKKVLITAPGKGDIPTYVVGVNADLYNPDEPIISNASCTTNCLAPFVKILDQKFGIIKGTMTTTHSYTGDQRLLDASHRDLRRARAAALNIVPTSTGAAKAVALVLPSLKGKLNGIALRVPTPNVSVVDLVVQVSKKTFAEEVNAAFREAADKELNGILSVCDEPLVSVDFRCSDVSSTVDASLTMVMGDDMVKVIAWYDNEW

SEQ ID NO: 57318 - protein, 625 aa, Oryza sativa Japonica Group
MEVALAVYSLVLLASFSFPCRLASALLSPKGVNYEVQALMMIKTSLKDPHGVLKNWDQDSVDPCSWTMVTCSPENLVTGLEAPSQNLSGLLSASIGNLTNLEIVLLQNNNINGPIPEEIGRLTKLKTLDLSSNHFSGGIPNSVGHLESLQYLRLNNNTLSGAYPSSSANLSQLVFLDLSYNNLSGPVPGSLARTFNIVGNPLICAAGTEHDCYGTLPMPMSYSLNNTQGTLMPAKSKSHKVAIAFGSTIGCISFLIPVMGLLFWWRHRRNHQILFDVDEQHTENVNLGNVKRFQFRELQVATENFSNKNILGKGGFGNVYRGKLPDGTVVAVKRLKDGNAAGGQAQFQTEVEMISLALHRNLLRLYGFCMTATERLLVYPYMSNGSVALRLKGKPPLDWITRQRIALGAARGLLYLHEQCDPKIIHRDVKAANILLDDYCEAIVGDFGLAKLLDHRDSHVTTAVRGTVGHIAPEYLSTGQSSEKTDVFGFGILLLELITGQTALEFGKSSNQKGAMLDWVKKMHQEKKLDVLVDKGLRSNYDRVELEEMVQVALLCTQYLPGHRPRMSEVVRMLEGDGLAERWEASQRADSHKFKVPEFTFGRCYSDLTDDSSLLVQAVELSGPR

SEQ ID NO: 57319 - protein, 460 aa, Oryza sativa Japonica Group
MVAVTGGRPPGLQDAPGAPPPAPAAEAVPSRPLARDATYGGRVYGGVGGGGCCLEFLDCVLRAMGVATPAEIMPPADFRWAARPMRRRRRGGSSSSSSSPRDREPRDGRIAANGASAAASLYTMRGNKGVNQDAMLVWENFCSKEDTIFCGVFDGHGPYGHLVSKRVRDLLPIKLSANLGRDGHKETSTNIVTSSMTEGGGTERMDRDTETPLGTEENGDYPEMFAALRTSLLRAFYVMDRDLKFHKTIDSVFSGTTAVTVIKQGHDLLIGNLGDSRAVLGTRDEYDQFFAVQLTVDLKPTIPSEAARIRERSGRIFSLPDEPDVARVWLPKYNMPGLAMARAFGDFCLKDYGLISMPDVSYHRITEKDEFVVLATDGVWDVLSNSEVVSIVSQAKSEASAARFVVESAQRAWRTRFPTSKIDDCAVVCLFLNTDARNKPPGSGIKDLANAIELGGGNLS

SEQ ID NO: 57320 - protein, 312 aa, Capsicum annuum
GINGFGRIGRNFLRCWHGRKDSPLEVIAINDSGGVKQASHLLKYDSTLGIFDADVKPVGTDGISVDGKVIKVVSDRNPINLPWKDLGVDLVIEGTGVFVDREGAGKHIQAGAKKVLITAPGKGDIPTYVVGVNADLYSPDEPIISNASCTTNCLAPFVKVLDEKFGIIKGTMTTTHSYTGDQRLLDASHRDLRRARAAALNIVPTSTGAAKAVALVLPSLKGKLNGIALRVPTPNVSVVDLVVQVSKKTFAEEVNAAFRESADKELAGILSVCDEPLVSVDFRCSDVSSTVDASLTMVMGDDMVKVIAWYDN

SEQ ID NO: 57321 - protein, 534 aa, Ustilago maydis 521
MSAAVTASNAATAANGVSPSSAASSSAVATATANSAAKPAVQPSEVGWLFVTQYYTFLNQNPARLHCFFTKKSTMVHGIEQEESSPCFGQQQIHDKITSLNYQDAKVFVSNVDSQSSASGGILVQVLGELSNNGAAWRKFAQTFFLAEQPNGYYVLNDIFRYLKDDDEIEAEAEAVDEALQEEIDEADKNGVEVAHTIQINNIGNANAVPHLPAPTSSPAASKAIEAADTKPAATEQQPATKLDAPSAADNAVATSTAAEPTNTDADQVGTDKKLTAVDNHQAPVPPKGAKDAADAAKTETAPAAAASAPNAAASTPAAAAAAAAAPTPAPAQPAGPPKPKTWATLAASDATRWGSNVSAEAKGVSSSRPAAATTSTAAKPAAAAAAASAPKPAAATSNGASSSPSVYIKNVVADQVTEAALRQALEAFGTVKDVQIIGSRSCAFAEFTSVDGARKAAAKASVAVGKNGWNVTIEERRKPSAGGAGGAGAAGGARGAGGAPRNGAAGGSRTGAARGGNAAVRAGRGGAGRAGAN

SEQ ID NO: 57322 - protein, 317 aa, Capsicum annuum
INGFGRIGRNFLRCWHGRKDSPLDVVVVNDSGGVKNASHLLKYDSMLGTFKADVKVVDNETISVDGKPIKVVSNRDPLKLPWAELGIDIVIEGTGVFVDGPGAGKHIQAGAKKVIITAPAKGADIPTYVVGVNEQEYTHEVANIVSNASCTTNCLAPFAKILDEEFGIVKGTMTTTHSYTGDQRLLDASHRDLRRARAAALNIVPTSTGAAKAVSLVLPQLKGKLNGIALRVPTPNVSVVDLVINVEKKGITAEDVNAAFRKSADGPLNGILAVCDVPLVSVDFRCSDVSTTIDSSLTMVMGDDMVKIVAWYDNEWN

SEQ ID NO: 57323 - protein, 275 aa, marine gamma proteobacterium HTCC2143
MIKKCLFPVAGYGTRFLPATKSMPKEMLPVVNKPLVQYGVEEAIQAGMNQMAMVTGRGKRAITDHFDISYELEHQIAGSTKENYLASIREVIDQASFTMTRQREMKGLGHAILTGETLIGNEPFGVVLSDDLCINDGDGVLAQMVKLYKQFRCSIIAIQEVPNDQTEKYGIIAGEALKEGLYRVDDMVEKPKPEDAPSNMAIIGRYILTPDIFDILRETPPGKGGEIQLTDALLTQAQNGCVMAYAFKGRRFDCGSVDGFVEATNYVYENVYQEV

SEQ ID NO: 57324 - protein, 472 aa, marine gamma proteobacterium HTCC2143
MISVLIPVLLSGGVGSRLWPLSRELNPKQFLPLTGELSLLEQTLQRALHLESGKPIIVCNNDHRFMVAEQLRNVKIEPDAIILEPVGRNTAPAVAVAAMRAISQDDDAVLLVMPADHVVNDTAAFTAAVEIGLTQAQQGNLVTFGIVPEGPETGYGYIRRRDTESAGCFTIAEFVEKPSLAVAQQYVDSGDYFWNSGMFLLGAKAYLDELGVHAPAMLKAAQLAYNDAHEDLDFIRLDADAFAACDSDSIDYAVMEKTSKGMVVPMACGWSDVGAWSSLWEVGDKDSRGNVSTGDTILHNTQDSYIHSSSRLVTTVGIDNIVVVETADAILVADKDQVQDVKAIVNTLRLEQREEVNSHTKVYRPWGSYESLVVAERFQVKRIIVNPGQTLSLQMHHHRAEHWIVVRGTALVTCGETESLLLEDQSTYIPLGTKHRLANKGVIPLELIEVQSGSYLGEDDIVRFEDVYGRDS

SEQ ID NO: 57325 - protein, 489 aa, Burkholderia sp. 383
MSTVQETLALKDPSLFRQQAYVNGEWQGATNGETFEVRNPATGGLLGTVPAMGTAETRHAIEAANAAWPAWRKKTAKERAVVLRKWHDLMMEHADDLALILTTEQGKSLAEAKGEIGYAASFLEWFAEEGKRVYGDTIPTPASDKRIVVTKEAIGVCAAITPWNFPAAMITRKVGPALAAGCPIVVKPAEATPFSALAMAVLAERAGVPAGVFSVVTGDPKAIGGEMTSNPIVRKLSFTGSTPVGRLLMSQCAATVKKVSLELGGNAPFIVFDDADLDAAVQGAIASKYRNSGQTCVCTNRFYVHEAVYDQFAQKLAAAVGQLKVGRGTEPGVTQGPLINEAAVLKVEAHIEDALAKGATVVTGGKRHALGHGFFEPTVLTGVTPAMKVAKEETFGPLAPLFKFGSDDEVIRLANDTEFGLAAYFYSRDIGRVWKVAEALEYGMVGVNTGLISNEVAPFGGVKQSGLGREGSHYGIDDYVVIKYLCLAV

SEQ ID NO: 57326 - protein, 473 aa, Bacillus cereus ATCC 10987
MMDQNQGLKRELKSRHIFMIALGGVIGTGLFLGSGYTIHEAGPGGAIVAYLVGGFVMYLTMLCLGELAVAMPDAGSYQTYATKHISPAAGYVVGWMSWLNWSATIGIELIAVSILMKRWFPDVPSWIWCVVFAVLLFAINALSSRSFAEVEFWFASIKVITIIAFIILGGAAMFGFLDMKGNEPAPMFSSFTDYGGLFPNGLSAILITMIAVNFSFQGTELVGIAAGESENPEKTIPKAINNTVWRILVFFVLSIFILAGLFPWQQAGVIESPFVVVFDKIGIPYAADIINFVIITAVLSVANSGLYATSRMLWSMSNQGMISPIFSKLSKSGVPIYALIVSTIVGCLSLLSGIYAEDTVYLWLLSIAGFGAILVWASIALSNLLARRAYIKQGGDVKDLKFKTPLYPFVPLLALVLNVTVIVAMAFIPEQRMALYCGIPFMIVCLLFYRATRNKGSNLEHIEKTKTTEIESL

SEQ ID NO: 57327 - protein, 367 aa, Psychrobacter arcticus 273-4
MATILTLAGDGIGPEIMTQAIDVLNAVNNKFALGLTLESGLIGGVAVDATGEPLPEETLQRARAADAVLLGAVGGPKWDGIERSKRPERGLLKIRSELGLFANLRVAKLYPQLVNASSIKPEIISGLDLLIVRELTGGIYFGEPRGIRTLENGEQQGYNTMVYSTSEINRIGKVAFELAQTRAQAAGTPAKVCSIDKANVLEVTELWKQTMIELQQAEYSDVALSHMYADNACMQLIKDPKQFDVMVTGNLFGDILSDEAAMLTGSIGMLPSASLDEAGKGMYEPCHGSAPDIAGQDIANPLATILSVAMMLRYTFKQEVAAQAIEQAVSDVLDDGLRTVDILDRNEAGLIQVGCQQMGQAVLAKLL

SEQ ID NO: 57328 - protein, 429 aa, Burkholderia sp. 383
MTVKNADLQARKNAATPRGVGVMCDFYAARAENAELWDVEGRRFIDFAAGIAVLNTGHRHPKIVKAISDQLNNFTHTAYQIVPYASYVELAEKINARAPGDFPKKTAFFTTGAEAVENAIKIARAATGRPGVIAFSGGFHGRTMMGMALTGKVAPYKLNFGPFPGDVFHAPYPNAVHGVTTADSIKAIEMLFKADIDPKRVAAIIFEPVQGEGGFYAAPAEFVRALRKICNEHGILLIADEVQTGFARTGKLFAMQHYDVLADLITMAKSLAGGMPLSGVVGRADVMDAAAPGGLGGTYAGNPLAVASAHAVLEIIDEEKLCERATQFGDVLKAKLNALQADVPQIADVRGPGAMIAVEFLKPGSGEPDAEFTKRVQTRALERGLLLLVCGVYSNVVRFLFPLTIPQAVFDEALVILEEVLKETVGVPA

SEQ ID NO: 57329 - protein, 76 aa, Brassica napus
MGCLHSKTANLPSSDDPSAPTKPESVNGDQVEQENQNFKEFDLTELRKATNGFSPSCIVSEGGEKAPNVVYRGKLE

SEQ ID NO: 57330 - protein, 376 aa, Ustilago maydis 521
MHRVMEEPSSSTAALCAAEQVTDLLAPSRVARNLELHLAAESGDLALIRSLLASSPSPVSSSSSETDEGGVDVWYEDPSSANWSALHFAAEQGHVEVVRLLLRNGAIWNAVDANGFTAAQVAWSMNHERCYREILEEGVRQTFLLNALRGAESGENEEEHEIGPSEAKRLKADGACDADRGSVVTSADGRHVTLKPVALDVANDTERYLCTPLRFVPDSLGQVRCLDADDNMVMAPWETDIMQLSASLLCSNQARNFSILNVGFGLGIIDTLIQTYKPARHVIIEAHPDAIAYAHQLGFDKLAGVEIFQGRWEDYLIHADPDSDDAIAKMTQLGSFDAVYFDTYTDSASSTDSALPTASSTRCIPGSASSISKRSD

SEQ ID NO: 57331 - protein, 356 aa, marine gamma proteobacterium HTCC2143
MGNHVVCVDIDEAKLQRLRDGDIPIYEPGLETMVKAGVNNGVLSFTTNIAEAISAAEYIFIAVGTPPGEDGSADLQYVLAVAGDIGRYLQGYAVVVNKSTVPVGTADKVKQAIDQQLAVREVDIVCDVVSNPEFLKEGAAVADFMRPDRVVIGTDSERAEQKMTALYSPYLKSRDRMMFMGTRDAEMTKYAANAMLATKISFMNEVANLCDRLDVDVENVRKGIGSDSRIGYSFIYPGCGYGGSCFPKDVKALVHSAEQAGFEPTLLAAVEQRNNQQKHKLFDNIISYLGDLSGKKIAVRGLAFKPGTDDMREAPSIVLINRLIEAGATVLAFDPVARRPPRRNSHRNGCSRVACK

SEQ ID NO: 57332 - protein, 340 aa, Streptococcus thermophilus LMG 18311
MRNIPKSVTLKAWRCKYLVKGVLKMSNPNNHVIYLAGGCFWGVEEYFSRVPGVLDAVSGYANGSSETTRYELISQTGHAETVQVTYDAGKVTLREILLHFFRIINPLSKNKQGNDVGTQYRTGVYYTDVNDLPIIEKVFQEMSEQYGQPLAVELLPLQHFIPAEEYHQDYLKKNPNGYCHINVNQAVNPVIDSSSYHKPSQEELKVSLSPAAYAVTQENRTERAFTSPLWNHFEPGIYVDVVTGEPLFSSRDKFYSACGWPSFSRPISPEVANYKEDHSHNMDRIEVRSRVGDSHLGHVFPDGPSDKGGLRYCINGVATRFVPKADMEKEGYAYLLDQVD

SEQ ID NO: 57333 - protein, 110 aa, Candida albicans SC5314
MFKLAFRSIRAPVARASFVKPIRFYVAPPISKDEVTSRAIQALKTVAPLQESNITLESSFQKDLGLDSLDTVEALVALEEEFDLEIPDKISDEIKTVGEAVDYIYKEESK

SEQ ID NO: 57334 - protein, 337 aa, Chaetomium globosum
MAIKVGINGFGRIGRIVFRNAVEHADVEIVAVNDPFIEPKYAEYMLKYDSTHGVFNGTIAVEGSDLVVNGKKVKFYTERDPAAIPWKDTGAEYIVESTGVFTTTEKAGAHLKGGAKRVIISAPSADAPMYVMGVNEKTYDGSAQVISNASCTTNCLAPLAKVVNDKFGIVEGLMTTVHSYTATQKTVDGPSAKDWRGGRGAAQNIIPSSTGAAKAVGKVIPELNGKLTGMSFRVPTSNVSVVDLTCRLQKEASYDEIKAALKEASEGDLKGILGYTEDEIVSSDLNGNPNSSIFDAKAGISLNKNFVKLVSWYDNEWGYSRRVLDLLAYVAKVDASK

SEQ ID NO: 57335 - protein, 146 aa, Polaromonas sp. JS666
MKDVAQILKSKADHKVYTVSPLAPVLDAVKLMAEKNLGALLVLDGEEFVGIISERDCTRKMLLADRLPRETPVRDIMSSPVQYVGPRHTNEECMALMTDKRLRHLPVIDNGKLIGLVSIGDLVKDIISEQGFIIQQLEHYIAGVKG

SEQ ID NO: 57336 - protein, 462 aa, Picea sitchensis
MAPYGQENGLTRIGYSVDDGLENDKIADPRLPLLPDADLKDKIVLLRVDHNVVKKGEILDQYRIDVTLPTLYNITERGGRPILMTHVGRPYDKKNKTVTIRKDESVDAIVAYLQRKLRIKFVVPKFNYDEKDGILDIDTSINWLITDLRKRKIGGIYLPNTRWFAGEEDKGEKLERFAIQLAGLADVFVNDAFGSWQPHGSTYHITKYLPSYAGLCMQDELYHVEAVLNPTRPFIAIVAGSKYDTKIGPLNQIYKKVDKLVLGGVIYNTYLCAKYGVKIAGVQDSDIELAKELVEQDKTQGKIVEMDILVETDTLSGRFEGKYRAVNVKDFAPGKTYNYIVDIDPLSLESEDVLQALNSAKTIFVNAVMGFMPNFWHGTSKLDEVIDNNQSAKKYFGGGDTLQAFKSLHPNLYQAALDNTNYYLFTGGGTVLEVIEEGDSMGLDTVRALIENKTKLQSENPK

SEQ ID NO: 57337 - protein, 505 aa, Vitis vinifera
MELAKPSSVFAIQDHQSSSPPTPIWKTVVVASIAAGIQFGWALQLSLLTPYVQLLGIPHKWAAFIWLCGPISGMIVQPVVGYHSDRCTSRFGRRRPFIAAGAVLVAIAVFLIGYAADIGRVSGDPLHNTIKTRAVAVFVVGFWILDVANNMLQGPCRALLADLSGTSARRTRTANALYSFFMAVGNVLGYAAGSFSKLHKMFPFARTQACDLYCANLKSCFFLSIALLLILTIIAFATVHETPLNRADIAVVEAGQPFYSQMMNAFRQLRRPMWVLLLVTCLNWIGWFPFLLFDTDWMGREVYGGTVGEGPRGRLYDLGVRAGSLGLMLNSVVLGLMSLGVEFFGRGVGGVKRLWGGVNFLLALCLALTVLVSKLAASWRHSLGGELHPPPIGIKAGALSLFAVMGVPLAITYSIPFALASIFCHSSGAGQGLSLGVLNLAIVVPQMMVSVASGPWDARFGGGNLPAFVVGAFAAALSGVLALTMLPAPPPDVPNTKDERTQPSS

SEQ ID NO: 57338 - protein, 351 aa, Mycobacterium smegmatis str. MC2 155
MSDVESSTRIARLTVTEVIDESHDARSLVFAVPDEHRDHFGYRPGQFLTLRIPSERTGSVARCYSLASSPHTDDAHKVTVKRTDGGYGSNWLCDNVSVGSTIESLPPSGVFTPASLDDDFLLWAAGSGITPVMSILKSVLSAGSGRVILCYANRDERSVIFAAELRELAARHAGRLTVLHWLESVQGLPTRAQLCGFAQLFSGYESFICGPEPFMAVVRAALTEAGVPRRRIHLEVFQSLSGDPFAEDVPASGPAGPGTDAGAAEAEIELDGTVHQLRWPRDRNLVDTMLAAGVEVPYSCREGSCGSCAATVLDGEIERGDTPILDAQDIADGLFLACQARPVSDRIRIEF

SEQ ID NO: 57339 - protein, 341 aa, Deinococcus radiodurans R1
MGRPNQVVTSSPRRARSRRLLALAACGTLALGGFSLPAASFVPPLSVGQATAQSGGGFGGSSSGGGGGYSGGGGYSGGGYSGGGYSGGGYSGGGYSGPIIIGGGGGYYGGGGGLGIFPLIIFGLVIFGVVGMMRRNLGGGGARGLSSLGSSGTSQAVSVQLLLAEGDEVKSALQRIAQQGDPDTNAGLARMVQEAALVALRHPERWVYGNVERAQGSASAAGNQVGAWATEARAAFQEQTTSNYQNNDPNTGFQHRTDYSYNKEVADMYLAVTIAVAAQTLGNLPPAGVTTAAEARAALLAISGVTEGDLIRAEVIWSPDTEGEFLSEDEAIVKYPKLTKL

SEQ ID NO: 57340 - protein, 77 aa, Brassica napus
  misc_feature (22)..(22): Xaa can be any naturally occurring amino acid
NNTYNGVILFNLTGLQRIDPFXEEILITAAHATFYEFNIEISQWSRKDVEGSLFVVKRSKQEPRFQFIVMNHGNTVF

SEQ ID NO: 57341 - protein, 328 aa, Deinococcus radiodurans R1
MRLPKRLLLAAGVAALAGRRAFVPRYDLQGKHVLLTGGSRGLGLALGRELAGRGARLTLVARTERDLRLAAEDLRGRGAEVQIIAADVTDPGAGQHILDAAQSFGDVDVLLHCAGLIQSGPLANMTEQDFRDVMEIHAFAPLRLVRTLLPQLSRRQGRVLLVTSIGGKVAVPHLVPYSMSKFAAVGLGQGLRSELAAHGVTVTTVCPGLMRTGSPRQATVKGQYEQEYALFATIDNLPVISLDAATAAQRITDALVRGDAEVMVGGPALMARYVQAFAPQLTADVMALTNRFLPGPGESDQPRLGAEVETPITRNNPLKRTAEEDLNE

SEQ ID NO: 57342 - protein, 282 aa, Physcomitrella patens subsp. patens
DIDNDHSDPQMCTTYATDIYAHLRMAEMKRRPSANFMESMQQDINPSMRGILVDWLVEVAEEYKLVPDTLYLTVSCIDRYLSAHVVTRQRLQLLGVACMLIAAKYEEICAPQVEEFCYITDNTYGREEVLEMERGVLRVLKFELTTPTIKSFLRRFIRAAQAGCEAPALVLEFLGNYLAELTLVEYGFLPFLPSMIAASCAYLARVTLDSSRRPWDATLQHYTGYRPSELEQCVRAMHELQCNTRGCTLPAVREKYRHHKFKCVAALVPPALLPEEYFRELE

SEQ ID NO: 57343 - protein, 535 aa, Cryptococcus neoformans var. neoformans JEC21
MDMYFPEHTPTPLPQIEQIYDTVNKRFDSGVTCSLAYRLFNLKQLAYLIKDNEALIQAAVENDQGKGPFDVTIGELWPALNEIDLAVKNVENWMKDESRTADAILSMKAMPSRVKKQPKGVALIISTWNYPWQLSLCPLVGAISAGCPAILKLSEHSPTSSALLADLLPKYLDPEGYVAVLGEVEQSQALLVKPWGHILYTGSSGVGKIVAGAAAKTLTPTTLELGGKSPVIVASDANFKIAARRLFSIKQMTGGQICVAPDYVLCVKDKVDEFISVCKSTLDELFPPLPSSKSLLSSPSGSSFLRSPADFSRQLSYIEKAEMEGKLVYKGEMDEKTRRMGISLIRLNENGEREEGGVMVDEIFGPVLAIIPVEDIDGAIAYVNARPKPLALYVCAGKRSIFEKVISQTTSGSATWNDFAMATFARNLPFGGVGASGWGSYHGKDGFNAFTHHKAVLEIPYLFEPLISLRYPPISSLAKKILPFLMFAGIKFSRPKSIEHEEESLRRRKWRWRVIVLGFLMGALVGGKRLLGNGQ

SEQ ID NO: 57344 - protein, 277 aa, Arabidopsis thaliana
MKIPSIGYVFFLIFISITIVSSSPDHGEVEDETQFNYEKKGEKGPENWGRLKPEWAMCGKGNMQSPIDLTDKRVLIDHNLGYLRSQYLPSNATIKNRGHDIMMKFEGGNAGLGITINGTEYKLQQIHWHSPSEHTLNAKRFVLEEHMVHQSKDGRNAVVAFFYKLGKPDYFLLTLERYLKRITDTHESQEFVEMVHPRTFGFESKHYYRFIGSLTTPPCSENVIWTISKEMRTVTLKQLIMLRVTVHDQSNSNARPLQRKNERPVALYIPTWHSKLY

SEQ ID NO: 57345 - protein, 162 aa, Cryptococcus neoformans var. neoformans
MSDVYFDIAINSQPAGRITFKLFDDVVPKTVQNFRELCTGQNGFGYAGSGFHRVIPQFMLQGGDFTNHNGTGGKSIYGNKFADENFKLRHDRPFLLSMANAGPNTNGSQFFITTVVTSWLDGKHVVFGEVSSGQDLVRKIESYGSGSGATKAKITIAASGTV

SEQ ID NO: 57346 - protein, 162 aa, Cryptococcus neoformans var. neoformans
MSQVYFDIAINNAPAGRITFKLFDDVVPKTARNFRELCTGQNGFGYAGSGFHRVIPQFMLQGGDFTNHNGTGGKSIYGNKFADENFKLRHDRPFLLSMANAGPNTNGSQFFITTVVTSWLDGKHVVFGEVSSGQDLVRKIESYGSGSGATKAKITIAASGTV

SEQ ID NO: 57347 - protein, 461 aa, Streptococcus thermophilus LMG 18311
MSIFRKKDVGLSQTEMKRHLTLRDVVLLGIGAMVGTGIFTITGTAASTLAGPALIISVLISAVCVGMSAIFFAEFASRYPSAGGVYGYLYASWGEYPAWMGGWLTMIVFMNAVSSVASGWGAYLKGLLASFGLQLPKAISGPFNPSQGTYIDLLPVLVLVLVTALLLMDSKQVLRLNSLLVVLKFSALAVFILVGLFHLNPDNWANFAPFGFGQIYGGKTGIMAGASLMFFGFLGFESISMTVDEIKEPQKNVPRGIILALIIVASLYAVVSLVLTGVVHYTKLNVDDAVAYALRYIGVSWAANYVSVVAIMTLITVCISMAYALSRMVYSLARDGFLPQTFQKVSKTHKVPHYATLLTGILSAISSGIFSLANMASLVNISTLAYLVLLAIALIILRKDKGLPQKDEFKVPFVPVLPILSIIVCLSFMSQYSWQTWSAFGIAVLIGSAIYAFYGYKHSKY

SEQ ID NO: 57348 - protein, 259 aa, Xylella fastidiosa 9a5c
MVAVNLKTKEEIEQMRIAGRLAATVLDVVAPYVKPGVTTAELDQICHDYIVTVQGAIPANLGYRGFPKTICTSVNNVICHGIPSDAKVLKDGDIINIDVTVIKDGWHGDTSRMYYVGNPSVMARRLVETTYEAMWRGIRAVKPGATLGDIGHAIQIYAENERFSVVREYCGHGIGKVYHDNPQVLHYGRPGEGLVLESGMTFTIEPMINEGTRHHKVLPDGWTVVTKDRKLSAQWEHMIAVTEDGVDVLTLSPNDIGNT

SEQ ID NO: 57349 - protein, 514 aa, Mycobacterium smegmatis str. MC2 155
MTDEDLRDDLAEVLRRRALTQDDARPDAVERRRASGARTARQNIADLVDDGSFVEYGRFAIAAQRQRRSLDDLIARTPADGLVAGTARVDGQPCAVLSYDYTVLAGTQGALGHLKKDRLFDLIERMRLPTVFFAEGGGGRPGDTDIPTVSSLDVRAFKLWAALSGLVPRIAVVRGRCFAGNAVIAGAADLIVATEDASIGMGGPAMIAGGGLGEVAPEDVGPISVQAPNGVVDIVVADEPEAVAVTKTLLGYFGGPVDAGPERDQTPLRTMVPERARRAYPVGPVIETLADEGSVTYLREKFAPEMVTAFARMAGRPVGILANNTMVMAGAITATASDKAARFLQLCDAFGIPVVSLVDCPGYMVGPAAEAEALVRRGSRLLVAGAALTVPLIAVILRRGYGLGAQAMCGGSLHEPLLTVAWPGAHLGPMGLEGAVRLGMRKELEAIENEGAREEAVRAATKAAEEHAKALNSASMFEIDDVIDPAETRSVIISTLVAAAHHEHANRPRFVDTW

SEQ ID NO: 57350 - protein, 598 aa, Erythrobacter sp. NAP1
MRFAIAAGISALALAPVTVPAPALAQEAKPIEEQIGAGGRPVGANWSRSPVYAEHGMAATAHPLATQIALQILRDGGSAVDAAIAANAALGLMEPTGNGIGGDIFAIIYDPATDKLYGLNGSGRSPMGQTLDQLLEKLDGADALPPVGPLPVTIPGTVDGWFAMHERFGKLPMSEILAPTVEYAREGHPVAPIIAMYLDRSLRAYAGRLESYPFEFDNARATYFPDGTAPKAGDVFKNPDLANTLETIGREGRDAFYKGELAETMVDYLQRQGSAYTMDDFAAHKSDWVEPACAEYRDGFELCELPPNTQGFAALQMVNILKNVDLSQWERGSPEVIHYITEAKRLAYADVARFYADPDFTRFPEELLSEEYGRERFALIDPARATPEFGPGEPKLEGEGDTTYLTVTDESGLMVSLIQSNYRGMGGGLVPDGLGFMFQDRGELFSLDPAHPNAYEPGKRPFHTIIPAFVKKDGEPFMTLGLMGGGMQPQGHVQVLINMVDYGMDIQEAGDAARINHDGGRQPTEALSGPAADPLGTLNVEPGIPEATVEALRAMGHNVRVVSNGIMFGGYQAIMRDAETGVYAGATEMRKDGQASGY

SEQ ID NO: 57351 - protein, 512 aa, Glycine max
FHKMPREKAISSSAAKPSEPEEPVESDEKVDFEEANDPEEAMEEEVEYEEVEEEEEVEEIEEEVEEVEEEEEVEVEEEEEEEEEEEEEEEVEVEEVEEDDAMQNHSSDEAKVEDEDEKRKHAELLSLPPHGSEVYIGGIPHASDEDLKSLCERIGEVAEVRIMKGKDSSENKGFGFVTFTSVELASKAIEELNNTEFMGKKIKCSKSQAKHRLFIGNVPRSWGVEDLKKIVTEIGPGVTGVELVKDMKNTNNNRGFAFIDYYNHACAEYSRQKMMSPTFKLGENAPTVSWADPKNAESSAASQVKAVYVKNLPKNVTQEQLKKLFERHGKITKVVLPPAKSGQEKNRIGFVHFAERSNAMKALKNTERYELEGQLLECSLAKPQADQKSGGSNTQKPGPGLLPSYPPHVGYGLVGGAYGALGAGYAAPGLAQPLLYGGGQTPAGMAMMPMLLADGRIGYVLQQPGMQPQAPPSHHRGGRGGGGSGSGNRNAGSSSKGRHNNDGGHGRRYRPY

SEQ ID NO: 57352 - protein, 247 aa, Magnaporthe grisea 70-15
MGDSDTANGTVRTSVPGVPVTIERKPFVQDEHEDQRLPNAGTARVNTAASYEHPNGTTEDGYARRHSHQTVLQQHCDFFDRDQDGVIWPQDTFVGFYRLGFGVILSLISVFIIHGNFSYPTSPSWIPDAFFRIHLDRIHKDKHGSDTGTYDTEGRFVPQKFEDIFAKYAPGQDSLTWRDVMQVLHGQRLYADPIGWFAAVFEWLATYILLWPEDGHMKKDDIRGVYDGSIFYTIAARREERVRQKSS

SEQ ID NO: 57353 - protein, 523 aa, Glycyrrhiza echinata
MLVELAITLLVIALFIHLRPTLSAKSKSLRHLPNPPSPKPRLPFVGHLHLLDKPLLHYSLIDLSKRYGPLYSLYFGSMPTVVASTPELFKLFLQTHEASSFNTRFQTSAIRRLTYDNSVAMVPFGPYWKFIRKLIMNDLLNATTVNKLRPLRSQEIRKVLRVMAQSAESQVPLNVTEELLKWTNSTISRMMLGEAEEIRDIARDVLKIFGEYSLTDFIWPLKKLKVGQYEKRIDDIFNRFDPVIERVIKKRQEIRKKRKERNGEIEEGEQSVVFLDTLLDFAEDETMEIKITKEQIKGLVVDFFSAGTDSTAVATDWALSELINNPRVFQKAREEIDAVVGKDRLVDEADVQNLPYIRSIVKETFRMHPPLPVVKRKCVQECEVDGYVIPEGALILFNVWAVGRDPKYWDRPTEFRPERFLENVGEGDQAVDLRGQHFQLLPFGSGRRMCPGVNLATAGMATLLASVIQCFDLSVVGPQGKILKGNDAKVSMEERAGLTVPRAHNLICVPVARSSAVPKLFSS

SEQ ID NO: 57354 - protein, 149 aa, Magnetospirillum magnetotacticum MS-1
MTDYIKKILSARVYDVAIESPLDPMPRLTKRLGRPVLLKREDLQPVFSFKLRGAYNKMASLPRDQLERGVICASAGNHAQGVALGAARLGVRAVIVMPRTTPAIKVDACRARGAEVVLHGDAFDEALAEARRLEAQWGLTFLHPLTTRR

SEQ ID NO: 57355 - protein, 463 aa, Yarrowia lipolytica CLIB122
MKAWHWSVTLVVIYLAIPVILYLLTRKDDRKPLSDIRKRKRTIVLVLGDLGRSPRMLYHARSLARSGHKVDLCGYDGAKPFDEILNNDLIKIHHIPLILNTRKLPFVVFGILKVIRQHWLLISLLYKLRGADYLLVQNPPSIPTLGVVRFYNLFLSTRTKVVLDWHNFGYTILALKLPETHPMVKFAKFYEGFFGGRAFVHLCVTVLMGQAMRKTFGMSGRRIVPLHDRPAFHFKPLSESEKLDVLRDFKETLYDDMTADHKIIVSSTSYTPDENFNILLDALALYDESKLDLPPLRVIITGKGPMMPEFLAKVEKLQLKRVSIRTAWLEFADYPRILGAAHLGVSLHESSSGYDLPMKVVDMFGCGIPVVSVDYAALSELVKTNTNGVAVKGHVEMGNTFMSLFSNRGKLDNIKRGAMIESRNTWDQTWVKTVGPLFDIGEYVQQRPDEDYDFSSSSSDDDH

SEQ ID NO: 57356 - protein, 183 aa, Triticum aestivum
DHDVKHTFLPFLIKSLSMALSKYPLLNSSFVEETNEVILKGFHNIGVAMATEQGLVVPTIKKVQSLSILEITKELSRLHEMALQNRLSTNDITGGTITLSNIGAIGGKFGSPVLNLPEVAIIALGRIQKLPRFDDEENVYPSSTINVTVGADHRVVDGATVARFCNEWKSLVEKPELLLLHMR

SEQ ID NO: 57357 - protein, 320 aa, Triticum aestivum
  misc_feature (168)..(168): Xaa can be any naturally occurring amino acid
TIEQVCTKKQAGTGPEFPGYRRPTRPLENVRFYKEEEKNDPEFAKKLASLADLFVNDAFGTAHRAHASTEGVTKFLKPSVAGFLLQKELDYLDGAVSNPKRPFAAIVGGSKGVVPRLGLSNPLLEKCDILLLGGGMIFTFYKAQGLSVGSSLVEEDKLELATSLLAKXAKAKGVSLLLPSDVIIADKFAPDANSQTVPASAIPDGWMGLDIGPDSVKTFNDALDTTQTIIWNGPMGVFEFDKFAVGTESIAKKLAELSKKGVTTIIGGGDSVAAVEKVGVADVMSHISTGGGASLELLEGKELPGVVALDEGVMTRSVTV

SEQ ID NO: 57358 - protein, 90 aa, Brassica napus
MDSDSWSDRLASASRRYQLDFLSRSDNFLGFEEAEGEEEFREEYACPFCSDYFDIVSLCCHIDENHPMDTINGVCPVCAVKVSSDMVAHI

SEQ ID NO: 57359 - protein, 149 aa, Zea mays
KFPSGNYPSSEGNESDHLVHWCHGAPGVALTLAKAYEVFHDDYFEQSAAEAAEVVWEGGLLKRVGICHGVSGNAYAFLSLYRLTGNVEYLYRAKAFACFLLEKADQLIAEGAMHGGDRPFSLFEGKAGMSYLLLDMVDPSESRFPAYEL

SEQ ID NO: 57360 - protein, 168 aa, Glycine max
  misc_feature (18)..(18): Xaa can be any naturally occurring amino acid
  misc_feature (35)..(35): Xaa can be any naturally occurring amino acid
  misc_feature (54)..(54): Xaa can be any naturally occurring amino acid
  misc_feature (85)..(85): Xaa can be any naturally occurring amino acid
  misc_feature (130)..(130): Xaa can be any naturally occurring amino acid
  misc_feature (148)..(148): Xaa can be any naturally occurring amino acid
  misc_feature (162)..(162): Xaa can be any naturally occurring amino acid
ARDFLGGARVFVLNIQEXLAMATVISVYVEHMVVXSLAATGKGERACYLVHSLXDSYRDIITCPFVNVALGSKDRTSDGREYGGXVSENCVAHMLSAGTYSDDAAEATEVVSYAVQDQDVPRCSTGLYKXSPTGTWRLSFSNDETLPXHEHAVIDNMPLSDXVLETMI

SEQ ID NO: 57361 - protein, 120 aa, Triticum aestivum
  misc_feature (26)..(26): Xaa can be any naturally occurring amino acid
  misc_feature (37)..(37): Xaa can be any naturally occurring amino acid
TRPTAAAPTWWPPASPAAPRWGRRSXGTFVLVYTVFXPLPIGFAVFMVHLATIPITGTGINPARSLGAAVIYNKKAAWDNHWIFWVGPFVGALAAAAYHQYILRAAAIKALGSFRSSRSN

SEQ ID NO: 57362 - protein, 414 aa, Bacillus cereus ATCC 10987
MNVSSTVAIIGLGYVGLPLAVHFAERGHTVLGLDKDTRKIESIIQGESYIPDVSSKLLQSLLTRKKLIVNTPDQGIADFQNSDYVIVTVPTPINEQREPDLSALISASHYIQQNLQKGQTFIFESSTYPGTLEEVIIPIISQTGKKVGEDFYIGYSPERIDPANSQYSVQTIPKVISGQTEMCKQKVQALYSTIFDVVVPVSSPKVAEMCKLFENIQRLVNISLVNELNILCESLGIDFYEALEAASTKPFGFTPYWPGPGIGGHCIPVDPLYFQWRIKKNGAMSRLIEAAHVINEEMPEKMVRKVKGVVQSPATVLIVGIAYKKDVNDLRESPALPIIELLIKEGYEIEYHDPYISSAKFGDKVYQSVSLDEQVVKQADCILILTDHSNIDWKIFKGIKQVVDTRGIIKKVSV

SEQ ID NO: 57363 - protein, 673 aa, Shewanella sp. MR-7
MVEKITGMLALIGVLSLFCQWVGWKLRLPAILPLLLCGLLLGPAFGVLNPDAIFGDLLFPIISLGVAVILFEGALTLNFKEIKDHGRMVTHLVSIGMVITWGCISVATFYLLNFSWEVALLFGALVVVTGPTVIVPMLRSVRPKSQLASILRWEGIVIDPIGALLAVLVFEYITVSGDPTSHVLFALGSMLTLGLGLGAVSGYLIGQVIRRNLLPHYLRNTAVLTLMLGIFVGSNLLQEESGLLTVTVMGIWLANMRGVDIAEILEFKETLTVLLISALFILLAARLDSNAMMDLGWGGVGVLAVTMLIARPLSIWVSGIGTSLSRADKWFLCWIAPRGIVAAAVSSLFAIKLEATNVQGADAIVPLVFLIIIGTVVIQSLTAGRWAKYLGVTSGSAQGLLIFGASKFSRELAKILKAKDVKVLLADSNWDNIRLARMDNIPVYFGNPASEHAETYMDLTGIGRVLIMSPYKQLNPLVTFYFQDVLGSKKVFGLNNAEQGSARHQLSESYKQRLCLFGDAVSYAKIASQMAKGAQLKVTNLTENFTFEHFRKRYGETALPLVYLTKEGKVVIVSGNETQFPNGIELISLLPVEALEEAKIQQAIAEQEAIAAQAKAAEEAALAKAKAEVEAEAERQRLEQEEQMKASEQSQPETGSQEAIATSDESLAKGYML

SEQ ID NO: 57364 - protein, 167 aa, Oryza sativa Japonica Group
MAAANDGADAGDSKILLISSDGQHFQVTEAEASMSKLVSNMIEDDCTENGVPLPNVASNVLAKVLDYCKKHAAAAAAAAEDVAVKDQELKSFDASFIDVDNTMLFGLILAANYLNVPSLLDLACQHTADLIKGKTVQEIRDTFGIVNDFTPEEEEEIRKENEWAFEN

SEQ ID NO: 57365 - protein, 300 aa, Streptococcus thermophilus LMG 18311
MHFYLISFKIILLQLEKENRMETYTLSNGVTIPKIGFGTWQIPEGEEAYNSVSFALKAGYTHIDTAQIYGNEVSVGKAISDSDVAREDLFLTTKLWNDKHDYDLAKASIDESLERLGVDYLDLFLIHWPNPKALRENDAWKAGNAGAWKAMEEAYKEGKVRAIGVSNFMQHHLEALFETAEIVPHVNQILLAPGCTQEDLVAYCRERDILLEAYSPLGTGSIFGNEDVEAVAERNGKSVAQVALRWSLQKGFLPLPKSVTPKNIEANLDIFDFDLSEEDMAVLDKIQGIKTQVDPDTVNF

SEQ ID NO: 57366 - protein, 185 aa, Streptococcus thermophilus LMG 18311
MMETIMKWSDQAYGIKYVPLRYFNVAGAKPDGSIGEAHGPETHLLPIILQVAQGVREKIIIFGDDYNTPDGTNVRDYVHPFDLADAHLLAVEYLRKGNESTAFNLGSSTGFSNLQILEAARKVTGKEIPAEKAGRRPGDPDTLIASSEKARTVLGWKPQFDNIEKIIESAWAWHSSHPKGYDDRD

SEQ ID NO: 57367 - protein, 533 aa, Wolbachia endosymbiont of Drosophila melanogaster
MNIALKHRPSSFKDLVGQDILVRVLENAFILNKIPQSILLSGSSGVGKTTTARIIALCLNCSLGPIFEPCGSCENCLAIKNSSHPDVIEIDAASHTSIDDIKVILGDICYSPISSKFKVYIIDEVHMLSSSAFNALLKTLEEPPSSVKFILATTEIKKIPITIIARCQRFDLHNIPVAKIVERLNDVAQKESYSIEKGALELIARHSGNSMRNALFLMNQAVLYSKDGAISTKNVTDILGLVDKDIIFDLLGAILEGDLQKALSVFDKAVKTANPLSIFEGLLQTIQLVCRFLITKEIDNAVTEHEKNRIKDLSIKRSLIFFSRLWKMLLKGIQDIKTSTCNDVAAEMMLISLCYLSDLPSPEQVIKKVLSQNVEQGNRQGRPVAPSPSVIQVADYSDPKKYVESKQQPHSVIPVRDTGIHVENKQQNYDFDKILQLLRRSNQIYLYKQLCNNLQLIDCKPGYLKLKAVSKLDSNFCNDLKNYLNQVTQQEWVVAVDTGYINREVSNLNYAPAVKDILDTFKGAKVVNIENKE

SEQ ID NO: 57368 - protein, 398 aa, Vibrio sp. Ex25
MTFMFSNLPTPVLDPILSLSVAYRNDDRPNKVDLGIGVYKNSAGETPIMKAIQMAQDVVVETQKTKSYVGLAGCEEFNKSMIDLLLTGTSAMDRVAAIQTPGASGALRMLGDLMKVAQPDTTVWISNPSYVNHKPVMEAAGLKVKFYHYFSPETKQVDTAKMMDDLAKAGPSDVVLLHGCCHNPTGADIDFSAWQVITELSQKNGFTPFVDIAYQGFGDGLEEDAKGLRFMADNVEEMLITTSCSKNFGLYRERTGAAIVVGKNMQDVANAKGKLLTLARSTYTMPPDHGAALVKTILQDDNLTSVWKQELSEMQHRLVSLRQSLCNELRNNHNTDQFDFIEGHKGMFTVLGFSENQMAQLREDYGIYGVGDGRINIAGLTETHIPYVADAIKKVSQA

SEQ ID NO: 57369 - protein, 479 aa, Arabidopsis thaliana
MIPGLLVEIHRVYDFITEILEVTNLTYPCTGPCFANLDMLVTVDPANIHHIMSSNFANYPKGPEFKKLFDILGDGIFNADSELWKDLRKSAQSMMMNPEFQKFSLATSLKKLEKGLVPLLDHVAKEKLAVDLQDMFQRFTFDTTFVLATGYDPGCLSVEMPEVEFARALDDAEEAIFFRHVKPEIFWRLQGLLGLGDEKKMTKARSTLDRVCSKYIAIKRDEVSRGTNNVDSHSKDLLTSYMNLDTTKYKLLNPSDERFLRDTILTFMLAGRDTTGSGLTWFFWLLIKNPEVIAKIRQEINTALFQRSKVDDDASNNNDSDSFSPQELKKLVYLHGAICESLRLYPPVPFQHKSPTKPDVLPSGHKVDANSKILFCLYSLGRMKSVWGEDALEFKPERWISESGNSVHEPSYKFLSFNAGPRTCLGKEVAMMQMKSVAVKIIQNYEMKIVEGQQIEPAPSVILHMKHGLKVTVTKRCLV

SEQ ID NO: 57370 - protein, 754 aa, Oryza sativa
MWRLKQFMPREQPSGLEGRTVDVGNVRVHVREPVAEGGFSCVYLARDAANPAKQYALKHVVIQDEESLDLVRKEIMVMRSLKGHPNVVALVAHAVLDTGGRAREALLVMEFCEKSLVAALESRGAAHFDEQQVALIFRDALGCLLYRICYLKSAFDGESKLQILNGNYRIPELPKYSSPITSLIKDMLQSSPDVWFRVNELLPLELQKDLPDGSPSGSAFESHITEDEAPSRATISPSTDNTRSTSSEDPSNLRSQGLSKAAENFDNLKVNFQNNVSSLNATRRLKEQQLEAEPREKIEGTPPELRQGLFTSSPGTPSPDPKPWSAFPEEPKAQAAVTVKVAYHLYRNYTTKTTIAQGAALAGARARLPGGGPPQSVDYGGGQASDSSGGFWVKGSREISFVERFEALWGEWVSGEFQLNLFPWDVFVRAGTADDLPPPYPSNRGIRGSGRVSGNGRAIVPAGSYTRAHTDMATQIHHLEQEAYCSVLRAFKAQSDAITWEKEGLITELRKELRVSDVDHRELLNRDLYALAYDINTANESWEWVDLKQPDLLHFWVQLKLFGWASASGELELMGPEDIRWQGDDPGIYQGVRGAPGSGGKKSSSRGGPTPGTGRGRGLPKHVSRKDFPPSQNGVGKRSSDDIDILHTESLIKEVERVFSINNPDPLEVEKAKKVLKEQEQSLIDAIARLAEASDGESDEHNRVRRNAPYAGSQHQANYADAMAVDGGHMLGGADAVLTPAELIDCYYKMQVKA

SEQ ID NO: 57371 - protein, 890 aa, Arabidopsis thaliana
MRFLSFLIFVFAVLGLVQAQDQSGFISLDCGLVPTEITYVEKSTNITYRSDATYIDSGVPGKINEVYRTQFQQQIWALRSFPEGQRNCYNFSLTAKRKYLIRGTFIYGNYDGLNQLPSFDLYIGPNKWTSVSIPGVRNGSVSEMIHVLRQDHLQICLVKTGETTPFISSLELRPLNNNTYVTKSGSLIVVARLYFSPTPPFLRYDEDVHDRIWIPFLDNKNSLLSTELSVDTSNFYNVPQTVAKTAAVPLNATQPLKINWSLDDITSQSYIYMHFAEIENLEANETREFNITYNGGENWFSYFRPPKFRITTVYNPAAVSSLDGNFNFTFSMTGNSTHPPLINGLEIYQVLELPQLDTYQDEVSAMMNIKTIYGLSKRSSWQGDPCAPELYRWEVLTFGLSIRNLSGSNLSGTITSDISKLTHLRELDLSNNDLSGDIPFVFSDMKNLTLINLSGNKNLNRSVPETLQKRIDNKSLTLIRDETGKNSTNVVAIAASVASVFAVLVILAIVFVVIRKKQRTNEASGPRSFTTGTVKSDARSSSSSIITKERKFTYSEVLKMTKNFERVLGKGGFGTVYHGNLDDTQVAVKMLSHSSAQGYKEFKAEVELLLRVHHRHLVGLVGYCDDGDNLALIYEYMEKGDLRENMSGKHFNLVESISLDSLKHSKPGTGKHSVNVLSWETRMQIAVEAAQGLEYLHNGCRPPMVHRDVKPTNILLNERSQAKLADFGLSRSFPVDGESHVMTVVAGTPGYLDPEYYRTNWLSEKSDVYSFGVVLLEIVTNQPVMNKNRERPHINEWVMFMLTNGDIKSIVDPKLNEDYDTNGVWKVVELALACVNPSSSRRPTMPHVVMELNECLALEIERKQGSQATYIKESVEFSPSSASDFSPLAR

SEQ ID NO: 57372 - protein, 705 aa, Deinococcus radiodurans R1
MTAGRACAWTCTACACAASNGSAGNARPTRSSGPARTRREGERWLIRFSLREVSFTGVPCTGDRAGAGAVRILGPVLIALSHAAKEYGPLTVLQDITFAVEPGDRVGLVGRNGAGKSTLLRLLTGQLLPDGGEVRHAPNVRARALQQDPVFPAGATIDTVLESAFRDLDALEAELAAAAAAMSSGSEAAILHHEALLEQFARRGGYERRSRKEQVTLAFGFRGREHDPVTGLSGGERTRLGLAALLVENPDVLLLDEPTNHLDIVMVEWLEGFLGRYPGAVLVISHDRQFLDNVTKETAYLRGGTLKVYAGGYTKFREQLDLELEQQAALFAQQSKQIADLQSSADRMKIWGLGMSKLARRAKAMQARVDRMQKGAVAAPPPEERTTRITFHAPESGEVVLDARHLTRRMGERTLFADLDLQIRQGERVAIIGRNGAGKTTLLRTLLGLDPSDDPRGRVLTGARVSAGYYDQALRGVDPSQTLYDVAREYVQKDHEAHTLLGTFMFPFDHHDKPARILSGGERARLALLRLAQEDHNLLVLDEPTNHLDMEMLEALEDALAAYTGTLVMVSHDRAFIEGLADRIWLIEDGQFYEYPGWEDYRAKHRSAAELEAEAARTVAAATPKVALAPKAKGLWHLKREVEAIEADIARLEAELEGAQRALAEADMNADFTALGQAAHELEVQLEDKMALWGEKQGEVEAKGG

SEQ ID NO: 57373 - protein, 330 aa, Pseudomonas sp.
KLANVVILATGGTIAGAGASAANSATYQAAKVGVDKLIAGVPELADLANVRGEQVMQIASESITNDDLLKLGKRVAELADSNDVDGIVITHGTDTLEETAYFLNLVQKTDKPIVVVGSMRPGTAMSADGMLNLYNAVAVASNKDSRGKGVLVTMNDEIQSGRDVSKSINIKTEAFKSAWGPLGMVVEGKSYWFRLPAKRHTVNSEFDIKQISSLPQVDIAYSYGNVTDTAYKALAQNGAKALIHAGTGNGSVSSRVVPALQQLRKNGTQIIRSSHVNQGGFVLRNAEQPDDKNDWVVAHDLNPEKARILAMVAMTKTQDSKELQRIFWEY

SEQ ID NO: 57374 - protein, 225 aa, Triticum aestivum
  misc_feature (109)..(109): Xaa can be any naturally occurring amino acid
MSAAVGGAEFHGFGGAAQLPRSRMLGRPVRVAPPGATPAGSGPSAASIRAVSTPLKKDAKEVKRSKVEIIKEKSNFLRYPLNEELVSEAPNVNETAVQLIKFHGSYQQXDREVRGQKNYSFMLRTKNPSGKVPNQTYLAMDTLADEFGIGTLRLTTRQTFQLHGRRNKNLKRVLRTVRKNMGPGLGACGNPHKNVLAPAAPYGKKESFLPRKCGNIGDFLGPKGG

SEQ ID NO: 57375 - protein, 475 aa, Oryza sativa
MATAPAPVSLSAAASTVPARLLVGRGAAAAPVARRRARMVVVRAKIREIFMPALSSTMTEGKIVSWSAAEGDRVAKGDAVVVVESDKADMDVETFHDGIVAAVLVPAGESAPVGAPIALLAESEDDLQAALAKAQELSKAQPQQAPPPSDAAAPPPPPPPPAAAPAAPAPVAAGTKGIATPQAKKLAKQHRVDLAKVAGTGPFGRITPADVEAAAGIEPKPKVVPAASAAPVPLSAPAIGAVPQAAELPPVPGATVVPFTGMQAAVSKNMVESLAVPAFRVGYPIVTDKLDELYEKVKSKGVTMTVLLAKAAAMALAQHPVVNASCRDGKSFTYNTNINIAVAVAIDGGLITPVLEDADKLDIYLLSQKWKELVKKARAKQLQPNEYSSGTFTLSNLGMFGVDRFDAILPPGQGGIMAVGASKPTVVADKDGFFSVKSKMLVNVTADHRIVYGADLAAFLQTFAKIIEDPESLTL

SEQ ID NO: 57376 - protein, 167 aa, Mesorhizobium loti MAFF303099
MNRRDFLLSGAAAIGLVGAAATMLRMGSPQVAQAAEKFEVTKTDDEWKAILSPAAFDVLRKQGTEYPGTSPLLNEHRKGIFACAGCDLPVYPSETKFDSGTGWPSFWQEIANGIGKTEDRSLGMTRTEVHCRRCGGHLGHVFDDGPAPTGLRHCINGVALSFKPAAA

SEQ ID NO: 57377 - protein, 473 aa, Burkholderia sp. 383
MHQGYPTDLAARFERQRRAFALELNPALATRLARLDRLAAWLDAHEHDIVRAIDADFQGRSTHETRLAEVFIVRAGLRHARRHLKHWMRARRVPTALHFRPGHNRLMPQPLGVTGIISPWNYPLQLSLGPALAALAAGNRVLIKPSELTPALSDLLVSMARDTFAPDELDVVVGDVELGKAFAGLPFDHLFFTGSTQVGRVVAQAAAANLTPVTLELGGKSPAILDASCNVAVAAQRIAFGKLLNAGQTCVAPDYLLVPTGTADSVALQLTRAVARLYPTLAANPDYTAIISERHRARLTEMVDEARRAGARILEVNPAGETFGSSSRKFAPTIVIGAPADTRLMNEEIFGPVLPIVEYANLDDALAYIQGRARPLALYWFGEDASRRDRVLRETVSGGVTINDCLWHLVQENQPFGGVGQSGMGAYHGQWGFDTFSKLKPVFHQTRWNGAVLFHPPYGRVFDLLLRTLSRLA

SEQ ID NO: 57378 - protein, 604 aa, Cryptococcus neoformans var. neoformans B-3501A
MIALTDEIYFLWVKTLKQLVSITLDRQVTDITPSDPDMLWIRQLWPLGTKAINREKAEALCAQIGLQIKADGMLDITVFHDLIKASQTRPDINQVYRDLTLSGLLDKGRVVSFLTHIQRIPSSSVENVFNRYKSGDLWTIDSLTSFLSSSDNTPNQPQDMTHPLQHYFISSSHNTYLVGEQWKGESTVEGYIRVLLAGCRCVEMDVQSGDVEPVVYHRKTLTSSVPVRDICRAIKQYGFVTSPYPIIISTEIHCASEQQNRLAIILKEVFGDMLVSAPLVEEFSELPSPEDLKGKILFKAKPPKPELNSPKLEANLFYQESPSSTDSDTSFVRLARRLSIQSKTERPDIFSPQLSELLVYTHGVKYQGFSKLNEYLPSHQFSVSERTAAKILKVNKVDWIKHNFKHISRVYPRGTRLGSTNFNPVDSWSAGCQIVALNWQTLDESILLNHAMFHDSNGYILKPLSLREKVVEVPEKYLLTVRIISGQRTPLCADLYVEAILNGKISKRTRALSQVTLNPLWDETLTFEITSTPSLLMLNFLHLEVRNKALQAQWMRPVSLAPRGYHHLPLYDSLLSRFVFATLFVKITVEKLQDVVENEKSNSI

SEQ ID NO: 57379 - protein, 366 aa, Cryptococcus neoformans var. neoformans JEC21
MLSTFRTGVKDIELANPPTDSISRIEFSPTADILAVASWDNNVRLYDVNSQGQNQGKAMYSHQAPVLDLTWSADGQYVFSSGCDNAAQMYNVQTQQAQQVAQHDAPIKCVEFAEVPGSGQVLITAGWDKKLKYWDLRSPNPIATIDLSDRAYSMSVAQQLLVCATGDRQLHVINLSSPTTIFKSIESPLKWQTRVVSCFPTGDAFAVGSIEGRVAIQYPGEDDKRNFSFKCHRYDIPTGSMPRTPAVSGSQNVFAINSLTFHKVQGTFCSGGSDGSLTFWDGISRTKLKTFSCKDLNNGDTDVRPPRFGTPIVSTSFNRTQEIIAYAMSYDWSKGHSGVPPAGQNINKVMLHPVKPEEVNKKPKRN

SEQ ID NO: 57380 - protein, 400 aa, delta proteobacterium MLMS-1
MQLKKAADCAAIIAAGGSGSRMGGGVPKQFLELAGVPLLIHGLRAFAAVPEIGTLVVSSRADYLAYTRELAAHHGFTELLVVAGGDSRQQSVMNGLAAITDSGRQCRLVAVHDGARPLVSPELIRRCLQAAGRHGAAIAATEVQDTLKQSGKPPLIDATVDRAGLWQAQTPQVAEFSLLRRALEQARAAGFTGTDEASLLERLGVPVALVEAGAGNLKITRPHDLPLAEALMSKQAPSPTAATRIGHGYDVHRLVPERKLILAGVEIPHRLGLLGHSDADVATHALCDAILGALGNGDIGRHFPDDDPRYRGISSLKLLEAVIAQAAAAGWRLNNADLTIIAQQPKLAPHLPAMVRQLAAACQVSPERLNIKATTTEGLGFAGRQEGIAATAVVLLTPLP

SEQ ID NO: 57381 - protein, 381 aa, Mycobacterium smegmatis str. MC2 155
MARDYYGLLGVSKGASDSEIKRAYRRLARELHPDVNPDEEAQHRFTEIQQAYEVLSDPEKRRIVDMGGDPMESVGGAPNGFGGFGGLGDVFEAFFGGGTTSRGPIGRVRPGSDSLLRMRLDLEECATGVTKEVTVETAVLCDLCHGKGTNGNSSPATCDTCGGRGEIQTVQRSLLGQVMTSRPCPVCGGVGEVIPDPCHRCGGDGRVRARRDISVKIPAGVGDGMRVRLAAQGEVGPGGGPAGDLYVEVHEKPHDVFVRDGDDLHCTISVPMVDAALGCTVTVDAILDGPTELTIPPGTQPGSVTTLRGHGMPHLRSGVRGDLHAHIDVVVPTRLENSDIELLRKFKENRTRDTASVRTAQGSAGSGGGLFSRLRETFTGR

SEQ ID NO: 57382 - protein, 152 aa, Zea mays
  misc_feature (17)..(18): Xaa can be any naturally occurring amino acid
  misc_feature (20)..(20): Xaa can be any naturally occurring amino acid
  misc_feature (34)..(34): Xaa can be any naturally occurring amino acid
VRRIEEEYFSLSESRAXXDXGRGFVFGLGGGQDXDRGPRGRGRRGGRASEETKWVPVTKLGRLVADNKITKLEQIYLHSLPVKEYQIIDHLVGPTLKDEVIKIMLVQKQTRAGQRTRFKAFVVVGDGNGHVGLGVKLSKEVATAIRGAIIFA

SEQ ID NO: 57383 - protein, 611 aa, Xylella fastidiosa 9a5c
MGVSMNTVPFPSQGGIDRRRFLQGLALGGVAAGTGLWRLPVHAANPELPPLQRRTTPLELRIGQSSVNFTGRMRPAITVNNSLPGPVLRWRQGDTVQIHVTNTLPDVMTSIHWHGIVLPSNMDGVPGMSFDGIAPGEHYLYRFQLHQSGTYWYHSHAMFQEQAGLYGALIIDPLEPPPYRADREHILLFSDWTDLDPAALFRRLKKMSSYDNTYQRTVRDFFHDIRRDGLRTTLADRRMWGRMRMTPTDLSDVNAHTYTYLLNGTTPAGAWTGLFRPGEKVLLRLINGSAMTYFDVRIPGLKLTVVAVDGQYVHPVTVDELRIALAETYDVLIQPHGQDAFAIFAQDMGRTGYACGTLAVRPGLHAPLPALDPRPRLTMQDMGHGMAHGQHGSRASEMADMPGMTHPGRLGDHASHASQPPAQTIPHGSHSLPADRTAPRHPASEQNNPLVEMHVDAPQPLLNDPGIGLRDNGRHVLTYADLHSLFDDPDGREPGREIELHLTGHMEKFAWSFDGIPFASAQPLRLNYGERVRIVLVNDTMMAHPIHLHGLWSDLEDANAAFQVRKHTIDMPPGTRRSYRVRADALGRWAYHCHMLYHMESGMMREVQVRP

SEQ ID NO: 57384 - protein, 266 aa, Vibrio sp. Ex25
MEVKIFQVDSFTSDVFKGNPAGVCITESSLDEEVMLAIAAEMSLSETAFLSLNTMQLRWFTPETEVALCGHGTLATAHVLREQGLYNTGDTIDFATLSGVLTAQLDHDDIHLVFPAPLLDMRASINTDLLHGLGLDVADVIAYGQFDNKQLIVINDESLIEQLEPDFSALLKQKGRGVVITAQSSTDADFVSRYFAPWVGVDEDPVTGSAHCALCVYWAKELGKAQLKGFQASKRSGVVYTELLSPEYVKLSGSAVTMLRGDMRIA

SEQ ID NO: 57385 - protein, 371 aa, Yarrowia lipolytica CLIB122
MSMKQLETSMSSVSLQEKKPTRIKIALHPQSKSEQNETDRASKIPTGRISTTQPQTYYRPTNLTKTPASQVSRRSSYTTDPPSPLTGITGFRNYSLDDFEIGKALGKGKFGKVYLVKDKKTGFVSALKCMEKKELVEGNVEKQFRREVEIQSNLRHTNVLRLFGHFHDKDRVYLILEYVVHGELYKLLRNQKRFTESTASSYIYQMSEALLYLHGKNIIHRDIKPENILLHFNDTIKISDFGWSVHAPSNRRSTLCGTMDYLPPEIVQSRPYDKNVDVWSLGILMYEFLCGAPPFEEPGGAQATYRRIVKLDLRIPPYVSADAADLIKRMLTLDPAKRFKLKDMHKHPWIVRLRPTWKYKVPKTASHERSA

SEQ ID NO: 57386 - protein, 197 aa, Zea mays
NVAYDHEMDTTFMAKPYPGQAGNGLHVHISLLDKKTGKNIFASDDPLQSDALRHAIGGVLETMPASMAFLCPNINSYRRFGAQFYVPNAPSWGLDNRTVAVRVPTDSSENVRLEHRVAGADANPYLMLAAILAGVHHGLTNQVEPQAPIEGNSYEQLEQSLPNNLRDALRALDDSEVLNQYISPDYIDIFVACKESE

SEQ ID NO: 57387 - protein, 756 aa, Saccharomyces cerevisiae YJM789
MYNSSSNHHEGAPTSGHGYYMSQQQDQQHQQQQYANEMNPYQQIPRPPAAGFSSNYMKEQGSHQSLQEHLQRETGNLGSGFTDVPALNYPATPPPHNNYAASNQMINTPPPSMGGLYRHNNNSQSMVQNGNGSGNAQLPQLSPGQYSIESEYNQNLNGSSSSSPFHQPQTLRSNGSYSSGLRSVKSFQRLQQEQENVQVQQQLSQAQQQNSRQQQQQLQYQQQQQQQQQQQQHMQIQQQQQQQQQQQQSQSPVQSGFNNGTISNYMYFERRPDLLTKGTQDKAAAVKLKIENFYQSSVKYAIERNERRVELETELTSHNWSEERKSRQLSSLGKKESQFLRLRRTRLSLEDFHTVKVIGKGAFGEVRLVQKKDTGKIYAMKTLLKSEMYKKDQLAHVKAERDVLAGSDSPWVVSLYYSFQDAQYLYLIMEFLPGGDLMTMLIRWQLFTEDVTRFYMAECILAIETIHKLGFIHRDIKPDNILIDIRGHIKLSDFGLSTGFHKTHDSNYYKKLLQQDEATNGISKPGTYNANTTDTANKRQTMVVDSISLTMSNRQQIQTWRKSRRLMAYSTVGTPDYIAPEIFLYQGYGQECDWWSLGAIMYECLIGWPPFCSETPQETYRKIMNFEQTLQFPDDIHISYEAEDLIRRLLTHADQRLGRHGGADEIKSHPFFRGVDWNTIRQVEAPYIPKLSSITDTRFFPTDELENVPDSPAMAQAAKQREQMTKQGGSAPVKEDLPFIGYTYSRFDYLTRKNAL

SEQ ID NO: 57388 - protein, 482 aa, Prochlorococcus marinus str. NATL1A
MLEVNSHKHLKKYYQKNLALWPHNLTLTRLISRSLSRKDNTFIKLSSDSRNFWWPGLLIPLCLHNNKIVLILSERQYRRLFEVELPKLSSSRLGFDYVEGIELSPSDEKIWVLKYQDLIFANEKDLLKNRQLIFPESEFISSELRVSMSIKITPEDWENLIASHSRFEASIIEVHERLSRSLFNQSLRSDAVIRIDFRELLALKEILKDDLPSVMPWQRAFNVVNNGWVTWAKIDNQKLSWDWYIEPLLPLQILSGLLSKNTLLMLTNSGQSDSFFLDLNSKKFTFNVKVELGNKFDQEPIPLFVPKRQPLPNTSNFYRHIIRQCQRLILGRTHPTIILVDDLQLRLQITSELAGEFGLRVVHETTNIETNGIVCCSCNWWIANQYNLPTPDQLIFPVIPLPTLELPWIAAKVEMLKHQGRDWFREFLFPETLVILLKSLAIIRGKDVRVAILDGRMRYRSWGKLIFEALEPWVALERLLPY

SEQ ID NO: 57389 - protein, 297 aa, Mesorhizobium loti MAFF303099
MTDIAATAEMQAALLSRALPYMQRYEHKTVVVKYGGHAMGDIELGKAFARDIALLKQSGVNPIVVHGGGPQIGAMLTKMGIESKFEGGLRVTDQKTVEIVEMVLAGSINKEIVALINAEGEWAIGLCGKDGNMVFAEKARKTMIDPDSNIERVLDLGFVGEPVEVDRTLLDLLARSEMIPVLAPVAPGRDGHTYNINADTFAGAIAGACKASRLLFLTDVPGVLDKNKKLIDELTVAEAKALIKDGTVSGGMIPKVETCIEAIERGVEGVVILNGKTPHAVLLELFTEHGAGTLIVP

SEQ ID NO: 57390 - protein, 295 aa, Prochlorococcus marinus str. NATL1A
MEELIQKALSSSNKVSNNSLIEKIIPVGGGCIHKAWSIHFQNGKRVFAKSNYIDNINMFKFERECLSVLKRFANESYICVPETLDLISYQNISIFFLEWIDLKQCQQNVLGKGLALLHKSSSEWSKKNFGWEEEGFIGSSTQARGWNCNWGEFFVNYRLRPQLLQAKGWGVRVEDYEDVLIYLSSYLNDHQPKISLVHGDLWSGNCGSTKNGLGSLYDPACYWADREVDISMTKLFGGFDREFYKGYEEIWPLNKFSKDRTDIYNLYHLLNHANIFGGSYKENSLKILKDLRSRL

SEQ ID NO: 57391 - protein, 311 aa, Triticum aestivum
NPFPPPVPTLLCLNTGACRLFADFQKRFLPDSQIYIPTPTWSNHHNIWRDAQVPQRTFSYYHPESRGLDFAGLMDDIKNAPNGSFFLLHACAHNPTGVDPTEEQWREISYQFKLKNHFPFFDMAYQGFASGDPERDAKAIRIFLEDGHQIGCAQSYAKNMGLYGQRAGCLSILCEDEMQAVAVKSQLQQIARPMYSNPPVHGALVVSIILSDPELKNVWLGEVKGMADRIIGMRKALRENLEKLGSPLSWEHVTNQIGMFCYSGMTPEQVDRLTSEYHIYMTRNGRISMAGVTTGNVAYLANAIHDVTKSN

SEQ ID NO: 57392 - protein, 313 aa, Physcomitrella patens subsp. patens
MGNGGEFELSQEVVSVLPSDPYEQIDIASRITAMAVSTRVSKLETEAGKLRQKMTEKEHVIHGLQERISKATGALQEQSAKLSHSEAEQVKLVNEKNALATQVKNLLRDVAKLETFKRALMKSLEQEDENPPANSAMWKASRGTTRPKSQSAHTSPKQIMRGIDSARGSMTPRLTPLHTSMTSPQPKPKKEALPRASVTQIPSSLPTSGSSSPNSGHETLQGFHDNRSAFMNARVSVFIAARTARLDGKEFFRQARSRLSYEKFSSFLANIKELNAHRQTREETLAKAEDIFGPEHMDLHSAFEEVLSRHLSA

SEQ ID NO: 57393 - protein, 394 aa, Pichia jadinii
MTDIGESESDISTDVSALPMLSHSVSYTSIQKPPFVVSVIGSGNWGTTVAKIIAENTRENPLLFEQKVRMWVYEEEFEGSNLSDIINTEHVNKKYLPGIKLPDNLVAVPDLLEAVQYSNILIFNIPHQHLEKILSQLRGNIDPRARAISCLKGLRVNLDGVELLPDIIQDALGIHCGVLAGANLAQEVAEQRFSETTVGYPLPADYKPGDVDHTVLYTLFHRPYFHVHVIEDIAGISCAGALKNIIAISVGFVEGLEWGDNAKAAMLRRGLLEMIKFGRKFFPGCLVSSFTEESAGVADLFTTCTGGRNFKLAKIMAQTGKSAHEVEKEILNGQSAQGLITAKEIHELIKNKGCEEEFPLFETTYQILFHGVRIGILPYMLENKWSISKPNYSS

SEQ ID NO: 57394 - protein, 537 aa, delta proteobacterium MLMS-1
MADLQEYFNDFNKLPAFSRLTELALQPVELRAAVDPARIADYRCRGGGVELIYFGQRVNGQVLEALGELAAQAGVLEQYDLMRQGAVLNQIAGYASENRQVLHCSNRDIFAESPRQPEATARTANELAKLREFLEDLEAGRLANPAGEPFETMLQVGIGGSDLGPRALYLALRAYAKPGRQVRFISNVDPDDAAAVLQELDLSRTLVKVVSKSGTTLETLANEELVRRAYQDAGLDPKDFFIAVTGQGSPMDNPEHYLRSFYMFDYIGGRYSATSMVGLVMLGFALGYEQVLEILRGAYEMDEAATQPDPTRNPPLLLALLGIWNRNFLGSQDVAILPYSQALSRFAAHLQQLDMESNGKGVSRAGEPLGWDSGPVVWGEPGTNGQHAFYQLLHQGTAVVPIEFIGFKESQYRRDLTVKGTTAQEKLLANLLAQSLALAVGQEEENPNRRFPGNRPSSILLADRLTPATMGALLALYEAKVVFQGFLWNINSFDQEGVQLGKRLADGLLAQYEARRRGTTPPQDPLGRALLALASSE

SEQ ID NO: 57395 - protein, 427 aa, Cryptococcus neoformans var. neoformans JEC21
MPVAPTVKSARTTSVYDRSCRASASPKSSRRLSSQTKAKIQAVAAPVSQARAVPQHRKVEEVMYFEEDYSEEIIAYMNSMDNSTLASAELMDMQPELQWFMRSYLIDFIIEVHQQFRLRPEVLYLAMNIVDRYISKRVVYKKHYQLVGCAALWIAAKFEDAKDKVPLVHELSEMCCKAYDESAFIQMEGHVLSTIGWVLGHPSAEAWLRVFTTGIRYEDQKVANMARFLMEITLFHREFIGIQSSIIAAGALMLARFICGKPYKPCFPNVPETVAARVSIAIDKRFSQELEKVSEIVIRKYAPTYYDRVSTVCREWYLSGRRYTYNPVMPSTPVSGLSTPGLAPSCSSSWAKRGSWVTGSPAGSCASSEAGDDTPVTPITPIYTHVIDPFSVAAKENIAPDAGKPMAKVIPRVHNVTAPRVMRRLSN

SEQ ID NO: 57396 - protein, 191 aa, Wolbachia endosymbiont of Drosophila melanogaster
MVNNMFIQIEETPNPNTLKFLPGFEILNEGETADFSNANEIKNSKLAANLFQIEHVVRVFFGHDFISVTKLDGINWDILKVEVLTTIMNHFTSGGKALDKEEVNDPDEEFFDKNDIEIVNRIKELMESHIKPAVAQDGGDIKFRGYKDGIVYVELQGACSGCPSAAITLKQGVQNMLSYHIPEIAGIETTL

SEQ ID NO: 57397 - protein, 348 aa, Triticum aestivum
  misc_feature (8)..(8): Xaa can be any naturally occurring amino acid
  misc_feature (37)..(37): Xaa can be any naturally occurring amino acid
  misc_feature (181)..(181): Xaa can be any naturally occurring amino acid
VFRSKGLXVFPARVHHEPHWTVSWAEFQYAVDDYGDXFFQVPDDGNILEDDDANNPVTVLIGTDGAIIGETSAVTSDFSDHVVVEDSMDMHDNGGKVDTEITDILIEWGMPVTMRSIHPIYFAKCLTKAVHDNHGEKIDNPSNGVSIVGYLRPAFIEEESYLRSLSGAECSADGYSSNWRXEYNREPRPASGTNGLIDGDKSRSDINDTESSIDSTIYKLEMMSIELFSVYGKQFMIDPQDFQDAEPDLLSNHASDIIKRVKENSDQCTMALRSLWCRKKGLTVEDASLIGVDSLGIDVRAFSGLEARTVRFSFNAQALSERSAEKKIKRMPFPRYPKTGKASAEDDC

SEQ ID NO: 57398 - protein, 340 aa, Burkholderia sp. 383
MENAAKQVLDTLFGRWRSRILYAGTRLGVFDAVTTDTPASSAALAAKLDVDEPLLYRLLRALASLGLLDEDTRRGFRATASGALLHADAPSTLRDFVLLQEGPEHYAIWAHLPDMVREGQQNGFVREFGAMAFDYAKDHERYRTDFKRAMSSFSTVQSEQVVDALRDVTFAPGTHACDIGGGQGHMLCSVLRRFQSLTGVVFDLPEVIDGDADDWAQRMGVSARCSKAGGNMFDAVPAADVYLLKLILHDWNDDECVAILKRARESARDGARVFVIERVVPAPGVAHFSKLYDIHMMCWGSGRERTRDEYDALLVAAGWRPAGVRPAPDGQIDVIEAVAA

SEQ ID NO: 57399 - protein, 161 aa, Zea mays
MTSSSTPSRKALSKIACNRLQKELAEWQVGPPAGFKYKVSDNLQRWVIEVGGAEGTLYAGETYQLQVDFPEHYPMEAPQVIFLNPAPMHPHIYSNGHICLDILYDSWSPAMTVSSVCISILSMLSSSPAKQRPADNDRYVRNCRNGRSPKETRWWFHDDKV

SEQ ID NO: 57400 - protein, 409 aa, Zea mays
MDASSSLSLLALVTMLSLLHSATTDAAAGLPAARTSHRRLLLLHQQDTNLAALPPPARVHVVPVDVHVPSHGTGSFPAASPGPHGGKNGPSEAAPATPATAAAYLSRSMRWLYMVAVPAVALLALAGLACWLLCRKSAVATIGPWKTGLSGQLQKAFVTGVPKLQRSELERACEDFSNIVVSYPHYTVYKGTLSTGVEIAVVSTMITSSKEWTEHSESCFRRKVDALSRINHKNFVNLLGFCEEEEPFTRMMVLEYAPNGTLHESLHAEDFERIAWRGRMRIVMGLAYCVQHMHELSPPVAHPDMQSSSVLLSEDGAAKALVERVTNDDRSVASLLDPTLGGDHREDELAVIGEVIRACMQSDPRRRPSMREVAARLREAVGISPVAATPRLSPLWWAELEVLSAAEAS

SEQ ID NO: 57401 - protein, 272 aa, Mycobacterium gastri
MSADHGDSSVRPGRNLLRDPRDRRLNRIAGPSSLVLFGVTGDLARKKLVPAVYDLANRGLLPPSFALVGFGRREWTNEDFAAEVKANVKAYARTPFDEAVWEQLSEGIRFVQGAFDDETAFKRLRATLEDLDEQRGTRGNYAFYLSIPPKAFEQVCRQLSESGLAQAENDKWRRVVIEKPFGHDLESARQLNDVVESVFPPDAVFRIDHYLGKETVQNILALRFANQLFEPLWNANYVDHVQITMAESIGTGGRAGYYDGVGAARDVIQNHL

SEQ ID NO: 57402 - protein, 759 aa, Lotus japonicus
MGSAKILSFTLLLFVGYTLVHGSTPKHYIVYMGDRSHPNSESVVRANHEILASVTGSLNDAKAAAIHHYSRSFQGFSAMITPEQAKKLADHNSVVSVFESKMNKLHTTHSWDFLGLDTVYKNNPSALDSASNVIVGVIDSGVWPESESFNDYGLGPVPEKFKGECVTGDNFTLANCNKKIIGARFYSKGLEAEIGPLENIVDSIFFRSPRDSDGHGTHTASTIAGSIVSNVSLFGMAKGTARGGAPSARLSIYKACWFGFCSDADVFAAMDDAIHDGVDILSLSLGPDPPQPLYFENAISVGAFHAFQKGILVSASAGNSVFPRTACNVAPWIFTVAASTVDREFRSDIYLGNSKVLKGLSLNPIKMEGSYGLIYGSAAAAAGDAALNASFCKEHTLDPTLIKGKIVICTVEKFTDNRREKAIIIKQGGGVGMILIDHNARDVGFQFVIPSTMIGQDAVEELQAYMKTEKNPTATIFPTLTLVGTKPAPESAAFSSVGPNIITPDIIKPDITGPGVNILAAWSPVATEATVEQKSVNYNIISGTSMSCPHISAISAIIKSHHPSWSPAAIMSAIMTSATVMDNTHSLIGRDPNGTQATPFDYGSGHVNPVASLNPGLVYDFSSQDVLNFLCSNGASPAQLKNLTGELTQCQKSPTASYNFNYPSIGVSNLNGSLSVYRTVTYYGQEPTEYFASVERPSGVIVRVTPAKLKFWKAGEKITFRIDFTPFKNSNGNFVFGALTWNNGKQRVRSPIGLNVLST

SEQ ID NO: 57403 - protein, 326 aa, Erythrobacter sp. NAP1
MTNTRILVLGTGGTIAGIAGDAMRHDYQPGQIGIDEWLEDAGRYTLDVDFVGRQIANVGSENMGPQIWKVLHEVICEAMEDDALDGIIVTHGTDTAEETAFLLDLTLPLTKPVVLVGAMRPADAVGSDGMRNFVNAVRVASAESSKGRGVLLVMGDRVLAARDARKVRTRGTDDAFRGFPRGSVAIVTPSALEWFGNPWRDDPSPRFAFPSEFPEVPILYAAGGIRPSMAGRLLEDAQGVVVAGVGEGNMPEAVRAMLAKRAANGLLVIRASRVDEGLVDREPEDDANRFVASRALNPQKSRILAMVLLANGVTDPAKVQAVFDRP

SEQ ID NO: 57404 - protein, 199 aa, Oryza sativa
  misc_feature (122)..(122): Xaa can be any naturally occurring amino acid
  misc_feature (142)..(142): Xaa can be any naturally occurring amino acid
GLLPPELISLLSRAPTTETSSPPSAAMQQRRPASGRPSGTDGSDFSYRMVVDSRYQRVADGKSRLGRLILVQALHQVAGGALLLLALSKGAEMNKFAVMSVAAGLLAIVLGEIGRRRTMAVXCLRMYTSLSSIAVAFSVACXIIRSELFFKITKQNTESITSHELLEVVRVALGVLLQLVVIATTTRLLQNMSPPRRAS

SEQ ID NO: 57405 - protein, 333 aa, Streptococcus thermophilus LMG 18311
MAILVLGGAGYIGSHMVDRLVEKGQEKVVVVDSLVTGHRAAVHPDAIFYQGDLSDQDFMRKVFKENPDVDAVIHFAAYSLVGESMEKPLKYFDNNTAGMIKLLEVMNECGVKYIVFSSTAATYGIPEEIPILETTPQNPINPYGESKLMMETIMKWSDQAYGIKYVPLRYFNVAGAKPDGSIGEDHDPETHLLPIILQVAQGVREKIMIFGDDYNTPDGTNVRDYVHPFDLADAHLLAVEYLRKGNESTAFNLGSSTGFSNLQILEAARKVTGKEIPAEKADRRPGDPDILIASSEKARTVLGWKPQFDNIEKIIASAWAWHSSHPKGYDDRG

SEQ ID NO: 57406 - protein, 459 aa, Thiobacillus denitrificans ATCC 25259
MSNGKIVQIIGAVVDVEFPRDAMPKVMEALKMQAPELTFEVQQQLGDGVVRTIAMGSTDGLRRGMDVLSTGNPIMVPVGQKTLGRIMNVLGDPVDEAGPIGAETTMPIHRKAPAYADQAATVEILETGIKVIDLIMPIAKGGKVGLFGGAGVGKTVTLMELIRNIAVQHSGFSVFAGVGERTREGNDFYHEMKEGGVLDKVALVYGQMNEPPGNRLRVALTGLTMAEYFRDEGRDVLLFVDNIYRYTLAGTEVSALLGRMPSAVGYQPTLADEMGRLQERITSTKTGSITSFQAVYVPADDLTDPSPATTFAHLDATLVLSRQVAELGIYPAVDPLDSTSRILDPQVVGEEHYTVARKVQGTLQKYKELRDIIAILGMDELSPEDKLAVSRARKLQRFLSQPFFVAEVFTGAPGKYVTLKDTIAGFKAIVEGEYDHLPEQAFYMVGGIEEAVEKAKTIQ

SEQ ID NO: 57407 - protein, 388 aa, Streptococcus thermophilus LMG 18311
MNTSQLREKFKEVFGVEADHTFFSPGRINLIGEHTDYNGGNVLPVAITLGTYGAARKRDDKVLRFFSANFEEKGIIEVPLENLRFEKEHNWTNYPKGVLHFLQEAGHTIDSGMDIYIYGNIPNGSGLSSSSSLELLIGVIVEKLYDIKLERLDLVKIGKQTENDFIGVNSGIMDQFAIGMGADQCAIYLDTNTLKYDLVPLDLKDNVVVIMNTNKRRELADSKYNERRAECETAVSELQEKLDIQTLGELDFLTFDAYSYLIKDENRIKRARHVVLENQRTLQARKALEAGDLEGFGRLMNASHVSLEYDYEVTGLELDTLAHTAWEQEGVLGARMTGAGFGGCAIALVNKDKVEDFKKAVGQRYEEVVGYAPSFYIAEVTGGSRVLD

SEQ ID NO: 57408 - protein, 547 aa, Saccharomyces cerevisiae YJM789
MSQVQSPLTATNSGLAVNNNTMNSQMPNRSNVRLVNGTLPPSLHVSSNLNHNTGNSSASHSGSQSRDDSTIVGLHYKIGKKIGEGSFGVLFEGTNMINGLPVAIKFEPRKTEAPQLKDEYRTYKILAGTPGIPQAYYFGQEGLHNILVIDLLGPSLEDLFDWCGRRFSVKTVVQVAVQMITLIEDLHAHDLIYRDIKPDNFLIGRPGQPDANKVHLIDFGMAKQYRDPKTKQHIPYREKKSLSGTARYMSINTHLGREQSRRDDMEAMGHVFFYFLRGQLPWQGLKAPNNKQKYEKIGEKKRLTNVYDLAQGLPIQFGRYLEIVRNLSFEETPDYEGYRMLLLSVLDDLGETADGQYDWMKLNGGRGWDLSINKKPNLHGYGHPNPPNEKSKRHRSKNHQYSSPDHHHHYNQQQQQQQQAQAQAQAQAQAKVQQQQLQQAQAQQQANRYQLQQDDSHYDEEREASKLDPTSYEAYQQQTQQKYAQQQQKQMQQKSKQFANTGANGQTNKYPYNAQPTANDEQNAKNAAQDRNSNKSSKGFFSKLGCC

SEQ ID NO: 57409 - protein, 412 aa, Yarrowia lipolytica CLIB122
MYNGIAWEGYIYILGPFLKTRQHQKPQDTIMRLATIASFVGLVTASPIGLLPPALLNPFGPKKPDGTVATAPLDVVHEMEHYWKYCSVSYCVGMGKNNQLYSQVKSPFVCNNILCADQEFSQTELLYSFYGINEHQTANGYLAADHKRKQLILVFRGTQSEADSAADLNTWQVSNVDFDGLKNSTDTNAESDCHGCSIHAGFVGIFNNSFKQIDSRLNLYKSMYPDYKLVVTGHSLGGAVALLYGVSLRINGRDPLVVTFGQPRVGNAAFASYVDSLFFPTAGDQLSSSPYRKMYRVTRYEDPVTQVPFWDGYTQQSGEVFINQFNVPTKPENVVFCQGQNNGFCANGIPWYQYANIDSDKQVHSSYFFRSPGCGGSQSFTPYGGNQTEPSAVSIPPGDLKARLNLPYDTNY

SEQ ID NO: 57410 - protein, 300 aa, Campylobacter lari RM2100
MKIAVVGAGKWGSALYDALSVKNECAITSFHEKDLSYFVSTKEALGYEYLVFALYAQGIHEWLVNNFKDLNQKILVASKGIDCKSLKFMDEVFGEFISSDRLCFLSGPSFASEVLEKKPCALVISGKNQNLCSKFASFFPNYIKTYTSLDVKGAEICGAYKNVLAIASGVCDGLNLGNNARASLVSRGLVEMHRFGQFFNAKEETFLGLSGAGDLFLTASSNLSRNYRVGSSLASGKNIKDVLIELGEVAEGVQTAYAIHALSKQFQIYTPIVNEVVLMLEGKNAWESLKDLMSSKEEIS

SEQ ID NO: 57411 - protein, 184 aa, Haemophilus ducreyi 35000HP
MMKLNFPTYLTLFRVVLIPLFIAAFYLPEGWYAPEISTLIFFIASITDAFDGYLARKWNQTTRLGAFLDPVADKILVTVAFVCIVEYYHSWWITIPVSIMIAREILISALREWMAEIGERASVAVSIWGKVKTACQMLALGGMLWRQSTFMEILAFILLYISAILTIWSMLQYLKASKKSLMKS

SEQ ID NO: 57412 - protein, 480 aa, Sphingomonas paucimobilis
MDSARIAPDQERDRMEFTRLNPMTGEVASSAPALKAGDIPAIARKAREGFTAWSVMGPNARRAVLMKAATALEARADAFVDAMMGEIGATKGWALFNLGLAASMVREAAALTTQINGEVIPSDKPGCLAMALREPVGVILGIAPWNAPIILGVRAIAVPLACGNSVILKASETCPRTHALIIEAFADAGFPEGVVNVVTNAPADAGEVVGALIDAPEVKRINFTGSTGVGKIIAKRAAEHLKPVLLELGGKAPLIVLEDADLDEAVKAAAFGAFMNQGQICMSTERIIVVDAVADEFAARFKAKVSAMPVGDPRQGSTPLGAVVDTKTVAHCLSLIEDALGKGAEQLTGGETTQNVLMPAHVIDRVTPDMKLFRDESFGPVVGIIRARDAEHAIELANDTEYGLSASVFTRDTAKGLSVARRIESGICHVNGPTVHDEAQMPFGGVKASGYGRFGGKAGIDSFTELRWITIETQPGHFPI

SEQ ID NO: 57413 - protein, 519 aa, Oryza sativa Japonica Group
MAVAAPGQLNLDESPSWGSRSVDCFEKLEQIGEGTYGQVYMARETETQEIVALKKIRMDNEREGFPITAIREIKILKKLHHQNVIQLKEIVTSPGPERDEQGKPIHGNKYKGSIYMVFEYMDHDLTGLADRPGMRFTVPQIKCYMKQLLTGLHYCHINQVLHRDIKGSNLLIDNEGNLKLADFGLARSFSNDHNGNLTNRVITLWYRPPELLLGSTKYGPAVDMWSVGCIFAELLNGKPILPGKNEPEQLSKIFDVCGTPDESNWPGVTKMPWYNNFKPPRQLKRRVKEYFKHFDRLALDLLEKMLTLDPAQRISAQDALDAEYFWSDPLPCDPKSLPKYESSHEFQTKKKRQQMRQADEAAKRQKTQHPQPHGRLPPIQQTGQPHPQIRPGQPMNNPHAPMAAGPGHHYAKPRGPGGSSRYPQGGNQGGGYPNRGGQGGGGSYGNAPYPQQGRGPPPPYPGSGMAGTGGPRGGVGGGYGGGSNYPQQGGPYGPSGPGRGSNYPQQGGSRNQQQYGNWQ

SEQ ID NO: 57414 - protein, 395 aa, Medicago truncatula
MAMEKSNSFENMKHYTAMICLQFGYAGMNIITKVSLNQGMSHYVLVVYRHAFATASIAPFAFMFERKGQPKITFRIFLQIFVLALLGPVIDQNFYYAGLKLTSPTFSCAMSNVLPAMTFVMAVLCRMEKINIKQVRCQAKILGTILTVAGAMLMTLYKGPIVEMVWAKNRHPQNETHETSTTGSSERDWILGCTFLIIATFAWASLFVLQAKVIETYKHHQLSLTSLVVFIGTLQAIAVTFVAEHDPSVWRIGWDMSLLASAYAGIVTSSLAYYVQGLVIRKKGPVFATAFSPLMMIIVAIMGSFILAEQIYSGGVMGAILIVIGLYSVLWGKHKEEIERKVDDIPLPIKGPQMSGNSGLVIDDTDQVKHGQVEDTNNMLSSVAISIPTNNVNQQ

SEQ ID NO: 57415 - protein, 179 aa, Haemophilus ducreyi 35000HP
MNQLDLIKSSIKSIPNYPKVGIIFRDITSLLENPTAFKASIDAIVAEFKNKGITKVVGTESRGFIFGAPVALALGLPFVLVRKPHKLPRAVISQSYALEYGEDTLEMHLDSINQDDNVLVVDDLLATGGTIDATAKLIRQLGGQVKNAAFVIGLPDLGGKARLEQIGIKSFTLVEFDGH

SEQ ID NO: 57416 - protein, 561 aa, Kluyveromyces lactis NRRL Y-1140
MAKSDAKVSQGKRNSAPNAINNVKTRRYSLWNFWICATVLKVLLFPGYYSTDFDVHRNWLAITNKLPLNKWYVESTSQWTLDYPPFFAYFEWFLSQFVPKSVAEDGCLDIVKVGSFGLPTIIFQRITVILSELVLYAALQVFINTSDISEKSANFVVASSIVLSPGLLIVDHIHFQYNGFLFGILISSIVAAKNKRYILCAAFFSIALCFKHIFLYLAPAYFVFLLRAYVLDFSSFKFRSYKDLISIVQWSNLLKLASVVMGIFSLAFLPFITTWQQLLARLFPFSRGLTHAYWAPNVWAVYSFTDKVLTVLVLKLPYLQKILSIVLTSMPKTAADIHVRIESNNSGTRGLVQDVFFVVLPQITPKLTFLLTLFYQILAVVPVLFDPSFKRFVGSLTLCGFVSFLFGWHVHEKAIMLVIFPFSFLVPFDRRLLTPFTLLASAGYVSLFPLLYESQDFLLKFLYTFIWCILYFYAMGQTSKVNRSGVRRIFFFDRLAICYYLLLIPMVLFVQALDVLKHKYAALDKYEFLGLMIYSIYCSIGVLSSWIGLSWLFNFDEPMWN

SEQ ID NO: 57417 - protein, 308 aa, Zea mays
MEHRAFDCSGSDDDLPPTYQIRVPRMHFSGNRRQLAGPFSQPRPHNKLDSDIHQIEQQAYTGVLRAFKMQSDALTWEKESLITELRRELKVSDVEHRMLLNMVNEEEAIHRIRQSRQGCGMQSSLPYNSVVDHNLGPIKRQKKSHPIYSLPVDPHSPSMPLKALVDNKIYTLKSSPPPTAPRQLAPENIRRGSAYQTLPHQGGWLASDGATKGMDGRSGRYHTNEYYASHNDMGLLNFNRTDIPDTETLVKKVERVLSRPDVYAIERAKELLIGQEQSLLDAIAKLDEASDHESDDTLVGSWIHAAIG

SEQ ID NO: 57418 - protein, 381 aa, Zea mays
MASPTQGQVITCKAAVAYEPNKPLVIEDVQVAPPQAGEVRVKILFTALCHTDHYTWSGKDPEGLFPCILGHEAAGIVESVGEGVTDVQPGDHVIPCYQAECKECKFCKSGKTNLCGKVRSATGVGVMMNDMKSRFSVNGKPIYHFMGTSTFSQYTVVHDVSVAKINPQAPLDKVCLLGCGVPTGLGAVWNTAKVESGSVVAVFGLGTVGLAVAEGAKAAGASRVIGIDIDNKKFDVAKNFGVTEFVNPKEHDKPIQQVLVDLTDGGVDYSFECIGNVSIMRAALECCHKGWGTSVIVGVAASGQEISTRPFQLVTGRVWKGTAFGGFKSRTQVPWLVDKYMKKEIKVDEYITHNMNLADINDAFHLLHEGGCLRCVLAMQI

SEQ ID NO: 57419 - protein, 359 aa, Burkholderia sp. 383
MTFNAPTSLAYPARANLQGLFGFDSIRVPRYRLLDGATPIHPLPRLSAYLGGATIHVKREDVASVGGGGNKLRKLELLIGEALQSGADTVITVGARQSNHARLTAAAAAHAGMRCEVVLTRSVPRDDADYIESGNVLLDNLFNARVHDLPASADAMAYAIARADELRAAGHRVYVCPFGGSSPVGCLAYAACAAEIVQQSQALGTRFDRIIVPNGSGGTHAGLVAGFAALGTGTVEVDAYTVYAPAADAYRATLDKAQQTANIIHPDTEISPDAVRVDASQLGPGYGIPTDAMRRAVRLLASQEGLLLDPVYSGKAFAGLIEGVASGRYASDQSILFVMTGGLPGLFAYRREFQMALDG

SEQ ID NO: 57420 - protein, 241 aa, Glycine max
MEYVSPEGLRLDGRRPMEMRQIRAEIGAVSKADGSAIFEMGNTKVIAAVYGPREVQNRNQQISSHALVRCEYSMANFSTGDRMRKPKGDRRSTEISLVIRQTMEACILTHLLPRSQIDIYVQVLQADGGTRSACINAATLALADAGIPMRDLVTSCSAGYLNSTPLLDLNYVEDSAGGPDVTLGILPKLDKVTLLQMDSKLPIDILENVMQLAIEGCKAIANYIREVLLENTKQLEYRRGV

SEQ ID NO: 57421 - protein, 319 aa, Cryptococcus neoformans var. neoformans JEC21
MSKVQESTVKKPTDTDVSGFLTNFLMGGVSAAISKTAAAPIERVKLLIQNQDEMIKQGRLSTPYKGVINTFARTYKDEGLVSLWRGNTANVIRYFPTQALNFAFKDYFKTLFGFKRSEGYWKWFAGNIASGAAAGASSLIFVYSLDYARTRLANDNKSAGKGGTRQFNGLLDVYKKTLASDGIIGLYRGFVPSVAGIVVYRGLYFGLYDSVKPVVLVGVLEGNFLASFLLGWTVTTAAGFVSYPLDTIRRRMMMTSGGTVHYKSMFDAASQIVAKEGSRSLFKGAGANILRGVASAGVLSLYDKAQELMFGKVYSSGSG

SEQ ID NO: 57422 - protein, 479 aa, Cryptococcus neoformans var. neoformans B-3501A
MPPRIAPLLSRTVRTSTRSFASTSVSMSAPVRTAAQWSDFGREHVSHGLGRVKDHVIVKGEGLNLYTADGKKLLDFTAGIGVTNLGHCHPAVSKAAAEQINNLVHLQCSIAFHQPYLELIEKLLPVMPDPSLDQFFFWNSGSEAVEAAVKLTRKATGRQNLIVFQGAYHGRTMGSGSMTRSKPIYTQSTGPLMPGVIATPYPYWHSLGVSPSTSEEELVNLAKYQLDLLFRQQTSPKDVAAIFIEPVQGEGGYVPCPPAFMKHLREVCDKHGILLVVDEVQTGFFRTGKYFAVNSIPDFRPDVLVFAKGIANGFPLSGIVSTKELMSTLDVGSLGGTYAGNPVACAAGIAAQEVYASGEIEKNVAARSEQLFTALNKLASSEKTKHLIADVRGVGLMTAIEFRSASDPLTHEGLPEGTKIPKDIGKRVQAYCLEKDLMVLTTSCFDTIRFIPALVINEEEMKRAMDIFTEAVEKVALEA

SEQ ID NO: 57423 - protein, 477 aa, Arabidopsis thaliana
MTMSENSRNLEAGLLLRKNQNDINECRITAVVLFSTFVSVCGSFCFGCAAGYSSVAQTGIINDLGLSVAQYSMFGSIMTFGGMIGAIFSGKVADLMGRKGTMWFAQIFCIFGWVAVALAKDSMWLDIGRLSTGFAVGLLSYVIPVYIAEITPKHVRGAFVFANQLMQSCGLSLFYVIGNFVHWRNLALIGLIPCALQVVTLFFIPESPRLLGKWGHEKECRASLQSLRGDDADISEEANTIKETMILFDEGPKSRVMDLFQRRYAPSVVIGVGLMLLQQLSGSSGLMYYVGSVFDKGGFPSSIGSMILAVIMIPKALLGLILVEKMGRRPLLLMNDLYLQASTGGMCFFSLLLSFSFCFRSYGMLDELTPIFTCIGVVGFISSFAVGMGGLPWIIMSEIFPMNVKVSAGTLGTLANWSFGWIVAFAYNFMLEWNASGTFLIFFTICGAGIVFIYAMVPETKGRTLEDIQASLTDFLQ

SEQ ID NO: 57424 - protein, 156 aa, Haemophilus influenzae
NRTNTPVLVDGKDVMPEVNAVLAKMKDFCQRIISGEWKGYTGKAITDVVNIGIGGSDLGPYTVTEALRPYKNHLNMHFVSNVDGTHIAETLKKVNPETTLFLVASKTFTTQETMTNAQSARDWLLKAAKDESAVAKHFAALSTNAKDVEKFGIDTN

SEQ ID NO: 57425 - protein, 253 aa, Arabidopsis thaliana
SSPAQSKIMEELGLSVADYSFFTSVMTLGGMITAVFSGKISALVGRRQTMWISDVCCIFGWLAVAFAHDIIMLNTGRLFLGFGVGLISYVVPVYIAEITPKTFRGGFSYSNQLLQCLGISLMFFTGNFFHWRTLALLSAIPSAFQVICLFFIPESPRWLAMYGQDQELEVSLKKLRGENSDILKEAAEIRETVEISRKESQSGIRDLFHIGNAHSLIIGLGLMLLQQFCGSAAISAYAARIFDKAGFPSDIGT

SEQ ID NO: 57426 - protein, 573 aa, Burkholderia thailandensis E264
MNATNRFKSTALAALVSATLAGFLPSAPAYAKGPQQRVVLDGSAVAVADKYSADAAEQIFKQGGNAVDAAVAIAFTLAVTYPEAGNIGGGGFMTVYIGGKPYFLDYRERAPLAATKDMYLDKDGNVVKGMSLYGDRAVGVPGTVAGMWEAQKRFGKLKWKQVLAPAIRYARDGFNVDEQLAQRGAEASKEFGGKTNFDQYFSGLKAGANFKQPELAAVLARIANDGAKDFYDGKTADLIAASMKKGGGLITKQDLVQYKAVWRQPVQASWNGYRVITAPPPSSGGIGLVQLLKMKADRKADFDGVALNSPQYVHLIAEIEKRVFADRAQYLGDPDFYKVPVAQLTDDAYIAKRAAEVNPEKPSDTKSVQPGLGTSMPEKAETTHFSVVDKWGNAVSNTYTINGYFGSGVVAEGTGIVLNDEMDDFSAKPGVANMFGVVGSDANAIEPKKRPLSSMSPTILTKDGKVSLVIGTPGGSRIFTSILQVITNLYDFKMPLKDAVGAMRFHHQLLPPNTIFWEPYHPIDGDLAKGIEAKGYTLKGQDFSGDIQAIRIDGKTPEPVSDPRGRGVSRVIQ

SEQ ID NO: 57427 - protein, 312 aa, Pseudoalteromonas tunicata D2
MIKNNNELPDLAKVATKTKGVVISGILGITALVVFFQSLYTVDEGHVGIIKRFGEATEQVNPGLHTKIPFVDTVEVLEIRTRKNVETLNASTHEQMPVTAEVSINWTVMREQAFDLFKSYGGLTQFETRILDPKLRSATKDALARYKAEELIQNRSQVIAQIEELLVEEMKEYPVKLDSAQLENLGLPQKYIQSIETKQTEKNLAAAEMHRLERQKLEAQQQVNTAFAQRDAAKAQADGKAYSIKAEAQAEAEAIKLKGLAEAESIQKKVEALKGSKEMVEYVKAQQWNGQMPTTVMGSEQSVLWNLEQKQK

SEQ ID NO: 57428 - protein, 823 aa, Candida albicans SC5314
MTEINDSTENITRIDRNDAKELKHWLAKANCQHHYSKFIENGITMDLLPELDTGSLKELGISKLGDRLRLEIAISNLKAENLKELISVDEIYQLLNLNPQPSGSLTNLNNNNNSLLDVSNSNEGTLTQLSQNNSSNNLPISSMNSSTNNINGNTINSSSGNVVGNSASSKDSSKTITFILQDGSTKRVNATGCFNAQAIKRRVLKKLGFKPDEIQFDTYVHSVPHGVENVLYGKTEPTITLLYDVELVTICYSPERLEKYRIMLVPKNEPPTPAAIETSKKIMSKYKKQVSGSKAELQEEVNQLHTKDVQAHRSTLRNFFGQRPPSELISSNLAEYFPDTRQKDLEQTVRNSVRHSVRLSRRFNLPAGAFSSSVYSLNKRQSILSNSTGFPSNRTMSISSGEQQSGVFNTSGGGSGGLRRAQRTIGDVMVNSITAIDEVVNSNDTFSVFNKPSTSFSNQPVQPLNNHDSRSIISSKSLSGGTALHRISISPNYNDNPAHDRHSTIELLNPSDSEGEDGEEDGEFGISDYAGLSSSSGENGPPENWLKGARIGSGSFGTVYLGMNPFTGELMAVKQIPLVNENGNNSDTENIQNSMQEQQREMMLLKELNHENIVRYFGSTTDENFLNIFLEYVPGGSVQSMLNSYGPFEEPLIRNFVRQVLIGLSYLHGEDIIHRDIKGANILIDIKGTVKIGDFGISKKVSAIDEEDEDFKKTGKRASLQGSVFWMAPEVVKQTTYTKKADIWSVGCLIVEMFTGRHPFPELSQMQALFKIGNHITPQIPEWCTNEAKEFLKKTFEINFEMRPDAIELLAEQFLNPLIMSKQ

SEQ ID NO: 57429 - protein, 422 aa, Oryza sativa Japonica Group
MVRGSLGKLASRALSVAGKWQHQQLRRLNIHEYQGAELMGKYGINVPRGAAAGSVEEVKNTLKNVFPSEKEIVVKSQILAGGRGLGTFKSGLQGGVHIVKAEEAESLAAKMLGQILVTKQTGPQGKIVSKVYLCEKLSLVNEMYFAITLDRNTAGPLIIACSKGGTSIEDLAEKYPDMIIKVPIDVFKGITDDDAAKVVDGLAPKTADRQSSIEQIKKLYELFCKSDCTLLEINPLAETADNKLVAADAKLNFDDNAAFRQKEIFAMRDTTQEDPREVAAAKADLNYIGLDGEIGCMVNGAGLAMATMDIIKLHGGTPANFLDVGGSASEGQVVEAFKILTSDDRVKAILVNIFGGIMKCDVIASGIVNAAKQVDLKVPVVVRLEGTNVDQGKRILKESGMTLITAEDLDDAAEKAVKASVK

SEQ ID NO: 57430 - protein, 84 aa, Oryza sativa
  misc_feature (44)..(44): Xaa can be any naturally occurring amino acid
  misc_feature (78)..(78): Xaa can be any naturally occurring amino acid
  misc_feature (81)..(81): Xaa can be any naturally occurring amino acid
MDSFSSSSGSPPNTEALMDQIKAQLAQAYAQEFLETVGNKCFAXCVTKPGSSLSGSESSCISRCVDRYIEATGIVSRXLFXSTR

SEQ ID NO: 57431 - protein, 480 aa, Zea mays
MVKICCIGAGYVGGPTMAVIALKCPDIEVVVVDISKPRIEAWNSDTLPIYEPGLDDVVKQCRGRNLFFSTDVEKHVAEADIIFVSVNTPTKTRGLGAGKAADLTYWESAARMIADVSKSDKIVVEKSTVPVKTAEAIEKILTHNSKGINYQILSNPEFLAEGTAIEDLFKPDRVLIGGRETPEGRKAVQALKDVYAHWVPEDRILTTNLWSAELSKLAANAFLAQRISSVNAISALCEATGANVTEVAYAVGKDTRIGPKFLNASVGFGGSCFQKDILNLVYICECNGLPEVANYWKQVIKINDYQKSRFVNRVVSSMFNTVAGKKIAVLGFAFKKDTGDTRETPAIDVCKGLLGDKAQISIYDPQVTEDQIQRDLAMNKFDWDHPMHLQPTSPTAVKQVSCVWDAYEATKGAHGLCILTEWDEFKTLDYQKIFDNMQKPAFVFDGRNIVDSEKLREIGFIVYSIGKPLDAWLKDMPAVA

SEQ ID NO: 57432 - protein, 256 aa, Triticum aestivum
  misc_feature (238)..(238): Xaa can be any naturally occurring amino acid
LDRTSLYKKAGWYRSGIPGISSTHASATTQGFDDLGKRCAKYYEAGARFAKWRAVLKIGATEPSQLSIDQNAQGLARYAIICQENGLVPIVEPEILVDGPHDIDRCAYVTEIVLAACYKALNDQHVLLEGTLLKPNMVTPGSDAKKVAPEVIAEYTVRTLQRTVPAAVPAIVFLSGGQSEEEATLNLNAMNKLQTKKPWNLSFSFGRALQQSTPQAWSGKTENEEKGRTAFLVRCKAXSEATLALQGDAPWRGALK

SEQ ID NO: 57433 - protein, 117 aa, Oryza sativa
MTFHQVDHPLLVIPGSIEVSDDVLFANASPSQSHMSKSFTETFGAAIKMFRQVLVTERGQPIITAGSGTLGWDMIACNLTEPGDEVLVLHSGYFGQSFADCFEAYGVKVTQLKAPVG

SEQ ID NO: 57434 - protein, 279 aa, Physcomitrella patens subsp. patens
MKLKNGSHRIARHPKDETGQDKLKARLSLEKEMEAWRRNSRWVDETPVIEVKVPREAFCEVYSQFKIGIPPDAVWNILTDPGNKRVFKNIQAVTSRKVLKDDGLRQLVEVDQAAIWKFLWFSGTLSVCVLVDQDRRLHMMNYKLAKHGFMKQFDGTWKVDPLYVDAQGIPAPEHAADRVASIITLQQVVQPAVVPPPPFKNYVRKITTRTTEMLLQDLQAEGKRLREGSLENFGEYVKFSHATKNEDVLDENSDYLKKTTGSRRKSRKSRWRMKASSSP

SEQ ID NO: 57435 - protein, 333 aa, Deinococcus radiodurans R1
  misc_feature (309)..(309): Xaa can be any naturally occurring amino acid
MAKYRICLIEGDGIGHEVIPAAKRVLEAAGFDAEYVHAEAGYEYFLDHGTSVPEATYDAVENTDATLFGAATSPSGEKPAGFFGAIRHLRQKYNLYANVRPTKTRPVPHSYENVDLVIVRENTQGLYVEQERRYGDTAIADTVITREASDRIGKFAADLAMKRSKRLTVVHKSNVLPVTQGLFMNTILDHTKTVEGLSTSTMIVDNAAMQLVRNPQQFDVMVMTNMFGDILSDLAAGLVGGLGIAASGNVGDQFGIFESVHGSAPDIAGQGISNPTATILAAVIMLDHLGDHETARRLDNAINKVLAEXPRTRDLGGTAGTQEFTEAVIKALA

SEQ ID NO: 57436 - protein, 139 aa, Campylobacter lari RM2100
MPDLDIFLAGFGTGGTISGVGEILKEHNPNVKIIALEPAASPLLSQNIAASHKIQGIGANFIPKILNQKIIDEIVCVSNEDAINTALELGKNGIMAGISSGANVYMARKIALENPNKKVLTMLNDTAERYLSTDLFANL

SEQ ID NO: 57437 - protein, 324 aa, Physcomitrella patens subsp. patens
MEGNPDEVPIYIVPEYVPEYRSGGCAEKGLRRFMEDAHLCVDDLEETLGCRGAFYGVFDGHDGESAACYVKEHLLPFILRDASFSSSVEDAVKNAYLELDKEFLEACRLNKSLSSGTTVLTALLQGRNLLVANAGDCRAVLCRKGRAVPMSRDHVPSAAWERSRIESAGGYVIDGYINEQLTVARAIGDWHMKGLKEVGGKGPLSAVPDIQSLVLSEDDEFLLMGCDGLWDVFSNENAISFARKQLQRHNDPELCSKELVEEALKRNSQDNVTVIVICFKADAPPPLVLERRTTVRKFCFQKLCTVMKDVDIPQASATERSCVV

SEQ ID NO: 57438 - protein, 238 aa, Haemophilus influenzae Rd KW20
MRVAILRITERSWEINTMLPWKSSKKFSNHSIASTSKWLVHQVANFVTWHETAKKCGAKIRVLPILDNWLIDENVLISTLSEKTKLVALNFVSNVTGTEQPIKRLIQLIRKHSHALVLVDAAQAISHIKIDLQDLDADFLAFSAHKIYGPNGLGVLTGKLTALSQLQPLFFGGKMVERVSNNRITFAELPYRLEAGTPNIAGVIGFNAVLDWLQKWDFTAAEQHAISLAESVKVRRNF

SEQ ID NO: 57439 - protein, 301 aa, Shewanella sp. MR-7
MNKLTDFERYVIEEKGTERPFSGEYYKHDAKGVYLCKKCHAPLYRSEDKFNAHCGWPAFDDEIPGAVSRHVDADGRRTEIVCSQCGGHLGHVFEGEYLTPKNIRHCVNSVSMVFQAADEAAASTHKTAFATFGAGCFWCVEAIFKSLKGVLNVSSGYSGGEASDADYKSVCSGLTGHAEVVHIEFDPAQISFTTLLQVLFESHDPTTLNRQGNDKGPQYRSVVFAHDAAQIEETNAMITKLTEARVFDAPIVTQVVAFESFYPAEDYHNDYFALHGEQPYCQIVVRPKVEKVRALFAELQA

SEQ ID NO: 57440 - protein, 407 aa, Brucella suis 1330
MTETTPKTAPWTVQKRTAVLVLADGTVIEGKGLGATGAVEAEVVFNTALTGYEEILTDPSYAGQIVTFTFPHIGNVGANAEDIEDLTPANRHGAVGAIFKADITAPSNFRAAEDLDSWLKHRGIIALAGIDTRALTALIRERGAQNAVIAHDPNGNFDLDALKARAANWCGLENLDLAKDVTIGQSLVWKELPWTLQDGYGEQDAPQYHVVALDFGVKRNILRLLTGLGAKVTVLPATATAEDVLAHNPDGVFLSNGPGDPAATGEYAVPTIGKLVETGIPLFGICLGHQMLALALGGRTEKMHQGHHGANHPVKDYTTGKVEIVSMNHGFAVDSDSLPENVEETHVSLFDGTNCGLRVVGKPVFSVQHHPEASPGPQDSHYLFRRFINLIRERKGQAPLPEREQAA

SEQ ID NO: 57441 - protein, 220 aa, Blastopirellula marina DSM 3645
MILVIDNYDSFVNNLARYFRLWGQETVVVRNDAIDFAQIRHLKPQAIVLSPGPCTPQEAGISVEVVGEFLETVPILGVCLGHQAIAAALGGKIVRSAEPMHGRSSIIRHDQDPLFAGMPDSIRVGRYHSLTVEPKSLPTSLRTIAAAEDRSIMAIRHLTRPVYGLQFHPESILTEQGFAIIGNFLQSAGIAVQLKNAATADQTVSTSTPILSPTNVPFYY

SEQ ID NO: 57442 - protein, 118 aa, Xanthomonas axonopodis pv. citri
MNFHEYQSKQLLAEYGIPVPAGKVAATPDEAVEVANSLGNGPWMVKAQIHAGGRGKAGGVKFCKTTDDVKAAAAKMLGTKMSTYQTAGVELPVNLVLVTTAGEIVKELYLSILVDRWY

SEQ ID NO: 57443 - protein, 156 aa, Haemophilus influenzae
NRANTPVLVDGKDVMPEVNTVLAKMKDFCQRIISGKWKGYTGKAITDVVNIGIGGSDLGPYMVTEALRPYKNHLNMHFISNVDGTHIAETLKKINPETTLFLVASKTFTTQETMRNAQSARDWLLKAAKDESAVAKHFAALSTNAKDVEKFGIDTN

SEQ ID NO: 57444 - protein, 271 aa, Bacillus subtilis
AGHMTSILSRNHVKVKGSGKASIMFAPGFGCDQSVWNAVAPAFEEDHRVILFDYVGSGHSDLRAYDLNRYQTLDGYAQDVLDVCEALDLKETVFVGHSVGALIGMLASIRRPELFSHLVMVGPSPCYLNDPPEYYGGFEEEQLLGLLEMMEKNYIGWATVFAATVLNQPDRPEIKEELESRFCSTDPVIARQFAKAAFFSDHREDLSKVTVPSLILQCADDIIAPATVGKYMHQHLPYSSLKQMEARGHCPHMSHPDETIQLIGDYLKAHV

SEQ ID NO: 57445 - protein, 110 aa, Glycine max
  misc_feature (100)..(100): Xaa can be any naturally occurring amino acid
MKLNIANPSTGSQKLIEIDDDKKLRIFYDKRMSAEVAGDALGDEFKGYVFKITGGNDKQGFPLKQGVLVQGRVRLLLKQGQSCYRERRHGQRKRKSVRGXIVGPDLAVLN

SEQ ID NO: 57446 - protein, 236 aa, Picea sitchensis
MDTEFPGIVVRPVGNFKTASEFHYYTLKSNVDVLNLIQLGLTFSDEDGNLPRCGTDKYCIWQFNFREFNLDKDMYASDSIELLQQSGIDFKKNNEKGIDAQVFAELLMSSGIVLNDTVHWVTFHSGYDFGYLLKLLTCQQLPPTRAGFFKLINMYFPTVYDIKHLMKFCNSLYGGLNKLAELLDVKRIGVCHQAGSDSLLTSCAFRKLREGFFNGSTEKYAGVLYGLALEHGQTVH

SEQ ID NO: 57447 - protein, 104 aa, Glycine max
VLPSKVKGDRSKSVLFDARRLAKSLQSLETKRNWSKEEKWEMISHVWVEMLCYAASQCRGLHHAKQLSRGGELLTHVWLLMAHLGITEQFQISQGHARAKLIVS

SEQ ID NO: 57448 - protein, 100 aa, Halobacterium sp. NRC-1
MEDPKDTITIENVVASTAIEQELDLSRVAMDLEGADYDPEQFPGLVYRLDEPSVVALLFGSGKLVITGGKHPVDAEHAVDTIDSRLEDLGLLDGYGDRAK

SEQ ID NO: 57449 - protein, 533 aa, Thiobacillus denitrificans ATCC 25259
MSFSELGLDPLILKSVLAAGYENATPVQQQAIPAALSGGDLLVSSHTGSGKTAAFLLPSIQRLLAEPAVKSIGPRVLVLTPTRELALQVEKAAMTYGKEMRRFRTACLVGGAPYGLQLKRLSQPVDVVVATPGRLIDHLERGKIDFSRLEVLVLDEADRMLDMGFVDDIKAIAARCPAERQTLLFSATLDGVVGNLARELTRDAQRIEIEAVPHKEAKIEQRLLFADNMDHKNRLLDALLRDVEMVQAIVFASTKRSTEEISDLLAESGFASDALHGDMQQGQRNRALQRLREGRTRVLVATDVAARGIDVASISHVINFDLPRQAEDYVHRIGRTGRAGRTGIAVSFAGMREGGLVKNIERYTGNRIEVHTLPGLEPTQRPSTGRPGNGRPRGNGPRGGYEKRSFGDRSEPRSYGDRPRGDSRDNRDRGYRGDARRNDGAPARRFDNGVRGPSDVPRMTSEQTAGPRGAASKPEVNGNSVEYWEKREREAKAKAATGRSYGDRGNAARPARGYGNENRGGAGRGGVRGRFKD

SEQ ID NO: 57450 - protein, 247 aa, Picea sitchensis
MSVLGLTIDYGPFGFLDAFDPKFTPNTTDLPGRRYCFANQPDVGMWNVAQLASTLSSANLINDDEAKYGMERYGAKFMEEYQSIMTKKIGLKKYNKELISKLLSNMAFDKVDYTIFFRALSNIKTNTDLSEDKLLSPLKPVLLDISKERKKAWIDWIHQYIHELTTSGISDEERKASMDSINPKFVLRNYLCQTAIDAAEQGDYSEVRRLLKVMQKPYDEHPGMEKYARLPPAWAYRPGVCMLSCSS

SEQ ID NO: 57451 - protein, 899 aa, Oryza sativa Indica Group
MALEISMEGIEARARELGVDLSTVDLDSVTLPAGEDFGILSDDEDLLRIDDPMELEMGFANVVVVDNLPVVPPEKFEKLENVIRKIYSQIGAIKEGGLWMPVNPETKKTYGYCFIEYNTPQEAELAREKTNGYKLDKSHIFAVNMFDDFDKYMKVPDEWMPAEIKPYTPGENLQKWLADEKARDQFVIRAGTFTEVYWNDARQKMPELVFQKQYWTDSFIQWSPLGTYLATVHRQGSQVWGGDDKFERLMRFAHAQVKLIDFSPGEKYLVTYSSHEPSNPRDTHRVVLNIFDVRTGKVMRDFKGSADEFSASGNISVSGVSWPIFRWGGGKDDKYFARLGKNVISVYETETFSLLDKKSLKVENVVDFCWSPTDPIIALFVPELGGGNQPARVSLVQIPGKEELRQKNLFSVSDCKMYWQNSGEYLAVQVDRYTKTKKSTYTGFELFRIKERDIPIEVLELDNKNDKIIAFAWEPKGHRFAVIHGDGPKPDISFYSMKTSNNISRVSKLTTLKGKQANALFWSPGGRFIVFAGLKGFNGQLEFYNVDELETMATGEHFMATDIMWDPTGRYLASAVTSVHEMENGFQIWSFSGKQLYKVSKDHFFQFLWRPRPPSLLTPEKEDEIAKNLRKYSKKYEQEDQDAFNQLSEQERKRRKQLQEEWEGWVAKWKQLHEEERPYRMELRDGEASDDEEEYDTKEVEIEEEIIRRFSNPSSCRLGIFLCLGEFQVQASRRCKMQSDAVARSPRQTVRVGGRRPTADPSRGSSEAYGFVGSIAAVAAAAAYLAWAYLPEPWLRFLGVTYYPARHWALAMPSLLLEAAAQGMVLYMASNFLLAPAPTLLGHYLRGTCSDIFCLLPDEFAREPAACGTATGEEKPIEDISDISIDKINNLMFGNASSS

SEQ ID NO: 57452 - protein, 425 aa, Haemophilus ducreyi 35000HP
MNSFQTISVVGLGYIGLPTAAVFAQAGKRVLGVDINQQTVTTINQGNIHIVEPALAEVVQQAIEKGVLSASTAVQPADVFIIAVPTPFDQDHQPDLSYIKAAAEMIAPHLQAGNLVVLESTSPVGTTEQLAEWLQQARPDLLLPTSTTAKPNIQLAYCPERVLPGKVMTELLTNDRVIGGITAEATQQAVDLYKIFVKGRCIPTNARTAEMCKLTENSFRDVNIAFANELSMVCDQLNINVWQLIALANCHPRVNILQPSAGVGGHCIAVDPWFIVAQAPQQARLIQTARQVNDAKPHWVIKQIKQMWADCIMANNCRPSDIKIACLGLAFKPDIDDLRASPALEITQHLTEWQLAELMVVEPNITDLPTSLVGKAQLVSLEYAMTQADILVLLVAHTPFKAVASQLLSAKWRLDICGLQAVTRT

SEQ ID NO: 57453 - protein, 252 aa, Campylobacter lari RM2100
MLEAGGKHFRAQLLLGIVNTKNPALFEKALNAALALEFIHTYSLIHDDLPAMDNASLRRGKQTLHKKYDETTAILVGDALNTEAFLLLSKLDLKENIRLKLIETLAFNAGLGGMIIGQAIDCYFEDIPLNLEQVEFLHIHKTARLIAAALKMGCEICELDEKECEQIYDIGLLIGLIFQIKDDIIDATLDTQEAGKPTHNDLHKNSFINLLGLEGAKKAKDDKIILCEEKIKNLDSKLANELQILIDKYLKG

SEQ ID NO: 57454 - protein, 264 aa, Mesorhizobium loti MAFF303099
MTHDLDARTQFAIDLARRAGELGLEYFRDLESLTIESKGHQDLVSQADREVELFIRAAIAKDYPRDGIVGEEHASVASSTGHVWVIDPIDGTANFVRGIPAWCVVIACARDGETVVGVIHEPSTGETFHGRRGGGAFIDGRPIKASAATSLEEGSVGTGFSNRAEAENIAVLIKKLLAEGGVFFRNASGALMLAYVASGRLLGYVEEHMNAWDCLAGMLLIEEAGGTVLKADPNTVLQNGTQVITGGKGVFSKLQALCSGVFRP

SEQ ID NO: 57455 - protein, 136 aa, Echinacea angustifolia
LDAAGKTTILYKLKLGEIVTTIPTIGFNVETVEYKNISFTVWDVGGQDKIRPLWRHYSQNTQGLIFVVDSNDRDRVVEARDELHRMLNEDELRDAALLVFANKQDLPNAMNAAEITDKLGLHSLRQRHWYIQSTCA

SEQ ID NO: 57456 - protein, 400 aa, Brucella suis 1330
MAFLADALSRVKPSATIAVSQKARELKAKGKDVIVLGAGEPDFDTPENIKQAAIAAINRGETKYTPVSGIPQLRQAIVSKFKRENGLDYKPEQTIVGTGGKQILFNAFMATLNPGDEVIIPAPYWVSYPEMVAINGGTPVFIDTKIEDNFKLTAADLEKAITPKTKWLIFNSPSNPTGAAYTQAELKSLTDVLVRHPHVWILTDDMYEHLVYGDFVFTTPAQVEPSLYDRTLTMNGVSKAYAMTGWRIGYAAGPIELIKAMDMIQGQQTSGACSIAQWAAVEALNGTQDFIPANKKIFQARRDLVVSMLNQATGLQCPTPEGAFYVYPSCAGLIGKKTEAGKVIETDKDFVTELLETEGVAVVHGSAFGLGPNFRISYATSDELLEKACIRIQRFCASLR

SEQ ID NO: 57457 - protein, 156 aa, Haemophilus influenzae
NRANTPVLVDGKDVMPEINAVLAKMKDFCQRIISGEWKGYTGKAITDVVNIGIGGSDLGPYMVTEALRPYKNHLNMHFVSNVDGTHIAETLKKVNPETTLFLVASKTFTTQETMTNAQSARDWLLKAAKNESAVAKHFAALSTNAKDVEKFGIDTN

SEQ ID NO: 57458 - protein, 431 aa, Oryza sativa Indica Group
MRRVWWVCGLGYWVQGFRCFPWLALNFHLTRGLGLTPAALQLVQNAGNLPLVAKPLFGVLSDAVYVGRAHRLPYISIGALLQLMAWGTLAVIPVTGDTFPTQMACILIGNLGASVTEVVSDAVVTEFSRTQKAGVLQSYAFIILAAGSLLGNLSGGYVLLRTQEPKTMFSAFSILLGLQLALSLSTKETLPSSHRNWNICHVRTSLSDNLRKQFSNLRTAISEEQIFYPLMWIMTSFAVVPILSGTMFCFQTQYLKLDPSVIGLSKVVGQVMVLSLTVLYNKYLKKIPLRRLVAGVQTMYALAVLSDLVLVKQVNLMLGIPNEIHVLCFSALAEAIAQFKVLPFSVLLSSQCPPGCEGSLFAFFTSGLVFSAIVSGVFGVGLSSLIGVSGGDYTSFPLCILLQSLAALVPLGWISFLPEKWTADDKILKPR

SEQ ID NO: 57459 - protein, 186 aa, Halobacterium sp. NRC-1
MSTLADTIHIENVVASSDLGQELALDQLSTDLPGAEYNPEDFPGVVYRLQEPKSATLIFRSGKVVCTGAKSVDDVHEALGIVFGDIRELGIDVTSNPPIEVQNIVSSASLEQSLNLNAIAIGLGLEQIEYEPEQFPGLVYRLDDPDVVVLLFGSGKLVITGGQNPDEAEQALAHVQDRLTELGLLD

SEQ ID NO: 57460 - protein, 444 aa, Haemophilus influenzae Rd KW20
MTNNNKTMEILMKSGDLNKYDLVKNALVLVLAGGRGSRLHELTDKRAKPALYFGGNRRIIDFALSNCINSDLNRIGVVTQYAAHSLLLHLQTGWSFLPQERGEFVDMLPARQQIDDSTWYRGTADAVYQNMAIIKNHYRPKYILILAGDHIYKQDYSVMLMDHVNSGAKCTVGCIEVPRSEAHEFGVMAVNENLKVKAFVEKPKDPPAMVGKPDVSLASMGIYVFDADYLYKMLEQEVNTPQTSHDFGKDVLPKCLEEGALYAHPFSRSCMGRNTEGEIYWRDVGTLDSFWQSNIDLVSENPQLDIYDQSWPIRGNPIQAYPSKFFYKHSNVHPVDNSLIGGGCVITDASISNSVLFDHIKIDAFSKVDHCVVLPQVKIGKNCVLKNCIIDRECEIPDGMQIGVDMEEDKKRFRISSTGKVILVTSKMLKILEGHEIGEEGHLD

SEQ ID NO: 57461 - protein, 284 aa, Oryza sativa Indica Group
MASKRIQKELMDLRKDPPTSCSAGPAGEDLFHWQATIMGPSDSPYAGGVFFVNIHFPPDYPFKPPKVNFQTKVYHPNINSNGSICLDILKEQWSPALTISKVLLSISSLLTDPNPDDPLVPEIAHVYKSQRPRYEETARAWTQKYAMESTGLYSLCFTIGSMLCVLSSTIGSKSSHLLLLAQSIRICNLVGYVPYGRGRRCNTFSLSKNAYCNHCLDEIMRRRSRKPLPALPFFVRNRQFLQLMTYQPVWSYQFFSTSIPDTHSLSASTNVIAQEEKKIRLEIS

SEQ ID NO: 57462 - protein, 226 aa, Picea sitchensis
MLQCLEGISKLIDCFVQSFDIKVFKHVQGLKDPETIASETVFSVSEVEALYELFKRISSAVIDDGLINKEEFQLALFKTNKKESLFADRVFDLFDTKRNGLLGFEEFACALSVFHPNAPIDDKIEFSFQLYDLKQKGFIGRQEVKQMVVATLAESGMNLSDDVVENIIDKTFEEADTKHDGKIDKEEWRSLVLRHPSLLKNMTLPYLKDITTSFPSFVFHSQVEDT

SEQ ID NO: 57463 - protein, 102 aa, Picea sitchensis
MQSLTRHAVHLLGGQHFTPRQGSILDRPQVRGIHIEPGAREKALLEEDPALKKFKSYKKSIRRMQTARDILTIVVISGCCYEIYYRTMMRKAERDQRQASSE

SEQ ID NO: 57464 - protein, 182 aa, Glycine max
  misc_feature (158)..(158): Xaa can be any naturally occurring amino acid
NCVTQVIALTEELLATAKQNEIPAPPNAAAASPTLSIHNDNQVLDSSSDHQEKLPVGTKVQAVWSEDGEWYDATVEAYTPNGYYVSYDNWGNKEEVDPANIRSIQEGSVDALLEAERVAEATKQAIKRKIVQAASIDLQSRSLPAKLRIEADDPEDVXSKRKKIHAFKSKMRMEQLEVTQNK

SEQ ID NO: 57465 - protein, 450 aa, Hebeloma cylindrosporum
MVKPFEPEFQQALDELTTSLQPFLDANPQYKKALEIVQVPERVLQFRVVWEDDQGVAQVNHGFRVQYNSALGPYKGGLRLHPSVNLSILKFLGFEQTFKNALTGLSMGGGKGGSDFDPKGKSDSEIRRFCFSFMGELFRHIGSDTDVPAGDIGTGGREIGFLFGAYKKLRNEFTGMLTGKGLTWGGSFIRPEATGYGLIYFVEHMIAKACPEYSLDKPSTLVAISGSGNVAQFTALKVIELGATVLSLSDSKGSLISDKGYTKEFIRKVADLKLKGGSLASLANEEGYTYHAGARPWTLIPTIHIALPGATQNEVSAEEAEALLKAGVRIVAEGSNMGCTADAIDIFESSRKAGPGGVWYAPGKASNCGGVAVSGLEMAQNSQRLAWTTQEVDSKLKDIMAECYGICLTAGTKWSGEELTDEVLPSLLSGANVAGFIKVADAMKAQGDWW

SEQ ID NO: 57466 - protein, 298 aa, Brassica napus
VDPRVRRILAVLGTLPCIVLIPGLFFIPESPRWLAKMGMTDDFETSLQVLRGFETDITVEVNEIKRSVGTSTKRSSTVRFVDLKRRRYYFPLMVGIGLLVLQQLGGINGVLFYSSTIFESAGVTSSNAATFGVGAIQVVATAISTWLVDKAGRRLLLTISSVGMTISLVIVAAAFYLKEFVSHDSDMYSMLSILSVVGVVAMVVSFSLGMGPIPWLIMSEILPIPPGNIKGLAGSIATLANWFISWLITMTANLLLAWSSGGTFTLYGLVCAFTVVFVTLWVPETKGKTLEELQALFR

SEQ ID NO: 57467 - protein, 451 aa, Gibberella fujikuroi
MSHLPQEPEFEQAYGELASALENSSLFNEHPEYRTALAVAAIPERVIQFRVVWNDDKGNLQVNRGYRVQFNGALGPYKGGLRFHPSVNLSILKFLGFEQIFKNALTGLNMGGGKGGADFDPKGKSDAEIRRFCQAFMTELSKHIGAETDVPAGDIGVGGREIGYLFGAYRKFANRWEGVLTGKGLSWGGSLIRPEATGYGLVYYVEYMLKHANRGTFEGKRVALSGSGNVAQYAALKIIELGGSVVSLSDSKGALVAKEGSSFTPEQIHNIAALKIKHQALTTFEHDGQFTWIEGARPWVHVGKVDIALPSATQNEVSKEEAQALVDAGAFIVAEGSNMGCTAEAIDVFEAHRKEKGAEALWYAPGKASNCGGVAVSGLEMAQNSQRIQWTEKEVDDRLKAIMKDAFVAGLETAQKYVEAKEGELPSLIAGSNIAGFIKVAEAMHDQGDWF

SEQ ID NO: 57468 - protein, 457 aa, Tuber borchii
MSNLAPEPEFQQAYNELVHSLRDQNSSRLPQILRLLCLSSPPERVIQFRVTWEDDKGNFQVNRGYRVQFNSALGPYKGGLRFHPTVNLSILKFLGFEQTFKNALTGLNMGGGKGGSDFDPKGKSDNEIRRFCYSFMRELSKHIGQFTDVPAGDIGVGGREIGYLFGAYESYKNQFEGVLTGKGITWGGSLIRPEATGYGLVYYVAHMISYASGGKETFAGKRVAISGSGNVAQYAALKVLELGGKVITLSDSKGALIATGEEGFNETDIELIAKLKLDRGYLTQLHAAEDSFKSRFKYLPGERPWCHVDKVDVALPSATQNEVSEQEAKELIASGCKFLAEGSNMGSTQEAINVYEEDRKSRKADGLWYGPAKAANCGGVAVSGLEMAQNSQRLTWTSEQVDKELAGIMERCFWNCLNPAKEYFDIAEGELPSLVAGANIAGYVKVVNAMKAQGDWW

SEQ ID NO: 57469 - protein, 454 aa, Neurospora sitophila
MSNLPSEPEFEQAYKELAYTLENSSLFQKHPEYRTALAVASIPERVIQFRVVWEDDNGNVQVNRGYRVQFNSALGPYKGGLRLHPSVNLSILKFLGFEQIFKNALTGLSMGGGKGGADFDPKGKSDAEIRRFCCAFMAELHKHIGADTDVPAGDIGVGGREIGYMFGAYRKAANRFEGVLTGKGLSWGGSLIRPEATGYGLVYYVGHMLEYSGAGSYAGKRVALSGSGNVAQYAALKLIELGATVVSLSDSKGALVATGESGITVEDINAIMAIKEARQSLTTFQHAGHVKWIEGARPWLHVGKVDIALPCATQNEVSKEEAEGLLAAGCKFVAEGSNMGCTLEAIEVFENNRKEKKGEAVWYAPGKAANCGGVAVSGLEMAQNSQRLNWTQAEVDEKLKDIMKNAFFNGLNTAKTYAEAAEGELPSLVAGSNIAGFVKVPQAMHDQGDWWSKN

SEQ ID NO: 57470 - protein, 454 aa, Neurospora intermedia
MSNLPSEPEFEQAYKELAYTLENSSLFQKHPEYRTALTVASIPERVIQFRVVWEDDNGNVQVNRGYRVQFNSALGPYKGGLRLHPSVNLSILKFLGFEQIFKNALTGLSMGGGKGGADFDPKGKSDAEIRRFCCAFMAELHKHIGADTDVPAGDIGVGGREIGYMFGAYRKAANRFEGVLTGKGLSWGGSLIRPEATGYGLVYYVGHMLEYSGAGSYAGKRVALSGSGNVAQYAALKLIELGATVVSLSDSKGALVATGESGITVEDINAVMAIKEARQSLTSFQHAGHLKWIEGARPWLHVGKVDIALPCATQNEVSKEEAEGLLAAGCKFVAEGSNMGCTLEAIEVFENHRKEKKGEAVWYAPGKAANCGGVAVSGLEMAQNSQRLNWTQAEVDEKLKDIMKNAFFNGLNTAKIYVEAAEGELPSLVAGSNIAGFVKVAQAMHDQGDWWSKN

SEQ ID NO: 57471 - protein, 458 aa, Xanthomonas oryzae pv. oryzae
MTDTPRRDDAATLDRFGYAQELKRQLTLKDLLIYGLVSMVPTAPFSIFGGVFDISAGMVPLTYLVGFVAMLFTALSYQQMSQAFPVAGSVYAYVGRGLNSGMGFLAGWAILLDYLLVPTLLYVVGANAMYNVVPAVPQPAWIGFFVVLNTVVNLRGIETTARANRFFLLGQLVVLAVFLVLATLAIQRGVNGAHWSWRPIYDPQAFSPHVIFSALSVAVVSFLGFDAISTLSEEARGGNRVVGRATLLALLIVAGVFVLQTWLAALLQPTLQRYPSAQASNDAFFEIGRLIAGPWLQIVIALTVAISAAIANSLVAQAATSRLLFAMARDRQLPAFLRYIHPRTAVPQRAILLVAGLSIVLGEVFVGQIALLSSLCNVGALTAFLLLIAVLWHFRAQGRRVLHGLAPLIGIVILAYVLLNADTHAQLGGTAWMVVGLTVLAFLKLSGRSTEFRATDAL

SEQ ID NO: 57472 - protein, 435 aa, Deinococcus radiodurans R1
MHFGGRVPLFLSCCRLHLSGVPMKPRVLGMILAGGQGSRLAPLTQKRSKPAVPFGSKYRIIDFAINNFINSGMFSVYVLTQYKAQSLTEHIQRGWRFGTFLSDYFITLVPAQMYRFEELGDAWYRGTADAVYQNMHLIDNFEADYVAIFSGDHIYKMNVEHMLEKHIETRADVTIAAYPMPQSQAHQFGVMQVDERWRVTEFHEKVPDPPTIPGQADLSLTSMGNYIFSRRALEELLEASISGQETGYDFGHNVIPRALSDGYHVQAYDFHKNPIPGQERPNTYWRDVGTLDAYFEANMDLVSVNPEFDIYNPEWPLRTSSEFSPPAKFVHESEGRKGQAFNSIMAGGAIISGGTVRDSVLGRNVRTHSYSLVESCVLFDDVQVGRHSHLRRVIVDKDVVIPPGTTIGLNREHDEQRGFTVTEHGVVVVPKGYVF

SEQ ID NO: 57473 - protein, 461 aa, Penicillium chrysogenum
MMQNLPFEPEFEQAYKELASTLENSTLFQKKPEYRKALQVVSVPERVIQFRVVWEDDKGQVQINRGYRVQFNSALGPYKGGLRFHPTVNLSILKFLGFEQIFKNALTGLNMGGGKGGSDFDPKGKTDNEIRRFCVSFMTELCKHIGADTDVPAGDIGVTGREVGFMFGQYKKIRNQWEGVLTGKGGSWGGSLIRPEATGYGVVYYVEHMIQHASGGKESFAGKRVAISGSGNVAQYAALKVIELGGSVISLSDSQGALVLNGEEGSFTAEEINTIAEIKVQRKQIAELATQDAFSSKFKYIPGARPWTNIAGRIDVALPSATQNEVSGDEAKALIAAGCKFIAEGSNMGSTQEAIDVFEAHRDANPGAAAIWYAPGKAANAGGVAVSGLEMAQNSARVNWSREEVDSRLKKIMEDCFNNGLSTAKEYVTPAEGVLPSLVAGSNIAGFTKVAEAMKEHGDWW

SEQ ID NO: 57474 - protein, 534 aa, Pyrobaculum aerophilum str. IM2
MSWEEVYKKNLIEKIKRDKHPFKLLEELETLARRHYSDIPEEEFIRLYWLGVVHDRPRTGYLMLRLRIPGGILKPHQLRRIGELSYKYGKNYAEITVRQDIQLHWIELKYLPEVLAQLKDVGILTIGTEGDTVRNITTCPLAGLTVNELFDVRDDVYKIDKAFLLDPIYADLPRKFKITITACPYMCSVPEIQDLALIGVTKDGKYGYTVLIGGGLSLAPRVGRHMPVFVPREMVIEFVKAVLDVWREEPRYRLSRVRARIKFMIDDLGVDKFRELVENRLGQRLEDYPSKPESLGKTDHIGVERLKDGTYAVGVAIPAGIVTGEFLIKLADLAEAVGVKEVRLTQRQNLILAGVPEDKVEIVKEFCQKWGYAVEQTPLVAMSVACTGDPYCNYSISDTKGLLLELIKSLKERFGEIQDLPPIHIVGCPHACAWYWIGNIGLMATTAKMPDGRFVKAYDVLVGGDYGKRTAIGKVLFKKVPADKIKDCITYLVEYYINKRAPGEDFPTFIARIDLRELADYISGKLGVQLALGK

SEQ ID NO: 57475 - protein, 578 aa, Kluyveromyces lactis NRRL Y-1140
METKTLIHSGAAKEMSYTERYNVAPLIPLPEYLFHRLFQLNCRTVFGVANYSTAKLYQAIAASGIQWIQTINQLNTSFAVDAYGRAIGVSCYVTSESAELGHVNGFFGSFCEYVPILQVVVLEQSHDLERLIGDVSIFHDVVDDPSEIDSCVRTLFWGKRPVYMGLRSKDATKLVPSSSLNGNIADKMGIKNTFFQTDTIKRVIDKIIAEVYASSRPLIVVDALIDRYNYNSTIQNFLTETGIPFVTTLMSKGSIDESLPNFVGTFLGTMSQPIVREYMNNADCTLILGCMIENFKNSYCRFNYKSKNQILLWNDRVKIENNIIPDILLHELLPQLIASLDTTKIVNSRPVTIPNMIPRVEPQPVTFLRQEYLWFKMSTWLKQGDVIISESGTSAIGLLQQKFPDNTRLVSQAIWNSSGYSIGACLGILAAYRDMGTLDKHRIILMVGDGSLQFTFQELSTILTHGFKPYIFVINNQGYTVDRTLNREKTHLNATYFDIQPWELLKLPSLFYSQEYFKRRCMSVGELNSLLSDKEFNKSDQLKIVELILPSMDVPVLLDPRDDSSDDESSPQHKRPRT

SEQ ID NO: 57476 - protein, 504 aa, Oryza sativa
  misc_feature (365)..(365): Xaa can be any naturally occurring amino acid
MATAIPQRQLFVAGEWRAPALGRRLPVVNPATESPIGEIPAGTAEDVDAAVAAAREALKRNRGRDWARAPGAVRAKYLRAIAAKIIERKSELARLETLDCGKPLDEAAWDMDDVAGCFEYFADLAESLDKRQNAPVSLPMENFKCYLRKEPIGVVGLITPWNYPLLMATWKVAPALAAGCTAVLKPSELASVTCLELADVCKEVGLPSGVLNIVTGLGSEAGAPLSSHPGVDKVAFTGSYETGKKIMASAAPMVKPVSLELGGKSPIVVFDDVDVEKAVEWTLFGCFWTNGQICSATSRLILHKKIAKEFQERMVAWAKNIKVSDPLEEGCRLGPVVSEGQYEKIKQFVSTAKSQGATILTGGVXRPKHLEKGFYIEPTIITDVDTSMQIWREEVFGPVLCVKEFSTEEEAIELANDTHYGLAGAVLSGDRERCQRLTEEIDAGIIWVNCSQPCFCQAPWGGNKRSGFGRELGEGGIDNYLSVKQVTEYASDEPWGWYKSPSKL

SEQ ID NO: 57477 - protein, 1115 aa, Oryza sativa Indica Group
MAAAAAEIVGSAAARMAAPAVRPAPPAAAAAAPPQPRRAVAARSLRTSTSDRVAADLALGSNGSLSAQAPQHNTREMIWKLAETGMNVARMNMSHGDHQSHQKVIDLVKEYNAKNTDGNVIAIMLDTKQMSCDDRTSVMQGPEVRSGDVPEPIMLEEGQEFNFTIKRGVSTKDTVSVNYDDFINDVEVGDILLVDGGMMSLAVKSKTADTVKCEVVDGGELKSRRHLNVRGKSATLPSITEKDWEDIKFGVENGVDFYAVSFVKDAKVIHELKDYLKSANADIHVIPKIESADSIPNLQSIIAASDGAMVARGDLGAELPIEEVPLLQEEIVRTCRSMQKPVIVATNMLESMIDHPTPTRAEVSDIAIAVREGSDAIMLSGETAHGKFPLKAVKVMHTVAQRTESSLYNPTTSPSLVAHPQALLNEEFSQSQLSKMFGSHATMMANTLCTPIIVFTRTGSMAVLLSHYRPSSTIFAFTNEERVKQRLALYQGVVPIYMKFSDDAEETFSRAISSLLNAQFVKEGDYVTLVQSGVKSIWREESTHHIQAAPELSRKDQQMKHVGHELPYLNPTNKPRIGGDANQNLKASEAQCCQYLTTSRRASNGVLPVQAGGGGSPSRPTTPPRSPPTTPQIPAAAANGGADSAAADGGGDDKDAAKRAVPVFREFGLAELRAATKGFSADLIVSESGEKAPNVVYRGRLDGGRLIAVKRFSRLSWPDPQQFLAEAAGVGKVRHKRLVNLIGCCAEGDERLLVAEYMPNDTLSKHLFHWDKQPLPWEMRLRVAYYIAQALDHCNAENRKIYHDLNAYRVLFDEEGDPRLSSFGLMKNSRDGKSYSTNLAYTPPEFLRTGRVIAESVIYSYGTVLLDLLSGKHIPPSHALDLIRGKNILLLMDSSLEGQYANEDASKLVDLASKCLQFEARDRPNIKYLLSSVGPLQKQKEVASHVLMGITKATAVLPTILSPLGKACSGMDLTAVHDILLKTGYKDEEGAENELSFQEWTQQVQEMLNTKKFGDIAFRDKDFKTAIDYYSKLVGMMSVPSATVFARRSFSYLMNGQSELALRDAMQAQVCMPEWPTAFYLQALALSKLGMETDAQDMLNDGATFEAKKQNSWRG

SEQ ID NO: 57478 - protein, 379 aa, Deinococcus radiodurans R1
MRRIAGRYPFGHAGDIASADAGTQPGDVVDVRDEGGKLVGRGYFNPDGATPLRMLVWEARDIDLNFYRERVRAALARREGRITGTNAMRVLHAEADGLPGVVADQFGDVLSVQLRNAGVEQHRDLILRALREETGATSAFERSDTGERRKEGLDLVSGPLWGEVPERVEFYEDDLRLHFAPLDAQKTGFFLDQRDNRRMLAGLLAPGQQFLDVYSYTGGFSLHAAKAGAQSTAIDKDSVALGVLEREARENGVSVGLRWGDAIEQLAALEKEKKTFHAAVFDPPTLAKRRDDVPRAKRIFTDGTAALLRMLVPGGHVLVSTCAHYIRVDDLLDAARVAAGAADCDAEVVAVTYQPADHPHLLSVPESLYLKSILLRKQG

SEQ ID NO: 57479 - protein, 219 aa, Schizosaccharomyces pombe
GATNLIGVFFHAYPATGSFSRSAINAKSGVRTPLGGIFTAGVVVLALYCLTGAFYYIPNAVLSAVIIHSVFDLIIPWRQTLLFWRMQPLEALIFICAVFVSVFSSIENGIYTAVCLSAALLLFRIAKPSGSFLGILKIANKFDDDENSIDVVRDIYVPLNQKGMNPNLTVRDPPAGVLIFRLQESFTYPNAGHVNSMLTSKAKTVTRRGNANIYKKASD

SEQ ID NO: 57480 - protein, 392 aa, Triticum aestivum
  misc_feature (5)..(5): Xaa can be any naturally occurring amino acid
SLLVXAFNSQRNDAFCIRNPHGSRIKIIVATSSVATLVVLLSMVATTLYFSLKTRYNEEIHLKVEMFLRTYGTSKPTRYTFSEVKKIARRFKIKVGQGGFGSVYKGELPNGVPVAVKMLESSTGEGEEFINEVATIGLIHHANIVRLLGFCSEGMRRALIYEFMPNDSLEKYIFSDDSNIFEDILVPNKMIDVALGIARGMEYLHQGCNQRILHFDIKPHNILLDYNFNPKISDFGLAKLCARDQSIVTLTAARGTMGYIAPELYCRNFGGVSYKSDVYSFGMLALEMVSGRRNTDPSVESQNEVYLPEWIYEKITTEQEWELNLEMTAEDKEKMRQLTIVALWCIQWNPKNRPSMTKVVNMLTGRLQNLQIPPKPFVSSENHPMLQNRANT

SEQ ID NO: 57481 - protein, 1142 aa, Oryza sativa Japonica Group
MDNPEAEPDDAVLFVGVSLVLGIASRHLLRGTRVPYTVALLVLGVALGSLEFGTKHGMGKLGAGIRIWANINPDLLLAVFLPALLFESSFSMEIHQIKKCMAQMVLLAGPGVLISTFFLGSALKLTFPYNWNWKTSLLLGGLLSATDPVAVVALLKELGASKKLSTIIEGESLMNDGTAIVVYQLFYRMVLGRTFDAGSIIKFLSEVSLGAVALGLAFGIASVLWLGFIFNDTIIEIALTLAVSYIAFFTAQDALEVSGVLTVMTLGMFYAAFAKTAFKGDSQQSLHHFWEMVAYIANTLIFILSGVVIADGVLENNVHFERHGASWGFLLLLYVFVQISRILVVVILYPLLRHFGYGLDLKEATILVWAGLRGAVALSLSLSVKRASDAVQTHLKPVDGTMFVFFTGGIVFLTLIFNGSTTQFLLHLLGMDRLAATKLRILNYTKYEMLNKALEAFGDLRDDEELGPPADWVTVKKYITCLNGLDDEPVHPHAVSDRNDRMHTMNLRDIRVRLLNGVQAAYWGMLEEGRITQTTANILMRSVDEAMDLVPTQELCDWKGLRSNVHFPNYYRFLQMSRLPRRLITYFTVERLESGCYICAAFLRAHRIARRQLHDFLGDSEVARIVIDESNAEGEEARKFLEDVRVTFPQVLRVLKTRQVTYSVLTHLSEYIQNLQKTGLLEEKEMAHLDDALQTDLKKFKRNPPLVKMPRVSDLLNTHPLVGALPAAMRDPLLSSTKETVKGHGTILYREGSRPTGIWLVSIGVVKWTSQRLSSRHSLDPILSHGSTLGLYEVLIGKPYICDMITDSVVHCFFIEAEKIEQLRQSDPSIEIFLWQESALVVARLLLPMMFEKMATHELRVLITERSTMNIYIKGEEIELEQNFIGILLEGFLKTKNQTLITPPGLLLPPNADLNLFGLESSAINRIDYCYTAPSYQVEARARILFVEIGRPEIEADLQRSASLISQTLELPRTQSKEHSETIQQLSGAQNGASLTEIRDHPASFSARALQLSMYGSMINDMKSGQGQGQRRQRHRHTKASSNKAHSSSYPRVPSSSSNTQRPLLSVQSEGANMTTARQAAAAGASLPPEPEEAGRRRRRQRKAIEEDEDNSSDESAGEEVIVRVDSPSMLTFRQPSSAADR

SEQ ID NO: 57482 - protein, 427 aa, Dechloromonas aromatica RCB
MNAPLLPSYISAQNIGPWHIFLQQVEQVAPLLDKSLWPWVETLRRPKRSLIVDVPIRLDSGEVAHFEGYRVHHNTSRGPGKGGVRFHQDVTLSEVMALAGWMTIKNAVVNVPFGGAKGGVRVDPRQLSISELEGLTRRYTSEISSMIGPDKDIPAPDMNTNAQVMAWMMDTYSMGEGRTVTGVVTGKPLSLGGSLGRQDATGRGVFVTAREAARKLNLPIEGARVAVQGFGNVGEASARIFAQAGARIVAVQDVSATLYCEAGLDIAALKRYLAENKTLLGAPGCEVIDNAAFWAVPCDFMVPAALESQINRYNAGQITARIVVEGANGPTTPEADVILAERGITVVPDVLANAGGVTVSYFEWVQDFSSFFWSEDEIYQRLERIMSEAFNAIWQLAEARQMSLRSAAFVIGCTRVLEARATRGLYP

SEQ ID NO: 57483 - protein, 376 aa, Dechloromonas aromatica RCB
MPALLPQPDPDGLLEYSVVYTDRALNHMSQRFQGVMKDISRLMKQVYNAKSAIIVPGSGTYGMEAVARQFATDKKVLVIRNGWFSFRWTQIFDMGKIPSESIVLKARQTGSGSQAPFAPAPIEEVVAAIHQHRPAVVFAPHVETSSGMILPDSYIKAVGEAVRAVGGMFVLDCIASGTIWVDMAANNVDVLISAPQKGWSASPCCAMIALGERARAHIDSTTSTSFACDLKKWLQIMEAFENGGHAYHATMPTDALATLRDVMLETEAYGFDKVCAEQREVGRRIRELMVAKGFPSVAAEGFQAPGVVVSYTTDPDIQSGKKFLAQGLQTAAGVPLQCDEPADFRTFRLGLFGLEKLHNPELTLANLAKALDSVLA

SEQ ID NO: 57484 - protein, 139 aa, Brassica napus
VDSADEPHSHHHHQLAKALTVPHLIAIGVGATIGAGVYILVGTVAREHSGPSLALSFLIAGIAAALSAFCYAELSSRCPSAGSAYHYSYICVGEGVAWLIGWALILEYTIGGSAVARGISPNLALIYGGEDGLPSFLAR

SEQ ID NO: 57485 - protein, 108 aa, Chlorobaculum thiosulfatiphilum
AGKYFEATDKNFQTEILDSDKAVLVDFWASWCGPCMMLGPVIEQLADDYEGKAIIAKLNVDENPNIAGQYGIRSIPTMLIIKGGKVVDQMVGALPKNMIAKKIDEHIG

SEQ ID NO: 57486 - protein, 363 aa, Glycine max
MGIYLSTPKTEKASEDGENDKLRFGLSSMQGWRASMEDAHAAHPYLDESTSYFGVYDGHGGKAVSKFCAKYLHQQVLKSEAYLAGDLGTSLQKSFLRMDEMMRGQRGWRELAVLGDKIEKLSGMLEGFIWSPRSSEANDRVNDWAFEEGPHSDFTGPNSGSTACVAVIRGNKLVVANAGDSRCVLSRKGQAHNLSKDHKPELEAEKDRILKAGGFIQVGRVNGSLNLARAIGDMEFKQNKYLPVEKQIVTADPDITSVELCDDDEFLVIACDGIWDCMSSQQLVDFIHQQLKTENKLSAVCEKVFDRCLAPTAGGEGCDNMTMILIQFKKPSSSPDASSVTNQPQSSAQPSEADRSSETIESK

SEQ ID NO: 57487 - protein, 340 aa, Burkholderia xenovorans LB400
MTTKGTILVTGGAGFIGSHTCVELLNGGYDVVVIDNLVNSNRESLRRVEKITGKAVTFYEADARDEAALNRIFDAHPITGAIHFAALKAVGESVAKPIEYYSNNVGSLLTLLGVMRERNVKQFVFSSSATVYGVPKSSPIDESFPLSATNPYGQSKLIAEQVLRDLEVADPSWRIATLRYFNPVGAHESGLIGEDPAGIPNNLMPYVAQVAVGKLEKLRVFGGDYDTPDGTGVRDYIHVVDLARGHLAALDALVTRDASFVVNLGTGQGYSVIDVVKAFEKAAGRPVPYEIVARRPGDVASCFADPAAAEKIIGWRAQFGIERMCADHWRWQSTNPQGFA

SEQ ID NO: 57488 - protein, 283 aa, Chlamydomonas reinhardtii
MKKGERKVLDYGDVLLREADVELLEGPHWLNDQIVSFYFEYLEREALPATSAAAAISGVLLLPPATSFLLMHAGPDMAGDILGPLKPHSRGLVLLPVNDNPDVDRAAGGSHWSLLVFHRPSNTLRHYDSSGGSGNAAAAKRLAAAVGPALQPPGAGGGGSGSSGSGSSGTGSSGASGGGPRFVEVVDTPRQCNGYDCGVYVLAVARAACERWCLGPAVAEGAAEGAAGAAAEAGAAGRGEDGEAGGEGSWREWERGLRALITPAAVKALRREVREVIREKAGE

SEQ ID NO: 57489 - protein, 485 aa, Prochlorococcus marinus str. NATL1A
MNITDNSIIPVILSGGSGTRLWPLSRESYPKQFLALDSRTKKTLLQKTYERLLGLEGLENPILICNEDHRFIVAEQFREINTDPQAIILEPVGRNTAPAIAVAALQAISLGKDPLLLILASDHLIENNVEFQRVIQSAKIYANQGKLVTFGIVPTSAETGYGYIETKEFPTKDNQIIGLEINKFIEKPNKDIAEKLIKDSRFTWNSGMFLFKASTIISELKKFSPEILNNCKIALEKDIEDLDFLRLETESFKKCPKISIDIAVMEKTNLGIVLPLNVGWNDIGSWKSLWDISKKNNDGNYINGRIIAEKSKNCYLKGEQRLIVGIGIENLIVVDTNDAILVANRDQSQNIGNIVKSLSSSAFPEGKVHRKIYRPWGNYTTIVEGNRWLVKLIEVKPNASLSLQMHHHRAEHWVVVNGTALIEKNGEKKLLSENESTFIPLGCKHRLSNPGKMRLELIEVQSGTYLGEEDIIRFEDSYGRIKNQN

SEQ ID NO: 57490 - protein, 212 aa, Zea mays
MQVLHPQSMRPAREGDIPVRVKNSYNPKAPGTLITRQRDMDKVVLTSIVLKSNVTMLDIVSTRMLGQYGFLARVFAIFEDLCISVDCVATSEVSVSVSLDPSKIWSRELIQQELDHVVEELEKIAIVRLLQQRAIISLIGNVEQSSLILEKTGRVLRKSGVNVQMISQGASKVNMSLIVHDSDAKALVEALHQAFFEDDVLSQVEAENLLVG

SEQ ID NO: 57491 - protein, 317 aa, unidentified eubacterium SCB49
MKTYTNTGNKDTRSGFGAGLEELGKKNEQVVALCADLTGSLKMDAFKANHPERFFQVGIAEANMIGMAAGMTIGGKIPFTGTFANFSTGRVYDQIRQSVAYSGKNVKICASHAGITLGEDGATHQILEDIGLMKMLPGMTVINTCDYNQTKAATLAIAEYDGPVYLRFGRPKVANFTPENGEFKIGEAVELTQGNDVTIIATGHLVWEALEAAKTLNESGISAEVINIHTIKPLDANAIIASAKKTGCVVTAEEHNYMGGLGESVARVLSENTPTPIEMVATQDTFGESGTPAQLMEKYGLNAEAIVKAATKVIARK

SEQ ID NO: 57492 - protein, 553 aa, Mycobacterium avium 104
MSSMGAQTALTLLLAAIAVIVLVDWISERTRLPSATLLVLVGIGQALLPGPTIGLEPDVVMTCILPPLLYHAALESSLVGIRRNLRTVVSLSVVLVLLTAASVGVAFSLLVGGATLAVGMVLGAAVAPTDPVAALAVARKEGLPLNIVTLIEGEGLLNDATALTTLAVAVTVARGAAFSAPSAIREFVLAAVGGLVVGQVFAYARRLLRRWRHDVLTANAISLATPFLTYLVAEKLSASGVLAVVVCGLIVGHDSPRVESGASRLQTRAVWRLVNFLLEGVVFLLIGHQVPVILDELGGYALSTILVAVGVTVAVVLLVRPLWLLLTQALPRSLHTRLGNVDDSATDDAEPRPERTRERLSGREIVVLSWAGTRGVVSLAAIFAVPVLTEGNAPFPDRDLLLFCTLVVVLVTLIGQGVTFGPLVRALGLRAKTTDELRLRNRARAAALRAALDRLDSLDPEDGADVDPRVIDVVRQQLSAQLERYEHRLTLLSDVDELPAAPAYEAAVGLRRVAIDAQRDELVRWRDAGMLPDQSLRAIERELDHEESMLPMG

SEQ ID NO: 57493 - protein, 913 aa, Oryza sativa Japonica Group
MVLPPRLLLFFLLLIGVHASVSHGSPSLPPTYDPSICSNLDGSKQTPFIQLNGENYTILEIIYDSRTIVLADTDALRGSCPRVRHNVTFGQAYPWLQYTGSRDNLTFFFGCKLNLPPPIDPGLVSLADKHQINCKDFSNWPDSGDSFVFTSGELEAPVESELARCCSQVIVVPVNGSVLNSSNQSALPSGGYGQVLKMGFDLAWNSSKDEQCYKCEQSKGHCSYSQNRAFLGCLCSDGKVSTKDCRNNGASNSSALTMLLSLCLRLLPLLLVLVAASHGDASGDTYDTSMCLQKPTTCGNVSISYPFYFATKTKDINGSSNSYCGYPGLAIDCDDGKPILQLNGTEKYKVNYINYGSITNVSLADLEVVDDSSGCPRVDHNVTIPQISWLFFSGISVDYLVFFLRCSFTTFAPKPANFNPIACGSFINLTRPSFVFPDELVPPGNWSQLCEETFEVPVLKYQLMEMDSNGNAWNNSGYAQVLRQGFQLSVNESRRPPNCSQCEESQGRCGYSQAGEFIGCLCPNGRVRSLRCDPSDLAGYAVMDKTRYSILMPFSVPNFLHANIIAGTSSVLLLCLLSFACLFGLKKSRYRRISKGTPRIESFLQRNGTLHPKRYTYTEVKRMTKSFAEKLGHGGFGAVYRGNLSDGRQVAVKMLKDSKGDGEEFINEVASISRTSHVNVVTLLGFCLHGSKRVLIYEYMPNGSLERYAFRNNSEGEHSLTWEKLFDVVVGIARGLEYLHRGCNTRIVHFDIKPHNILLDQEFCPKISDFGMAKLCSNKESIISIAGARGTIGYIAPEVYSKQFGAISSKSDVYSYGMMILEMVGARERNIDANSESSSHYFPQWIYEHLDEYCINSSEIDGETTELVRKMVVVALWCIQVVPTNRPTMTRVVEMLEGSTSGLELPPKVLLSW

SEQ ID NO: 57494 - protein, 658 aa, Oryza sativa Japonica Group
MAHLPLLLLSFLVLIGVHASVSHGSPPLPSTYDPSICSKSSECGGVNISYPFYLSNATDYYTRFSCGYTDLKISCSRDRDGRNETPTILLGGDNYTVLDIIYDSHTIVLADTDALRGGSCPRVRHNITFAQADEWLQYTGPRDNLTFFFGCKLNLPPPIDPGLVSLADKHQINCKDFSNWPDSGDSFVFTSAELEAPVESELARRCRQVIVVPVNGDILNSSNQSALPSGGYGQVLNKGFDLAWNSRKDEQCYQCEQSQGHCSYSQNRVFLDCLCSDGKVGNQDCRNSGASNSSTLRYSSLKGRMKLYIIAGISSVLLLCLLSFPCLFSLKKYRHRRISKGTPRIESFLQRNGTLHPKRYTYTEVKRMTKSFAEKLGHGGFGAVYRGNLSDGRQVAVKMLKDSKGDGEEFINEVASISRTSHVNVVTLLGFCLHRSKRALIYEYMPNGSLERYAFRNNSKGELSLTWEKLFDVAVGIARGLEYLHRGCSTRIVHFDIKPHNILLDQEFCPKISDFGMAKLCANKESIVSIAGARGTIGYIAPEVYSKQFGAISSKSDVYSYGMMILEMVGARERNIEANSESSSHYFPQWIYEHLDEYCISSSEIDGETTELVRKMVVVALWCIQVVPTNRPTMTRVVEMLEGSTSGLELPPKVLLSW

SEQ ID NO: 57495 - protein, 120 aa, Haemophilus ducreyi 35000HP
MSLTNEQIIEAIASKSVSEIVELITAMEEKFGVSAAAAVAAAPAAAAAEEKTEFDVVLANAGANKVAVIKAVRGATGLGLKEAKDLVESAPATLKEGISKPEAEALKKELEDAGAQVEIK

SEQ ID NO: 57496 - protein, 380 aa, Coccidioides immitis RS
MADTVGKTITCKAAVAWEAAKPLSIEDIEVAPPKAHEVRIQIYYTGVCHTDAYTLSGKDPEGAFPVVLGHEGAGIVESVGEGVTSVKPGDHVVALYTPECRECKFCKSGKTNLCGKIRATQGKGVMPDGTSRFKCRGKDLLHFMGTSTFSQYTVVADISVVAVTDKAPMDRTCLLGCGITTGYGAAVVTAKVEEGSTVAVFGAGCVGLSVIQGAVKNKAGKIIVVDVNDSKESWSRKFGATDFVNPTKLGNKSIQEHLIEMTDGGCDYTFDCTGNVGVMRAALEACHKGWGQSIVIGVAAAGQEISTRPFQLVTGRVWKGCAFGGIKGRSQLPDLVDDYLKGDLKVDEFITHREPLANINAAFEQMKAGDCIRCVVDTRT

SEQ ID NO: 57497 - protein, 176 aa, Escherichia coli
EGLWDTLSARLDFCNLDVNDTAAFNRLGAMLDQKNRITINYFAMPPSTFGAICKGLGEAKLNAKPARVVMEKPLGTSLATSQEINDQVGEYFEECQVYRIDHYLGKETVLNLLALRFANSLFVNNWDNRTIDHVEITVAEEVGIEGRWGYFDKAGQMRDMIQNHLLQILCMIAMSP

SEQ ID NO: 57498 - protein, 486 aa, Streptococcus pyogenes MGAS10394
MKFTIITNYDTLSRKSFTIEGDNMTIFRKKKKYSNKTEMQRHFKVIDLVFLGLGSMVGTGIFTVTGIGAAKYAGPALTISIIISAIAIGILALFYAEFASRMPSNGGAYSYVYATLGEFPAWLVGWYIIMEFLTAISSVAVGWGSYLKGLLANYNIVLPNALNGTFNLKNGTYIDILPVLVMFFVTGIVLMNSKLALRFNSFLVILKFSALALFIFVGIFFIDHNNWSHFAPYGVGQITGGKTGIFAGASVMFFAFLGFESISMAVDEVKEPQKTIPKGIILSLIIVTALYIVVTTILTGIVHYTKLNVPDAVAFALRNIRLYWAADYVSIVAILTLITVCISMTYALARTIYSISRDGLLPKSLYTLTKKNKVPQNATLVTGLLAMICAGIFPLSSLAEFVNICTLAYLIILSGAIIKLRRIEGEPKANEFKTPLVPFLPMLAIIICLSFMSQYKAFTWIAFAIATIIGTLIYLAYGYTHSIENK

SEQ ID NO: 57499 - protein, 399 aa, Vitis vinifera
MRIGHRRGTLIFVAQHYFSFTSLQPRLHRFGSHFPLKTLVFSMAEAVDNPSSFSGESDEDFKYGFQREEMYKASIAGTVDAYDRHVFLCFKSPEDWLPRVEGSDSDLLPKLFSSALKSRKNDIAVKTKFTICEGRDGTEFSDGDVLIFPEMIKYKSLKDSDVDSFVDDVIVNGKPWASGMQEVLTGSHIFVCAHGSRDKRCGVCGPVLIQKLKEEIDLRGLGDQVFVTPCSHVGGHKYAGNLIIYSPNPEGKIMGHWYGYVTPNDVPELLDQHIGKGEIIERIWRGQMGSSTEEGEKVDEQKLPNGKDQKRKKKHQEDSPSLGNKESVAGCCQGADGVSCCRDATLVDKCTSEEQGKKVLTKLSHWMGTWEQGDVFATIAVVGAVATVAVAYSLYRRSG

SEQ ID NO: 57500 - protein, 449 aa, Mycobacterium avium 104
MARLEQTRRLVTEIPGPASLELSKRRAAAVSHAVNVSVPVFVARAGGGIVEDVDGNRLIDLGSGIAVTTIGNSAPRVVDAVRAQVAEFTHTCFMVTPYESYVAVAETLNRITPGAGEKRSVLFNSGAEAVENAVKVARAYTRKPAVVAFDHAYHGRTNLAMALTAKSMPYKGGFGPFAPEIYRAPLSYPYRDGLLDKELATDGEKAAARAINIIDGQIGADSLAAVIIEPIQGEGGFIVPAEGFLPTLLDWCRRNDVLFIADEVQTGFARSGAMFACEHEGPNGLEPDLICTAKAIADGLPLSAVTGRAQIMDAPHVGGLGGTFGGNPLACAAALATIETIESDGLIERARQLERLITEPLLRLQARDDRIGDVRGRGAMIAIELVKSGTAEPDKDLTQRLSVAAHAAGVIVLTCGMFGNIIRLLPPLTISDELLAEGIDILGGLLADL

SEQ ID NO: 57501 - protein, 324 aa, Streptococcus pyogenes MGAS10394
MEEKMSYSDLKLFALSSNKELAEKVASAMGIQLGKSTVRQFSDGEIQVNIEESIRGHHVFILQSTSSPVNDNLMEILIMVDALKRASAEKISVVMPYYGYARQDRKARSREPITSKLVANMLEVAGVDRLLTVDLHAAQIQGFFDIPVDHLMGAPLIADYFDRHGLVGEDVVVVSPDHGGVTRARKLAQFLQTPIAIIDKRRSVDKMNTSEVMNIIGNVSGKKCILIDDMIDTAGTICHAADALAEAGATAVYASCTHPVLSGPALDNIQRSAIEKLIVLDTIYLPKERLIDKIEQISIADLVAEAIIRIHEKRPLSPLFEMGN

SEQ ID NO: 57502 - protein, 486 aa, Xylella fastidiosa 9a5c
MMHHNVHQSEILADPCDLQRAERWLQRDLRVLWHPCTQMREHPDTLPLVPIVRGEGAWLVGHDGRRYLDAVSSWWTNLFGHADPRISAAIAAQARTLEQVMLAGFSHEPAVRLAEALLRLAPRQDGREPLSKVFYADNGSAGVEVALKMAFHYFRNRGEEQRTRFIALHNGYHGETIGALAVGDIPLYRRVYAPLLTEVLFAPSPDAYLAEPGQSAAEYALQAAEALEVLFKRYSGQICALILEPLLQCAGGMRMHHPVYLHRVRELCDAHGALLICDEIATGFGRTGTLFACEQACPVILTDTDDKQLGIMPDLLCLSKGLTGGFLPLAAVLTTQQLYEEFLDDSRERAFLHSHSYTGNPLACIAALTTLDIFENDCIIERNQVTAARMTQLAASLSGHPHVADVRQAGMVVAFELTRDGNKRTPFPLQARLGLHVYRAALARGVILRPLGDVVYWMPPYCVDEEQLHLLAETTRVAIDEAIACV

SEQ ID NO: 57503 - protein, 757 aa, Arabidopsis thaliana
MSSSFLSSTAFFLLLCLGFCHVSSSSSDQGTYIVHMAKSQMPSSFDLHSNWYDSSLRSISDSAELLYTYENAIHGFSTRLTQEEADSLMTQPGVISVLPEHRYELHTTRTPLFLGLDEHTADLFPEAGSYSDVVVGVLDTGVWPESKSYSDEGFGPIPSSWKGGCEAGTNFTASLCNRKLIGARFFARGYESTMGPIDESKESRSPRDDDGHGTHTSSTAAGSVVEGASLLGYASGTARGMAPRARVAVYKVCWLGGCFSSDILAAIDKAIADNVNVLSMSLGGGMSDYYRDGVAIGAFAAMERGILVSCSAGNAGPSSSSLSNVAPWITTVGAGTLDRDFPALAILGNGKNFTGVSLFKGEALPDKLLPFIYAGNASNATNGNLCMTGTLIPEKVKGKIVMCDRGINARVQKGDVVKAAGGVGMILANTAANGEELVADAHLLPATTVGEKAGDIIRHYVTTDPNPTASISILGTVVGVKPSPVVAAFSSRGPNSITPNILKPDLIAPGVNILAAWTGAAGPTGLASDSRRVEFNIISGTSMSCPHVSGLAALLKSVHPECSPAAIRSALMTTAYKTYKDGKPLLDIATGKPSTPFDHGAGHVSPTTATNPGLIYDLTTEDYLGFLCALNYTSPQIRSVSRRNYTCDPSKSYSVADLNYPSFAVNVDGVGAYKYTRTVTSVGGAGTYSVKVTSETTGVKISVEPAVLNFKEANEKKSYTVTFTVDSSKPSGSNSFGSIEWSDGKHVVGSPVAISWT

SEQ ID NO: 57504 - protein, 188 aa, Bacteroides fragilis YCH46
MEPIINSQMPEFKVQAFQNGSFKTVSSEDVKGKWAIFFFYPADFTFVCPTELVDVAEKYEQFQAMGVEVYSVSTDSHFVHKAWHDASESIRKIKYPMLADPTGVLSRGFGVMIEEDGMAYRGTFLVNPEGKIKIAEIQDNNIGRNADELLRKVEAAQFVATHDGEVCPAKWKKGEATLKPSIDLVGKI

SEQ ID NO: 57505 - protein, 999 aa, Coprinopsis cinerea okayama7#130
MQNSQDSPPRAPPIQYNAPLGTRWAKEKAAAGGSAAFDLPSDPKSIGPWILGECIGKGASGRVKIARHQRTRQLAAVKILPIAPLVNSRASLATQQAKSEKQRLGIDREITMMKLMNHPNIMRIYDVYEGEKELFLVLEYVEGGELFDFLVNRGRLPPSEALLYFRQIIYGLNYAHTFSIIHRDLKPENILIASLDPPVVKIADWGMAAFAPPMLQLETSCGSPHYASPEIVNGEKYFGTATDIWSCGVILYALLTGRLPFDDKNVRTLLSKVKSGKYDIPSWMDPMAKDLLTKMLVVDVHKRITIPDILVHPWFVKGPTSTSQHTMDITLAQPPLPPSPSTLARPIASPDLIDPELFASLRIIWGRHADPDGAAIQQDLCSPAGQGLHAKAFYFLLDRYREESLRNRSDDAADRIQTPRSETECQSDKLYLGWDLDQTRARRSLEAVVNTSSPADKAVSPYRSTTPANEPFTADDPRSNELSMPGTPIPTTRHPNLLGEDRSFLKELQRRASAVPFHASVHPGRVPPPSLMDVDSSAVTLRQSMVERSDLRENVDRPGAVRTDVSVIPSDNHIHHRQSTRRRASLDAEKENAMAVDDGPFGVTTNREVGRDVVNTPETTHSIPSAKTKKEKERKSRPPPIELPPIHQRRTLVGSSFHTPSPGLHGGTGTAHTGSTSNRIMASPVVGEFKGWFSNLFNWKSHSAHPPASVFYSPEDIPKTREMTLRFFQSLAFGISRVILDLNADSSEIYHCRLDQSVVDLATNTTLKPVRLRVEFSLVVPASPGPTTGGGTGAMTSSAGTTPTPTPTTATSEFWTFTTGQLQQHAQQPLDPSSNTFLSAGTAGFGARATRNSLAALGRTASNAIGHHHQSHHHHHHLHHHPTVNTTSATTTTTAPTSGGQGATVNANATALLSTHWEMPLGCACVIVMTFEKGSGSAFRAVKQRLQDMFSDSQVVGSGVGAGVGVGAGGGVGAGGGAISPTCFSPVLTAAGGGDRMVM

SEQ ID NO: 57506 - protein, 795 aa, Chromobacterium violaceum ATCC 12472
MADNYVIWFEKLRMTDVEEVGGKNASLGEMISQLAGSGVRVPGGFATTAQAYRDFLQHNGLADKINAALAKLDIDDVSELARVGKEIRQWIIDTPFPAKLDADIKEAWDKMVADAGGADISVAVRSSATAEDLPDASFAGQQETFLNIRGLDNVKDAMKHVFASLYNDRAISYRVHKGFAHDVVALSAGVQRMVRSDMGAAGVMFTIDTESGFEDVVFITASYGLGETVVQGAVNPDEFYVHKPTLKAGRPAVLRKTMGSKLIKMEFTDASQAGRSVKTVDVEPALRKAFSISDAEVAELAQYALIIEKHYGRPMDIEWGRDGVDGKLYILQARPETVKSQEDRKDTLRRYRLNSKSEILCEGRAIGQKIGQGVVRTIKDASEMDRVKPGDVLVTDMTDPDWEPVMKRAAAIVTNRGGRTCHAAIIARELGIPAVVGCGDATDVLKEGMQVTVSCAEGDTGNIYDGLLDVEVIDLELDKMPKAPVKIMMNVGNPELAFDFAQLPNEGVGLARMEFVINRQIGIHPKALLEFDKLSPELKETISDRIAGYASPVDFYVDKIAEGVSTLAAAFYPKKVIVRMSDFKSNEYANLIGGQLYEPHEENPMIGFRGAARYVAESFRDCFELECRAIKKVRDVMGLTNVEVMIPFVRTLAEAEKVVEILAENGLKRGENGLRLIMMCELPTNAVLAEKFLQHFDGFSIGSNDMTQLTLGVDRDSGGPIASTFDERNEAVKAMLHMSIQACRKLGKYVGICGQGPSDHPDFAKWLVEEGIETVSLNPDTVVETWLYLAKELNS

SEQ ID NO: 57507 - protein, 590 aa, Glycine max
MTEDRNVRKTRVVDLVLDCVIPYIDDPKDRDAVSQVCRRWYELDSLTRKHVTIALCYTTTPARLRRRFPHLESLKLKGKPRAAMFNLIPEDWGGHVTPWVKEISQYFDCLKSLHFRRMIVKDSDLRNLARDRGHVLHSLKLDKCSGFTTDGLFHIGRFCKSLRVLFLEESSIVEKDGEWLHELALNNTVLETLNFYLTDIAVVKIQDLELLAKNCPNLVSVKLTDSEILDLVNFFKHASALEEFCGGTYNEEPEKYSAISLPAKLCRLGLTYIGKNELPIVFMFAAVLKKLDLLYAMLDTEDHCMLIQKCPNLEVLETRNVIGDRGLEVLGRCCKRLKRLRIERGDDDQGMEDEEGTVSHRGLIALSQGCSELEYMAVYVSDITNASLEHIGTHLKNLCDFRLVLLDHEEKITDLPLDNGVRALLRGCNKLRRFALYLRRGGLTDVGLGYIGQYSPNVRWMLLGYVGESDAGLLEFSKGCPSLQKLEMRGCSFFSERALAVAATQLTSLRYLWVQGYGVSPSGRDLLAMARPFWNIELIPSRKVAMNTNSDETVVVEHPAHILAYYSLAGQRSDFPDTVVPLDTATCVDT

SEQ ID NO: 57508 - protein, 446 aa, Xylella fastidiosa 9a5c
MNFETLGLLPSLLRALSEQGYEIPTPIQQQAIPLALAGHDLLAAAQTGTGKTAAFGLPVLQRLMAASSNVGAGKPRALVLTPTRELATQVYDSLRGYAKYQRVSSAVIYGGVGMGNQLDVLRRGVDLLIACPGRLIDHIERRSVDLSGVGILVLDEADRMLDMGFLPSIKRILGKLPRQNRQTLLFSATFAEPIKQLALEFMCRPREVMVASHNTVAETITHRVHPVDVSRKRELLLHLLAQDSREQTLVFVRTKHGSDKLATFLEKYGIKTAAIHGNKTQGQRLRALNSFKAGRVTVLVATDIAARGIDIDQLPKVINYDLPMVAEDYVHRIGRTGRNGVQGEAISLVTQEDAKLLRQIVRLLDRDMDIRDVPDFEPQVPIRWGNSAPGKSKQPAGQHPPRKSQHRRAFGKASVQTAHALTKQSGVQHSNGSRNRDGMFPVHQRG

SEQ ID NO: 57509 - protein, 512 aa, Arabidopsis thaliana
MVSHPMEKAANGASALETQTGELDQPERLRKIISVSSIAAGVQFGWALQLSLLTPYVQLLGIPHKWASLIWLCGPISGMLVQPIVGYHSDRCTSRFGRRRPFIVAGAGLVTVAVFLIGYAADIGHSMGDQLDKPPKTRAIAIFALGFWILDVANNTLQGPCRAFLADLSAGNAKKTRTANAFFSFFMAVGNVLGYAAGSYRNLYKVVPFTMTESCDLYCASLKTCFFLSITLLLIVTFVSLCYVKEKPWTPEPTADGKASNVPFFGEIFGAFKELKRPMWMLLIVTALNWIAWFPFLLFDTDWMGREVYGGNSDATATAASKKLYNDGVRAGALGLMLNAIVLGFMSLGVEWIGRKLGGAKRLWGIVNFILAICLAMTVVVTKQAENHRRDHGGAKTGPPGNVTAGALTLFAILGIPQAITFSIPFALASIFSTNSGAGQGLSLGVLNLAIVVPQMVISVGGGPFDELFGGGNIPAFVLGAIAAAVSGVLALTVLPSPPPDAPAFKATMGFH

SEQ ID NO: 57510 - protein, 221 aa, Bacillus pseudofirmus
IYKRYDMMNSVISFQRHKAWRKDTMKRMKVQPGDHALDVCCGTADWTIALGEAVGHNGKVEGLDFSKNMLLIGEEKVKEHKMKHVSLRHGNAMELPYADETFDVVTIGFGLRNVPDYMQVLKEMHRVVKKGGKVVCLETSQPTIPVFKNLYFFYFRRVMPVFGKVFAKSYDEYSWLQESTMSFPNREKLAEMFREAGFERVDVKPYSGGVACMHLGVKGKN

SEQ ID NO: 57511 - protein, 128 aa, Brassica napus
MGNCVRSNLRDLGGRRSMDPRIWHKVAAVSGMAALGLGTYGAHVFKPENPSYKQVWQTASLYHLVHTAALVSAPSTKYPNIFGGLLTAGIVAFSGTCYMVALREDRKFSTLAPFGGFAFIAAWTTLLF

SEQ ID NO: 57512 - protein, 134 aa, Oryza sativa
LYTAFALIHKERPPPNVVGRMVLVGDVQDKVAILVDDIADTCGTLAKAAATVNEHGAREVYAIVTHGILSGNAIDTINQSCLKGLVVTNTVPLGDKTERCPKLKVIDVSATLGEAIRRTHNGESVSYLFNNVPV

SEQ ID NO: 57513 - protein, 265 aa, Brassica napus
MATNSAWKLDDHPKLPKGKTIALIVLDGWGESAPDEYNCIHTAPTPTMDSLKNGRPDTWTLIKAHGTAVGLPSEDDMGNSEVGHNALGAGRIFAQGAKLCDIALASGKIFDGEGFKYVSESFEKNTLHFVGLLSDGGVHSRLDQLQLLIKGSAERGAKRIRVHILTDGRDVLDGSSVGFVEILEADLAKLRENGVDAQIASGGGRMYVTLDRYENDWGVVKRGWDAQVLGEAPHKFKNAVEAVKTLRKEPGANDQYLPPFVIVDD

SEQ ID NO: 57514 - protein, 403 aa, Streptomyces avermitilis MA-4680
MTYDVGALRAQFPALRAGTAHFDGPGGTQIPEPVIAAIADAMSNPLSIRGAEVLGETNAETIVQEFRQAMADLLGAAAPGIVLGRSATQLTYDFSRVLARTWAPGDEIVVSRLDHDANIRPWLQAAEQAGVHVRWADFDPATGELPAAAVGEVLSDRTRLVAVTAASNLIGTCPAVAEIADLVHRSGALLYVDGVHYAAHNFVDVTQLGADFFVCSPYKFFGPHHGVLAASPELLETLRPDKLLPSTDAVPERFELGTLPYEFLAGTRAAVDFLAGLATGAAVTGDRRDRLRSAYAAVERHETALRERIEKELSLLDGVTIHSRAAERTPTLLLTFADRSATRAYHFLARLGVHAPAGSFYALEASRHLGLGDSGGLRVGLSPYNDASDAERLLEGLTAFLAS

SEQ ID NO: 57515 - protein, 384 aa, Zea mays
MGAVASTVAARFAFFPPTPPSYGVEPPPSPAAAAADTEVVELSGVPVSRGRGVEARRLPTKRGTEVVSMYVRQPGARLTLLYSHGNAADLGQMYELFVELSAHLNVNLMGYDYSGYGQSSGKPSEQNTYADIEAVYRCLLESYGASEENIILYGQSVGSGPTLDLASRLPHLRAVVLHSPISSGLRVMYPVKHTYWFDIYKNIDKIPLVRCPVLVIHGTADEVVDCSHGRALWELSKVKYEPLWIKGGNHCNLELYPEYIKHLKKFVTAIEKSQPVKDESPESSGPSDPSEIGSESAENSRRSTDIRDKPRSSIDHRPSIDRREKPRGSIDRRDKNRKSIDQLDKPRASVDQPDRARKSIDRFGGMMRSVKLCNIDCFTAASGS

SEQ ID NO: 57516 - protein, 252 aa, Geobacillus stearothermophilus
RKPIIAGNWKMNGTLAEAVQFVEDVKGHVPPADEVISVVCAPFLFLDRLVQAADGTDLKIGAQTMHFADQGAYTGEVSPVMLKDLGVTYVILGHSERRQMFAETDETVNKKVLAAFTRGLIPIICCGESLEEREAGQTNAVVASQVEKALAGLTPEQVKQAVIAYEPIWAIGTGKSSTPEDANSVCGHIRSVVSRLFGPEAAEAIRIQYGGSVKPDNIRDFLAQQQIDGALVGGASLEPASFLQLVEAGRHE

SEQ ID NO: 57517 - protein, 293 aa, Zea mays
LRARSPFRCAHLGICASARLSPPARPPSFPCLAEGRSHCARVRATMSSAVEAISCPKVDVPAGPEPGEPAKEAAPPAEHCDTAPNGKCAPRCHGEEDDEEEDEEEEEEKAPKAIDLGPMVSIKEQLEKDKDDESLRRWKEQLLGGVDFNSVGETLEPDVKIMSLSILSPGRPDIVLPLPVEPNGKGVWFTLKEGSPYRLKFTFSVSNNIVSGLRYTNTVWKTGLKVDRAKEMLGTFSPQLEPYTYVTPEDTTPSGMFARGSYSARTKFLDDDRKCYLEINYTFDIRREWPSTS

SEQ ID NO: 57518 - protein, 344 aa, Streptomyces avermitilis MA-4680
MPVRRPCPGRPYRDLSSAPGTAVRAEPTTPLPPFALRTCACQTPGRDMSVNALTAVPSARSIPATSAFRGRIGCDARSGHYPVPGRYRLHLSPSCPHCLKIAVAHSLLGLEDACPVTLLPAVPDGPGGEHSALRPLYEASAHRYAGAAVAPVLSDDWSGRIVSTHAPDIMRDLARRFGGERPPLYPKGMEAEIEAVGHLCEQGINATAQRAGRADADDAERDSALGSLLRTLRSLEGRLARQDYLLGDRLTAADIELWVSLVQLDTVHRWHLDASAVHRVADHPALWAYARRLAGDPAFGAHLDLDGIARRHHAHCRGLEAAGAAVQIVEWAAHAPDRTASRQG

SEQ ID NO: 57519 - protein, 321 aa, Mucor mucedo
MSTDYLTLNRTGDKMPIRGFGCWKIDTKDCEETVYQAIKTGYRLFDGACDYGNEVEVGRGINKAINEGLVKREDLFIVTKLWNTFHSKKHVRALFDRQLKDTGLEYFDLYLIHFPVPLQYVDPATVYPPGWYVGDAKSLQFEQSPIHECWAELEKIVDAGLARNIGVANFNCQAILDLLTYARIKPAVLQIELHPYLPQERLVKWVKEQGIQITAYSSFGPTSYVDLTESGKTYTSLLEHASVKSVADKHNVSTGQVLLRWALDREFAVIPKSVNAGRMKANLEILDIKLDAEDNKTLDSLKTNQRFNDPMTYGFGLPLFD

SEQ ID NO: 57520 - protein, 548 aa, Arabidopsis thaliana
MSPFSETSVLLLPMVEKCINLLQTYGVSSITKLRQIHAFSIRHGVSISDAELGKHLIFYLVSLPSPPPMSYAHKVFSKIEKPINVFIWNTLIRGYAEIGNSISAFSLYREMRNSLLHLYANCGDVASAYKVFDKMPEKDLVAWNSVINGFAENGKPEEALALYTEMNSKGIKPDGFTIVSLLSACAKIGALTLGKRVHVYMIKVGLTRNLHSSNVLLDLYARCGRVEEAKTLFDEMVDKNSVSWTSLIVGLAVNGFGKEAIELFKYMESTEGLLPCEITFVGILYACSHCGMVKEGFEYFRRMREEYKIEPRIEHFGCMVDLLARAGQVKKAYEYIKSMPMQPNVVIWRTLLGACTVHGDSDLAEFARIQILQLEPNHSGDYVLLSNMYASEQRWSDVQKIRKQMLRDGVKKVPGHSLVEVGNRVHEFLMGDKSHPQSDAIYAKLKEMTGRLRSEGYVPQISNVYVDVEEEEKENAVVYHSEKIAIAFMLISTPERSPITVVKNLRVCADCHLAIKLVSKVYNREIVVRDRSRFHHFKNGSCSCQDYW

SEQ ID NO: 57521 - protein, 467 aa, Zea mays
MSVQEYLEKHLLSRKIEEAVNAAVRAKAPDPVLFIAGHMRRAAPAVITRVRARQILDGHGAPAVEVELHTNKAIHRASAAGSGALEGAAADAAGAAERRKILAKVVADSVRMINDKVSEALVGMDPQEQSQIDQAIMDLNKARHKAELGVGANAMLAVSIAACKAGAAEKEVPLYKHIANLVGKSATTLPVPAITVINGGKHAGNGLPIQEIMILPIGAKNFEEAMQMGSETYHHLKDVILEKYGSDSCNIGDHGGISEGLDLVIAAIERAGYNGRIKLAIDVAATDFCTGKKYDLEFKSTKKSGQNFKTADDMIEIYSQLCSGDDLLMSDPERIKRAVNEYTCNALVLKARAVWTGTYGAAPRLRCGGRFERHTRANQVGTVTEAIEVVKQAKDAHWGVMVSHRSGDTEDSFIADLAVGASAGQIKAGAPCRGECLTNYNQLLRIEGELGSEGVYAGENWRTVNTS

SEQ ID NO: 57522 - protein, 176 aa, Escherichia fergusonii
EALWETLSGRLNFCNLDVNDTPAFTRLAAMLDQEKRITINYFAMPPGTFGAICKGLGEAKLNAKPARVVMEKPLGTSLATSREINDQVGEYFEECQVYRIDHYLGKETVLNLLALRFANSLFVNNWDNRTIDHVEITVAEEVGIEGRCCYFDKAGQMRDMIQNHLLQILCMIAMSP

SEQ ID NO: 57523 - protein, 231 aa, Haemophilus influenzae Rd KW20
MTRKILIVEDECAIREMIALFLSQKYYDVIEASDFKTAINKIKENPKLILLDWMLPGRSGIQFIQYIKKQESYAAIPIIMLTAKSTEEDCIACLNAGADDYITKPFSPQILLARIEAVWRRIYEQQSQFIQIDELSIDENAQRVFFQQQEINLSSTEFKLLHFFMRHPEKVYSREQLLNRIWHNDLEVEYRTVDSYIRRLRRNLAPFQCEHYIQTVRGSGYRFSSYLRDKQ

SEQ ID NO: 57524 - protein, 607 aa, Vitis vinifera
MPKHYRPPGKKKEGNAAKYITRSQAVKHLQVSLPLFRRLCILKGVFPREPKKKVKGNHHTYYHTKDIAFLQHEPLLEKFRNIRAYDKKVNKAKAKKNRDLAERLLTRRPNYTLDRLIRERYPKFTDALRDLDDCLTMVHLFASLPALESEKIQVKRIHNCRRLSHEWQAYICRTHKLRKTFISVKGIYYQAEVEGQKITWLTPHTLQQVLTDDVDFNVMLTFLEFYETLLAFVNFRLYHSINVKYPPILDSRLEALAADLYGLSRYFAANSSATVLGSQAVSSSGAEQIDITKDGTQPDESELRLAQLQHQLPSNEPGTLMHLVEDASCEDEDDEETRECKTLFKNKKFFLSREVPRESLLFVIPAFGGVVSWEGEGAPFKEADQSITYQIVDRPTQGHIFLSREYVQPQWVFDCVNARIILPTDAYMVGRVPPPHLSPFIDNEAEGYVPEYAEMIKRLQAAARKEVLPIPGAGKEDLDDPQNLLVEGIISRTEANEVAERKQKMLALENQYHNELQLELQGVQYSSSVSNMNKQSSVEDTEAWEESLPDMQQIAEDTTTMSKVVMSRKKRRLYEAMQIGKERKRAHVNLLKERKQKIEAAQGSEKS

SEQ ID NO: 57525 - protein, 173 aa, Dechloromonas aromatica RCB
MPLFKLGDKQPQLGDNAWVAPNATVIGDVRLGSNASIWWNATLRGDNDPIHIGDNTNIQDGSVLHTDEGVPMHIGNDVTVGHLVMLHGCTVGDGSLIGIGSVILNHAVIGKGCIVGANTLIPEGKVFPDRSLIVGSPGKVVRELSDEDVAKLKKSAEHYVDNARRYRDTLSPL

SEQ ID NO: 57526 - protein, 499 aa, Oryza sativa Indica Group
MAMGAASWAPIPAPARAAAAFYPGRDLAAARRRRGAAAAARRPFVFTPRAVSDSRSSQTCLDPDASTSVLGIILGGGAGTRLYPLTKKRAKPAVPLGANYRLIDIPVSNCLNSNVSKIYVLTQFNSASLNRHLSRAYGNNISGYKNEGFVEVLAAQQSPENPNWFQGTADAVRQYLWLFEEHNVMEFLILAGDHLYRMDYQKFIQAHRETDADITVAALPMDEERATAFGLMKIDDEGRIIEFAEKPKGEKLKSMMVDTTILGLDTERAKELPYIASMGIYVFSKDVMLKLLRQNFPAANDFGSEVIPGATEIGMRVQAYLYDGYWEDIGTIEAFYNANLGITKKPVPDFSFYDRSAAIYTQPRYLPPSKVLDADVTDSVIGEGCVIRHCTINHSVVGLRSCISDGAVIEDSLLMGADYYETETDKKALSETGGIPIGIGKNAHIRKAIIDKNARIGENVKIINVDNIQEASRETDGYFIKSGIVTVIKDALIPSGTVI

SEQ ID NO: 57527 - protein, 293 aa, Sulfolobus solfataricus P2
MIIVVGSYNVDVILKVNKIPEIGETVIADELYITHGGKGSNQAVSASRLGSHVKIIVAVGDDKHGTDAIEFWKSENIDVSKVKVKSGINTGTAYIFVDKKGRNIIVVNRGANYYLSEDDLNNSLEGDILLMQLEIRESVVKKAAKEFNGIKILNPAPANLKDTEILSLVDIITPNEIEFKELVNTDDFEYGLNLLLKKVKKAVIVTLGERGALLATRDGKKVLIPAPKVNVIDETGAGDVFNAALSVYLEKGYDLETAVEYANKVAALSVTKIGALGPKLDEVVRFLEEIDKA

SEQ ID NO: 57528 - protein, 338 aa, Vitis vinifera
MSLTELDDDTVRSMSIGALFSDFVGKINSLDFHRTDDLLVTASEDDSVRLYDIANAKLLKTTYHKKHGADRICFTHHPSSVICSSRHNLDSTGESLRYLSMYDNRCLRYFKGHKERVVSLCMSPINDSFMSGSLDHSVRIWDLRVNSCQGILRLRGRPTVAYDQQGLVFAVAMEGGAIKLFDSRSYDKGPFDTFFVGGDTAEVCDIKFSNDGKSMLLTTTNNNIYVLDAYGGEKRCGFSLEPSPSTTIEATFTPDGQYVVSGSGDGTLHAWSISMRHEVACWNSNIGVTSCLKWAPRRAMFVAASTVLTFWIPNASKSTADPGNTDPEAGPQSEHISQ

SEQ ID NO: 57529 - protein, 457 aa, Shigella flexneri 2a str. 301
MTTRLTRWLTTLDNFEAKMAQLPAVRRYGRLTRATGLVLEATGLQLPLGATCVIERQNGSETHEVESEVVGFNGQRLFLMPLEEVEGVLPGARVYAKNISAEGLQSGKQLPLGPALLGRVLDGSGKPLDGLPFPDTTETGALITPPFNPLQRTPIEHVLDTGVRPINALLTVGRGQRMGLFAGSGVGKSVLLGMMARYTRADVIVVGLIGERGREVKDFIENILGAEGRARSVVIAAPADVSPLLRMQGAAYATRIAEDFRDRGQHVLLIMDSLTRYAMAQREIALAIGEPPATKGYPPSVFAKLPALVERAGNGISGGGSITAFYTVLTEGDDQQDPIADSARAILDGHIVLSRRLAEAGHYPAIDIEASISRAMTALISEQHYARVRTFKQLLSSFQRNRDLVSVGAYAKGSDPMLDKAIALWPQLEGYLQQGIFERADWEASLQGLERIFPTVS

SEQ ID NO: 57530 - protein, 357 aa, Zea mays
  misc_feature (172)..(172): Xaa can be any naturally occurring amino acid
MFLHCVRVTASSVFRAQSFRCLFRMTTCRTANAAAVVRLLLLCSFCAAAAIACDPPNGAKFGYTGSVGPDHWGALSPSFRQCATGTKQSPIDISTAQAVSNPALQPLHRDYTVANATLVDNVVNVAVCRCLFLFVCFFFFKHNAAPRIELYYCTTAGPVDRCVSNNFSAGAXCTQLRFDGDGGAGSVSVGGKLYTLKQVHWHSPSEHTVDGRRFPVELHMVHASDDGNVTVVAMLYRFGRPDPLLWQIQDKLAALHAEGCRADKGAPVAAGDVSLWSLRLYSHTYYRYVGSFTTPPCTENVIWSVLAQVREMTVDQAAALMAPLEQAYRRNNRPTQPRNGRVVQVYRNGFINKKTAP

SEQ ID NO: 57531 - protein, 199 aa, Synechococcus sp. WH 7803
MICICGPSAAGKTLFAGLLASALQNADIKAIVIGCDDYYREHWTPDPFFGFDTVEAIDSESLINDLRALRSGELKRLRRYDMGTRAVHWTRLEAEADVVLLEGAFGPQLLLNSCPPDLLIYLEESLAVRALRRLRRDIRERQRTVLSVLKQMFKQMIPGERRFIQPLREEADVVVRHGARDLSEALEPIISLCSSRRAQ

SEQ ID NO: 57532 - protein, 92 aa, Zea mays
  misc_feature (43)..(43): Xaa can be any naturally occurring amino acid
  misc_feature (52)..(52): Xaa can be any naturally occurring amino acid
MKLNISFPATGCQKLIEVDDERKLRTFYEKRIATEVAADALGXEEWKGYVAXISAGNDKQGFPMKQGVLTHGRVRLLLSKGHSCYRPRRTGE

SEQ ID NO: 57533 - protein, 303 aa, Caulobacter crescentus CB15
MTVFVLGSINLDAVARVDDLPRPGETVAGLSLELFLGGKGANQAVAAARMGVATRLMGAVGGDDSGAGLKAKLAGYGVQVGDVVELPGVPTGQAHVWVANSAENMIVVTAGANAMVTPQQVAATTIEGQRVLLCQLETPATAIETLFRAGSAKGALRILNAAPALPQGAALFPLTDILIVNQTELATYAKLDREPVKLEEVSVAARKLMSRPDQTIIVTLGAAGAAVVRRDEAFLVEGKKVKAVDTVGAGDCFCGALAATLAAGMDLAEAVETANAAAALSVQKAGAAPSMPNRREVEAFLEG

SEQ ID NO: 57534 - protein, 338 aa, Prochlorococcus marinus str. NATL1A
MRAGSVIAIGEALIDRLGPLGGAPSSDLPVTDCFGGAPANVACALSRLGAKVSFIGSLGNDAFGEDFNNLLIQRRINTSGLQQDTLRPTRVVLVRRDSDGERCFEGFEGDKGLGFADQAISLEQIIRDWPLVAENAQWLVAGTIPLASEISSKAFLWCIENAMHSGIKIALDLNWRPTFWRNQVSNVSEPSVKEKNQILSILKNVSLIKLAKEEAQWFFHTSDPTEISSSLPQRPSVVVTDGSNPILWRLNNHVGKSFAIIPSSVVDTTGAGDAFTAGLIYKLISVELDQISEQSAKDIIQFGIACGSHVCKGVGAIEPQPYLDDIDNLLSLSKGGIS

SEQ ID NO: 57535 - protein, 414 aa, Campylobacter lari RM2100
MLIIEDLRAFEVLDSRGNPTIKAEIMLSDGSMGSAIVPSGASTGKKEALELRDNDERFGGKGVLKAIENINGTIAENIIGLDAFNQTQLDNTLLELDGTKNYSNLGANATLGISMATARAAANALGIPLYRYLGGANASVLPVPMCNIINGGAHANNNVDFQEFMIMPFGFSSFKEGLRSVCEIYAILKKELAALGYSTALGDEGGFAPNLANNTEPLDLLMTCIKKAGYENKIKLALDVASSELYKDGKYYLEGKVFSNEDLIARYEELCAKYPIFSIEDGLAEDDYEGWIKLTQKLGNKIQLVGDDLFVTNEDILREGILKNMANAVLIKPNQIGTITQTMRTVRLAHRNNYRCIMSHRSGESEDAFIADFAVALNTGQIKTGALARGERTAKYNRLLEIELDNDEYLGDKL

SEQ ID NO: 57536 - protein, 165 aa, Triticum aestivum
  misc_feature (33)..(33): Xaa can be any naturally occurring amino acid
  misc_feature (56)..(56): Xaa can be any naturally occurring amino acid
  misc_feature (70)..(70): Xaa can be any naturally occurring amino acid
  misc_feature (77)..(77): Xaa can be any naturally occurring amino acid
  misc_feature (85)..(85): Xaa can be any naturally occurring amino acid
  misc_feature (106)..(106): Xaa can be any naturally occurring amino acid
  misc_feature (146)..(146): Xaa can be any naturally occurring amino acid
MSSPSKRREMDLMKLMMSDYKVETVNDGMQEFXVEFRGPEESLYQGGVWKVRVELXPDAYPYRSPSIGFXNKIYHPXNVDELSGXSSAWDVINQTWSPMFDLVNVXFESSFPQLLLYPNPPDPINGRNCCILMRDRPAYEQKVKEXCEKYPNQRMRYNPEDIQRQ

SEQ ID NO: 57537 - protein, 467 aa, Pyrobaculum aerophilum str. IM2
MYDVVVLGGGSAGVAAAVKAAQLGAKVAVVNSGPLGGTCVNVGCVPSKFLIRAAQLKRYAERPFFKGISAKVEVAFDALLQHMKEVVEELRREKYEEVLKYYDVDIIEGYGYLKDAKTVKVGEREVRGEKIIVATGARPRVPEIPGLKEAMARGMAFTNEEFFKLDHMPSSIVFIGGGAIAAELSQALARLGIEVAVIYRSSFLKYEEEIASKFVEELLANEGVRLIKAAVTAVEIRGREVEVRHSGGSVRAEALFVAAGRAPNIEPLGGLLKLGPNGGVLVNERMETSLPGVYAAGDVTGGLEGARFLENAAARQGVVAAVNAMGGNAKFNPLAVPRVVFTDPAVASVGLREEDMIKGGIGCRCRAAPIEAVAAGWTKGQTTGFIKINTYPETWKVSVKRGKIAGALVVAPEAEELINVFAMAIQLGLTVEDLIEWLPSFPSYGEALRLAALAFYTDPTKLSCCGG

SEQ ID NO: 57538 - protein, 178 aa, Triticum aestivum
RLSPDEHEPLLRRLRAASCEAAPRLRGASRNSARDLLEWTRRGSGLRAILVISVGTITLIALTGLLIFMFFLLVATANAVIVSVLMSLAAAGGFLAIFFACLVAVYIGAVSAAIFAISATVISAVVGVMIATGWVGFFWMIWFAARKSMDLTKHSIGVTSSAIQSYSASRHVNQKPVD

SEQ ID NO: 57539 - protein, 618 aa, Zea mays
MISPAMCRSAPRRAAQVRRLLSSAAPPAHAGAAVPGPCIVHKRGNDILHDPWYNKDTAFPMTERDRLGLRGLLPPRVMSFEQQYERFINSFRSLEHNTRGEPDSIVALAKWRILNRLHDRNETLYYRLLIDNIKDFAPIIYTPTVGLVCENYSGLFRRPRGMYFSAKDKGEMMSMIHNWPAEKVDMIVVTDGSRILGLGDLGVQGIGIPIGKLDVYVAAAGINPQKVLPIMLDVGTNNEKLLEDKLYLGLRQPRLEGEEYLAVVDEFMEAVHARWPKAVVQFEDFQMKWAFETLQRYRNRFCMFNDDVQGTAGVALAGLLGAVRAQGRPLQDFTNQKIVVVGAGSAGIGVLSMAKQAMLRMPGIHRTGEGHNQFWVLDKDGLITKARKDLDSAVARFARGFGPDEVPDLYEGASLVEVVKKVKPHVLLGLSGVGGIFNEEVLKAMKESDSPRPAVFAMSNPTTKAECTPDDVFKHVGDKAIFASGSPFSNVSLGNGKSGYANQANNMYLFPGIGLGALLSGARHVSDGMLQAAAECLASYITDDEIRKGILFPSVSSIRHITARVGAAVVRAAVAEDLAEGCCDVGPRELGSMSESEAVDYVARKMWYPIYSPLVSDK

SEQ ID NO: 57540 - protein, 344 aa, Aspergillus nidulans FGSC A4
MTLFLGYNYSENTSLTKVKPEHIVVTSGGGSALGALMRSICDERDSVLLVCPIWDGLGLYLLIHGNIEWINVTVPWLEIGPQRSLVEELERAYLNHPNPDRIKAVVFTNPNNPLGRCFAPSVLRECLAFCAEKALHCISDEVYALSSFSSSAPFPRFTSILSLLDDTLPATFASRVHVIWSASKDFGCNGLRLGCIISQANDTLRLGSGLTSYLEVSSLTTVMTIALLDSPHLPLLIAKSSERLTAAYNLLTRGFERLHIKFIPANYGLCVFFRLVDNCSSAKEETAAVHELAQLGLVVSQGQNYALGDGVWGWARIIFAYPPDVIQRALDVLEKFRRGRGGCI

SEQ ID NO: 57541 - protein, 235 aa, Blastopirellula marina DSM 3645
MQTAQRERLAENLAEVRGKIAAAADRAGRSSDDVRLIAVTKYVDLETTEALFELGCCDLGESRPQQLWARAEQFAARPVRWHMIGHLQTNKAKRTAPVLSWLHAGDSLRLLKAVDAAATADRRVQALLEINISGDAAKHGIAPDDAPRVLEEAAKLPHLEIRGLMGMAALAGGVDVARANFAALRELRDRLAADAPDNIELTELSMGMSGDYQAAIEEGATMVRVGSSLFEGIER

SEQ ID NO: 57542 - protein, 476 aa, Kluyveromyces lactis NRRL Y-1140
MLILSRVFERNHVEILRKFMKFVGPGIMVSVAYMDPGNYSTSVSGGAQFKYKLLFITFISNIFAIVLQCLCIKLGTITGLDLAENCRRHFSKRVNYILYGFAEVAIIATDLAEVIGAAVALNILFNIPLLWGVLLTVFDVLLILLFYRPDEHSMKRVRAFETFVGILVGATVICFAIELFKISVPSKLEVFKGFIPNPIIFKEQQAMYISLGILGATVMPHSLFLGSSLVKPRVFDYDLKKYGKIKEQPSVGAIEYTLRYSYAELIVSLFFIATFVNAAILIVAGATLYGQPDAEDADLLSIYELLSHYVSPAAGLVFALAMLFSGQSAGVICTMAGQIVSEGFLEWSLEPWVTRLLTRLIAIVPCFLVTAFLGEKGVSSILNLSQVVLSLILPIVSAPLIYFTMNHKIMTVVDVDSAPASADSTEESRLLSKGVKSIDYTNGRLLSISSFVIWLTIGSLNCYLVFSYLMGADVHF

SEQ ID NO: 57543 - protein, 453 aa, Oryza sativa Indica Group
MDTEPLLSPLSPSPHLLHPLPEHAEVSTFSPPLSPCPSPASSYKERIIFGAHPPPPPPPPPPPPRGRRYYRRVSGDDLDVPSCSSSPSPPSDEENPPPNPPSLFDFIGGRTNLHRSRTAPAMAPLNAAAIAAAAASGDSRNPPPPPRRPAIVLHAFLFLLAYLAMGVTFYAALPGNFTSSAGPTHPVADALYFCIVTLCTIGYGDITPATPAAKLFSISFVLIGFGFVDILLSGMVSYVLDLQEHLLITALKNPRSVRKHRHNYIFDLKKGRMRVRMKVALALTVVAICVGVGAAVLKRVENLGWLDAVYLAVMSVTTVGYGDHAFRTLAGRLFASAWLLVSTLAVARAFLYLAEMRIDKRHRAMANWVLSRDMTVSEFLAADIDNNGYVTKSEFVVYKLKEMGKISEKDIMMICDQFQRMDSGNCGKITLSDLLESHQLVTDLNEKKKGKKS

SEQ ID NO: 57544 - protein, 323 aa, Mycobacterium sp. JLS
MARYDSVLEALGNTPLVGCPHLSPRWDDDENGPHVRLWAKLEDRNPTGSIKDRPALRMIEQAERDGLLHPGSTILEPTSGNTGISLAMAALLKGYQMICVMPENTSIERRQLLELYGARIIFSPAEGGSNTAVAHAKELAAANPDWVMLYQYGNPANADAHYYGTGPELLADLPEITHFVAGLGTTGTLMGTGRFLREKVPGVQIVAAEPRYGEGVYALRNIDEGFIPELYDPDVLTTRFSVGSFDAIKRTRELVTKEGIFAGVSTGAILHAALGMAAKAIKAGERADIAFTVCDAGWKYLSTGAYTGSLDDAEDALEGQLWA

SEQ ID NO: 57545 - protein, 442 aa, Dechloromonas aromatica RCB
MKYGKIAGLFVLAFVLNHIAPEILARLAMLEGTEAAIANALWCMGLFLVFGWACSKAAEGTVFPNFTLQLLVGIVLHDALAPIAPQIMIPVVVCTALAAIILKGGGDEVDRFDFLKIAFPTLMIAVVGYLVTFFVMFPILMAFGLDGKTAALLSAILGSTDPAALIPTLKKIVFKEEYKRLNDIAVAESALNDAVGAIFTAAVAAMILAGTAVDSLTALAAGLFSAENMLLLGKQFLFGSIAGVIGWGAMYSYEVYKSRDHVRDVGETSYDFAIVLAVPLVTFLLAQVIHGNGFLAAFVAGLLANYNHGKTYFHKTLHTMEIKIESIAKPTIFMMVGPFVALGDLWESALLGLVVSLAFILIARPVAVMLSLLPTDLNMKDKLFMSIVRETGVIPVVLAVITVAQFPELKLLMPLTAWVVIWTLTLLPAITPWWTRKLGIAQ

SEQ ID NO: 57546 - protein, 339 aa, Roseovarius nubinhibens ISM
MPQTAEPKLITGNANKPLANAVARRMSMHRGVQVGLCDARIERFNDQEIFVEVYENVRGEDMFIIQSTSNPANDNLMELLIMADALRRSSAQRITAVIPYFGYARQDRRTKARTPITAKLVANMIYGAGIERVLTMDLHATQIQGFFDIPVDNLYASPIFALDVKDQFKDCMDEVMIVSPDVGGVARARELAKRINAPLSIVDKRREKAGEVAEMTVIGDVSGKKCIIVDDICDTAGTLCKAAEVLLEHGASEVHAYITHGVMSGPAVERVSKSVMKSLVLTDTIAPSEAVRNAPNIRIVPTAPIFAQAILNIWNGTSVSSLFETDTLGPIYDGMYSAS

SEQ ID NO: 57547 - protein, 438 aa, Oceanicola granulosus HTCC2516
METTRIIGRVSSVRGLLLTATGLERAIGIGQRCRVLGAGGAVLGEVVGVDGAGSHILPFGTWDGIVAGDQVEVSPQGERVRPCDGWIGRVVDPLGRPLDRAGPLPEGRSPRAVRAGPPPAFDRRRVGARLETGIRAFDAFTPLCRGQRMGVFAGSGVGKSTLMAMLARNADVDVIVVGLIGERGREVQDFIQADLGPEGLARAVLVVATGDEPPLMRRQAAWTAMAVAEHFRDRGKQVLLLLDSITRFATAQREIGLSGGEPPTSRGYPPTVFAELPRLLERAGPGCDGQGDITALFTVLVEGSDMEEPVADSVRGITDGHVILDRRIAERGRYPAIDLQRSVSRMLPDCHGPDEFAILSAARRALGRYGDMEELVRIGAYRPGSDPETDAAIRFADPVAAYLGQRKGEATPPRETFADLYRLLVDAGIEVDLPPEAA

SEQ ID NO: 57548 - protein, 551 aa, Azoarcus sp. EbN1
MTVSPAGSPCRRGRRAAASGHFSVRGITLSCSRPKWQTGFYRILARAGQCLYPTPACAHAGSYRISTDPAMKLHPVILSGGSGTRLWPLSREQYPKQLLALIGDDTMLQQTALRLAGFSGGLPVSDQPLVVCNEEYRFITAEQMRAAGCPTNHILLEPVGRNTAPALTLAALTVRRDSDDGVLLVMPADHVIRDREAFHRAIDIGIEAALAGAMVTFGIVPERAETGYGYIRVGAEASPGIHAVASFVEKPDAGTAAEYVASGAYLWNSGLFMVKAGVWLKALGHFNPEMLAACESALETAGRDADFVRVGCEAFQACPSDSIDYAVMEKLAATPELGIAPQVVPMSVGWSDVGAWDALWTLADKDDDGNSGRGDVMFEGTTGSLVHATSRMVVCLGVEELVIVETPDAVMVARKDQTQDVKKIVARLKSDSRPQALAHRKIHRPWGCYDSIDTGGRFQVKHIEVKPGASLSLQMHHHRAEHWIVVRGTARVTRGDETFLLSENQSTYIPLGVTHRLENPGKMLLEMIEVQSGSYLGEDDIVRFEDTYGRS

SEQ ID NO: 57549 - protein, 515 aa, Acidobacteria bacterium Ellin345
MDTQSIVILDFGSQYTQLIARRIREQNVFSVVLPCTAKLDEIQKYNPAAIILSGGPSSVYDADAPPADPQVLHQGLPVLGICYGLHWMTHNLGGNVRPGAKREYGHAEVEIVKDSPLFAHLTGPLQVWMSHGDEADKLPDGFTLFAQSPNALAGMHNLEKNWYAIQFHPEVHHTRQGTEILRNFLFEIVKIKPNWTPARFIDETVESIRKQVGDGHVICGLSGGVDSSVAATLVHRAIGKQLTCIFVNNGVLRMNEFESVQTNLRDKLGLNIVGVDATDRFLGKLAGVTEPEKKRKIIGNEFIAVFEEEAHRIEQESGKVDWLVQGTLYPDVIESQSVRGPSQVIKSHHNVGGLPEKMKLKLIEPLRDLFKDEVRRIGRDLGMPEDVLNRQPFPGPGLAVRILGEVTADRVALLQKADHIVVSEIKRAGLYNKIWQSFAVLLPVMSVGVMGDQRTYAYTCAIRSVHSEDGMTADWVPLPYDVLKAMSNRIVNEVKGINRVVYDITSKPPGTIEWE

SEQ ID NO: 57550 - protein, 299 aa, Triticum aestivum
MPSSIATHLLKAAAAKPLFSPRAAQIPALPRPPVARRPPAPASAACRWFRWPSPARGLCSSPHSGPAEGMGSDGTGARRRLPPANGVSKEGAPLPLPQPVPPRLLTLPTVLTIGRVAAVPFLISTFYMEGPWAATATTGIFLAAAITDWLDGYIARKMHLGTPFGAFLDPVADKLMVAATLVLLCTKPLETSLLTNGPWLLTVPSIAIIGREITMSAVREWAASQNTQVLEAVAVNNLGKWKTATQMTALTLLLASRDPSLHVQGALVPPGVALLYASAGLAIWSLVVYIRNIWRILLK

SEQ ID NO: 57551 - protein, 639 aa, Oryza sativa Japonica Group
MSSLSGTVSVPHCPVLFDGCNYSHWAQHMRLHMRGQRLWDVLSSELPCPPCPIAPTMPSLASQATDDDREKAKEQFDDAMENYQSQFALYKAWLDEDARASAILVASMEIHLTGEVVTLTSAHLMWTHLHDRYAPTSDALYLAMVRQEQSLQQGDSTVDEFYTQLSSIWRQLDSLGPTICHTYPCCQRQRSHMDLRRIYDFLTRLRSEYESTRAQLLSRHPRVTIMEALTEIRSEEIRLREAGILPLPSSVLAVRTVASSASSTPAVHSTVSSSSSSARPPTTVVPSTRGHLHCTYCDKDGHVESFCFRKKKDLRRGNSSKGTSGSSQKSSGGSDSQEILMLLRRLTASAATGSVGSVALPSAQSGSAVLGSSSSTEGSSSASEPIEVYHDKEYRNRRWHFQSYNFTVSLVWSPFLTKSEVFENENGQSTSEIQLHLDILDPIWTSQYETFDYVVIAGGQWFLKVAVYWENDRVIGCHYCQDKKLRELGFEHLYRRTLQQIFRFIASSNHKPAVLFRTWAPDHFEDAEWFNGGTCRLILAYKKGEYSGKDMDRIMRPIELEEFRNAMAALGGSRNSANLKLLDTYSISSMRPDGHVGPYRYPFLKGDKDAKSVQNDCLHWCVPGPIDAWNDLVMKMVLG

SEQ ID NO: 57552 - protein, 182 aa, Picea sitchensis
MIKNLLVTGSNRMDRFLGSASPRSSGNMNELWEEDLWPVDTEEDDLESVQDRKDDNSGRGKFVIHSTGICGSPRMIPRVGGSSSDAGLRHHHQSAPVNVPDWSKILGVDHRKDQNPYAVDVDMAADEEEEEEERLPPHEYLAREHARCRISTPSSVLEGVGLKGRDMSRVRNAVWRQTGFLG

SEQ ID NO: 57553 - protein, 607 aa, Klebsiella pneumoniae
MRMLLKTSRRTFLKGLTFSGVAGSLGVWSFNARSSLSLPVAASLQGTQFDLTIGETAVNITGSERQAKTINGGLPGPVLRWKEGDTITLKVKNRLNEQTSIHWHGIILPANMDGVPGLSFMGIEPDDTYVYTFKVKQNGTYWYHSHSGLQEQEGVYGAIIIDAREPEPFAYDREHVVMLSDWTDENPHSLLKKLKKQSDYYNFNKPTVGSFFRDVNTRGLSATIADRKMWAEMKMNPTDLADVSGYTYTYLMNGQAPLKNWTGLFRPGEKIRLRFINGSAMTYFDIRIPGLKMTVVAADGQYVNPVTVDEFRIAVAETYDVIVEPQGEAYTIFAQSMDRTGYARGTLATREGLSAAVPPLDPRPLLTMEDMGMGGMGHDMAGMDHSQMGGMDNSGEMMSMDGADLPDSGTSSAPMDHSSMAGMDHSRMAGMPGMQSHPASETDNPLVDMQAMSVSPKLNDPGIGLRNNGRKVLTYADLKSRFEDPDGREPGRTIELHLTGHMEKFAWSFNGIKFSDAAPVLLKYGERLRITLINDTMMTHPIHLHGMWSDLEDENGNFMVRKHTIDVPPGTKRSYRVTADALGRWAYHCHLLYHMEMGMFREVRVEE

SEQ ID NO: 57554 - protein, 250 aa, Prochlorococcus marinus str. NATL1A
MFRSLKSDFAIIKERDPAARSLWEIIFCYPGFQALVMHRISHKLWTYKLPLFPRLISHFTRFLTGVEIHPGARIGRGVFIDHGMGVVIGETSEIGDRCLLYQGVTLGGTGKESGKRHPTLETNVVVGAGAKVLGGICVGTNTRIGAGSVVVKNVEANSTVVGIPGRVVHQSGVKINPLAHSALPDTEANVLRNLMERIDQLESDILGLQDLVVKIQTNRNKDDIIIGESQNLRDKEIIEFIGDNIEEESG

SEQ ID NO: 57555 - protein, 570 aa, Caulobacter crescentus CB15
MVRVLEYGSVMTAFDRRTLLQGALSLGAAGLLPGWATAAGGERSPPALSGEEIKLTVGHTMAKIDGKAGHAVTVNGAIPGPLIRLKEGQNVRLSVTNTLDEDTSIHWHGLLVPFQMDGVPGVSFPGIKPGETFTYEFPIRQSGTYWWHSHSGLQEQMGHYGPMIIDPAGEDPVAYDREHVVVLSDWSFLHPHELFRKLKVSAGHFNRQKQTVAGLLKGQDQSLKDRVAWGQMRMDPTDIADVTGSVYTYLMNGHGPGDNWTGLFAPGERVRLRFINAGAMTIFNVRIPGLSLEVVGTDGQLVSPVAVDEFQIAPAETFDVIVRPTEDKAFTLVAEASDRSGMARGTLAPRLGMTAAVPPLRRRPLANMKDMGMGNMHHGMDMPGMDMSMRAQSNAPNVPLTPGVQTISPMPMDRMVEPPQGLEDAGHRVLTYADLASLYPPKDSRAPGRTIEIHLTGNMERFMWAFDGEAFGPLKKPIAFQRDERARVVLINDTMMAHPIHLHGHFFELVNGQERQPLKHTVNVAPGGKVAFDLTADEPGDWAFHCHMLLHMHAGMFNVVTVRPLDGAAA

SEQ ID NO: 57556 - protein, 458 aa, Listeria monocytogenes str. 4b F2365
MEEQKEELQRGLKNRHIQLIAIGGAIGTGLFLGAGKSIHLAGPSIMLVYLIIGAILFFVMRALGELLIHNPTTGSFTEFAEQFIGPWAGFITGWTYWFCWIVTGIAEITAVGMYVKFWVPDLPQWIPALACVLILLLFNLATVKAFGEIEFWFAIIKVVVIIALIVIGFVLVFIGYKHGTSTASFSNLVDYGGFFPNGIAGFLLAFQMATFSFVGIELVGVTAGEADDPERTLPKAINNIPIRILIFYIGALLVLMSIYPWSNIDPNTSPFVSVFTMIGIPAAAGIINFVVLTAAMSSCNSGIFSTSRMLYTLSAEGKAPKKMHHLSSNGVPATALITSTACLLIGVFLNYFLPEQVFILVTSIATICFIWVWGVILVAHLRFRHKHPEIAEKSKFKMPLSPLMNWVSLIFFGGLLVILGFAADTRIALFVTPVWFLILGIAYQVLKASNRKTKIRHN

SEQ ID NO: 57557 - protein, 536 aa, Opitutaceae bacterium TAV2
MSATTRKPVLLVIRDGWGRNPHPEQAKTNAVNLAKKPADDMLHATYPYALVKASGLDVGLPDGIMGNSEVGHENIGAGRIVDQELVRLNKLFSEKKLAANPVWLAAIARVKQNPSAKLHLMGIVSDAGVHGMLEHLYGLLAQAKADGVPADRVFIHAFTDGRDTPPSSGIGYVRQVDAKCRELGIGRIASVCGRFWVMDRDNRWERVSKAYDMLTGKRAEATAPDAATAIQSYYDHPTSDTQKGDEFVAPTWIVNADATGATPKPLATFADGDSVLFYNYRGDRPREITKAFVIDDFKGFDRGKKLDLYYATMTEYEAGLPVNVISPKPEKLKNILGQVVSDAGIAQFRCAETEKNPHVTFFFNNYRGEPFPGEDRACPASPKVPTYDMQPEMSAAEVTRLSKEAILSGKYGFIAVNYANPDMVGHTGSLPAAIKACEATDAGVGELLAAIKQMGGKAVVCADHGNCEQMWDETVNGPHTAHTLNLVEVFTVGEGLKAGVTKMREGGRLADIAPTILDLMGLPKPAEMTGESLILR

SEQ ID NO: 57558 - protein, 492 aa, Triticum aestivum
  misc_feature (251)..(251): Xaa can be any naturally occurring amino acid
AYLGDSLEQVCTKKQAGTGPEFPGYRRPTRPLVSVTMAPLELPKPKKPLLSATVNLSSVIQDKAYVGFSSSTGVVSSRHYVLAWSFKMDGGQAPPLNIQKLPALPFTTPKRRSKTLYIVLPIASAALVLALAIAVVLIERRRRRYAEVKEEWETEFGPHRFSYKDLFHATKGFSDERLLGIGGFGRVYKGVLPTSGAEIAVKKVSHESRQGMKEFISEVVSIGQIRHRNLVRLLGYCRRKRELLLVYDYMXPNGSLDKLLHDHNTMVLSWRQRLGIINDVASSILYLHEDWEKVVLHRDVKASNVLLDADMNGRLGDFGLARLYDHGTDPHTTHVVGTMGYLAPELGHTGRASKASDIFAFGVFMLEVACGRRPVSQDEHDGHLLLADRVIEHWREGAITDAVDPRLRGDFPAEEASFVLKLCLLCSHPLPSARPGIRQIMQFLSGDTRLPEVSVEHVSVDVLALRQNQVVPSHSSLPSTEAGNISDIPAAR

SEQ ID NO: 57559 - protein, 346 aa, Bacteroides fragilis YCH46
MLAYTYVEHGKFELLEKLRPQIKDARDVIVRVTLGSICTSDLHIKHGSVPRAVPGITVGHEMVGIVEEVGSGVISVRPGDRVTVNVETFCGECFFCRHGYVNNCTDPDGGWALGCRIDGGQAEYVRVPYAEQGLNRIPDNVSDEQALFVGDVLATGFWATRISEISEDDTVLIIGAGPTGICTLLCVMLKKPRRIIVCERSAERIRFVREHYPDVLVTEPENCRDFVLCNSDHGGADVVLEVAGSEETFRLAWECARPNAIVTIVALYDKPQFLPLPDMYGKNLIFKTGGVDGCDCAEILSLIEQGRIDTTPLITHRFPLNEIEEAYRIFENKLEGVIKIAITGGR

SEQ ID NO: 57560 - protein, 204 aa, Chromobacterium violaceum ATCC 12472
MAVLVGKQAPFFAGEKTFSAVLGNGEIVDNYSFKQATAGKYAVVFFYPLDFTFVCPSELIAFDHRLAEFKAKNVEVIGVSIDSQFTHAAWRNTPVEKGGIGQVGYTLVADIQHDLCKAYDVEADGGVAFRGSFLIDKSGVVQHQVVNNLPLGRNVDEMLRMVDALQFTEEHGEVCPAGWNKGKKGMKPSAEGVASYLAENAKDL

SEQ ID NO: 57561 - protein, 190 aa, Synechococcus sp. WH 7803
MELGSWVPSADGLMTDRSGPQSAMFPAPQIDPGAWVAESAVVMGDVQMAADASLWPLAVARGDMAPISIGPGSNVQDGAVLHGDPDAPVTIGADVTIGHRAVVHGATLEDGCLIGIGAIVLNGVTVGQGALVAAGAVVTKDVPPGSLVAGVPAQVKRELNADARAAQRDHARRYAELARTWARMLQIQTE

SEQ ID NO: 57562 - protein, 228 aa, Picea sitchensis
MAAAGAAAVFSCMPTMPTTGITTSSTRLAVGPIFKGTNNGCKIQVTPLCTDFDGNANHWRRKSNTFTVSAAARQLTGSITKTEGLHFAVVAARFNDIVTKPLVEGALEAFRRYSVQEEDIDVIWVPGSFEIPLVVQTVAKSGKYHAVLCIGAVIRGDTTHYDAVANSAASGIVSASLNSGIPCIFGVLTCDNMEQALDRAGGKVGNKGAEAAVTAIEMASLFQHHIGR

SEQ ID NO: 57563 - protein, 317 aa, Bradyrhizobium japonicum
MSAKNGSIKLVAGNSNPALAQAIAQGLHLPLTKAVVRRFADMEIFVEIQENVRGSDAFIIQSTSFPANDHLMELLIITDALRRSSARRITAVLPYFGYARQDRKSGSRTPISAKLVANLITQAGVDRVMTLDLHAGQIQGFFDIPTDNLYAAPLMVRDIKDKFDLSKTMVISPDVGGVARARGLAKRINTPLAIVDKRRERPGESEVMNVIGDVAGYTCILVDDIVDSGGTLVNAADALIAKGAKDVYAYITHGVLSGGAAARITNSKLKELVITDSILPTDAVSKAPNIRTLPIASLISDAIARTAAEESVSSLFD

SEQ ID NO: 57564 - protein, 459 aa, Listeria monocytogenes str. 4b H7858
MGRNLALNIESRGHTVSIFNRSTEKTKAVMEENADKKLVPTYSLEEFVESLEVPRRILIMVKAGDATDMMIEAVKPFLNEGDILIDGGNAFFKDTIRRNKELSEEGFNFIGTGVSGGEEGALKGPSIMPGGQRKAYDLVAPILREIAAVADGEPCVTYIGPDGAGHYVKMVHNGIEYGDMQLIAEAYTILKEIGGLSHDELADVFEEWNNGELDSYLIEITKNILKVKDEETGKPIVDVILDKAGQKGTGKWTSQSALDLGVPLSLITESVFARYISALKDERVYASTVLSGPSNYRFEGDKKAFVESVRRALYFSKIASYAQGFAQMRAASEENDWDLQYGEIAKIFRAGCIIRARFLQKITDAYNKDKNLKNLLLDPYFKDIAHNYQGDLRTVVAEAVKAGIPVPTFTAAISYYDSYRSEVLSANLIQAQRDYFGAHTYERVDKPGVFHTEWPQVED

SEQ ID NO: 57565 - protein, 337 aa, Spinacia oleracea
KLKVAINGFGRIGRNFLRCWHGRKDSPLDVVVINDTGGVKQASHLLKYDSILGTFDADVKTAGDSAISVDGKVIKVVSDRNPVNLPWGDMGIDLVIEGTGVFVDRDGAGKHLQAGAKKVLITAPGKGDIPTYVVGVNEEGYTHADTIISNASCTTNCLAPFVKVLDQKFGIIKGTMTTTHSYTGDQRLLDASHRDLRRARAACLNIVPTSTGAAKAVALVLPNLKGKLNGIALRVPTPNVSVVDLVVQVSKKTFAEEVNAAFRESADNELKGILSVCDEPLVSIDFRCTDVSSTIDSSLTMVMGDDMVKVIAWYDNEWGYSQRVVDLADIVANKWQA

SEQ ID NO: 57566 - protein, 282 aa, Listeria monocytogenes str. 4b F2365
MNLSVYVASAFSKNNKGGNKAGVVLNEPTLATAQKMAIAKQLGYAETAFLTESNCADYKLEYFTPKEEVDLCGHATIGTFAILMHLNKIHKSQYTIETNSGVLTITIKDGTIFMEQNQPTFYDTIPPNKLTGCFSLNLLNTNYPIQIVSTGLKDILIPIKSEADLYALEPNFEEVKKVSKHYEVVGMHLYTFNADRIICRNFAPLFDINEEAATGTSNGALACYLYKNHYLRKENYVFEQGYSLHSPSEIFVNLVISNKDEIEKVYVGGKGYYCEMQDLSME

SEQ ID NO: 57567 - protein, 181 aa, Brassica napus
MASSMLSSAAVVTSPAQATMVAPFTGLKSSAAFPVTRKANNDITSIASNGGRVSCMKVWPPVGKKKFETLSYLPDLTEVELGKEVDYLLRNKWIPCVEFELEHGFVYREHGSTPGYYDGRYWTMWKLPLFGCTDSAQVLKEVQECKTEYPNAFIRIIGFDNNRQVQCISFIAYKPPSFTGA

SEQ ID NO: 57568 - protein, 383 aa, Pyrobaculum aerophilum str. IM2
MEFKFPDLGEGLVEGEVIKWHVKEGDFVKEGDPLVDVMTEKATVTLPAPTTGRVVKILVREGEVVKVGQTLCVIEPAEGPAAGPQTEAPARPREVAAMPAARRLAKELGIDLSKVKGTGPGGVITVEDVKRYAEETAKATAPAPAPKAVEKAEEAEVVPVRGIRRAVAEKMSKAKRLIPHAYHLEEVDFTELIKLRERVKAEAEKRGIRLTLLPFIAKAVAMALREYPMLNSEYDEEKNAIVVKKEVNLGIGVDTEQGLVVVVVKNADKKGLLEMAKEINELAQKAREGKLELQDVRGSTFTISNIGAVGGLGGLSILNYPEAGILAVGQARKKPWAVGDRIEIRDIALLAVSFDHRVVDGAYVARFMNRVKELLENPWLLLL

SEQ ID NO: 57569 - protein, 452 aa, Pyrobaculum aerophilum str. IM2
MKVVVVGGGPAGYVAAIRARQLGLDVTLVEAERLGGECTNYACIPSKALLHAAEAYRRAVSSPWITGTVSFRWKEAVQWKEKVVEKLRRGIEFLLSAAGVEVVRGLAKPGPGKTVEIDGRRLQYDFLILATGSEPVGLKELPFGRRVIGTREIFSLEEPPASVAIIGGGASGVEIASLFSMIGAEVHVVEAMERILPGLDPEISRQMERALSSRGVKIYTSSRVVKGEEGEGSVKLRISSPGGEREIEAELAVVAVGRRPRPGPFSAMGLEVDGRGAVRVDESMRTSVPWVFAAGDVTGPPYFAHKAYAQAKVAAEAIAGLKSAYSPRSVPAVIFSDPEVVSVGMTEEEAVAKGYRPKAVRMSLSALGKAVAAESEGGFAKLIYDAESRIILGVHIVGRGVSELAGEASALVEFYATVDDLALTIHPHPTLSELFAELAEAALGKPVHIAKL

SEQ ID NO: 57570 - protein, 268 aa, Desulfovibrio vulgaris subsp. vulgaris str. Hildenborough
MTQASIARTVLIIEDSPVQAKIIRKQIQAYTQFDVRVAHSLADAEDVLREAHDTIFVAVIDLNLPDAPDGEAVDLCLHWQMPSIVLTATFNEDIRRRFIERRVVDYFFKGSIQDMDPMVTSIERVFKNRFVHALVVDDSRTQRGIIRQLLEVQCVNVLEAENGVEGLAVLEANPQVTLVITDYQMPEMDGIELVRELRQRHRMDKIAIVGVSAVGSGPLTAQFLKHGANDFLTKPFEVEEFYWRVNQTLEGLDLMCDLRSCREQLESR

SEQ ID NO: 57571 - protein, 387 aa, Oryza sativa Indica Group
MGDNLMDKVNALGERLKVSGAEVSRKMSAGVSNMSFKMKEFFQGQNMADKIVDEATLETMDAPDWATNLEICDMVNTGNVNSIELIRAIKRRIMLKNPRVQYLALVLLETVVKNCEKAFSEIAAERVLDEMVKLIDDPQTVVNNRNKALMLIEAWGESGDELRYLPVYEETYKSLRSRGIRFPGRDDESLAPIFTPPRSAPSAEQYSAAAQEGYQEIPDESFAPVHVVPAVQVNEAFEVARNSVELLSTVLSSSPQKEALKDDLTTTLVQQCQQCQRTIQRIIEMAGDNEAQLFEALSVHDELEKVLSKYKELKEPVVAEPEAEPAMIPVTVEPENSPRTKDGPVGKRAGSGADELLQDLDDMIFGKKGGTSSQQDRKEQKDDFISF

SEQ ID NO: 57572 - protein, 136 aa, Triticum aestivum
RVEAQNPKDMTGATGTLGYMAPEVLDGKPYNRKCDVYSFGICLWEIYCCDMPYPDLSFADVSSAVVHQNLRPDIPRCCPSAFANIMRKCWDGNPDKRPDMDEVVQLMEALDTSKGGGMIPDGQSSGCLCFTRARGP

SEQ ID NO: 57573 - protein, 486 aa, Listeria monocytogenes str. 4b F2365
MKKETHGEIRRDLKTRHLSMIAIGGSIGTGLFLASGNAIHTAGPGGALVAYIAIGIMVYFLMTSLGEMATYMPVSGSFSTYASRFVDPAFGFALGWNYWFNWAITLAVDISTAAIIVQFWLPNTPAWLWSAIFLILIFGLNALSVKAYGESEYWFSIIKVATVIIFLIVGVLTIVGILGGEVIGFSNFTAGDAPFKGGFFAILGTFLIAGFSFQGTEMVGIAAGESATPETSVPKAIKQVFWRILLFYIFAIFIIGMIIPYTNPNLLSAEATDVAISPFTLVFEKAGLAFAASVMNAVILTSVLSAGNSGLYASTRMLWAMARDKKAPKFLGKVNRRGIPMAALIVTTIVGAMTFITTLTENGTVIYTWLLSASGLTGFIAWVGIAISHYRFRKAFIKQGHDLSELKYKAKFFPFGPILALILCILVIVGQDYAAFLKPEFTNPAWWQKIGISYIGLPIFLVFWLSFKFTNKTKVIPLEDCKFDQK

SEQ ID NO: 57574 - protein, 398 aa, Acidobacteria bacterium Ellin345
MKAVCWNGRHDMRVETVDDPKILNPRDCIIKVTRTAICGSDLHLYNGLIPTMEAGDIVGHEFMGEVVEIGPQVKKLKVGDRVVIPFTIACGNCFFCRQQLWSSCDNTNPNAYIAEALMGYSPSGLFGYSHMTGGYAGGQAQYVRVPFADIGPLKIESDLTDDQVLFLSDVFPTGYMAAENCDIQPGKGQTVAVWGCGPVGLFAIKSAFLLGAEQVIAIDRFPERLYLAEQAGAETLNYSEIPDLIEVLKELTGGRGPDACIDAVGMEAHGVSIDALADEVKQVMKVETDRPLALRQAIQACRKGGVVSVPGVYGGFVDKIPMGAFMNKALTMKTGQTHMMKYMKPLLEHIEKGDIDPSFIISHRVTIDQVPEMYDVWLKKQDHVTKIVIDPWAENIAA

SEQ ID NO: 57575 - protein, 207 aa, Triticum aestivum
GGSLMAMRYIPIFFLLFLSSFCKSDDQLTQAKPLTHGHTLISETGDFALGFFSPTTSNRSFYLGIWYHSLPGPRTVVWVANRDNPITNPSSGTLTVTSNSSLVLSDSSGRNIWMTASNIPARVSRAHAVLLNLGNLVLRSPNGADIWQSFDHPTDTMLPTMRFWASYKAQVVGRFMAWKGPHNPSSGNFSLSRDPSSTSPQFIIGHG

SEQ ID NO: 57576 - protein, 294 aa, Methanocaldococcus jannaschii DSM 2661
  misc_feature (28)..(28): Xaa can be any naturally occurring amino acid
MEIEGYEKIIEAGKIASKVREEAVKLIXPGVKLLEVAEFVENRIRELGGEPAFPCNISINEIAAHYTPKLNDNLEFKDDDVVKLDLGAHVDGYIADTAITVDLSNSYKDLVKASEDALYTVIKEINPPMNIGEMGKIIQEVIESYGYKPISNLSGHVMHRYELHTGISIPNVYERTNQYIDVGDLVAIEPFATDGFGMVKDGNLGNIYKFLAKRPIRLPQARKLLDVISKNYPYLPFAERWVLKNESERLALNSLIRASCIYGYPILKERENGIVGQAEHTILITENGVEITTK

SEQ ID NO: 57577 - protein, 105 aa, Glycine max
MASSVLKSLLLRFSSSRNTTTTRSFSLVTPQISNHTAKWMQDTSKKSPMELINEVPPIKVESRIVACEGDTDPALGHPIEFICLDLPEPAVCKYCGLRYVQDHHH

SEQ ID NO: 57578 - protein, 315 aa, Opitutaceae bacterium TAV2
MSAPKFKVFSGNSNRPLAEEICQHIGQPLGEAVVTSFPDGESFVKINENIRGQDVYIVQSTCTPTNHHLMELLIMMDAARRASAKRITVVMPFYGYARQDRKDQPRVPITAKLVANLLVAAGADRILTMDLHAQQIQGFFDIPVDHLFASPVFFKYLESFKGENLVVCSPDVGGMKMAAAYAGILGAGLGMVWKKRTSSTTVESVNIVGEVADKDVLIVDDITETAGTLVNAAKLLRANGALTVRAAVSHALLSPMAYDRLRTGGLDELITTNSIPIDTRDLPIKVLSIAPLLADAIMRINNNESVTSLFKVKGF

SEQ ID NO: 57579 - protein, 541 aa, Coprinopsis cinerea okayama7#130
MTTGSASSSSFPQVKSRDTLHPTLDVKPNDDEEKATVVRDTKDLNDVYHRAETATTLDVNTEAFPVPSFVSPKPWYKRFQLSKKSKLRTLFTPAHDPGPRPTYMQSFKAALFYSWLNLLLLFIPVSWALFYTEQSATLTFVFSCLAIIPLAALLGLGTEQIALRTSQSVGGLLNATLGNVVEMIIGAIALSKCELELVQGSLLGGQLSNLLLVLGCAFVVGGFRFQHSEFQAMVAQLNSSLLIVSVISFFIPTAFHTYLESRLAEGTELPFLLRVSHGSAVILLILYFAYLFFQFYSHNHLFVDMDIPSTYSSDSSKSTSRQSIHSGRVATRGSTPMLGVPSNPDNLFASRVSLASALETRTNSSDDSHHETLKLNLPSALLLLGSVTALVYLTAEHLVDSLQGLLDDNPSISKKWITLIVIPVVGNAAEYATAVLVARKGKFNLSMSVAVGSCIQIAFFVIPILVIVSWGLGKPLTLLFDPLETFALFFSVLVVKFTVEDGKSHWLNGLALISVYTLFAVAFWGFPDTPRLIQGQPIICR

SEQ ID NO: 57580 - protein, 146 aa, Triticum aestivum
MASSMLSSAAVATSPAQATMVAPFTGLKSSAAFPVTRKSNTDITSIASNGGRVSCMKVWPPVGKKKFETLSYLPDLTDVELAKEVDYLLRNKWIPCVEFELEHGFVYREHGSTPGYYDGRYWTMWKLPLFGCTDSAQVLKEVQECK

SEQ ID NO: 57581 - protein, 316 aa, Populus alba x Populus tremula var. glandulosa
MGSAKFFVTLCIVPLLASSFCSAQLSATFYASTCPNLQTIVRNAMTGAVNGQPRLAASILRLFFHDCFVNGCDGSILLDDTATFTGEKNANPNRNSARGFEVIDTIKTRVEAACNATVSCADILALAARDGVVLLGGPSWTVPLGRRDARTASQSAANSQIPSPASSLATLISMFSAKGLSAGDMTALSGGHTIGFARCTTFRNRIYNDTNIDASFATTRRASCPASGGDATLAPLDGTQTRFDNNYYTNLVARRGLLHSDQELFNGGSQDALVRTYSTNGATFARDFAAAMVRMGNISPLTGTNGEIRRNCRVVN

SEQ ID NO: 57582 - protein, 691 aa, Vitis vinifera
MDATSSCPSTPRWNVERPFLTGRFHQVPHSFLFSRHSEAKGFSMDSLKYGFDFFTGLEKAIACYHASVQELIVIDDLLSALVGIEGRYISIKRFRGKEFDVTFQIDASMDLALQELAKRIFPLCESFLLINQFVESRSQFKTGLVNHAFAAALRAFLLDYQAMVAQLEHQFRLGRLSIQGLWFYCQPMMGSMLALSTVIHKASANNFMGSAAKAMAGDNAVRSLLEKMTQCASSAYLGILERWVYEGVIDDPYGEFFIAENKSLQKESLTQDYDAKYWGQRYSLKDGIPSFLANAAGTILTTGKYLNVMRECGHNVQVPASEDSKFISFGSNHHYLECIKAAYEFSSTELLNLIKEKYDLLGKLRSIKHYLLLDQGDFLVHFMDIARDELAKRLDDISVEKLQSLLDLALRTTAAAADPCHEDLTCCVERSSLLKRLGTLKALEIRSLADSNDLKEPVSISGLETFSLSYKVQWPLSIVISRKALTKYQLIFRFLFHCKHVNRQLCGAWQLHQGVRAINMRGTAIPRSSLLCRSMLKFINSLLHYLTFEVLEPNWHVMHNRLQTAKSIDEVIQFHDFFLDKCLRECLLLLPELLKKVERLKSLCLQYASATQRLISSSVDIPKSEQGKSRIPSRVLKLAITNSTVTDSILKFEKEFNAELHSLGPILSNSAQAEPHLTHLAQWILGVGNEQ

SEQ ID NO: 57583 - protein, 486 aa, Dechloromonas aromatica RCB
MLQDKILNFINGEFVATNKWFENRTPISNAVIGQVAEAGKAEVDAAVAAAQAALKGPWGKMTLAKRVELLEALVAEINNRFDEFLEAECADTGKPKSLASHIDIPRGAANFKVFADVIKNVPGEFFDMATPDGGTAINYTFRSPVGVVGVICPWNLPLLLMTWKVGPALACGNTVVVKPSEETPRTAALLGEVMNKVGIPKGVYNVVHGFGPNSAGEFLTTHPDVDAITFTGETRTGEIINRAASVGSRPVSLEMGGKNAAIVFADCDFDAAIEGTLRSAFANCGQVCLGTERVYVERPIFEKFVAAMKAGAEKLKIGVPEDPATGMGPLISKEHQNKVLSYFQIAKEAGATIVTGGGVPDMPGELKDGCWVQPTIWTGLPETARVIKEEIFGPCCHIAPFDTEEEVLEKANDNIYGLATAIWTKDVSRANRVAQQMEVGIAWVNSWFLRDLRTAFGGAKQSGIGREGGVHSLEFYTELKNICIKL

SEQ ID NO: 57584 - protein, 377 aa, Triticum aestivum
  misc_feature (259)..(259): Xaa can be any naturally occurring amino acid
  misc_feature (269)..(269): Xaa can be any naturally occurring amino acid
  misc_feature (278)..(278): Xaa can be any naturally occurring amino acid
  misc_feature (309)..(309): Xaa can be any naturally occurring amino acid
  misc_feature (326)..(326): Xaa can be any naturally occurring amino acid
NKFVQKSRLVPVRNSRDIVDPRVRSTATDMAASADEEACMYALQLVSSSILPMTLKNAIELGLLETLVAAGGKLLTPAEVAAKLPSTANPAAADMVDRMLRLLASYNVVSCTMEEGKDGRLSRRYGAAPVCKFLTPNEDGVSMAALALMNQDKVLMESWYYLKDAVLDGGIPFNKAYGMSAFQYHGTDPGFNRVFNEVMKNHSFIIPKKLLDFYTGFEGVSTLVDVGGGVGATLHAITSRHPHISGVNFDLPHVISEAXPFPGVRHVGXGDMFASVPXGDAILMKWILHDWSDAHCATLLKNCYDALPXNGKVIVVECVLPVNTEXTPKAQGVFHVDMIMLRAQPGGKERYSASPRLAKGAGLRVKALHLPNPGIDS

SEQ ID NO: 57585 - protein, 515 aa, Debaryomyces hansenii CBS767
MGQILSQPVTEKISEHGIDKHLAYGISCMQGWRVNMEDAHATILNLYDLKNEGKGAVSDKAQDNSSSGKSGTDNDTTEEHTSFFGVYDGHGGEKVAIFTGQHLHEIIKSTKAFQEKDYVNAFKEGFLNCDQAILNDDEMKEDDSGCAAVSVIITPRQVICGNAGDSRSIMSINGFAKALSYDHKPSNEGEKSRICSAGGYVDMGRVNGNLALSRGIGDFEFKKNIDLPPEEQTVTCYPDVIQHNLDFTKDEFVVLACDGIWDCLSSQQCIECVSRGLYERKPLQDICEEIMELCCAPTSDGSGIGCDNMSMSIVALLDESRNESLDQWYDRVIKRIELSQSEDEESQFYGNISGEYNDMYKQMYGEYFEIGQQSQNSNTKSAGNNSSYYSMFGGLPGLRNGPGLNQNEDEEENELSNEPTEEIQEDGTAADLAGNGAISLQKLLASNAITNENGVIYLDTSSAQSLLAHFGMSGEDDEYEGNDVHDKHIEEEEVEEDDDQESKSKIEEEPQDDEE

SEQ ID NO: 57586 - protein, 754 aa, Bacteroides fragilis YCH46
MSQLPTLIADLALILICAGIMTLLFKKLKQPLVLGYVVAGFLASPHMPYTPSVMDVANIKTWADIGVIFLLFALGLEFSFKKIVKVGGTAVIAACTIIFCMILLGIAVGMGFGWQRMDSLFLGGMIAMSSTTIIYKAFDDLGLRKKQFTGLVLSILILEDILAIVLMVMLSTMAVSNNFEGTEMLGSIGKLLFFLILWFVVGIYAIPEFLKRCRKLMSEETLLIVSLALCFGMVAIAANTGFSAAFGAFIMGSILAETIEAESIDRLVKPVKDLFGAIFFVSVGMMVDPAMIIEYAVPIIVITLAVILGQAFFGTMGVMLAGQPLKTAMQCGFSLTQIGEFAFIIASLGLSLHVTSDFLYPIVVAVSVITTFLTPYMIRVAEPASNFVDRKLPESWRRFLMRYTTGTRTVNHESLWRKLLFALARILVVYSIVSISVITLSFRFVVPLLREHLPGIWGPLAGAVFTILCISPFLRAIMVKKNHSVEFITLWNDNRVNRGPLVSTVVFRVAVSVLFVMFVITRLFKASVGLMFGVALLLVILMILSRQLKKQSILIERKFFQNLRSRDMRAEYLGEKKPAYAGRLLSRDLHLTDFEIPGESAWAGKTLLELNLGKKYGVHVVSILRGKRRINIPGGSIRLFPMDKIQVIGTDDQLNTFAEEMSHVAVIDSGVFEKSEMTLKQLLIDTDSAFLGKTLRESGIRDKYHCLIAGVERGGEALMTPDVNVPFEEGDVVWVVGENEDVYRLIGQNCDRKR

SEQ ID NO: 57587 - protein, 323 aa, Acidobacteria bacterium Ellin345
MFASDFLSIRDFTPQQIRHLLDLAMHIKAMPQAYSRSLRGKTMALIFEKPSLRTRVSFDVGIQQLGGFSVYLSPAEINLGKREGVYDVAKNLERMVQGIMIRTFAHRIVEDMAAFASIPIINGLTDYSHPCQAMADYMTIFEAKGRLSGLKLAYVGDGNNVAHSLMFAGAQLGVHVWVATPDGYEPDHAAREWATRRAAETGGSCTITNDPVAAVEDADVIYTDVWASMGQESEAALRKKIFLPYQVNGKLFAQAKPDTIFMHCLPAHRGDEVTDEVIDSPRSFVFPEAENRLHAQKAIMLELMRDESVEHEHGVLHEVEMVK

SEQ ID NO: 57588 - protein, 402 aa, Acidobacteria bacterium Ellin345
MAVMESLQTKELIELEEKYGAHNYHPLDVVIERAEGVWVYDVEGKKYLDCLAAYSAVNQGHCHPKILKALLEQSKKVTLTSRAFRNDQLPLLCEQLHQLSGMDAALPMNSGAEAVETAVKAARKWGYKVKGIPEGKAEIVVCSNNFHGRTVTIISFSTDEQYRDGFGPFTPGFKVIPFGDAKELKHAITSNTCAFIVEPIQGEAGIVMPPDGFLKEAAQLCRDHRVLFVCDEIQSGLGRTGKLFAYEHEGVKPDMIIVGKALSGGFYPVSAVLASKEVLGVFKPGDHGSTFGGNPLACAVARAALTALVDEKMVERSAELGAYFLAKLKTLKSDKLKEVRGRGLWIGIELTVQARPYCEALKELGILCKETHDHVIRIAPPLVITKEEIDWAFERIKQAIEK

SEQ ID NO: 57589 - protein, 370 aa, Deinococcus radiodurans R1
MTSPSSTATSSPTTTTAPTPARMRALSKQQPGEGIWMIETEVPTPGPNDLLIRIRKGSICGTDVHIYKWDDWASQTVPVPMVVGHEYVGVVAGMGSEVRGFEIGDRVSGEGHVTCGHCRNCRAGRRHLCRNTQGVGVNRPGSFAEYLVLPAFNAFKLPDDIPDDVAAIFDPFGNAVHTALSFDLVGEDVLITGAGPIGCMAAAVARHVGARNVVITDVNDYRLDLARQMGVTRAVNVAREDLWTVATQELDMHEGFDVGMEMSGSGPAFAQMVSVMNNGGKVALLGIPSGEVQIDWNAVIFKMLTIKGIYGREMFETWYKMAALIQSGLDLTPVITHHYGIGDFQQGFDAMLSGQSGKVILDWETEEQSA

SEQ ID NO: 57590 - protein, 393 aa, Methanocaldococcus jannaschii DSM 2661
MAMIGLVGKPNVGKSTMFNALTEKPAEIGNYPFTTIQPNKGIAYITSPCPCKELGVKCNPRNSKCIDGIRHIPVEVIDVAGLVPGAHEGRGMGNKFLDDLRQADAFILVVDASGKTDAEGNPTENYDPVEDVKFLLNEIDMWIYSILTKNWDKLARRAQQEKNIVKALKDQLSGLNIDEDDIKMAIRDMDESPIKWTEEDLLNLAKKLRKISKPMIIAANKADHPDAEKNIERLKKEFKDYIVIPTSAEIELALKRAEKAGIIKRKENDFEIIDESKVNEQMRRAFDYIKDFLKKYGGTGVQECINKAYFDLLDMIVVYPVEDENKFSDKQGNVLPDAFLVKKGSTARDLAYKVHTELGEKFIYAIDAKKKIRVGADYELKHNDIIKIVSAAK

SEQ ID NO: 57591 - protein, 466 aa, Escherichia coli O157:H7 EDL933
MPHSYDYDAIVIGSGPGGEGAAMGLVKQGARVAVIERYQNVGGGCTHWGTIPSKALRHAVSRIIEFNQNPLYSDHSRLLRSSFADILNHADNVINQQTRMRQGFYERNHCEILQGNARFVDEHTLALDCPDGSVETLTAEKFVIACGSRPYHPTDVDFTHPRIYDSDSILSMHHEPRHVLIYGAGVIGCEYASIFRGMDVKVDLINTRDRLLAFLDQEMSDSLSYHFWNSGVVIRHNEEYEKIEGCDDGVIMHLKSGKKLKADCLLYANGRTGNTDSLALQNIGLETDSRGQLKVNSMYQTAQPHVYAVGDVIGYPSLASAAYDQGRIAAQALVKGEATAHLIEDIPTGIYTIPEISSVGKTEQLLTAMKVPYEVGRAQFKHLARAQIVGMNVGTLKILFHRETKEILGIHCFGERAAEIIHIGQAIMEQKGGGNTIEYFVNTTFNYPTMAEAYRVAALNGLNRLF

SEQ ID NO: 57592 - protein, 553 aa, Mycobacterium tuberculosis H37Rv
MAFSVQMPALGESVTEGTVTRWLKQEGDTVELDEPLVEVSTDKVDTEIPSPAAGVLTKIIAQEDDTVEVGGELAVIGDAKDAGEAAAPAPEKVPAAQPESKPAPEPPPVQPTSGAPAGGDAKPVLMPELGESVTEGTVIRWLKKIGDSVQVDEPLVEVSTDKVDTEIPSPVAGVLVSISADEDATVPVGGELARIGVAADIGAAPAPKPAPKPVPEPAPTPKAEPAPSPPAAQPAGAAEGAPYVTPLVRKLASENNIDLAGVTGTGVGGRIRKQDVLAAAEQKKRAKAPAPAAQAAAAPAPKAPPAPAPALAHLRGTTQKASRIRQITANKTRESLQATAQLTQTHEVDMTKIVGLRARAKAAFAEREGVNLTFLPFFAKAVIDALKIHPNINASYNEDTKEITYYDAEHLGFAVDTEQGLLSPVIHDAGDLSLAGLARAIADIAARARSGNLKPDELSGGTFTITNIGSQGALFDTPILVPPQAAMLGTGAIVKRPRVVVDASGNESIGVRSVCYLPLTYDHRLIDGADAGRFLTTIKHRLEEGAFEADLGL

SEQ ID NO: 57593 - protein, 462 aa, Acidobacteria bacterium Ellin345
MEESRAVTATNPQANTLKRSLGLWDLILYGIIVIQPTAPMPAFGVFSNGGKGHVVTSILIAMIAMVFTAMSYGRMARVYPSAGSAYTYVGRELHPALGYVTGWSMTMDYMLNPLICTIWCAHTMADMIPGIPLGWVLWTFFFAILFTGLNLRGIQTSARINQILCAIMAVVIAAFFVATVRYIFHLGSYPSGYFTHPFFNPDTFSVKTVFHGTSLAVLTYIGFDGISTLSEEVENPRRNIFLATVLVCVITGALAAAEVYGAQLLRYDWHFEASEEITAFAHVAAIAGGAKLANAIGITLLIATIGSGMGAQLGAARLLYGMGRSEALPKKFFGAIHPKTRIPANNVLLVGGIALVGAFLMNYDRGAELLNFGALLAFMGVNLAALTHYFLRDTAEPFLKRFVVHFLPSALGFVICLAIWLNLTHKALLLGAVWMVVGIAYGAVRTKFFRAELVNFDIPSEE

SEQ ID NO: 57594 - protein, 578 aa, Caulobacter crescentus CB15
MKPFRLLAAAASVFALALSPIVSSEALAQKKQLLEYPSIRSPVVGERGMVVSQNAIATKVGADILRQGGNAVDAAVATAFALAVTLPRAGNIGGDGFMMVHLAKTNETVFIDYRGTAPKAAKLETFVDANGKEMDDVASRGYRAPTVPGTVAGLHLAHQKYGRLPWKQVVEPAYRLAADGVVLTPDEAFVFSWGKERLSESEAGKKAFYKTGGELYRAGEILKQPELAWSLRQIADKGAEAFYRGEIAQRFAADMKAHGGLITLEDLASYKAEIRQPLVGSYRGLTVKTSPPASAGGATLLEMLNILETFDLKATGLGSAKTLHLQAEAMKMAYADRYKYLGDTDFVKVPLQGFTSKAYGVQRAKLIDPDKARPAKELGAGDPWAFESPNTTHFSVADAEGNAVSNTYTLGADFGSGVMVAGAGFVLNNQMNNYAHKAAWRAQKAGGTLPPNALQPGKRVLSTMMPTMLFKDGKPWLITGTPGGSTIIDTVLQVIVNVVDFKLNVAEATHQPRIFQDASDTLRVEPNFNPDTVAILKAMGHPITSDETMGSAQSIMIENGLFLGGADPRRPGAEAIAP

SEQ ID NO: 57595 - protein, 386 aa, Hordeum vulgare
MMIGVAGFRRHAGQLLSKSNGFIAASLSAASCADEVEKAEGAGCRDDAAALRLKWIAMAAILVSGVMGVGLPLAGRKRRTVETGSAVFVAAKAFAAGVILATGFVHMLHDAEHALSNPCLPAAPWRRFPFPGFVAMLAALATLVLDVLVTRFYETKHRAEVARVKADAAAALAAASTSASDEDITVVTVVQSEHKAPLLQAHSHSHAQSHGHELVQPQGREGEVSEHVRSVVVSQILEMGIVSHSVIIGLSLGVSRSPCAIRPLVAALSFHQFFEGFALGGCIAQAQFKNLSAVMMASFFAITTPTGIAAGAGLSSFYDANSPRALVVEGILDSVSAGILIYMALVDLIAADFLGGKMTGSARQQVMAYVALFLGALSMSSLAVWA

SEQ ID NO: 57596 - protein, 283 aa, Methanocaldococcus jannaschii DSM 2661
MIRKAVIPVAGFGTRLLPITKAQPKEMLPVVNKPIVQYVVEDLVEAGVKDILFVTGKGKQAIENHFDVNYELECKLEKSGKYELLKIIKEIDRLGNIFYVRQKEQKGLGDAILYGEEFVGEEYFIAMVGDTIYSKNIVKDLIKAHEKYGCSVIALERVPKEDVYKYGVIDGEEIEKGVYKIKNMVEKPKVEEAPSNLIITGAYLLSPKIFEKIRETPPGRGGEIQITDAMNLLLKEEDIIGVEINCKRYDIGDALGWLKANVEIGAERFPEFREFLKEFVKNL

SEQ ID NO: 57597 - protein, 262 aa, Alteromonadales bacterium TW-7
MQLTIHQIDAFTHALFKGNYAAVIPLESWLDDDLMLNIGAENNVSETAFTCRQTDGRFAIRWFSPLMEIDFCGHATLAAAYVLCEEHNVSQIRFIADAVGELIVNKNNDGSFAMTFPKQAPVEVKNPPQALLNGLSIQPIKVLKNRQAYFAVYESAMQVESLNTDSALLKTLAPHDVVATAPSDEYDFVSRYFWPASGGDEDYVTGSIHTGLAPYWAQLLDKTQLTAYQASSRGGHIQCEVGESTVTLTGHAVRYLKGTIYL

SEQ ID NO: 57598 - protein, 421 aa, Kluyveromyces lactis NRRL Y-1140
MSRTILNNIQELPGDALFAIKQRLAEDPRSAKVDLGIGAYRDEDGKPWVLPAVRKAETLIHSDASFNHEYLGIAGLPALTSGAAKVILGDDSSALAEKRVVSAQSLSGTGALHIAAKFIQKFLPGKLLYVSDPTWANHVSIFESQGVKTATYPYWDAATKSLDLEGFIKAIESSPRGSVFLLHACAHNPTGLDPTEAQWEKILSACVKNDIIPLFDSAYQGFASGSLTNDAFAVRLGVKKFAESAPIFICQSFAKNVGMYGERCGCIHLIVPRQESNVNVSTITKAVASQISKITRSEVSNPPAYGAKIVAKILNNAELTEQWHKDMVTMSQRITKMRHSLRDKLLELQTPGNWDHIVNQCGMFSYTGLTKPMVERLEKEHGVYMVASGRASIAGLNEKNVEHVAKAINEVVRHFNESSKL

SEQ ID NO: 57599 - protein, 431 aa, Vitis vinifera
  misc_feature (346)..(346): Xaa can be any naturally occurring amino acid
MGSLGAILTHPDDIYPLLKLKMAVRHAEKQIPPEPHWAFCYTLLHKVSRSFGLVIQQLGTELRNAICIFYLVLRALDTVEDDTSIRTDVKVPILIAFHRHIYDRDWHFACGTKDYKVLMDQFHHVSTAFLELERGYQEAIEDITKRMGAGMAKFICKEVETIDDYDEYCHYVAGLVGLGLSKLFHASKLEDLASDELSNSMGLFLQKTNIIRDYLEDINEIPKSRMFWPREIWSKYVNKLEDLKEEENSIKAVQCLNDMVTNALIHMEDCLTYMSALQSPAIFRFCAIPQIMAIGTLALCYNNIEVFRGVVKMRRGLTAKVIDRTKAMSDVYGAFFDFSCMLKSKXRRLFICTIRDALASKEKVDKNDPNATKALSRLEAVQKICRESGALTKRKSYVIRSEPRYNSALIVAFFIILSIIFAYLSANRQNN

SEQ ID NO: 57600 - protein, 247 aa, Bacillus megaterium
MTTLQGKVAIVTGGSKGIGAAITRELASNGVKVAVNYNSSKESAEAIVKEIKDNGGEAIAVQADVSYVDQAKHLIEETKAAFGQLDILVNNAGITRDRSFKKLGEEDWKKVIDVNLHSVYNTTSAALTHLLESEGGRVINISSIIGQAGGFGQTNYSAAKAGMLGFTKSLALELAKTGVTVNAICPGFIETEMVMAIPEDVRAKIVAKIPTRRLGHAEEIARGVVYLAKDGAYITGQQLNINGGLYM

SEQ ID NO: 57601 - protein, 229 aa, Streptococcus agalactiae A909
MQKVEISPSLMCMNLDKFQEEICFLDSHVDSYHIDIMDGHFVPNITLSPWFVEEVRKLSSLPMSAHLMVKDQPFWVQQMIDIKCEWICMHAEVINGLAFRLIDQIHNEGLKAGVVLNPETPIEVIMPYIELLDKVTIMTVDPGFAGQRFLDSTLDKIVDLRRLREENNYNYLIEMDGSSSRKTFKKIDEAGPDIYIVGRSGLFALTDNISESWDIMTNDYFEMTGKKLN

SEQ ID NO: 57602 - protein, 245 aa, Triticum aestivum
MDMGLEVSSSSPSSSSVSSSPVHAAGRASLAKRPAGRTKFRETRHPVYRGVRRRGNAERWVCEVRVPGKRGARLWLGTYATAEVAARANDAAMLALGGRSAACLNFADSAWLLAVPPALSDLGDVRRAAVEAVADFQRREAANGSLTATVTEEASCGAPEESSSESDSAGSSETSEPSADAEFEVPVAVDTDMFSRLDLFPEMDLCSYYASLAEALLVDPPSTVAIIDSYWDNGDDGADVALWSY

SEQ ID NO: 57603 - protein, 340 aa, Zea mays
  misc_feature (86)..(86): Xaa can be any naturally occurring amino acid
MADWYQLAQSIIFGLIFAYLLAKLISILLAFKDENLSLTRNHTTQSEYENLRKVETLTGISGETGSLIAEQGSLRGDEDESDDDDXWEGVESTELDEAFSAATAFVAAAASDRLSQKVSNELQLHLYGLYKIATEGPCTAPQPSALKMTARAKGQAWQKIGCYASGRADGESISALVTQLYPAWVEGGSKRRNRSGEAAGPMGPVFSSLVYEEESDNELKIDAIHAFAREGEVENLLKCIENGIPVNARDSEGRTPLHWAIDRGHLNVAEALVDKNADVNAKDNEGQTSLHYAVVCEREALAEFLVKQKADTTIKDEDGNSPLDLCESEWSWMREKKDSN

SEQ ID NO: 57604 - protein, 350 aa, Azoarcus sp. EbN1
MKICILPGDGIGPEITAEAVRVIEALDLKFEMEEALLGGAAVDATGDPYPEATRKLAREADAVLLGAVGGPKWDTLPREQRPERGLLGIRKDLGLFANLRPAILYPELANASSLKPEVVAGLDILIVRELTGDIYFGQPRGLEVRDGERFGFNTMHYSESEIRRIGRVAFEAARKRNRRLCSVDKMNVLETTQLWRDVMIELAAEYPDVELSHMLVDNAAMQLVRAPKQFDVMVTGNMFGDILSDEASMLTGSIGMLPSASLDANNKGLYEPSHGSAPDIAGQGIANPLATILSVAMMLRYTFNQENGALRIENAVKKVLAQGLRTGDIFEPGTTKVGTKQMGDAVLAAL

SEQ ID NO: 57605 - protein, 226 aa, Glycine max
MNQTVVTNFEKPIGCYSPSVQELIVIDDVLSSMTGIEGRYILIKAVRGKNDDIAFLVDPSMDLALQELAKRIFPLCKSFLLISQFVESRSQFQSGLVNHAFSAALRALLLDYQAMVAQLEHQFRLGRLSLQGLWFYCQPMMRSMQGLSTVIQRASVNNISGSAVLNLLQSQAKAMAGDNAVRMMLEKMAQCASSAYMSILERWVYEGVIDDPYREFFIAEDKSLQK

SEQ ID NO: 57606 - protein, 400 aa, Bifidobacterium longum DJO10A
MDLYEYQARQLLEEQDIPTPDAIFAQNSHEVAEAADKIGYPCVIKAQVKIGHRGQAGGVKIAHNRDEAILESESILPMTIHGHKVSGVLVAEAKNILHEYYVSISVDRTSRDFDVLATANGGTEVEEIAKEHPEAVKRLHIDALGDFDLAAATEMAQSIGFYHADVDQAAQILLKMWRCFKDNDATLVEINPLAKIGDPDDESTKQLSALDAKISLDDNASFRHDGWARFVDPIVPDPFEQRAREHGLHYVHLHGEVGVIGNGAGLVMSSLDAVSGAGEEQGTNIKPANFLDIGGGASAAVMAESLEIVLSDPQVESVFINVYGGITSCVEVANGILEAVAKLGGSKPIVVRFDGNAAAEGLHILASANNPNIHVSETMEGAAAKAAQLAGEATQSKEVR

SEQ ID NO: 57607 - protein, 193 aa, Bifidobacterium longum DJO10A
MAQSDITIDALSKVGQQDAEYLVSLVRSVPGFPKEGIIFRDFMPVLADPKGLKILLKALEEALPVSPSEFDSIAGLESRGFLFGPAMAAHLGKGFIAVRKAGKLPPETIGESYDLEYGTASVEIETDAVQAGKRVLIVDDLIATGGTAKAATDLIEKAGGTVVGFSFVMRLDGLDGLDKLDGKPSSSLIAMPA

SEQ ID NO: 57608 - protein, 233 aa, Listeria monocytogenes str. 4b F2365
MTKEKVLWGYDEKTGPEMWGHICSDFEIAHTGKAQSPVDIEQADVVKLKPSTMKFYYKETDYTIRRIEQSVHVFPHDKEQGLRFNGEYYPLVSFHAHIPAEHLLDGYVYPIEWHFVHEKPDGTTLVMSAWMEIDNTNNVEFKDLPTYFPEVFADFETEREITLDVNEFMPEERVFYTYQGSRTTPPTVEGVTWIVLKNAKTLGQEDFTEFEKAIGNTSRPVQDLNGREITFYN

SEQ ID NO: 57609 - protein, 474 aa, Trichodesmium erythraeum IMS101
MFSLMAESNFFSEIFLFPLSGKIAPILATATETGAEPEMVLAGVLLSLVAIYIASKAGGEFFSWLNFPPVLGELVGGVVIGISALHLVIFPESGADSSSSVIINILEATAGLAPEAAGATLQAQSEVLDVLAELGVIILLFEIGLESNIRDLMQVGVQSLIVATVGVVLPFVGGTAGMMAIFHVSAVPAVFAGAALTATSIGITSRVLTEINRLNTQEGQIILGAAVIDDVMGIIILAVVASLAKTGEVDIINVVYLIISASVFLVGAILLGRFFNDGFVFFAEKFKTRGRAVIPALTIALFMAYIGTAIHLEAILGAFAAGLVLDNLDQKEVGRELEELIRPISDVIVPIFFVTVGTKTNLNVLNPAIPTNREGLVIAIFLIAVAIVGKVACGFSVFGLGPINRLAIGVGMVPRGEVGLVFASVGSASGALSPALDVAIILMVILTTFLAPPLLRVVFGKAEAETEEVPETSG

SEQ ID NO: 57610 - protein, 372 aa, Cryptococcus neoformans var. neoformans
MPVAPTVKSARTTSVYDRSCRASASPKSSRRLSSQTKAKIQAVAAPVSQARAVPQHRKVEEVMYFEEDYSEEIIAYMNSMDNSTLASAELMDMQPELQWFMRSYLIDFIIEVHQQFRLRPEVLYLAMNIVDRYISKRVVYKKHYQLVGCAALWIAAKFEDAKDKVPLVHELSEMCCKAYDESAFIQMEGHVLSTIGWVLGHPSAEAWLRVFTTGIRYEDQKVANMARFLMEITLFHREFIGIQSSIIAAGALMLARFICGKPYKPCFPNVPETVAARVSIAIDKRFSQELEKVSEIVISKICADVLRPCLYRLPGMVSVRPTIHLQPCYAFHPRLRSFNSGPCSFMLIILGQAWFMGNRLSRGFLRFVGSWR

SEQ ID NO: 57611 - protein, 176 aa, hyperthermophilic archaeon G1-H
PYGGGKGGIIVDPKKLSDREKERLARGYIRAIYDVISPYEDIPAPDVYTNPQIMAWMMDEYEAISRRKTPAFGIITGKPLSIGGSLGRNEATARGASYTIREAAKVLGWGDLKGKTIAIQGYGNAGYYLAKIMSEDYGMKVVAVSDTKGGIYNPDGLNADEVLKWKQEHGSVKDFP

SEQ ID NO: 57612 - protein, 117 aa, Glycine max
MFRSMTTRRGYERLGKESATTALLHEGFKRSTSLPSWGSNSSRKMALGSTYGEINLKRNPTKKGNNSDKKSHPLLSFLALRRKKKTTARPEFARYLEYLKEGGMWDLNSNKPVMYYK

SEQ ID NO: 57613 - protein, 532 aa, Acidobacteria bacterium Ellin345
MAPVAAPEKPEVKVETKPTGIEQKIQELETMRVQVKLGGGEDKIAKQHEAGKLTARERIARLADPDSFQEIGMFAKHRASLFGMAKKDIPADGVVTGVATIDGRLVHLASQDFTALGGAVGEVHADKIVEMMNLSLKTGSPFVIVNDSGGARIQEGIDALAGYGRIFYNNVMLSGTVPQISLICGPCAGGAVYSPALTDFIIQTKQAQMFITGPSVIKQVTGEVVTPDQLGGAAAHMTQSGNVHFVAENDEDAIYITRRILSFLPSNNLEDPPRLDFDGNLESDPAVNKIIPDDPKQAYDVRNVIAQLVDRGDLLEIQSGYAQNIVIGLARIAGCTVGVIANQPCVMAGVLDINASDKAARFIRFCNAFNIPLLTLADVPGFLPGVAQEYGGIIRHGAKMLFAYSAATVPKITVVLRKAYGGAYLAMCSRDLGADRVIAWPTAEIAVMGAEGAAEIVFRKEINEAEDKAAKRKELIEKYRSAFATPYVSAARRLVDDIIEPAETRRYLAMALDALHAKRELRPPKKHGLMPL

SEQ ID NO: 57614 - protein, 250 aa, Zea mays
  misc_feature (186)..(186): Xaa can be any naturally occurring amino acid
  misc_feature (242)..(242): Xaa can be any naturally occurring amino acid
MADGAEMDEEAMRAFFPLSFGKAAPRPSSATSSAHSNTLRKPQNPSNPKPSASTAADDDGAAMIGPPRPPPAPAGEEDDEDGGGIMIGPPRPPPPSARGEGDDGDGMIGPPRPPPADDEDVDDDEDDDEEEMEDDGEGGFNRIPLSNEIVLRGHNKVVSALAVDHTGSRVLSGSYDYTVRMYDFQXGMNSKLQSFRQLEPFEGHQVRSLSWSPTSDRFLCVTGSAHAKIYDRDGLTLGEFRXGDMYIRDL

SEQ ID NO: 57615 - protein, 428 aa, Ehrlichia canis str. Jake
MLLNNMYINTCAWFNKGYQNIWMPYTQMKNSPLPLSVKSASGCYIILEDGKRLLDGISSWWSVCHGYSHPHIVQKVQDQVAKLSHVMFSGLAHEQSYVLASRLVKISPEQKKVFFSDSGSTAVEVAMKMAVQYHQNLGNKNKYNFVSFVNGYHGDTMGCMSISDPTKIHGTKFKKYHPSQFILPLPSTEEEIKNFANTIYSIRDQVAAVILEPILQAAGGMLIHSANILKKIYDIAKANNILFIADEVATGFGRTGTMFGCNQANIVPDIIVIGKALTGGFCTLAATLTTQEVYDAFLSDNIDDAFMHGPTFMANALACAAANASLDIFESQDLIRNIGLIENQLKSELGVFKQLDCVTDIRVKGATGVIELKDGLIDKHDIINKGVELNIWIRPLNNVIYVMPPFIINSNELTQLITSIYKILKSNI

SEQ ID NO: 57616 - protein, 268 aa, Bifidobacterium longum DJO10A
MLNNGTVIPQVGLGVFQTPDGDTTVNAVQTALENGYRHIDTAMIYHNEASVGEGIRRAGVPRSDFFLTTKLWNDDIRARCGKDAFQESLDRLGVDYVDLYLIHWPADGWQQAWDDLQEIYASGRAKAIGVSNFQKHHIDELLTHSDVVPAVDQVESSPQFTNQELIGQLRAKGIHTEAWSPLGGTGGNLLSNPVLAGIGAKYGRSAAQVVIRWHIQRGIVVLPKSTHAERIKQNFEVFDFNLSVDDMTAISAINTGKRNGADPDNFNF

SEQ ID NO: 57617 - protein, 313 aa, Arabidopsis thaliana
MAISDLPRDLVEEVLSRVPVTSLRTVRSTCKKWNIISKDESFTKKHVGQANAAARESEFQVVIMTEYKVYLMSVNLHGIQNNVDPSIEFKCKLISLDDSDRIVDFHPVYETEIYNFHSDSWKNIVDSTPEGDMQYFKQGVSLKGNTYWFARKYVIYEGGQEAWVSFLICFDFTTERFGPRLTLPFDYSTKESVSLLSAREEQLVLLYHPWFTMMMEIWVSNKIELNAVSWIKFLEVNMITFPHYRFSFHHVSFFIDKKNKVVVVLDKDKETRSRNLGYFIGDDGYFKEVELGGSRDRNGYPFVFSYVPSSVQF

SEQ ID NO: 57618 - protein, 352 aa, Oryza sativa Japonica Group
MGVYLSTPKTEKYSGEGGNDRLRYGLASMQGWRTTMEDAHTALPRLDECTSFFGVYDGHGGKAVSKFCAKHLHLQVLKNEAYSSGDLATSVLKSFFRMDEMMKGQRGWRELAELGDKGQKFTGMLEGIIWSPKPGESDKPEDTWTEEGPHSHFPGPTSGSTACVAIIRNDELIVANAGDSRCVLSRKGRAYDLSKDHKPDLDAEKERILNAGGFIVAGRVNGSLNLARAIGDMELKQNEFLPAERQIVTAEPELNTVKLSEDDEFIVLACDGIWDCMSSQEVVDFVHKEMNTEDSLSAVCEKLLDHCLAPVSGGDGCDNMTVIIVKFKKPSKSAATSSTNQSVSSEEMRPKI

SEQ ID NO: 57619 - protein, 3982 aa, Streptomyces neyagawaensis
MTDGTLNDDKLRDYLKRVAADLHRTRRRLQEVEGRQQEPVAIVGMGCRYPGGVDSPEKLWQLVASGTDAVDAFPADRGWDLGALYDPTRERPGTTYAAEGGFLTGAADFDPGFFGISPREALAMDPQQRLLLETTWEAFERAGLDPGALRGSDTGVFVGVMYQDYGLRLRQVPDDIQGYIGNGNSDSVASGRLSYTFGLEGPAVTVDTACSSSLVALHLAAQALRRGECGLALAGGAMIMSTPVPFVEMSRQGGLAADGRCKSFAAGADGTGWGEGVGMLLLERLSDARRNGHPVLALVRGTAVNQDGASSRLTAPNGPAQQRVIRRALADAGLTPADVDVVEAHGTGTPLGDPIEAQALLATYGQDRPADRPLLLGSLKSNLGHTQAAAGVGGIIKMVMAMRHGTVPPTLHAERRTPTVDWSAGAVELVTEAVAWPETGAPRRASVSSFGISGTNGHIVLEQAGTEPDSAPEGEADPSGTADEPGLPTALPWSVSARSREALRAQARRLAAHLDTHPGQRPLDIGHALATTRAALEHRAVVVAADEEGFLRGLRALAEDTPEPGLVRGTGTPGADTVFVFPGQGSQWTGMAAELLDTAPVFAERIADCARALAPHTDWSLTDVLRDAPGTPPLDRVDVVQPALWAVMVSLAALWQSYGVEPSAVAGHSQGEIAAAVVAGALSLEDGAKVVALRSRAIVALAGAGGMASVPLPVDEVRALLSDGDGRLSVAAVNGPASVVVSGDRSALDDLIDRLTARDLRVRRIPVDYASHSAHVERIHDELLRLLADITPRPCDIPFYSTVTAEPLDTTGLDAGYWYRNLRRTVEFEQTTRALLAAGHHVLVEVSPHPVLTVPMEETARAAGADEAVVIGTLRRDDGGRARFLAAVGELYVHGVRVDWRAAYAGWRTRRADLPTYAFQRRRYWLEDSAAPQGDMASAGLAAADHPLLGAVVALADGDGLLLTGRLATRTHPWLADHAVRDAALLPGTAFLELAVRAGDQVGCGQVEELTLEAPLVLPPEGGVAVQLAVGAPDRDGRRPLSLHARPDGIDDVPWTCHARGLLSPAAEEAAPGDPAVWPPAGAVPVELDGLYERFAEGGFAYGPAFQGLRAAWRLGEEVFAEASLPSELQAEAARFGLHPALLDGALHATGLGEAAEGRMPFVWNGAVLHAQGATGLRMRITPAGPDTVTLRALDQAGRPVLTVAGLALRPVGAGNFTAPAAGRHHDSLFRLDWTPVRPVPGPTAASWAVLGPTEDTPGVAHHADLAALRDTDGPLPEFVLADLGAAPDDRADELADTTRTAVHDALALVQDWLADDRFTGARLVLVTRGAIAARPGEDVPNLPHSAVWGLVRSAQTEHPDRLHLVDLDPDADLPAALAAVLTATGETQFAVRGSEVLVPRLARIPVQDDDAAPPLDPDGTVLITGGTGLLGARVARHLVTAHGVRHLLLTSRGGPDAPGADGLRDELAALGAQVSVVACDAADAERLAEVLADIPVGHPLTAVVHAAGVLDDGVVSSLTPERVDAVLRPKTDAALNLHRLTADMDLAAFVLFSSAAGTFGGPGQGNYAAANAFLDALAHHRRAQGLAGRSVAWTLWERRSAMTGHLGDDEVRRIARSGLPPLTDTQGLALLDSALTVDEPLLVALRLDTAALRARAESEPVPRLLHGVVRLPARRQAALASATDGDGDRGPLAERLAALDAPGRRRELLDLVRGQVAAVLGHPSPEAVEAGRAFRDLGFDSLAAVDLRNRLGNATGLRLPATLVFDHPTPEVLAAHLGGELLGADTGRVSTSVPAAGGGGAATDEDPIAVVAMGCRYPGGVRSPEDLWNLVSSGTDGIAAFPADRGWDLDALYDPDSERHGTSYAREGGFLYDAAEFDAGFFGISPREALAMDPQQRLLLETSWETLERAGIDPATLRSTATGVFVGVMHQDYAARLLPHIPEEVEGFLGAGNSGSVVSGRVAYVLGLEGPAVTVDTACSSSLVALHLAVRALRSGECGLALAGGVTVMSSPELFVEFSRQRGLASDGRSKPFAAAADGVGFGEGVGMVLLERLSDARRNGHRVLALVRGSAVNQDGASNGLTAPNGPSQQRVIRAALADARLSPGDVDVVEAHGTGTRLGDPIEAQAVLATYGQDREEPVWLGSLKSNIGHTSAAAGVGGVIKMVEAMRHGVLPRTLHVDAPTPQVDWSSGAVELLTEERSWPAGPDRPRRAGVSSFGMSGTNAHLVLEHVEEDVAQPAPPEGPAVPWVLSGHTPEALRAQAERLADHIDAHPEHGAAAIGLALATTRTRHDHRAVLVGDREQLTAGLRALAADAPLATVARGTATAVGRTVFVFPGQGAQWTGMALDLLDSSPVFAARMAACERALAPHVDWSLTGVLASATDLERVDVVQPALWAVMVSLAETWRSCGVEPDAVLGHSQGEIAAAVVAGALTLEDGAKVVALRSRLLRAVAGHGGMASVALPADRTRELLSGWGEKISVAAVNGPRSTVVAGEAAALAELLAWCEKDGVRARRIEVDYASHSAEMDPLRAELLDVLADITPATAGTRMFSTLEADWIEGPELTADYWFRNLRGTVEFEPAVRALTGAGFTTFVESSPHPVLAPAVQEVLEDGAVTGVVVGSLRRDDGGRDRLLLSLGEAHVQGVPVDWPAALGRVPEVPSAPRRLARSPKLFEQGVPPLAAPGADPSTSSTRAYDRHAESTHQTPQGPPSGRTTGLCGHDLGRTSRPVDLPTYAFQRTRYWLDAPVRTGDVAAAGLGATDHPLLAAAVDLADSGERVLTGRLSTRTHPWLADHVVSGTNLLPGTAFLELALRAADEADSALVDELTLQAPLILPERDAVHVQLRLGPPDDSGRRTLGLYSRAETDPGADWTPHATGTLAPGDGADGPSAPATWPPAGTEPVDLDGVYDRFAEAGYRYGPAFQGLRAAWRDGTDVYAEVALERQSDTDGYLVHPALLDGALQASALLDDRPGPARLPFSWNGVTAHATGAAALRVRIGPAGPDAVSLDAWDPTGQPVLSAESLVLRPLSPDLLAAAVAGRDGLYRLDWTPAPGAAATAPLTGWADLDDTGSGAQPTAVVWTCPTATGPDEAARVRDTATATLAVVQRWPSDPRSGDAPLVVVTRHAVATGPGGHPADPAQAAAWGLVRAAQTEHPDRFVLLDLDDTADSADALPHLLGLALATREPQLAARAGNPLVPRLARAGRPGTLTPPAGEAVWRLDTTGEGSLDALALVPSPEAAAPLAPGEVRVAVRAAGLNFRDIAVCLGLAPDQRILGSEGAGTVLETGPGVTDLAPGDRVFGVFGGAFGPVAVADRRTLAPIPPGWSYARAATVPIAFLTAHYGLFDLGGLKAGETVVVHSAAGGVGMAAVQLARHAGAEVYGTASPGKWDVLRGLGLDDAHIASSRTLDFADRFLDATGGRGADVVLDCLAREFVDASLRLLPRGGRFLEMGKTDIRDADTVAAAHPGVHYRAYDLAEAGPERIARTLDLILDLFRQGTLTPLPLTCWDVRRAPGAFRYVGQARHTGKNVLLPPTAPNPDGTALITGGTGTLGRLVARHLVTEHGMRHLLLTSRGGPDAPGAAELCDELAALGAEVSVVACDAADRDRLAEVLAGIPAEHPLTFVVHAAGVLDDAVVSSLTAGQLERVLRPKTDAAVNLHELTRDHDLAAFVLFSSAAALLGGGGQANYAAANAALDALAERRRAEGLPGLSIGWGMWEERSGMTGHLGDVDLRRMSRSGVTPLTSEEGLALFDAALRSEDAYLLAARLDTAALRAGGGQDVPALLSGLVRAPRRRAAAANGDGGGRAAGLAERLAGLSEADAHAALLDLVRGHAAAVLGHPSPELVQPTRAFKELGFDSLTGVELRNRLSSATGVRLPAGMVFDHPTPDVLARHLAATTGRPAPAKASAPLVELDRFAELVAGLAPDAPDRDRLSQRLREVLARLEATEPAGQVTADHIESASHDEIFDLIDNQLGIS

SEQ ID NO: 57620 - protein, 401 aa, Triticum aestivum
  misc_feature (121)..(121): Xaa can be any naturally occurring amino acid
  misc_feature (136)..(136): Xaa can be any naturally occurring amino acid
  misc_feature (157)..(157): Xaa can be any naturally occurring amino acid
  misc_feature (169)..(169): Xaa can be any naturally occurring amino acid
  misc_feature (278)..(278): Xaa can be any naturally occurring amino acid
  misc_feature (327)..(327): Xaa can be any naturally occurring amino acid
  misc_feature (366)..(366): Xaa can be any naturally occurring amino acid
MAREPSESPRPALVPNSARGSNRIRKTNTRLPSSLDQRRRISSHPRQAGRYEMALTRIGLAGLAVMGQNLALNIAEKGFPISVYNRTTSKVDETVQRAKLEGNLPLYGFHDPASFVNSIQXKPRVVIMLVKAGAPXVDQTIATLRKHTLEQGDCIVXDEGTKWYENTEXRREKAMEERGLLYLGMGVSGGEEGARHGPSMMPGGSLEAYQYIEDILLKVSAQVPDSGPCVTYIGKGGSGNFVKMVHNGIEYGDMQLIAEAYDVLKSVGKLTNGELQQXVFAEWNKGELLSFLVEITADIFSIKDAQGEGYSVDKVLDRTGMKGPGKXTVQQAAELSVAAPTLQGSLDPRSLTGLRMTVSGLQDFQXDYSSGELSTGTLIEVVGSPLLPNLRSPGLNSLGQT

SEQ ID NO: 57621 - protein, 365 aa, Glycine max
MGSAAETQITPTHVSDEEANLFAMQLASASVLPMVLKSALELDLLEIIAKAGRGVHLSPTDISSQLPTQNPDAPVMLDRILRLLACYNILSFSLRTLPDGKVERLYGLAPVAKYLVKTEDGVSIAALNLMNQDKVLMESWYYLKDAVLEGGIPFNKAYGMTAFEYHGTDPRFNKVFNKGMADHSTITMKKILETYTGFEGLKSLVDVGGGTGAVVNMIVSKYPTIKGINFDLPHVIGDAPSYPGVEHVGGDMFVSVPEADAIFMKWICHDWSDEHCLKFLKNCYEALPDNGKVIVAECILPVAPDSSLATKGVVHIDVIMLAHNPGGKERTEKEFEALAKGSGFQGFRVLCCAFNTYVMEFLKKV

SEQ ID NO: 57622 - protein, 345 aa, Streptomyces rimosus
MTSTSPTALPPAVMRLRELALSAACAAAVRAAASLGVADALGDEPADAGTLAKAVRADADALERLLRALAAYDVFSELPDGRFEHTDASRLLREDAPRGLRYSALWATEPWTWALWPHLADAVRTGREEFTALYGTEFFDWLHTAEARESAEVFDKAMTQSSVLSAKAIAEVLDLDGVGAMVDIAGGQGMVLATLLEKYPALRGTLFDLPKVVADADPRLREGGALAGRAQLVGGDCRQSVPEGADLYLLKNILEWDDESTVRTLRNVAKSAPAGARVVVVENLVDGSPETRFTTAMDLMLLLNVGGKKHTKAGLSALVEQAGLQLEEVRAVNSYLHMFVSTVPA

SEQ ID NO: 57623 - protein, 263 aa, Streptomyces rimosus
MTTSATPRTALVTGGTSGIGLAVVKTLAARGLRVFLCARSRENVDAVVKELRDQGLQVAGCEGDVRSRESVERVVRAAVDRFGPLSVLVNNAGRSGGGVTARIPDELWYDVIDTNLNSAFLVTREALTTGGLERAGVDGRIISIASTGGKQGVPLGAPYSASKAGLIGFTKALAKELAPTGVTVNAVCPGYVETPMAVRVRQAYAATWDTTEEDVLSRFNDKIPLGRYSTPEEVAALVGHLAGDEAGSITAQALNVCGGLGIY

SEQ ID NO: 57624 - protein, 360 aa, Mycobacterium sp. JLS
MSTPVNAVHRRWPGLIEAYRDRLPVGDDWTPVTLLEGGTPLIHAKRLSEFTGCTVHLKVEGLNPTGSFKDRGMTVAVTESAASGKQAVLCASTGNTSASAAAYAARAGITCAVLIPQGKIAMGKLAQAVMHGAKIIQIDGNFDDCLELARKLTADFPTVALVNSVNPYRIEGQKTAAFEIVDVLGAAPDIHALPVGNAGNITAYWKGYSEYHRDGLSDRLPRMLGTQAAGAAPLVTGEPVKNPETIATAIRIGAPASWASAVEAQQQSDGRFLAATDEEILAAYHLVARTEGVFVEPASAASIAGLLKSVEDGWVAKGSTVVCTVTGNGLKDPDTALKGMPTVTPLAVDPVAVAAELGLV

SEQ ID NO: 57625 - protein, 234 aa, Pyrococcus abyssi GE5
KISEEALEFLKRPQRIVEVTIPVEMDDGSVKVFTGFRVQYNWARGPTKGGIRWHPEETLSTVKALAAWMTWKTAVMDLPYGGGKGGIIVDPKKLSDREKERLARGYIRAIYDVISPYEDIPAPDVYTNPQIMAWMMDEYETIARRKTPAFGIITGKPLSIGGSLGRNEATARGASYTIREAAKVLGWDDLKGKTIAIQGYGNAGYYLAKIMSEDYGMKVVAVSDSKGGIYNPDG

SEQ ID NO: 57626 - protein, 448 aa, Staphylococcus aureus subsp. aureus NCTC 8325
MHFIAISINHRTADVALREQVTFRDDALRIAHEDLYETKSILENVILSTCNRTEVYAVVDQIHTGRYYIQRFLARAFGFEVDDIKAMSEVKVGDEAVEHLLRVTSGLDSIVLGETQILGQIRDAFFLAQSTGTTGTIFNHLFKQAITFAKRAHNETDIADNAVSVSYAAVELAKKVFGKLKSKQAIIIGAGEMSELSLLNLLGSGITDITVVNRTIENAMKLAAKHQVKYDELSSLPNLLESADIVISSTSAQSYIITNEMIERIAENRKQDSLVLIDIAVPRDIEPGISAITNIFNYDVDDLKGLVDANLRERQLAAATISEQIPTEIHAHNEWISMLGVVPVIRALREKAMAIQAETMDSIDRKLPGLSERERKIISKHTKSIINQMLKDPIKQAKELSSDKKSNEKLELFQNIFDIEAECPHEQAKQQKESKVKEISARRIFSFE

SEQ ID NO: 57627 - protein, 530 aa, Synechococcus sp. WH 7803
MASGPAALRLESFIGNPSKELLSGLVVAFAMIPEAIAFSGIAGVDPQVGLFGAFCLSITIAFVGGRSAMITSATGSTALLMTGLVATGEARGPGLGLAYLLVAGVVTGILQILWGWMRLAYQMRFVPLAVLSGFVNALALLIFQAQLPQLGINLHFGETKAADHAHDVVFSGLQLPIIWGLVLLGLVIIYGLPRLTRVLPSQLVAIVVLTVISVVFNLADNFGIPTVSSLGDLPTGLPMPSWPFGSPETMKVPFSLETLGIVLPTALAISLVGLMETFLTQDILDDRTDSNSNKNVEARGQGIANIASSLFGGMAGCALVGQSVMNIDNGGRTRLSTLFSGISLLAMILLARPWLQQIPMAALVAVMISIAVSTADVAGLRRIRSIPKSDTAVMLMTFAVTMLTTPHNLALGVLAGVALAGILFSRKVAKVIRVEPVDVAPDLRRYVVTGQLFFVSKIYFLQGFDVHDHPAKIIIDMSSAHIWDQSGVGALNQLIRKLRQGGSEVEVVGLNNESLDLFERIGAQPEASHG

SEQ ID NO: 57628 - protein, 216 aa, Picea sitchensis
MTPPSAEGPRNGGESRFPHPPLNERILSSLSRRSVAAHPWHDLEIGPGAPSVFNCVVEIGKGSKVKYELDKKTGLIKVDRILYSSVVYPHNYGFIPRTLCEDNDPLDVLVLMQEPIYPGCFLRARAIGVMPMIDQGEKDDKIIAVCADDPEYRHYTDIKELPPHRLAEIRRFFEDYKKNENKEVAVNDFLPASTACEVIQHSMDLYATYIVESLRR

SEQ ID NO: 57629 - protein, 263 aa, Bifidobacterium longum DJO10A
MATYRKSRAFAPEGFFECEGRGLEWLGAAHAQGGPRVVQVYGWGKDYLDIERVGSASPTPQAARAFGAALARMHDAGAKYFGSAPDGYNGTCYFGPLQDPVKMDTGEWTDPISYFADGRLRPMVNLGVKRGELDKRDVELTERVIEALPDLMGRAAADKPARIHGDLWSGNVMWTADSGQSEAVLIDPAAHGGHREEDLAMLHLFGMSYLSEITEGYQSVHPLKAGWQERITLWQLYPIAGHCVFFGGGYVNEYRSMCRSLLK

SEQ ID NO: 57630 - protein, 381 aa, Bifidobacterium longum DJO10A
MADYYETLGVERGASDDEIKKAYRKLSRKYHPDIAGPEFEDKFKEVNNAYDVLSNPDKRRMYDSGVDPNNPNAGAGGFSGAGFGDMSDVFSTFFGSAFGGGSQGPVPRTQPGRDALASASIDLKTAVFGGTAHVKINTFSLCQECGGSGAQGGAQPVTCPDCHGQGFMQKVVRTMLGQMMTSAPCERCEGHGTIIQNPCPSCMGHGRVRTTRTVGVTVPAGINDNARLRLANQGEVGEGGGAAGDLYIDIRIKADKQFTRDGDDLHCWIQVPMSWAVLGHDLSIDTFDGEKTVSIPAGCQPEDTVTLKGLGVTNIRNKDERGNLIAHVNVLIPTKLNETERGLIEQFAASHDSGATHVSQASRPQAGQKKGFFSKLKDALS

SEQ ID NO: 57631 - protein, 470 aa, Zea mays
MEADSGKLFVGGISWETDEDRLREYFGRFGDVTEAVIMRDRNTGRARGFGFVVFADSGIAERVTMEKHMIDGRMVEAKKAVPRDDQSIASKNNSSIGSPGPGRTRKIFVGGLASNVTEVEFRRYFEQFGVITDVVVMYDHNTQRPRGFGFITYDSEDAVDKALHKNFHELNGKMVEVKRAVPKEQSPGPIARSPAGGQNYAMSRVHNFLNGFNQGYNPNPLGGYGMRVDARYGLLAGARNGFSSFGPGYGMGMSVEGGMRGYFGASSGFVNSSNGRQIGSYFNGSSNRLGSPIGYVGLNDDSGSILSSMSRNVWGNGNLNYIGNHTNMNSFPQPGSGGGISGDEISWGSLTSAHGMSNISSLGSGNLGRGTGDNNFGLPSGNYVRSNSTGTIGEPFSASANAYESNNPGAYGSSSIYGDSTWRFNSSEVDMPPFGHDLGNDDPDIKSEISASYMGNYTVNNNQTSRGITS

SEQ ID NO: 57632 - protein, 446 aa, Candida glabrata CBS 138
MEELCDIPNESLEALKIEACTTTTTRVCDLEVEENKFNVVVEDEEKIICESEEVVQDMDHKKAGYLFQRTLGAGSFGVVKRAKQLHSDEDVAVKILLKRALEKNGGLEPIYDELNIIQHLDHPNIVKFKDWFETESKFYIVTQLASGGELFDRIMHDGKYTEEDAVNIVVQILKAVEYLHSQNIIHRDLKPENLLYLDKSKDSRIVLADFGIARQLENDDDVIYRPAGSLGYVAPEVFTSDGHGKPSDIWSVGVITYTLLCGYSPFKAESVDGFLDEVTSDENPVKFQRPYWDGISELAKNFILRILDLDPACRPSATELLNDPWIQSKCSLRTDLYHNMRKNLSAKKKLQKAVELIKLNQRIKKLRQLYLLANETDSDLEEEERSSSASLSSLPSSQSSLSLSNEYGSKSKREQDEFISSLRQQTLAQIIKVATVNKDTVRKFEK

SEQ ID NO: 57633 - protein, 394 aa, Streptococcus pneumoniae
MKIAIAGSGYVGLSLAVLLAQHHEVKVIDVIKDKVESINNRKSPIKDEAIEKYLVENELNLEASLDPAHVYKDVEYAIIATPTNYDVDLNQFDTSSVEAAIKTCMEYNDTCTIVIKSTIPEGYTKEVREKFNTDRIIFSPEFLRESKALYDNLYPSRIVVGTDLDDSELTKRAWQFADLLKGGAIKEEVPILVVAFNEAEVAKLFSNTYLATRVAYFNEIDTYSEVKGLNPKTIIDIVCYDPRIGSYYNNPSFGYGGYCLPKDTKQLKASFRDVPENLITAVVQSNKTRKDYIAGAILAKQPSVVGIYRLIMKSDSDNFRSSAVKGVMERLDNYGKEIVIYEPTIECDTFMGYRVIKSLDEFKNISDIVVANRMNDDLRDIQEKLYTRDLFGRE

SEQ ID NO: 57634 - protein, 481 aa, Azospirillum brasilense
MANVTYTDTQLLIDGEWVDAASGKTIDVVNPATGKPIGRVAHAGIADLDRALAAAQSGFEAWRKVPAHERAATMRKAAALVRERADAIAQLMTQEQGKPLTEARVEVLSAADIIEWFADEGRRVYGRIVPPRNLGAQQTVVKEPVGPVAAFTPWNFPVNQVVRKLSAALATGCSFLVKAPEETPASPAALLRAFVDAGVPAGVIGLVYGDPAEISSYLIPHPVIRKVTFTGSTPVGKQLASLAGLHMKRATMELGGHAPVIVAEDADVALAVKAAGGAKFRNAGQVCISPTRFLVHNSIRDEFTRALVKHAEGLKVGNGLEEGTTLGALANPRRLTAMASVIDNARKVGASIETGGERIGSEGNFFAPTVIANVPLDADVFNNEPFGPVAAIRGFDKLEEAIAEANRLPFGLAGYAFTRSFANVHLLTQRLEVGMLWINQPATPWPEMPFGGVKDSGYGSEGGPEALEPYLVTKSVTVMAV

SEQ ID NO: 57635 - protein, 328 aa, Sinorhizobium meliloti 1021
MQNNNILVVGGAGYIGSHTCLQLAAKGYQPVVYDNLSNGHEEFVKWGVLEKGDIRDRQRLDEVLARHKPRAILHFAAMIEVGESVKDPAAFYDNNVIGTLTLLSAALAAGIDAFVFSSTCATYGLPDSVPMDESHKQAPINPYGRTKWICEQALKDYGLYKGLRSVILRYFNAAGADFEGRIGEWHEPETHAIPLAIDAALGRREGFKVFGTDYDTRDGTCVRDYIHVLDLADAHVRAVDYLLEGGESVALNLGTGTGTTVKELLDAIEKVAKRPFNIGYAERREGDSTTLVANNDKARQVLGWEPQYDLAAITESAWNWHSRRNQGG

SEQ ID NO: 57636 - protein, 306 aa, Streptococcus pneumoniae
MKKVKKAVIPAAGLGTRFLPATKALAKEMLPIVDRPTIHFVIEEALRSGIEDILVVTEKSKRSIEDYFDSTFELEYSLRKQGKMELLKSVNESTDIKVHFVRQSSPRGLGDAVLQAKSFVGDDPFVVMLGDDLMDITDSTAVPLTRQLMDDYNATQASTIAVMPVRYEDVSSYGVISPRLESSNGLYSVDAFVEKPKPEEAPSNLAIIGRYLLTPEIFSILETQKPGAGNEIQLTDAIDTLNKTQSVFAREFVGKRYDVGDKFNFMKTSIDYALQHPQIKESLKNYVIALGKQLEKLDDCSSSGHL

SEQ ID NO: 57637 - protein, 274 aa, Listeria monocytogenes str. 4b F2365
MNLKYTVKLANGVEMPRLGFGVWKVQDGDEAVNSVKWAIEAGYISIDTAAAYKNEEGVGQAIKESGVKREDLFVTTKLWNAEQGYESTLAAFDESLRKLELDYVDLYLIHWPVKGKFKDTWRAFEKLYKDKRVRAIGVCNFHEHHLKELMEDAEIAPMVNQIELHPQLTQEPLRKFCAENNIVVEAWSPLGNGKLLSNPEIKAIADAHGKSVAQVILRWDLQIGVVTIPKSVHQERIIQNADIFDFELSEEEVAKISGLNKDERTGPDPDNFNF

SEQ ID NO: 57638 - protein, 538 aa, Arabidopsis thaliana
MLDSLVSKLPSLSTSDHASVVALNLFVALLCACIVLGHLLEENRWMNESITALLIGLGTGVTILLISKGKSSHLLVFSEDLFFIYLLPPIIFNAGFQVKKKQFFRNFVTIMLFGAVGTIISCTIISLGVTQFFKKLDIGTFDLGDYLAIGAIFAATDSVCTLQVLNQDETPLLYSLVFGEGVVNDATSVVVFNAIQSFDLTHLNHEAAFHLLGNFLYLFLLSTLLGAATGLISAYVIKKLYFGRHSTDREVALMMLMAYLSYMLAELFDLSGILTVFFCGIVMSHYTWHNVTESSRITTKHTFATLSFLAETFIFLYVGMDALDIDKWRSVSDTPGTSIAVSSILMGLVMVGRAAFVFPLSFLSNLAKKNQSEKINFNMQVVIWWSGLMRGAVSMALAYNKFTRAGHTDVRGNAIMITSTITVCLFSTVVFGMLTKPLISYLLPHQNATTSMLSDDNTPKSIHIPLLDQDSFIEPSGNHNVPRPDSIRGFLTRPTRTVHYYWRQFDDSFMRPVFGGRGFVPFVPGSPTERNPPDLSKA

SEQ ID NO: 57639 - protein, 493 aa, Mycobacterium avium 104
MSDIQTQAKTEYDKLFIGGKWTEPSTSEVIEVHCPATGEYVGKVPLAAAADVDAAVAAARAAFDNGPWPTTPPKERAAVIANALKVMEERKDLFTGLLAAETGQPPTSVETMHWMSSIGALNFFAGPAVDQVKWKEVRTGGYGQSIVHREPIGVVGAIVAWNVPLFLAVNKLGPALLAGCTVVLKPAAETPLSANALAEAFAEAGLPEGVLSVVPGGIETGQALTSNTDVDIFSFTGSSAVGREIGRRAADMLKPCTLELGGKSAAIVLDDVDLPSALPMLVFSGIMNSGQACVAQTRILAPRSRYDEIVDAVSTFVQSLPVGLPSDPAAQIGSLISEKQRARVEGYIAKGIEEGARLVCGGGRPEGLDSGFFVQPTVFADVDNKMTIAQEEIFGPVLSIIPYDTEEDAIKIANDSVYGLAGSVWTADVQRGIAVSEKIRTGTYAINWYAFDPCCPFGGYKNSGIGRENGPEGVEHFTQQKSVLMPMGYTLEG

SEQ ID NO: 57640 - protein, 426 aa, Bifidobacterium longum DJO10A
MYARQILDSRGNPTVQVVLDTEDGAQGLGLVPSGASTGEAEAWERRDGDKSVYGGKGVLNAVKAVNEVIAPKVIGMDAADQRALDDLMIELDGTPNKGKLGANAILGVSLAALYASAESAGLPLYRYIGGTNGHILPVPNMNIMNGGAHADFATDIQEYMISPYGFDTYSEALRAGVEVYHTLKNVLKKEGLNTGLGDEGGFAPKMKSNEDSLKYIMDAISAAGYEPGKQIGICLDVASSEFYNKETGKYRFDGEERDSAYMLDYYENLINEYPIVSIEDPFNEEGWEDWAAITARLGDRLQFVGDDLLVTNPARLQKAIDLGAANSLLVKLNQIGSVTETLDAIELATANGYTSMVSHRSGETPDTTISDLAVAKNTRQIKTGAPARGERVAKYNRLLEIEEELGSTAQYAGYSAFKACKKYLAK

SEQ ID NO: 57641 - protein, 131 aa, Glycine max
NNSVIALSTLREYGRKELIDVLDSVRGKKGLVLDPKFSGPLGLIAEVSLLKEHGIENIYHLTPGKLNTQCKNLIYLVRPKVHLMKMIAEHIHGHIQEGQKKEYSVFFVPRRTMICERVLEEEGVYPEISFG

SEQ ID NO: 57642 - protein, 481 aa, Opitutaceae bacterium TAV2
MTIRWRSTNSRPLPASTPIRPASSAPRSPGTPRLRRSNAARRPPPDSTTIIIVTFIPALSVLAFQLFHLMSALSTNLRIDFPTLDQHVGGKPLVYLDNAATTQKPRSVIDALARYYERDNSNVHRGLHALSMRATDGYEAARARAARFINAADPAEIVFTRGTTESINLVAQTWAIANLKPGDVVLTTEMEHHSNLVPWQLAAQRTGATLRYVPVAGADAEHGLDLDALDRLLTPQVKLFAFTHLSNTLGTINPISDLCAKARAVGAVTVIDAAQSIGHEPIDVRALDCDFLAFSGHKMAGPTGIGVLYGKRALLDAMPPWQTGGGMVDSVTYEGAKWKPAPERFEAGTPNVADAIALHAAFDYLDALDRARIAAHDYALGARAAAALAELPGLRLLGPRAGQPRGGVVSFALADVHAHDVVTFADQDGVALRGGHHCNQPLMKKLGLPSSARASFYVYNTEAEIDVLVASLRRTIKFFSM

SEQ ID NO: 57643 - protein, 311 aa, Mannheimia haemolytica
GSHTLVELLNENREIVVLDNLSNSSEVSLERVKQITGKSVKFYQGDILDRDILRKIFAENQIESVIHFAGLKAVGESVREPLRYYQNNVTGSIVLVEEMLKANVNTIVFSSSATVYGDPQIIPIVESCPVGGTTNPYGTSKYMVERILEDTVKAFPQLSAVVLRYFNPVGAHESGLIGEDPNGIPNNLMPFISQVAVGKLPQLSVFGGDYNTHDGTGVRDYIHVVDLALGHLKALDKHQNDAGFHVYNLGTGTGYSVLDMVKAFEAANGITIPYKVVDRRPGDIAVCYSAPQKALEQLGWETERGLEQMMK

SEQ ID NO: 57644 - protein, 255 aa, Ehrlichia canis str. Jake
MSSSLIAGTLFLVIFMSLLIVANWKMYGDFITFSSFTKELSINLTNVKADLEVVLCPPFIALPKVVDCISCIKFGAQNCFYETEGKYTGEVSAKMLYDCGCSYVIVGHSERRSIFHESDYHVQLKASAAIKSGLIPIVCVGETLLDRENGMLKDSLLNQCYNSFPKSGKFIIAYEPVWAIGSNTIPSIDMITEALEVIRSYDSTSDIIYGGAVNQDNIRDVIAINQLSGVLVGSASLKLDSFYNIIHGAVNVRQN

SEQ ID NO: 57645 - protein, 311 aa, Mannheimia haemolytica
GSHTLVELLNENREIVVLDNLSNSSEVSLERVKQITGKSVKFYQGDILDRDILRKIFAENQIESVIHFAGLKAVGESVREPLRYYQNNVTGSIVLVEEMLKANVNTIVFSSSATVYGDPQIIPIVESCPVGGTTNPYGTSKYMVERILEDTVKAFPQLSAVVLRYFNPVGAHESGLIGEDPNGIPNNLMPFISQVAVGKLPQLSVFGGDYNTHDGTGVRDYIHVVDLALGHLKALDKHQNDAGFHVYNLGTGTGYSVLDMVKAFEAANGITIPYKVVDRRPGDIAVCYSAPQKALEQLGWKTERGLEQMMK

SEQ ID NO: 57646 - protein, 472 aa, Pseudomonas putida GB-1
MSGQNMHSGELKRGLKNRHIQLIALGGAIGTGLFLGSAGVMKSAGPSMILGYAICGFIAFMIMRQLGEMIVEEPVAGSFSHFAHTYWGGFAGFLSGWNCWVLYILVGMSELSAVGKYVHYWWPEIPTWVTAAAFFVLINAINLMNVKFFGEAEFWFAIIKVVAIVSMIGLGAYLLTSGSGGPDATVANLWSHGGFFPNGVSGLVMALAFIMFSFGGLEMLGFTAAEADKPKSVIPKAINQVIYRILIFYVGALVVLLSLTPWDNLVASIDASGGSYGSSPFVQVFSLLGSDVAAHLLNFVVLTAALSVYNSGTYCNARMLLGMAEQGDAPASLAKVDKRGVPVRSILVSAAFTFVAVLLNYLMPQNALELLMSLVVATLVINWAMISYSHLKFRQHLDRTGQKPLFKAMWYPYGNYLVLAFVVLILGIMLMIPGIQVSVYAIPFWLFGMFVIYMVKPRRKLNAGGAAGHVAK

SEQ ID NO: 57647 - protein, 311 aa, Mannheimia haemolytica
GSHTLVELLNENREIVVLDNLSNSSEVSLERVKQITGKSVKFYQGDILDRDILRKIFAENQIESVIHFAGLKAVGESVREPLRYYQNNVTGSIVLIEEMLKANVNTIVFSSSATVYGDPQIIPIVESCPVGGTTNPYGTSKYMVERILEDTVKAFPQLSAVVLRYFNPVGAHESGLIGEDPNGIPNNLMPFISQVAVGKLPQLSVFGGDYNTHDGTGVRDYIHVVDLALGHLKALDKHQNDAGFHVYNLGTGTGYSVLDMVKAFEAANGITIPYKVVDRRPGDIAVCYSAPQKALEQLGWKTERGLEQMMK

SEQ ID NO: 57648 - protein, 1486 aa, Coprinopsis cinerea okayama7#130
MADQQPHHLTDIVEEPASTGVSRIGSQMTLQPKPSSVDDKLEKDIEDDDDRGRHPPPSSPKVPHRTRRTSSASRVSMDFFDPSGMQSLRRTLTHERVGLPKGQSEPSESSDTSSDHTLIVDGDNFDLEKTIKTIIRRRDQSEIKPRQLGVVFRNLRVVGLKAAASFQPTVGSLFNPADVVQNIQNARHPPVRNILDGFEGVVRPGEMLLVLGSPGAGCSTFLKTLANHREEYHSVEGEVHYDSITPEELKKWFRGDVQYSPEDDVHFPTLTVEQTIKFAARTRTPRNRIEYTRAQFIDTLSNILTTVFGLRHARKTPVGDAMIRGVSGGEKKRVSIAESLATRACIACWDNSTRGLDASTALEFVRALRIGTDTMRLSTIVSIYQAGESLFSHFDKVCVIYEGQMAYYGPADQAKDYFYEMGYVPANRQTTPDFLVAVTDPNARIAREGVTNQPRTAEEFAAYFKASAHGQRNKAEIEEYIAEHVGKPDAAQRYIDSARAEFAKRSGKKNPYMLTIPQQVAAVMRRKVQILRGDMLATGLNLFSYVFQALIMGSIFLKMPEQTSAYFSRGGVLFFALLFSALATMAEIPALYAQRRIVLRHEKAALYHPFVEALAHTLVDIPITFCILSLFCIILYFMTGLQRSVDQFFVFFLFVFAMAVTMKSWFRGIAAAFKSEATAQAVAGISVLALSIYTGYTIPKPTMIGALRWITYINPLRYGFEAILTNEFRTLNGLCTSLVPSGPGYENVSLANQVCAVVGALPGEAFVNGARFAELSYSFKWSNTWMNLGIVIAFAIGFLIVLLIFAEFNTTSSADTATTLFKRGSKKAVAAASSGSDEEKKGSPSGTVVVDEKGKDTSALKDEPALRMTDTFTWQHVHYTVPIPGEADRTLLSDVSGYVAPGKLTALMGESGAGKTTLLNVLAKRVYSGVVTGDMFVNGQSLPADFQSQTGYCQQMDTHMPNATVREALLFSAKLRQPPSVPLEEKEAYVEKCLKMCGLEEYADAIVGTLNVEYRKRTTIAVELAAKPKLLLFLDEPTSGLDSQSAWAIVSFLRSLADQGQAILCTIHQPSAELFQVFDRMLLLKKGGQTVYFGDLGHNATTLIQYFERNGARHCDPSENPAEYMLDVIGAGATATTEFDWHGIWKSSPEATAVQEELEAIHTEGRNRPAVEAELHTEFATSWLFQVKELFIRNVQSYWRDPTYIMAKMVLNVSSGLFIGFTFFKAKDTIQGTQNKLFAIFMVTILSVPLASQLQVPFIKLRTIYEIRERPSRMYSWTALITSQILVELPWNIIGSTLLFMCWYWPVGFLASRGGYTYLMLGIIFPLYYTTIGQAVAAMAPSVEIAALLFSLLFSFVIAFNGVLQPFRELGWWKWMYRLSPYTYLIEGLLGQAIGRQDVECAPYEYVQITPPEGLSCGGYMDPFISFAGGYLTNPNATDACNYCSVKTTDQFLLASFNISYSHRWRNVGLMLAFTVFNNTYGEFAA

SEQ ID NO: 57649 - protein, 201 aa, Oryza sativa Japonica Group
MVMTTTRHTVRFGSATIDTTVTSDVAAADEWARGVRAAARGGRGLIVGLDCEWKPNHVSWKTSKVAVLQLCAGERFCLVLQLFYANRVPPAVADLLGDPSVRLVGIGVGEDAAKLEADYGVWCAAPVDLEDACNRRLGLVGTGRRLGLKGYAREVLGMAMEKPRRVTMSNWEKRELDPAQVEYACIDAYVSYKLGERVLAN

SEQ ID NO: 57650 - protein, 359 aa, Streptomyces rimosus
MRELPEFPWDVLLPYKKRAAAHPDGLVNLALGEPVDATPDVLRDALAAATDAPGYPPTEGTPALREAAAAWLRRRLGVTVDPSAVLPAVGTKELIAWLPAMLGTGPGDTVAFPRLAFPTFDVSARLAGARGRPVDSPLELGSEPVKVVWLNSPSNPEGRVLSVPELREIVAWARDRGAVLVNDECYIEYGWDRRPVSLLDSAVCGGSHDGLLAVHSLSKRSNLAGYRAGVCSGDPALIGRLLQVRKHAGHAVPAPVQAAMVAALEDDAHVERQRDRYAYRRRVLRTALEGAGFRVEHSEGGLFLWATRGEPCWPAVQKLADLGILVAPGAFYGEAGEQYVRIAFTATDERIAAAAARLT

SEQ ID NO: 57651 - protein, 404 aa, Oceanicola granulosus HTCC2516
MSPAPFRRAERLAGIEISEIVQLSERAAELRRAGQDVVALTTGEPDFPTPPHVVAAAHAAAEAGQTRYPPTAGTPELRAAIARQAGAEAAEVLVSTGAKQVLANAMLATLDPGDEVLIPAPFWTSYGDIVALAGGRPVRLPCPAADGFKLRPEALAAAITPRTRWLMLNSPSNPTGAVYGPGELAALAAVLADHPQVWVLSDEIYSHLAYVPAPSLRDAAPGLAERTLVVDGVSKAFAMTGWRLGWGIGPRALIGAMAAVQGQVTSGACSISQAAALAALTGPQELLADRRAAFRARRDRVCAALAAIPGISCVPPDGAFYAFPDVTGLILGGGFADDAALCRWLLDEVGLALVPGRAFGMPGHVRLSFAYAEREIDDALDRLATAAARLAARPFQASKEQVTT

SEQ ID NO: 57652 - protein, 535 aa, Treponema pallidum subsp. pallidum str. Nichols
MNWRNLDECAAYARLQAIRAPSLKTVLCGPEGIERVRRYCTDAGAGLRYHYAAKTVNEEILTALAALADEQELVAKYDALRAGAQINTGEKRKVLHHLTRLGVQGSSLASLPCEVRDMHAFYTKEYERVCAFARQVHEGGLRTSRGAPFTDVVQIGIGGSDLGPRALYLALEGWAQRHQAVKMRTHFISNVDPDDAALVLSKLPLETTLFILVSKSGTTLETLSNELFVAHVLRQAGLEPHTQFVAVTSETSPLANNPQYLASFYMDDFIGGRYSSSSVCGAVVLTLAFGPQVFGHFLSGAAEADRAAQEQDIRRNAALLDALIGVYERTILGYEHTAVLPYSQALARFPAHLQQLDMESNGKSVNRFGIPITYKTGPVIFGEPGTNGQHSFYQHLHQGTSVVPLQFIAFQHSQLGQDPIIRGSTGQQKLLANVVAQIVAFARGKEHADANKTFSGERPSSLLYAKALTPQTLGALLAHFENKIMFQGFAWNLNSFDQEGVQLGKTLAQHILAGEVEGVLRAYADLFDLAHAPTC

SEQ ID NO: 57653 - protein, 828 aa, Cryptococcus neoformans var. neoformans JEC21
MGNDQSRTSSGDGKQVDEKPPDYYELLQVDEEAGYDEIKRSYRKLANPHRIEEATKLFADLQHAYEERAFYDSHRNAPVAATDDDIFEHVRTGDKATNDPKSKLNRRRQGDPGVTIAQLMRFFDPKIASKMDDTSEGFYSIYRTLFALLASDEALHTTSTTPLSYPSFGNSSTAYAPPPGLTRAQKDSQVWARDFYAVWGEFVTEKKFEWLNKWDAERGDDRMVRRAMEKENKKAREETRKEYNETVRQLVVFIQHRDPRYKAHQTKLAQERAASKSAKTSGASTPAGKPVVDAEAAKRRHEERLRAAAQYEEQDWQKFSSRNSDDEEMEEEEPEEELGDGTGVRLDDGQGGEIFECVACGKTFASEASWINHERSKKHKQAVWRLKKEMRAEAKAMGLTEPQSEEEPGDERAEDADAGEGEIGGETKGVGMTEEEQLAELQALEAEMVDLALEESEDVDYGNKKSKKKGKKNRRDGVIDEVDTATGLSPSRNESQPDASNTPSAAVSDDGVARESDKTSELSKRDKRRAREARKKIEEEERKAAFKEARKAAKKAGASVETFASPQQSDRKDKVDDDGFVAPKQKGKNSIKSGKGTKGGREQGENDYSDERVAKVVAGIQEKREKMVEKWGDTWADLVSKLKHLLSGDSHLPLSILCLGLGKPFSDRTAQIQLALALELADALNCTVHDLEMYDPVWDEGDKKVLSSIGVTLLQDNLLGRHTLETGRPYLLYLPHAPKQLYESILSTNYAPSLCGNKPGRILLGNDLAEYLPGFVRPSQKKEPSGEADGDGEFVKPKKKRRGRGEVKPQIKDGVLSRVGESHSALLR

SEQ ID NO: 57654 - protein, 304 aa, Triticum aestivum
PTLPDPPPTPLVDAGELGKWSLYRAVIAEFTATLLFVYVAVATVVGHKRQTDAQACSGAGVLGIAWSFGGMIAVLVYCTAGISGGHINPAVTFGLLLARKVSLPRAFLYMVAQCVGAICGAELVRAVHGGHHYVLNGGGANELAPGYSRTAGLIAEIAGTFVLVYTVFSATDPKRIARDPHVPVLAPLLIGFDVLMAHLATIPVTGTGINPARSFGAAVVYNGGKAWDDQWIFWVGPFVGAAMAMVYHQYILRNSAIFRSTTPSSYFHSSIHCCPYLLGDELRGQWMDPPRGCNGWLISMLLWY

SEQ ID NO: 57655 - protein, 799 aa, Physcomitrella patens subsp. patens
MTTRIVAQSASLDAQSFGLNATLGGNQTWLSENGTFTMGFYPIPANSSSLYLAVWYSGVPVAPVWLMNRERAVKSGATLTLNNAGSLVLANADGSSVWTSNTSGVGVVGGKFLENGNIVLRNSSNWTMWDSFDYPTDTFLPGLIVMGHKFTSWRTNSDPSPGLYTFEMLADGQLYFKWNGTETYYNSGPWGGSYFTNPPQLGRTTSPDVFHFDNSTGSPRFYYNTSGRSATADISLKRMRLDPDGVARQHIWVIDSNSWQTFISAPVEPCDSYHVCGKNSLCISSNYIPGCTCLPDFRPVSAAEWSDQDYWLQGCGRDPALLGSCTTNASIANSTSDFSFMALAGATIEVNRTSPPQFFFNDTESACRERCAGNCSCGSFSFSEVAPGTSTATNCDNNGSSFNGAKLIITVVIVCCVVVAVAASLLWWLCIRRRDAKRRADAAAAFSVVGLARFTYKELVDATGNFGHQLGSGGFGTVFQGTLPDKSEVAVKTLNKLRQGEQEFRAEVAVIGTVQHINLVQLRGFCAEGDHRALVYEYIPNGSLEKYLFRRVAGKGDGPQDVNNVMDWRTRMAVALGAARGIAYLHHECRSSIIHCDVKPENILLSGDFTPKVADFGLAKLMGKDVSRLITNIRGTRGYLAPEWLTNCTLTSKVDVYSYGMTLLEIISGRRTVDLSYPADKWFYAVWAYKEISKGRDLTSLVDDRLAKGSVDAEELRRALHVGLWCTQDDPVKRPNMRDVEKMLEGVLDVNDAPAPPSYIAQTDEACNSGDSKIASTDEKGSQLMNGISFEYTQTFSGR

SEQ ID NO: 57656 - protein, 515 aa, Treponema pallidum subsp. pallidum str. Nichols
MGKISGSGTVAPHILVIFGASGDLAARKLIPSLWDLFEQELLPRTFGILGAGRTALSTESFRARLAEAVTKHAVRTPHDPARLTEFLQKIHYFSFDPTDSVAFADFATYVRTLDQSLHTEGNFIFYLATPPSLYETIPTQLAMHHLNREQGNFRRVVIEKPFGYNLETAQHLNASLRAHFQENQTYRIDHYLGKETVQNILVTRFANPLFEPTWNRTHIDYVEITASESLGVENRGGYYDQSGALRDMIQNHLLLLLGIIAMEAPAVVSSSRLRDEIVKVFDCLRPMGERDVMQHTVRAQYVAGKIRGVAVPGYLEESGVDPRSCTETFAALKCYIDNWRWMDVPFYLRTGKRLPTGVTEVIVHYRTLPIALFEHIERPCAREGNALVIRIQPDEGIQLKIDLKEPGAGFKTIPVSVDFQYSALTYSHLPSAYERLLLDCMNGDNTLYHRDDAVESAWRFIDPILAAWKSNKSPLLTYPAGSWGPKAADDLIKGSAPRWHHPSSTLLSDDFACRL

SEQ ID NO: 57657 - protein, 617 aa, Synechococcus sp. WH 5701
MTLTPERHLKSSGPGHTKVETEAVDAASRSSPATNGNAADESAAAIKPPSKFERLKAASDYLKEPLATELENDKPFFTDGAVQILKFHGSYQQDNRDNRQKGQEKDWQMMLRLRSPAGRIPVPLYLAMDDLADRLGNGTLRLTTRQAFQMHGIAKADIREVIGTIVRSMGSTLAACGDINRNVMAPAAPFEKGGYPAARRLADEIADLLSPLAAEGSYLDLWVDGDHSYRFKPAAAVKRVRQRQLQGAGFSGDPNEPLYGGTYLPRKFKVAVTVPGDNSVDLLTQDIGLVAFTDPSGRLRGCNVYVGGGMGRTHNKEETFARTADPLGYVAAEHVLDLVQAIVALQRDHGDREQRRHARMKYLIHDRGVDWFRQELGRYLDAPIKPLRREPKPRLDDYLGWHRQNRGLWFVGLPLVCGRLEGERKRGLRRLVETYQLEVRLTPNQDLLLCSIGTSQRNSVKEALAALGFEAPEAPSLLSRHAIACPALPTCGLAITESERILPAVLERLEALLQRLGIERPLLLRMTGCPNGCARPYMAEVGLVGSGVEQYQLWLGGTPNLTQLAAPYLERMPLADLEATLEPLLVLWKSTGGRQSFGQFISGLGAERIQGLLPAES

SEQ ID NO: 57658 - protein, 344 aa, Streptomyces avermitilis MA-4680
MTTLTTALKAGPEAPAILHRCRELVAPALAEAVGGMHPWMREMADYALGRGAAGGAPAAHSQGKGVRQALAVLGAEAAGGPAEAGVPAAVAVELVHTFSLLHDDIMDGDAMRRGRPALWKAYGTGPAVLAGDALFALAVQTLTTASAPGAAHRLSAALGDLVRGQADDLLFAHRPWTGPEAVSVAEYEAMAEHKTGSLLGCALALGAHLAGAPEETAAVLDRTGRHLGVAFQIVDDLLGIWGDPAVTGKPVHGDLRQGKKTFPVLAALATPSGSALEGLLTARDDTAVVRAAAVVEQAGGRSAALREARRHLTVAHGLLASVQPAPRPAADLRTLLSALSRRTI

SEQ ID NO: 57659 - protein, 201 aa, Listeria monocytogenes str. 4b H7858
MILLIDNYDSFTFNLEQYLAEFSEVVVKRNDATDLMEMAALADGIVLSPGPGKPSDAGLLEEVVAKFAKEKPLLGICLGHQAIGEVFGGDVKRAAKIRHGKVSTMRQTAGAIFANLPEEMPVMRYHSLIVDKNTLPQVLEVLAVATDDAEVMAMKVKDYPVYGLQFHPESIGTNDGKQMMENFIHIVEGARENGNLTTKSI

SEQ ID NO: 57660 - protein, 267 aa, Bifidobacterium longum DJO10A
MASKRIPLVAGNWKMNFDHLEATYFVQKLVWLLRDAHFDFKRCEVALFPSFTSLRSVQVLVEADKLHVAYGAQSVSVTTQGAFTGDVSADMIAHLGCSYVIVGHSERRKYHPEDDANIVDQVRAVLAAGMQPILCVGESFEERRQGIELDFAVGQVRDVTRDLNEEQAAKLIVAYEPVWAIGTGMVATPQSAQDAANAIRNDLKTTFGTKVSDSVRILYGGSVTSKNAAELISQPDVDGFLIGGAALDVEELAKIARLALKSTKSRN

SEQ ID NO: 57661 - protein, 118 aa, Zea mays
  misc_feature (12)..(12): Xaa can be any naturally occurring amino acid
  misc_feature (76)..(76): Xaa can be any naturally occurring amino acid
MERTYIMVKPDXVERGLVGEIIKRFEQRGYQLTALELIHPTKELLEEHYCDLKGKAFFPSLVEYMLSGPVVGMVWXLAKDAVKTGRKMLGETNPLASAPGTIRGDFCIEVGRNICQRF

SEQ ID NO: 57662 - protein, 1423 aa, Ashbya gossypii ATCC 10895
MAFLKRLNVSSHSRSSSGSSGRTPQNTSGGSKATAVKPLPQIPVEMGGIESEVIKNGEGGQSVVILCDDVGSGSYTSVLLSPSDPHMFSADGQRLSVEEQAEKTLYSWDVTDPEQWTMQRVMSWFKAHDFDEQWILFFKRNHISGKKFLQLLAHDNFNKYESFLSATKNSSYNRFQHLLKRTLEENVSNSHRRQRSNKSNDSKGSADCSLRYRRRRSVASEQRTLTAAEGVTPRKTVEVADDRAGSSKNHRKAKSASVLYRRSFISLRSSSSSNIKNDVDDDCKTLPAMKISIPPRPFSSIERSTSSSPASTLKSQSSPLSPGNHNMFRKDHKSSSSDSSLFNNLFGSADEITKAVGGTAPQGEQIAVKKYNDTLPSPMRVSPRHIDDKSTIWDKLKKRALPSTEQYTPSRIKQLTSGRNSSYIQTLQESPDECSANNEDPPATATLEAPIIDDLVLEEKHYPSQKQDSSAQYVLVTKDNRIFLPLNIAPYKTTQELKDGMTAFLGISSKAYTIHLTDLGCDPGVSLSDDVIAAIGQRKLNTRHLKFYVKDATRMHLRLKNDSFTSDHNITTEMSRSKGSLRSAASSFISSNDDTNSFSDITSIDEHGNITGRRVYPQTPSHYYDQSAATHSPEVDYWNIKERLSEGTSPMNISLLRSTTKAASLPSSIDEIKKSSFKVIRKASVTDIDFNKGRESPYIRPKLAPKREAPRPPRTSSQVSLASSSSIQSSLVEQKSISNSPTKPQRQHAGTYVKNKTRPPPPPSIGSTMTVDTKVMTSVSDSPVSNEPPNRPYGPFSTQKLVPQGFKGVGVHPGTRKVEEQMHTNPVTQYIQKQRSRNSISKMGNNPSLYSPPRLKKRISTRRMVSSTSAADIFDENEISFADAPDLSDYDSENSESSDDIIWSTTNTTSLDASKISVSDSTTGDDSNFSVASSVELQSSIKNDAKTSEDSIVDSIKEEGDSVCNLVGRKMTLRPTTEVVYQNLEMFFPGTDLDKPILEGLTPPASPDSEANKMPDQDLTPLSKVSTISSESSMRQSTPRLLITKKSDSPQPMPVRNLKPPKRTKTIRSIAREASEARKKSLYNNLKRQNTKMWGTRVVEVTDKRMVSINKSKNSKGEYREFAWIKGEMIGKGSFGAVYLGLNVTTGEMMAVKQVEVPKFGSQDETTVNNAEALISEVSTLKDLDHLNIVQYLGFENKNCIYSLFLEYVAGGSVGSLIRLYGHFDEQLIRFLTTQVLEGLAYLHLRGILHRDMKADNLLLDNDGVCKISDFGISRKSNNIYSNSEMTMRGTVFWMAPEMVDTTQGYSAKVDIWSLGCVVLEMFAGKRPWSNLEVVAAMFQIGKSKSAPPIPEDTLPHISQDGRAFLDDCFMIDPEERPTADTLLSHPFCQVPKEFNFRDTDLYNFIKQNDKLNNSKLTRNSQR

SEQ ID NO: 57663 - protein, 460 aa, Acidobacteria bacterium Ellin345
MSTETLHLPAKKERQYRFPRGVEHNLLWEGLKNLGPIDPLRFFERLKRDYGKVGGYRVGNKRVVFLADAELIREVLVVQNDNFVKGEPVRRTKVLLGNGMITAEQQDWRSQRQAAQPAFHRQRIRSYADQMVGLTIETRDRIAPGIEFDLAQMFMELALKVVGKTLFDTDLDHEAGVVAHEISNIMDVYNFMMAVPAPQLMLHLPWPQVIKFRKARRRVDETVNRMIESHLHGPKRDCGDLLSMMIQAIPDVETPEGKEQLRDQVVTIFLAGYETTANALSWTFRLLGENPEVERRVLAEVDDVLNGRMASVEDVPQLKYIEMVLAESMRLYPPAWAMVRQGINDFQLGDYFLPGGTTVMMSQWVMHRSEEFWLDPLRFDPERFRPEAKAGRPKFAYFPFGGGGRQCIGEAFAWMEGALLLATLVQKYRFRLVAGQTFEPQSLITLRPRNGVRVVAEARG

SEQ ID NO: 57664 - protein, 473 aa, Mycobacterium tuberculosis H37Rv
MTIMAPEAVGESLDPRDPLLRLSNFFDDGSVELLHERDRSGVLAAAGTVNGVRTIAFCTDGTVMGGAMGVEGCTHIVNAYDTAIEDQSPIVGIWHSGGARLAEGVRALHAVGQVFEAMIRASGYIPQISVVVGFAAGGAAYGPALTDVVVMAPESRVFVTGPDVVRSVTGEDVDMASLGGPETHHKKSGVCHIVADDELDAYDRGRRLVGLFCQQGHFDRSKAEAGDTDIHALLPESSRRAYDVRPIVTAILDADTPFDEFQANWAPSMVVGLGRLSGRTVGVLANNPLRLGGCLNSESAEKAARFVRLCDAFGIPLVVVVDVPGYLPGVDQEWGGVVRRGAKLLHAFGECTVPRVTLVTRKTYGGAYIAMNSRSLNATKVFAWPDAEVAVMGAKAAVGILHKKKLAAAPEHEREALHDQLAAEHERIAGGVDSALDIGVVDEKIDPAHTRSKLTEALAQAPARRGRHKNIPL

SEQ ID NO: 57665 - protein, 349 aa, Ashbya gossypii ATCC 10895
MWFSLEQGSRILKHHTSFQYRRMTATPGSPKHLVSIKDLADHEFAELVSRAEYFKGLFKAQDKAECQKSHQELMGKTIALIFSKRSTRTRISTEGAAAFFGAQPMFLGKDDIQLGVNESLYDTIKVISSMVACIFARVGKHSEIQEFVKHSKVPVINSLCDKFHPLQAICDMLTIKEHFNYQEKKLKLAWIGDANNVINDMAIAALKLGIDVVVATPQGIELDADIVDAAKEVCKRTGTTIQLTHDSVAAAKDAHVLVTDTFVSMGEEYMYEAKMRQFKGFQINAELCKHAAPDYKFMHCLPRHQEEVTDDIFYGDHSIVFQEAENRLYAAMAAIDIFVNKNGDFSGLN

SEQ ID NO: 57666 - protein, 291 aa, Methanocaldococcus jannaschii DSM 2661
MKFFGDKMIVVSGSQSQNLAFKVAKLLNTKLTRVEYKRFPDNEIYVRIVDEINDDEAVIINTQKNQNDAIVETILLCDALRDEGVKKITLVAPYLAYARQDKKFNPGEAISIRALAKIYSNIVDKLITINPHETHIKDFFTIPFIYGDAVPKLAEYVKDKLNDPIVLAPDKGALEFAKTASKILNAEYDYLEKTRLSPTEIQIAPKTLDAKDRDVFIVDDIISTGGTMATAVKLLKEQGAKKIIAACVHPVLIGDALNKLYSAGVEEVVGTDTYLSEVSKVSVAEVIVDLL

SEQ ID NO: 57667 - protein, 311 aa, Mannheimia haemolytica
GSHTLVELLNENREIVVLDNLSNSSEVSLERVKQITGKSVKFYQGDILDRDILRKIFAENQIESVIHFAGLKAVGESVREPLRYYQNNVTGSIVLVEEMLKANVNTIVFSSSATVYGDPQIIPIVESCPVGGTTNPYGTSKYMVERILEDTVKAFPQLSAVVLRYFNPVGAHESGLIGEDPNGIPNNLMPFISQVAVGKLPQLSVFGGDYNTHDGTGVRDYIHVVDLALGHLKALDKHQNDAGFHIYNLGTGTGYSVLDMVKAFEAANGITIPYKVVDRRPGDIAVCYSAPQKALEQLGWKTERGLEQMMK

SEQ ID NO: 57668 - protein, 516 aa, Mycobacterium tuberculosis H37Rv
MLMPHSAALNAARRSADLTALADGGALDVIVIGGGITGVGIALDAATRGLTVALVEKHDLAFGTSRWSSKLVHGGLRYLASGNVGIARRSAVERGILMTRNAPHLVHAMPQLVPLLPSMGHTKRALVRAGFLAGDALRVLAGTPAATLPRSRRIPASRVVEIAPTVRRDGLDGGLLAYDGQLIDDARLVMAVARTAAQHGARILTYVGASNVTGTSVELTDRRTRQSFALSARAVINAAGVWAGEIDPSLRLRPSRGTHLVFDAKSFANPTAALTIPIPGELNRFVFAMPEQLGRIYLGLTDEDAPGPIPDVPQPSSEEITFLLDTVNTALGTAVGTKDVIGAYAGLRPLIDTGGAGVQGRTADVSRDHAVFESPSGVISVVGGKLTEYRYMAEDVLNRAITLRHLRAAKCRTRNLPLIGAPANPGPAPGSGAGLPESLVARYGAEAANVAAAATCERPTEPVADGIDVTRAEFEYAVTHEGALDVDDILDRRTRIGLVPRDRERVVAVAKEFLSR

SEQ ID NO: 57669 - protein, 311 aa, Mannheimia glucosida
GSHTVVELLNENREIVVLDNLSNSSEVSLERVKQITGKSVKFYQGDILDRDILRKIFAENQIESVIHFAGLKAVGESVREPLRYYQNNVTGSIVLVEEMLKANVNTVVFSSSATVYGDPQIIPIVESCPVGGTTNPYGTSKYMVERILEDTVKAFPQLSAVVLRYFNPVGAHESGLIGEDPNGIPNNLMPFISQVAVGKLPQLSVFGGDYNTHDGTGVRDYIHVVDLALGHLKALDKHQNDAGFHVYNLGTGTGYSVLDMVKAFEAANGITIPYKVVDRRPGDIAVCYSAPQKALEQLGWKTERGLEQMMK

SEQ ID NO: 57670 - protein, 280 aa, Coprinopsis cinerea okayama7#130
MAADLKIKLNDGREIPAIGLGTWQSQPGEVENAVAHAIKEAGYRHIDCAWVYGNEKEVGDGIKASGVPRDQLWITGKVWCTYHTRVEESLNETLEKLGTDYLDLFLIHWPVPLNPKGNHPAFPTLPDGKRDVDHSWKLSDTWKQMEALQKAGKVKSIGVSNFSEAKLAEILPSAEVIPAVNQLELHPYNPQHELVAFLKSKGIVAQAYSPLGSAGSPLLQDETVGIPVVPKSVTPARISANIEGAAAAFKKLEQADIAELDKLAAEGKQRRTYIDHVCFP

SEQ ID NO: 57671 - protein, 311 aa, Bibersteinia trehalosi
GSHTVVELLKQNREIVVLDNLCNSSKESLNRVKQITGKSVKFYQGDILDRAILRQIFAENPIESVIHFAGLKAVGESVAKPLWYYQNNVTGSITLVEEMLNAGVNTIVFSSSATVYGDPQEIPITENCPVGGTTNPYGTSKYMVERILEDTTKAFPQFSAVILRYFNPVGAHESGLIGEDPNGIPNNLMPFISQVAVGKRSELSVFGSDYDTHDGTGVRDYIHVVDLAIGHLKALEKHQNDAGFHVYNLGTGTGYSVLDMVKAFEQANGIQVPYKLVERRPGDIATCYSNPQKALEQLGWKTERGLEQMMK

SEQ ID NO: 57672 - protein, 314 aa, Bifidobacterium longum DJO10A
MLRDDDLNHEEQKQVLELAIKFHHDRFYKQPFAGPQAVAVLFDKPSTRTRSSFSIGVAELGGYPLVIDKSGSQLGRGEPVADTARVLNRMAYGVVWRTFGQGRVEEMAKYSTHPVVNALTDDFHPCQILADFQTIAEHRGGVDNLKNQTIAYLGDAANNMANSYLLGGAVAGMDVRVAGPYGYLPRPDIVADAKRVAAETGGSILVTTDAKEAVKDADCVFTDTWVSMGEEAEYAIRSKPFWDYQVNTELMALAKPDALFQHCLPAYRGKEVTAEVIDGPQSVVWDEAENRLHAQKALLTWLTGKARGDESLLA

SEQ ID NO: 57673 - protein, 567 aa, Prochlorococcus marinus str. MIT 9312
MSTKSDSLKGKLTENFSEFSQLSDYSLMNSLKADPQSTKDGNDHKPRSVYSGHYVPVVPTPIPEPEYISHSNKLFKELRLSSDLTKDENFCRFFSGDISVANYPMSPVGWATGYALSIYGTEYTQQCPFGTGNGYGDGRAISVFEGLFNGKRMEMQLKGGGPTPYCRGADGRAVLRSSVREFLAQELMDALGIPTSRSLTLYVSRSEIVRRPWYSKGSRYFEPDVMIDNQAAITTRVAPSFLRLGQIELFARRVRNNAHDEALNELKMIVQHLIDRNYKDEIEYEISIESKVIKLASLYRSRLISLIANWMRVGYCQGNFNSDNCAAGGYTLDYGPFGFCELFDPRFQPWTGGGEHFSFFNQPSAAAINFKTFCSSLSLLLSQSKQDQEKLDQIEKDFFELMNKELMKMWANKLGLEHYNETLINEFFNLMVISKADYTILFRKLSKIPDNLDSLKDCFYLPINDELNNRWEVWLENWQSVLKKEGNIKAKSASMKSLNPVYTWREWMVVPAYEEAEKGNYKKIKELQDVFSNPYVEQPPEIDQKYNRLKPSQYFNYGGVSHYSCSS

SEQ ID NO: 57674 - protein, 407 aa, Bifidobacterium longum DJO10A
MNVFGTPLRVMDHGQGAHIWDVDGNEYLDFLAGIAVNSLGYAHPKWVKAVADQAAKVAHISNYFASEPQIELASKLVKLAGAPEGSKVYFGNSGAEGNEAALKLAKLYGRTLPGALPSIGGKPARILAMTHGFHGRTMGALSATWKPGIRKPYDPLVPNIEFVRAGDKVALHDAFAQTGLGRYGKGPVAAVILELIQGEAGVQPLGADYVKFVRELCDINHALLIIDEVQTGIGRTGKWFAFQRDDLSGGVTPDMVTFAKGVAGGFPMGGMIAFGEKLAALFTPGSHGSTFAGNPLGAAAGLATLDVIEDENLVANAEARGEQLRDGIMATGNPLFVSVRGRGLLDAVELKHPCSHAVMNYCLEHGLIVNAVAPNALRFAPPLIVTAQDVDQALAILKDVPTDLPDD

SEQ ID NO: 57675 - protein, 250 aa, Triticum aestivum
MKLNIANPTTGCQKKVEIDDDQKLRNLYDKRISQEVVGDLLGEEFKGYIFKIMGGCDKQGFPMKQGVLTSGRVRLLLHRGTPCFRGFGRRNGERRRKSIRGCIVSQDLSVINLVIVKKGENDLPGLTDTEKPRMRGLKRASKIKKLFNLGKDDDVRSYVNTYRRTFLNKKGKKVSKAPKIQRLVTPLTLQRKRARIADKKKRIAKKKSEAAEYQKLLAQRLKEQRDRRSESMAKRRSKLSAATKAPAASA

SEQ ID NO: 57676 - protein, 360 aa, Vitis vinifera
MKEKSDGFVRADQIDLKSLDEQLQRHLSRAWTMEQKKEQQEERPNTREEWEIDPSKLVIKSVIARGTFGTVHRGVYDGQDVAVKLLDWGEEGHRTEAEIASLRAAFTQEVVVWHKLDHPNVTKFIGATIGSSELNIQTENGHIGMPSTVCCVVVEYLPGGALKSYLIKNHRRKLAFKVVVQLALDLARGLSYLHSKKIVHRDVKTENMLLDKTRTLKIADFGVARMEASNPNDMTGETGTLGYMAPEVLNGNPYNRKCDVYSFGICLWEIYCCDMPYPDLSFSEVTSAVVRQNLRPEIPRCCPSSLANVMKRCWDANPDKRPEMDEVVSMLEGIDTSKGGGMIPLDQPQGCFCFGKYRGP

SEQ ID NO: 57677 - protein, 314 aa, Bifidobacterium longum DJO10A
MKGPGFHFDVHTDLRADQKAEVLIEALPWLEEFAGQRIVVKYGGNAMVDDHLKQCFAEDMVFLRQVGLHPIVVHGGGPQISHMLKALGIKSEFKGGLRVTTPEAMDVVRMVLTGKVSRELVGLINAHGPLAVGLSGEDGGLFSAMQRRPIINGKPTDIGLVGDVVSVDASAVEDLVAAGRIPVVSSVAPNEEDATEVLNVNADSAAAALAAAVGAHKLVILTDVDGLYADWPDKNSLIGRIGVETLRDMLPDLESGMRPKMEACVRAIDGGVPQAHIIDGRKPHSILNEIFTSAGIGTMVMPDEGLEMRSSYGY

SEQ ID NO: 57678 - protein, 477 aa, Zea mays
MASHNGTKHLAPMEVSVEAGNGGGAEWLDDDGRPRRTGTFWTASAHIITAVIGSGVLSLAWAIAQLGWVAGPAAMLLFAFVTYYTATLLAECYRTGDPDTGKRNYTYMDAVRSNLGGAKVAFCGAIQYANLVGVAIGYTIASSISMQAVSRAGCFHKRGHAVPCKSSSNPYMILFGAVQILFSQIPDFDQIWWLSIVAAVMSFTYSAIGLSLGIAQTVANGGFKGSLTGISIGADVTSTQKVWHSLQAFGDIAFAYSFSNILIEIQDTIKAPPPSESKVMQKATRLSVATTTIFYMLCGCMGYAAFGDKAPDNLLTGFGFFEPFWLIDVANVAIVVHLVGAYQVFCQPIFAFVERRAAAAWPDSAFVSRELRVGPLALSVFRLTWRSAFVCVTTVVAMLLPFFGNVVGFLGAVSFWPLTVYFPVEMYIKQRRVPRGSTKWVCLQTLSVACLVVSIAAAAGSIADVIEALKVYHPFSS

SEQ ID NO: 57679 - protein, 237 aa, Coprinopsis cinerea okayama7#130
MKFNIANPATGAQKLLDIDDEKRFRVFYDKRISQEVPGDSLGDEWKGYIFRVTGGNDKQGFPMKQGVLVPNRVRLLLSDGHSCFRPRRSGERKRKSVRGCIVGPEIAVLSLVIVKQGEQEIPGLTDVVLPKRLGPKRATKIRRFFNLSKEDDVRKYVVRREVKSAKNPDAKPYTKAPKIQRLVTPLRLQRRRHLNAIKRHRIERQKEQKAEYDALLAKRLAEKKAKVAAIKAAHKTA

SEQ ID NO: 57680 - protein, 205 aa, Oryza sativa
  misc_feature (143)..(143): Xaa can be any naturally occurring amino acid
  misc_feature (151)..(151): Xaa can be any naturally occurring amino acid
MRNTLIFAGNSCPVLTGQICENLGMHPASAELTQFSNGETSVRILTSVREKDVFVVQSGSPSINDSIMELLIMISACKGGSANKVTAVLPYFPYSRQSKEKSHRGAITARMLCKLLGVAGVKHVITVDLHASQMQAFFKCPVXNLHAKPIXAKGNRHNVAKWGRKRPWAPKKRGGNPKGGNSLWGRLSKLKFPDFVSYKTGRAGG

SEQ ID NO: 57681 - protein, 381 aa, Azoarcus sp. EbN1
MTASPPALLALADGTVFFGKGVGAAGSTVGEVVFNTSMSGYQEILTDPSYCRQIVTLTYPHIGNTGINREDVEAGRVHAAGLVIRDLPILPSNFRMDQTLDAYLKAENIVAIAGIDTRKLTRVLREKGAQGGCIVTAADGATLNPDAAIAAARAFPGLAGMDLAKVVCVESPYQWTEGEWALGSGYGERGDGRYHVVAYDYGVKRNILRMLASRGCRLTVVPAQTPAAEVFALDADGVFLSNGPGDPGACDYAIAAVRSFLERGIPTFGICLGQQLMALAAGARTVKMKFGHHGANHPVKDLESGQVLITSQNHGFAVDPDTLPGNVRTTHVSLFDGSLQGLAWNDVPAFCFQGHPEASPGPHDVSYLFDRFIRMLETRAK

SEQ ID NO: 57682 - protein, 406 aa, Pseudomonas putida GB-1
MSVEQAPVQRADFDQVMVPNYSPAAFIPVRGEGSRVWDQSGRELIDFAGGIAVNALGHCHPALVKALTEQANTLWHVSNVFTNEPALRLAHKLVDATFADRAFFCNSGAESNEAAFKLARRVAHDRFGPEKHEIIATVNSFHGRTLFTVSVGGQPKYSDGFGPKITGISHVPYNDLEALKAQISDKTCAVVIEPIQGESGVVPADKAYLEGARKLCDEHNALLIFDEVQTGVGRTGSLYAYQHYGVTPDILTSAKSLGGGFPIGAMLTTTELAKHLAVGTHGTTYGGNPLGCAVACAVLDVINTPQTLAGIKAKHERFKTRLEQIGQKYNLFTQVRGVGLLLGCVLTEAWQGKAKDVLNAAEKEGVMVLQAGPDVVRFAPSLVVEDADIDAGLDRFERAVATLTQG

SEQ ID NO: 57683 - protein, 371 aa, Kluyveromyces thermotolerans
MSAADRLNQTHDILSESVQAVENPFKVTVIGSGNWGTTISKVVAENAALRPHLFVKRVDMWVFEETVDGQKLTEIINTKHQNVKYLPNIDLPENLVANPDLVSAVKDADILVFNIPHQFLPRIVSQLQGNIKKDARAISCLKGFDVSKDGVKLLSTYVTEKLGITCGALSGANLAPEVAKENWSETTVAYELPKDFKGEGKDVDHAVLKALFHRPYFHVNVIDDVAGISVAGALKNVVALGCGFVEGLGWGNNASAAIQRVGLGEIIKFGQMFFPDSRVETYYQESAGVADLITTCSGGRNVRVATHMAKTGKSAEECEKELLNGQSAQVFTHVRRSTSGWPSAVRPMNSFCSRPFTRLSTRTLLWTLCQT

SEQ ID NO: 57684 - protein, 362 aa, Glycine max
  misc_feature (163)..(163): Xaa can be any naturally occurring amino acid
MLKNQPQPDWPEPIVRVQSLSENCEDSIPERYIKPSTDRPSIKSCNFDDANIPIIDLGGLFGADQHVSASILKQISDACKEWGFFQVTNHGVNPDLMDKVRETWREFFHMPMEVKQQYANSPKTYEGYGSRLGIEKGAILDWSDYYFLHYLPFSLKDYNKWPXASPPSCREVPDEYGRELVKLCGRLMKAFSINLGLDEKILQNDFGGEDIGACLRVNFYPKCPRPELTLGLSSHSDPGGMTMLLPDDQVPGLQVRKCDDWVTVKPAKHAFIVNIGDQIQVLSNAIYKSVEHRVIVNSDKERVSLAFFYNPKSDIPIEPIKELVTPKRPSLYPAMTFDEYRLFIRMRGPRGKSQIESLKSPR

SEQ ID NO: 57685 - protein, 515 aa, Oryza sativa Japonica Group
MATSFVYLAIFACLAWAGTALLYWAHPGGPAWGKYRRARGQSPRCSIPGPKGLPVVGSLGLMSGLAHCSLAAEAARRPGAKRLMALSLGPVRAVVTSHPDVAKEILDNPAFADRPLNHAAYGLMFHRSIGFAEHGPYWRALRRVAAGHLFGPRQVDAFAPYRARVAGGVVAALRGAGGEAAVQVRGVLRRASLYYIMRFVFGKEYDVSRGAPESGEEVEELLEMVHEGYDLLGKENWCDYFPGLAAVDPQGVGARCAELMPRVNRFVRGIIQEHRGKAIAGGEARDFVDILLSLQESEGLADADIAAVLWEMIFRGTDAMAVLMEWTLARVVLHPDVQANVHRELDAVVGRSNTVAESAVPSLPYLQALLKEALRMHPPGPLLSWRHRAISDTYVDGHLVPAGTTAMVNQWAMSRDADVWDAPLEFQPERFLPGGKAHGVSVLGADGRLVPFGSGRRSCPGKSLAMTTVTAWMATLLHEFEWTPASGAVDLSEVLRLSCEMAVPLEVRVSARRNV

SEQ ID NO: 57686 - protein, 243 aa, Synechococcus sp. WH 7803
MRKPVIAGNWKMHMTCAQTRDWMGTFLPLISETPDDRHLVIAPPFTAISTLADVGAGSRVEISSQNVHWEGHGAYTGEISPAMLQEHGVRYAIVGHSEPRKYFSESDEQINHRARSAQAHDLIPIVCVGESDEQRSRGEAERVIRRQVEQGLEGLDPQRLVVAYEPIWAIGTGKTCESAEANRICGLIRSWVGSPDLIIQYGGSVKPANIDELMGMSDIDGVLVGGASLDPEGFARIANYKKG

SEQ ID NO: 57687 - protein, 954 aa, Oceanicola granulosus HTCC2516
MSTLVAPPPALSEAEIAALVARHWGLSGRLRPLPSERDQNTRLSCEAGEYVVKIANPAEPPEETAMQVAVLEHLAGEGVPGLPRIRPTLTGSATVRVDVGGRMAQARLVSWIAGVPLAQSPRSQAQLRALGSYMGRVTAGLQGFVAPAAHRPEFLWSLDHVAALRDFVSDIKDPSRRGMVEGLFARHAERVAPRLAGLRASVLHQDANDHNVITDPDHPERIVGLIDFGDMCQGRTVNELAVTIAYAMLDTDAPLAAARAVIEGFHAAFALTEDEAELVMELALIRLAASVCISSVQAAERPETRYLLISQAPAFATLELLHDLPADLLGALGRVAAGFEPMPGAAARLASLGEAAPLIAPGLARLPRKAPGTERAPDVHGGCTVPVADDLPVLGLTGWGSEAPDGRRRLGLGMEVPEGTPLLATHAGRILRRNGDALVQEIAPGLFLGLAGLAPEVAEGDALAPGDRLGRATGALDLQLMHGLPDLRPRSAAPGEWALWSALRPDPNLLLGLEPESFVPPAEPPEALLARRRERIGPSLSLSYRHKLTMLRGRGAWLADHTGRHWLDTVNNIAHVGHEHPRVVAALAAQAATLNTNSRYLHPLMVSYAERLTATLPAPLEVAYFVNSGTEANELALRIARTALGRKETLVLDWAYHGNSGGTVEISPYKFRRAGGFPQPRFLEVAPFPDPYRGAHRGPDSAPAYAAGLAARLDALEARTGSGAAAFIAESASGVGGQVFYPEGYLARAYEEVRARGGLCIADEVQCGMGRIGSHFWAFEAQGVVPDIVVIGKPIGNGHPMAAVVTTRALAEAFDNGMEYFNSFGGNPVSMAVGHAVMDVLEDEGLQAQAALTGAHLLAGMAKLAERHPVIGDVRGAGLFLGMELVEDRDSRAPATRAAAELVHRLYLRGILASTDGPDDNVLKIKPPMVFGRAEADLLLDEIGRALSHLYPQD

SEQ ID NO: 57688 - protein, 194 aa, Triticum aestivum
MRSPVPAMLTAPSAAAAVAKPLPAARSNTTAAALHATAASSRRDVIAGTGVGAALLLALWPQRARAASDDEYLAETTEVIGKVRSTISMDKTDPKVADAVTELREMSNSWVAKYRREKALLGRQSFRDMYSALNAVSGHYISFGPTAPIPNKRRIRILEEMDAVEKSLKRGRSRGSLEGAKLTRTQLFCTKWAL

SEQ ID NO: 57689 - protein, 126 aa, Listeria monocytogenes str. 4b H7858
MEQTYVMVKPDGVERGLIGEIVTRIEKKGLKIVAGKLMQIDRELAEKHYAEHIGKSFFEDLIGFITSGPVFAMVLEGDDAIATARRMMGKTNPLEADPGTIRADYAVHTNRNVIHGSDSPESAKRE

SEQ ID NO: 57690 - protein, 227 aa, Synechococcus sp. WH 5701
MSTKPLVIAPSILSADFARLGDEVRAVDEAGADWIHVDVMDGRFVPNITIGPLIVEALRPVTSKPLDVHLMIVEPERYVGDFAKAGADHIYVQVEACPHLHRNLGQIKDLGKKAGAVLNPGTPLETLEYCLELCDLVLIMSVNPGFGGQSFIPSAVEKVRRLRRMCDERGLDPWIEVDGGLKANNTWQVVEAGANAIVAGSAVFNAPDYRAAIEGIRHSRRPAAVLA

SEQ ID NO: 57691 - protein, 1030 aa, Cryptococcus neoformans var. neoformans JEC21
MRFSSRDEEPEDGEVVEDDAVWKNPLATTKYLKGAPSVSSSQKTSSYKKSRPSFIPSLDPADDDGHRPRRPPPPSLSSPPYQQSRHRSSSHNRKTISYEDEERGSGMQHALPKNPQTRQYPHSTEMREPEQRREDKYAKEPRSPHRREGYYSSRRGDGRDYPPQLDRERYGPARRLESGGDGGYGDRSRDRNMDRGGYRDKDDRRSYGRPSDSSAWGRPPREEYRDRRPEEFARHPTGERYREDSRERFPVDRDTGQRRSCSPVRIRSPERSSDRPLTPVPDNGRTSSPDHGAKNIASSRGHRSSPSHSSNHEDHNGEKGNGPIKLNRNRHRPSLPLKHISTQPPRSPSAPPPPPPPDPSTVPPSPTEPPPPMPGNLSLEQTVPHAPNPRAQMATRPPSPKREEGEIRQETESVVFKFKLWTAEEELKALGKNFGGSSTLMRYNMGTKLGEGTFGVVTKAVENDTKRAVALKKITQHNFRDGAHITTLREIKILKSLQHPNVVPLLNMVISRHDNHSENTFIKNEVFMVFPYMDHDLCGLLSNNDFKVNHSGAKCIMKQLLDGMAYIHSNNIIHRDIKTANILVDKHGQIMIADFGLARPWTDNKKMPPHLATEYTNMVVTRWYRAPELLLGWCNYGPAVDIWSIGCVLGEMYLRRPILPGGGDREQLSMIFAKCGPLNEETWSGWQDLPGFPEAHGFAWDKTPRDTSILEESKSWHMDRGGADLLVKLLSLDPSKRPTASEALDHPWFWVSPKPAETINLDFAASHEMSAWHKQPAAAPVQPPPQKAYQTQQAYQSQQTHHAQQIYQPQQPYVAYQSGYGNQQRGHGGYQQQTANATRHNLAMNPYASSQVGNAQGYNQQPYMQAQGVSNMPPGADAYGGINPYGAPVAYNTASLPPPNMAYNGQSSFNGGGGLTGGGGQQYSLPHQSYLPPGPPPMMHGNVNRPSRPPPPTSSEGRPLAAAPFPLAGGGGGGGGMKTFAPPPPFSLAGGGGGGRGGMPPTMKRPPSDSRRDFGGDHKRQRTEAPLPYD

SEQ ID NO: 57692 - protein, 145 aa, Triticum aestivum
  misc_feature (15)..(15): Xaa can be any naturally occurring amino acid
  misc_feature (89)..(89): Xaa can be any naturally occurring amino acid
MASSMISSPAVTTVXNRAGAGMVAPFTGLKSMAGFPTRKTNNDITSIASNGGRVQCMQVWPPVGKKKFETLSYLPDLDDAQLAKEVEYXLRKGWIPCLEFELEHGFVYREHNRSPGYYDGRYWTMWKLPMFGCTDASQVLKELQE

SEQ ID NO: 57693 - protein, 436 aa, Synechococcus sp. WH 5701
MHIAVVGLSHRTAPVEIRERLSIPEQTMEESLQNLRGDSQVLEASILSTCNRLEIYTLLRSPEQGIHAVGSFLSQHSGLDFGELTPHLFTYHHEEAVAHLLRVAAGLDSLVLGEGQILSQVKKMVRLGQEHGSIGPILNRLLNQAVSTGKRVRSETNLGTGAVSISSAAVELAQLKVGQARGLDELVPLDQEQVAVVGAGRMARLLLQHLQAKGCRGLVLLNRTAERAEALAADFPEFPVQCRPLSDLDHCLSTCSLVFTSTGAEEPIIDAGRLSGLNRRSSLMLIDIGVPRNISADVSHLGGVDAFDVDDLQEVVTRNQEARRDIAVEAEGLLQEEARQFLEWWDGLEAVPTLNRLRQQLEQIREQELQKALSRMGPDLSARERKVVEALSKGIINKILHSPVTNLRAPQPRQQRHQAMQVLHQLFALDGEDEES

SEQ ID NO: 57694 - protein, 478 aa, Glycine max
  misc_feature (249)..(249): Xaa can be any naturally occurring amino acid
MVEYASRTNLSYCRDYGIEEDSIDDMPLKSDPECYDDDGHLKRTGTIWTTSSHIITAVVGSGVLSLAWAIAQMGWIAGPAVMILFSIVTLYTSSFLADCYRTGDPMFGKRNYTFMDAVSTILGGYSVTFCGIVQYLNLFGSAIGYTIAASLSMMAIQRSHCIIQSSDGENQCNISSIPYTICFGAVQIFFSQIPDFHNMWWLSIVASVMSFTYSIIGLVLGITKIAETGTFKGSLTGISIGTVTEAQKXWGVFQALGNIAFAYSYSFVLLEIQDTIKSPPSEVKTMKKAAKLSIAVTTTFYMLCGCVGYAAFGDSAPGNLLAGFGFHKLYWLVDIANAAIVIHLVGAYQVYAQPLFAFVEKETAKRWPKIDKEFQISIPGLQSYNQNIFSLVCRTVFVIITTVISTLLPFFNDILGVIGALGFWPLTVYFPVEMYILQKRIPKWSMRWISLELMSVVCLLVTIAAGLGSVVGVYLDLQ

SEQ ID NO: 57695 - protein, 431 aa, Synechococcus sp. WH 5701
MKRVLAIILGGGAGTRLYPLTKMRAKPAVPLAGKYRLIDIPISNCINSGINKIYVLTQFNSASLNRHLTQSYNLSAGFGQGFVEVLAAQQTPDSPTWFEGTADAVRKYQWLFQEWDVDQYLILSGDQLYRMDYSRFVDHHIQSGADLTVGALPVDAEQAEGFGLMRTDLDGRIREFSEKPKGAALEAMKVDTARLGLAEAEATRRPYLASMGIYVFSRDTLFDLLAQNPGSTDFGKEIIPTALGQGDNLRAYLFDDYWEDIGTIGAFYEANLALTDQPRPAFSFYDEKFPIYTRPRYLPPSKLLDAQVTQSIIGEGSLLQDCSIHHCVLGVRSRIESEVVLQDTLVMGADFFESSEERAVLRERGGIPVGVGRGTTVRRAILDKNVRIGRNVTIVNKDGIEEADRPELGFYIRNGIVVVEKNATIADGTVI

SEQ ID NO: 57696 - protein, 472 aa, Synechococcus sp. WH 5701
MSKAHFGLIGLGVMGENLVLNAERNGYSSVVFNRTYAKTEDFLKGRAAGLNIIGAHTLEEFVGALERPRRILMMIKAGSPIDAMIAQISPLLEDGDLLIDGGNSLYTDTERRVKELESQSFGYIGMGVSGGAKGALEGPSMMPGGTKAAYDAIEGLVRKMAAQVDDGPCVTYIGPGGAGHFVKTVHNGIEYGIEQILVEAYDLMKRCAGMDGLAMAQVFDGWNQLEELSSYLVEITEVCLRTRDPEDGGDLVEKILDVAGQKGTGLWTVVSALEMGVPVPTIYAALNARVMSSLHSERLAAASVIDAPAAAAAVSLGEPSKGMPALRDAITLACIASYAQGMALMVEASALHEYHLNLSSIAQIWKGGCIIRAKLLQRIQNAYDTNPDLANLMVDPWFAEQVNARLSGLRQVVAGAALAGIPVPCLSSTLDYIDSYRTARLPQNLLQAMRDCFGAHTYQRVDREGSFHTEWL

SEQ ID NO: 57697 - protein, 301 aa, Sinorhizobium meliloti 1021
MDRVRTVRKAVIPVAGNGTRFLPATKAVPKEMLTIVDRPVVQYAVDEARQAGIEHIVFVTSRNKQVIEDHFDDAPELISSLSRSGKSAQISELEAMLPAAGSVSFTRQQAPLGLGHAVWCARDLIGDEPFALLLPDMVSFGARGCVAGLMDLYHEVGGNVVGVEQCAPEEASKYGIVGKGETVRHGFSVTEMVEKPAAGKAPSNYYLNGRYILQPEIFSILAHQTRGAGNEIQLTDGMLTLSQSQSFHAHPYEGRTFDCGSKQGFIEANVAFALARADIGDIVFESVRDMVLSHESRIRAA

SEQ ID NO: 57698 - protein, 456 aa, Haemophilus somnus 2336
MTKHYDYIAIGGGSGGIASINRAASYGKKCAIIEAKYLGGTCVNVGCVPKKVMFYGAQVAEAIAKYAPDYGFDVTLNHFDFAKLVESRQAYIDRIHTSYNNVLAKNNVDVLNGFAKFFDAKTIEVSYANGEKELVTADHILIATGGRPSRPTIPGAEYGIDSDGFFALTELPKRIAVVGAGYIAVELAGVVNSLGAETHLFVRRQTPIRSFDPLIIETLVEVMKQDGIQLHTQAIPQEIIKNADNSLTIKLEDGRTQDVDCLIWAIGREPATDVINLASTGVETNERGFIKVDKYQNTNVEGIYAVGDIIEGGIELTPVAVAAGRRLSERLFNNKPDEHLDYHLVPTVVFSHPTIGTVGLTEPKAIEQYGAEAVKVYTSSFTPMYSAVTSHRQPCRMKLVCVGKEEKIVGLHAIGFGVDEMIQGFAVAIKMGATKADFDNTVAIHPTGSEEFVTMR

SEQ ID NO: 57699 - protein, 127 aa, Oryza sativa Japonica Group
MAAAARFLAVLLLVLAVAAASSAAASLAGGGDRHLQLGMLSTGGECRGTVGECLEGGDVDGEEGELGSASGEAHRRVLAGRGYISYQSLRRDSVPCSRRGASYYNCRPGASANPYHRGCSRITRCRG

SEQ ID NO: 57700 - protein, 200 aa, Streptomyces avermitilis MA-4680
MGSYTIPNVVERTPQGERSYDVFSRLLSERIIFLGTEIDDGVANVVIAQLLHLESANPEHEIAIYINSPGGSFTSLMAIYDTMTFVQAPISTFCVGQAASTAAVLLAGGDPGRRFVLEHARVLLGQPASGGRQGTVSDLSLQAKEMIRIRSQVEEVLSRHTRHDIATLRADMDRDKVFTAQEAVAYGLADEVLSRRLAVV

SEQ ID NO: 57701 - protein, 533 aa, Bifidobacterium longum DJO10A
MAIEVQGLEIQIGARTLLHPTNFHVAKGDKIGLVGRNGAGKTTLTRVITGDMLPTAGKVRVSGKLGYLPQDTHASDPTQTALDRMMSARDIATIINRIRKAEKDMTDPDPDVMSKAMTRYDKAMQDFDKAGGYAAQSEAISMAASLGLPQEVMEQQLGTLSGGQRRRIELARILFSNADTLILDEPTNHLDADSIEWLRGYLKKYEGGFLVISHSTELLDEVVNKVWHLDAQLGQIDMYSLGWKAYLHQRVVDEERRRREREVAEKKADRLMKQGIRLHAKATKAVAAQNMMRRAEKLLENTSEAQKAEKVADIRFPEPAPCGRTPIMAKDISKAYGSNIVFAGVNLAIDKGSRVVILGYNGAGKTTTLRLLAHIEEPDTGSVEYGHGCKIGYFAQEHDTLDLNATVLENLQHVAPELDNTQARSILGSFLFSGDDAMKPAHVLSGGEKTRLALATLVTSRANVLLLDEPTNNLDPASREEILKAIAKYEGAIVLVTHDEGAVEALNPERVLLMPDGDEDLWNDSYLELVAEE

SEQ ID NO: 57702 - protein, 219 aa, Sinorhizobium meliloti 1021
MSLRINDTAPDFTAETTQGTINFHEWIGDGWAVLFSHPKNFTPVCTTELGAMAGIEPEFRKRGVKIIGISVDPVESHSKWKNDIKVATGFEVDYPLIGDRDLKVAKLYDMLPAGAGETSEGRTPADNATVRSVYVIGPDKKIKLILTYPMTTGRNFNEILRAIDSIQLTAKHQVATPANWQQGEDVIITAAVSNEDAVQRFGSFDTVLPYLRKTKQPTA

SEQ ID NO: 57703 - protein, 396 aa, Ashbya gossypii ATCC 10895
MAKATSAKKVSKKEMKKKEEAAAAAAAASSSSSSSSSESESGSSDESSDESSDSSSDNSSSSNSSSDSSSSDSSDSESSSSSDSDSSDSEEETKNSTSSSSSSDSEAEEKEKSASSKSSSSSSSESSSDSESSASDNEGSKEESKKRSAESEDDAVAKKQKTDGQPATIFVGRLSWSVDDEWLKTEFDHIGGVVGARVIYERGTDKSRGYGYVDFEDVSYAEKAVKEMHGKEIDGRAINCDMSTSKPASAPREDRAKKYGDTPSQPSDTLFLGNLSFNADRDALFELFSKHGNVISVRIPTHPESNQPKGFGYVQYGSVEEAQAALDALQGEYIDNRPVRIDFSSPRPPQQGGATRGRGGFRGGRGGGRTGSGANNAPLGKPRQSAAFKGTKKTFD

SEQ ID NO: 57704 - protein, 553 aa, Methanocaldococcus jannaschii DSM 2661
MEEKILPIALRNAIKYNGKANPKAVLGIFLSENPEYRSKAKEVMPIVEKVVEEVNKLSLDEIKKKLEELGEDVKKKEKKEKGLELPNVKDKVVMRFAPNPSGPLHIGHARAAVLNDYFVKKYGGKLILRLEDTDPKRVLPEAYDMIKEDLDWLGVKVDEVVIQSDRIELYYEYGRKLIEMGHAYVCDCNPEEFRELRNKGVPCKCRDRAIEDNLELWEKMLNGELENVAVRLKTDIKHKNPSIRDFPIFRVEKTPHPRTGDKYCVYPLMNFSVPVDDHLLGMTHVLRGKDHIVNTEKQAYIYKYFGWEMPEFIHYGILKIEDIVLSTSSMYKGIKEGLYSGWDDVRLGTLRALRRRGIKPEAIYEIMKRIGIKQADVKFSWENLYAINKELIDKDARRFFFVWNPKKLIIEGAEKKVLKLRMHPDRPEFGERELIFDGEVYVVGDELEENKMYRLMELFNIVVEKVDDIALAKYHSDDFKIARKNKAKIIHWIPVKDSVKVKVLMPDGEIKEGFAEKDFAKVEVDDIIQFERFGFVRIDKKDNDGFVCCYAHR

SEQ ID NO: 57705 - protein, 361 aa, Mycobacterium tuberculosis H37Rv
MSQTVRGVIARQKGEPVELVNIVVPDPGPGEAVVDVTACGVCHTDLTYREGGINDEYPFLLGHEAAGIIEAVGPGVTAVEPGDFVILNWRAVCGQCRACKRGRPRYCFDTFNAEQKMTLTDGTELTAALGIGAFADKTLVHSGQCTKVDPAADPAVAGLLGCGVMAGLGAAINTGGVTRDDTVAVIGCGGVGDAAIAGAALVGAKRIIAVDTDDTKLDWARTFGATHTVNAREVDVVQAIGGLTDGFGADVVIDAVGRPETYQQAFYARDLAGTVVLVGVPTPDMRLDMPLVDFFSHGGALKSSWYGDCLPESDFPTLIDLYLQGRLPLQRFVSERIGLEDVEEAFHKMHGGKVLRSVVML

SEQ ID NO: 57706 - protein, 439 aa, Flavobacteria bacterium BBFL7
MAKFELKLPKMGESVAEATITSWLKNVGDTIEADEAILEIATDKVDSEVPSEVDGTLVEVLFQVDDVVQVGQTIAIIEIDGDGASTPAPATTETAAPAASTVETANAQVEKGIETAAPVDYSGSDSFYSPLVKNIAKEENISLQELESINGTGSNGRVTKNDILSYVADKKAGKTTTAAAPQTKTTAPASAPVQKPAAPVSVNGGDEIIEMTRMGKLISHHMIASVQTSAHVQSFIECDVTNIWNWRKKHKDVFAKREGENLTFTPIFMEAVAKALKEFPMMNIAVDGDNIIKRKNINLGMAAALPDGNLIVPVIKNADQLNLMGMAKAVNDLARRSRDGKLKPDDTQGGTYTVTNVGTFGSVLGTPIINQPQVGILALGAIRKVPAVVETPQGDFIGIRMKMFLSHSYDHRVVNGALGGQFVQRVAQLLEGFDDKREI

SEQ ID NO: 57707 - protein, 138 aa, Ehrlichia canis str. Jake
MSYSEVLLEHYKNPKNVGTLPKDDYNVGTGLVGAPSCGDVMKLQIKVDNNGRIIDAKFKTFGCGAAIAASSLATELIKGKTVDEAHQLKNTVLAKELSLPPVKIHCSLLAEDAIKAAINDYNMKQENRKSNTAFSSDE

SEQ ID NO: 57708 - protein, 422 aa, Ehrlichia canis str. Jake
MSLTLSVIGNKMGREGQIHINLPVFLDYQSTTKTDDRVLEAMIPYFQQFSNPHSRSHSFGWKAESAVELARERVASLINAEPKEVIFTSGATESNNLAVKGVANFYKNKGNHIITVRTEHKCVLDSCRHLETEGFNVTYLDVQKNGIINLDLLKSYITDKTILVSVMMVNNEIGVIQPVEEIGKICHEHGIFFHTDAAQAFGKIPIDVNKMNIDLLSISGHKIYGPMGIGALYIRKRQPRVRLTPLINGGGQERGMRSGTIPTPLAVGLGEAARIAQEVMEEENIRIKELRDILYNEIKKHLSYVVLNGDYEQRISGNLNLSFPYVEGESIIMAINNLAVSSGSACTSASLEPSYVLRALNIEKDLEHSSIRFGIGRFTTKEEILYAAELIVSSIKKLREMSPLWEMVQEGIDLNNIKWDTH

SEQ ID NO: 57709 - protein, 582 aa, Triticum aestivum
  misc_feature (549)..(549): Xaa can be any naturally occurring amino acid
MQPDQNQQRRKGSSEMDFFSEYGDANRYKIQEVIGKGSYGVVCSAIDQHTGDKVAIKKIHNIFEHLSDAARILREIKLLRLLRHPDIVEIRHIMLPPSRRDFKDIYVVFELMDTDLHQVIKANDDLTKEHHQFFLYQMLRALKYIHTANVYHRDLKPKNILANANCKLKICDFGLARVAFNDTPTTVFWTDYVATRWYRAPELCGSFFTKYSPAIDIWSIGCIFAEILTGKPLFPGKNVVHQLDLMTDLLGTPSLDTVSRIRNEKARRYLSSMRKKQPVCFSERFPKADPAALKLMQRLLAFDPKDRPTAEEALADPYFKGLPRVRREPSCQPISKFEFEFERKKVTKEDVKELIFREILEYHPQLLKDYMNGTEKTNFLYPSAVDNFRRQFANLEENGGKGGAIVPSDRKHVSLPRTTTVHSTPIPPKDQKSSQVPQRIPTGRPGRVVGPVIPFENSCAMDPYSQRRVARNPVLPAAATNVSAYAYHRKSDSSERELQQELEKDRMQYQPMQRFMDAKMVSPDLRSTSYYMPKGVPKADVAERTGLQXNMMQGIAPFNGIAAVGGSYNKASAVQYGVSRMY

SEQ ID NO: 57710 - protein, 533 aa, Ehrlichia canis str. Jake
MLITTRLRYAVMFMVSLAQEYYILKGSNQPKKMSHIADSQSLSEGYLEQIIAKLKKQGLVNSTKGPGGGYFLNKSPNIITLNLILESIGENIKITRCKNNNVIRCLPNNAKCITHNLWDNIGNYIKKYLNSISLEDIINNNFKHSIKHSIKHSNILNNDENKYIYADYNSTSTILPVIKQQLDNLSSLNIYNPSSTHKLGQNTRSIIEKTREIAINILNARNYDVIFTSSGTEANNLVINSTTEYKHLISSIEHVSIMNCTTDAELIPVNSNGVICLDRFSETLNKFKDKKVLVSIMTANNETGVIQPIKEIVEISHKFGALVHTDAVQACGKIHIDIENLGVDLLTISSHKLGSIAGTGVLFFNSKKIKIKPMILGGNQEKGLRAGTENIISIYLLSISLNNLKDSIKKMSTVEKLRDKLEYEILNLVPEAQIFGKNTQRLPNTTCISMPNVSSEIQTISFDIENIAVGNGSACSSGTLTRSHVLSAMGIDDDIAKNSIRISLSPDITEHQIKKIVNCWYKTYQNNKLLKLK

SEQ ID NO: 57711 - protein, 350 aa, Malus x domestica
MGSMEQTILVTGGAGFIGSHTVVQLLEAGFRVSVIDNLDNSVAEAVDRVRDLVGPKLSQKLHFQLGDLRNKDDLEKLFSQTKFDAVIHFAGLKAVGESVAHPHRYYDNNLVGTINLYAVMAKYNCKKMVFSSSATVYGQPEKIPCVEDFNLVALNPYGRTKLFLEEIARDMHNADPDWQIILLRYFNPVGAHESGKIGEDPKGIPNNLMPYIQQVAVGRLPELNVYGHDYPTKDGTAIRDYIHVMDLADGHIAALQKLFTTENIGCAAYNLGTGQGTSVLEMVAGFEKASGKKIPIKLCPRRSGDATAVYASTEKAERELGWKAKYGIEEMCRDQWKWAVNNPHGYKSKY

SEQ ID NO: 57712 - protein, 354 aa, Porphyromonas gingivalis W83
MNFRRHILITGGAGFIGSHVVRLMVNAYPDYEIINLDTLTYAGNLANLKDIESKPNYRFVKADICNANTLKKVFAHYAIDGVIHLAAESHVDRSIKDPLAFARTNVMGTLTLLQTAKEAWHGEYEGKRFYHISTDEVYGALAFDGTLFTEETKYDPHSPYSASKASSDHFVRAYHDTFGLPTVISNCSNNYGPYQFPEKLIPLFINNIRHNKPLPVYGKGENVRDWLYVEDHARAIDLIFHRGKNGDTYNIGGFNEWKNIDLIKVMIRVVDRLLGREEGSSEKLITYVADRAGHDLRYAIDSTKLKNELGWEPSLQFEEGIEKTVRWYLHNQDWLDRVTSGDYLRYYDEMYSER

SEQ ID NO: 57713 - protein, 180 aa, Glycine max
EFPHIPPIPSDSGITFNEQPLMIALQIAEKARDAILSGKFDQVRVNLPNGDMVGHTGDIEATVVACKAADAAVKMILDAIEQVGGIYVVTADHGNAEDMVKRDKSGKPLLGKDGKIQILTSHTLEPVPIAIGGPGLAPGVRFRNDVPTGGLANVAATVMNLHGFEAPSDYETTLVEVVDN

SEQ ID NO: 57714 - protein, 363 aa, Prochlorococcus marinus str. MIT 9312
MLKAGIIGLPNVGKSTLFNALVENAKAQAANFPFCTIEPNKGIVSVPDQRLQELGDLSSSQNIIPTKIEFVDIAGLVKGASKGEGLGNKFLSNIREVDAIIHVVRCFEDNDVIHVSGKVDPLDDIEIINLELNLADLSQLQKRRERIKKQVRTSKEAAKEDALLEKIEEELHKGLSVRSISLSEEENLIIKQLGFLTAKPIIYATNLNENDLAEGNDFSSKVQSFAGSENTECIKISAQVESELIELEPEDKKDYLIGLGVEEGGLSSLIRSTYKLLGLKTYFTTGEKETKAWTIKDGMTAPQAAGVIHTDFEKGFIRAQTISYQNLIDSGSIANAKTKGLLRSEGKEYIVNEGDVMEFLFNV

SEQ ID NO: 57715 - protein, 411 aa, Pseudomonas putida GB-1
MALIVQKFGGTSVGSIERIEQVAEKVKKHREAGDDLVIVLSAMSGETNRLIDLAKQITDQPVPRELDVIVSTGEQVTIALLTMALIKRGVPAVSYTGNQVRILTDSSHNKARILQIDDQKIRADLKEGRVVVVAGFQGVDEHGSITTLGRGGSDTTGVALAAALKADECQIYTDVDGVYTTDPRVVPQAQRLEKITFEEMLEMASLGSKVLQIRSVEFAGKYNVPLRVLHSFKEGPGTLITIDEEESMEQPIISGIAFNRDEAKLTIRGVPDTPGVAFKILGPISASNIEVDMIVQNVAHDNTTDFTFTVHRNEYEKAQSVLENTAREIGAREVIGDTKIAKVSIVGVGMRSHAGVASRMFEALAKESINIQMISTSEIKVSVVIEEKYLELAVRALHTAFELDAPARQGE

SEQ ID NO: 57716 - protein, 215 aa, Synechococcus sp. WH 7805
MTDSNPQTNPNDIPSAADVPAAAEGQQEQRRGGGGRGDRGDRRGGRRGDRRNQERDSEWQERVVQIRRVSKTVKGGKKMSFRAIVVVGNERGQVGVGVGKAGDVIGAVRKGVADGKKHLVKVPLTRHNSIPTLSNGRDGAASVLIRPAAPGTGVIAGGSIRTVLELAGIKNVLAKRLGSKTPLNNARAAMVALDSLRTHKETAKERGISLEQIYS

SEQ ID NO: 57717 - protein, 164 aa, Camellia sinensis
MLRLPENLLVVCHGSLGKAVPKTAENFRALCTGEKGVGKSGKPLHYKGSKFHRIIPSSMLQGGDFTLGDGRGGESIYGEKFADENFKLKHTGPGFLSMANAGPDTNGSQFFITTVTTSWLDGRHVVFGKVLSGMDVVYKIEAEGNQSGTPKSNVQIADSGELPL

SEQ ID NO: 57718 - protein, 514 aa, Catharanthus roseus
ARVNFSLTSPIFLLLSSLFLIILLNKLMRGNKIQKGKKLPPGPKKIAIIGNLPSNGRFTSLIVFLNNLAEKYGPIMHLRIGQLSAVIISSAEKAKEILNTHGVRVADRPQTTVAKIMLYNSLGVTFAPYGDYLKQLRQIYAMELLSPKTVKSFWTIMDDELSTMITSIKSEVGQPMILHDKMMTYLYAMLCRATVGSVCNGRETLIMAAKETSALSASIRIEDLFPSVKILPVISGLKSKLTNLLKELDIVLEDIISAREKKLLSQPQQPLMLDEEDMLGVLLKYKNGKGNDTKFRVTNNDIKAIVFELILAGTLSSAAIVEWCMSELMKNPELLKKAQDEVRQVLKGKKTISGSDVGKLEYVKMVVKESVRLHPPAPLLFPRECREEFEIDGMTIPKKSWVIINYWAIGRDPKIWPNADKFEPERFSNNNIDFYGSNFELIPFGAGRRVCPGILFGTTNVELLLAAFLFHFDWELPGGMKPEELDMNELFGAGCIRENPLCLIPSISTVVEGN

SEQ ID NO: 57719 - protein, 88 aa, Zea mays
SARDGFGDDQNPYTESVDLLEDLVIQYITEITYKAMEVGKTGRVTVEDIMYLMKKDPRKYTRVKELLLMNEELKKARKAFDEVKYAAL

SEQ ID NO: 57720 - protein, 271 aa, Azoarcus sp. EbN1
MARFDGFECMERKLVVGNWKMNGDLVSNQALFEQLVDRSPSSIDTALCVPFPYLAQGQRALSGSAIMLGAQNLSEFDAGAYTGEVSGRMLSDFDCRFVIVGHSERRTVFREDDQLVARKARAALAAGLVPIVCVGESLAERDAGQAEDVLLRQLEALVQLLDGASLARLVIAYEPVWAIGTGRAASPEQVQEILSFVRRWLSGHVGNSRAIRILYGGSVKADSAAALFSLPDSDGGLIGGASLVAQQFLEICEAAAKAAQDGNMGDFKGSR

SEQ ID NO: 57721 - protein, 164 aa, Triticum aestivum
  misc_feature (59)..(59): Xaa can be any naturally occurring amino acid
  misc_feature (75)..(75): Xaa can be any naturally occurring amino acid
  misc_feature (106)..(106): Xaa can be any naturally occurring amino acid
MFRGIFKGQCTKTKKKKNLAGMAALPRKVDSCQEFISLSKARGTFVIVMPEGTQDKVVXVNEGDSPALPLAVVTXCINTVEYVAELVMLLLVDACKGLRLGYSTQXELTGSIGMFSGSCTEFVGRVWHVKEVDEVKLVCIQHMSGMMNIFSGQKLCAFGRFCSP

SEQ ID NO: 57722 - protein, 172 aa, Synechococcus sp. WH 7803
MDLRQYVRDIPDFPKPGILFRDITPLLRDPAGWHEVIQRLVAVCDRWQPDLIVGIESRGFIVGTALATQLGKGFVPVRKPGKLPGEVIGIDYTLEYGSDRLEIHADALSDHPKVLLVDDLLATGGTASASAELVTKAGGELVGCGFVIELADLAGRAKLPEGVPVESLIIYG

SEQ ID NO: 57723 - protein, 455 aa, Pseudomonas putida GB-1
MQSNSLKQSLKQRHITMIALGGVIGAGLFMGSGSLIASAGPAAILSYFIGGLVVTLVMFMLGEMACRNPDAGSFSTYANTYLGDWAGFAVGWLYWFKSMMTITLEAVLLGAILHDFLPWLPIWAGAFLMLVTLMASNAYSVRSFAEVEYWLAAMKVATILIFMLLGLSILLGLHSDIPSPGLVNLTAHDGFMPNGLSPVMAGVIVVIFSLGGSEIAAVAAGESENPRQNVIRAIKSVILRVMLFYVGSVSILILCLPWTDKANLASPYVSLFSLAGFGGAAVAMKLVLFVSFMSVMNSFMFSNSRMLFSLSQRGHAPKLFSRTSAKGVPINALLLSLSICTLILTVHFVSGGDLFMTLAKSTGSLVMVVWIFIIIAHVAMRWKTRHEAIDPNAFRAWLFPYANIVALLALLTVIGTQAFEPASRFQFWFTVLTVLLVMAGYFVMRQRLTGKLATN

SEQ ID NO: 57724 - protein, 452 aa, Shigella flexneri 2a str. 301
MSHNVTPNTSRVELRKTLTLVPVVMMGLAYMQPMTLFDTFGIVSGLTDGHVPTAYAFALIAILFTALSYGKLVRRYPSAGSAYTYAQKSISPTVGFMVGWSSLLDYLFAPMINILLAKIYFEALVPSIPSWMFVVALVAFMTAFNLRSLKSVANVNTVIVVLQVVLIAVILGMVVYGVFEGEGAGTLASTRPFWSGDAHVIPMITGATILCFSFTGFDGISNLSEETKDAERVIPRAIFLTALIGGMIFIFATYFLQLYFPDISRFKDPDASQPEIMLYVAGKAFQVGALIFSTITVLASGMAAHAGVARLMYVMGRDGVFPKSFFGYVHPKWRTPAMNIILVGAIALLAINFDLVMATALINFGALVAFTFVNLSVISQFWIREKRNKTLKDHFQYLFLPMCGALTVGALWVNLEESSMVLGLIWAAIGLIYLACVTKSFRNPVPQYEDVA

SEQ ID NO: 57725 - protein, 278 aa, Brassica napus
MGSQAAVSFLTNIAKAAFGLGTAATVLSSSLYTVDGGERAVLFDRFRGVLDQTVGEGTHFLIPILQRPHVFDIRTKPHTFSSVSGTKDLQMVNLTLRVLSRPEVSRLPTIFQTLGLEYDEKVLPSIGNEVLKAVVAQFNADQLLTERPQVSALVRDSLIKRARDFNIELDDVAITHLSYGMEFSRAVEAKQVAQQEAERSKFVVMKADQERRAAVIRAEGESEAAQLISDATAKAGMGLIELRRIEASREVAATLARSPNVAYLPGGQSMLFNLNAGR

SEQ ID NO: 57726 - protein, 114 aa, Sonneratia alba
PVAEDMFHWQATIMGPPDSPYTGGVFLVSIHFPPDYPFKPPKVAFRTKVFHPNINSNGSICLDILKEQWSPALTISKVLLSICSLLTDPNPDDPLVPEIAHMYKTDRAKYETTA

SEQ ID NO: 57727 - protein, 1047 aa, Photobacterium profundum SS9
MGDIMRPVPFGELLNRMFSEYKESKSIFGIPSKQFYRKENAKSLSVWGEHCETPVGPAAGPHTQLAQNIVCSWLAGGRFMELKTVQKLDQLEIAKPCIDAEDECFNTEWSTEFTLVKAYDEYLKAWIALHLLEEVFDPRTEGEDKSFVFNMSVGYDLAGIETAPMQKYIDDMVDSSQHENFHAYVAELKTFINDPEFIKTYGFEHRLARLENLPASISTQLTRGVTLSTMHGCPPNEIEAICRYMIADKHINTFVKLNPTLLGYTRVRSIMDNAGFDYIALSEESFSHDLQIEPAKAMLHRLVDLGKEKGIGFGVKLTNTLGTLNKKGRLPDKEMYMSGRALFPLSINVALELSREFNGTLPISYSGGASKFNIKEIFETGIRPITMATDLLKPGGYLRLADCAKELETSSEWGMGKVDLVKLEALAAKSLVAEYTQKEWRGPEEISVKKALPLTDCYVAPCVTACPISQDIPEYIRLMGLSQYTEALEVIYSRNALPAITGHICDHQCQYNCTRRDYEGALNIREMKKVALAKGWEGYKAKWHAPDLDSEKHPIAVIGAGPSGLSAAYFMARAGHPVTVFEKEHNAGGVVKNIIPQFRIPAEVIQHDIDFVQDHGVNIEYGCNPHMTVDTLKSSGFKYVCLGIGADKGNPMSLTGDNTNVFKSLEFLRSFNDGEFTPSPEHAPMHTLGKHVAVVGAGNTAMDSARAALQVDGVETVTVLYRRTLAEMPAYKDEYDEAVEDGVKFMFLTNPEEFNADGTVVARVMKLGEPDEKGRRRPVATDETVELHVDALITAVGEQSNRDALTRIGIPMGEDGWPVVNSETGETSVENVFLMGDASTGPSSIVSAISGGRKAATTILAREAQNDELIAVKSDVQVDDIYARKGEIQVKLIEANTLEIDDHEAFIQQESQRCLECSYVCSKCVDVCPNRANISLPIPGFRDQFQTIHLDAYCNECGNCAQFCPWDSKPYKDKFTLFNLRDDFTNSTNAGFYIEGTEVLVRSEGEIYTFSINEQSELDMPESLADEATIISYVHAHHSYLLGKVDV

SEQ ID NO: 57728 - protein, 250 aa, Nicotiana tabacum
MVRIAFGSIGDSFSVGSLKAYVAEFIATLLFVFAGVGSAIAYNKLTADAALDPAGLVAVAVAHAFALFVGVSIAANISGGHLNPAVTLGLAVGGNITILTGFFYWIAQLLGSTVACLLLKYVTNGLAVPTHGVAAGLNGLQGVVMEIIITFALVYTVYATAADPKKGSLGTIAPIAIGFIVGANILAAGPFSGGSMNPARSFGPAVVAGDFSQNWIYWAGPLIGGGLAGFIYGDVFIGCHTPLPTSEDYA

SEQ ID NO: 57729 - protein, 114 aa, Sonneratia caseolaris
PVAEDMFHWQATIMGPPDSPYTGGVFLVTIHFPPDYPFKPPKVAFRTKVFHPNINSNGSICLDILKEQWSPALTISKVLLSICSLLTDPNPDDPLVPEIAHMYKTDRAKYETTA

SEQ ID NO: 57730 - protein, 303 aa, Haemophilus somnus 2336
MALIKEIKMKVIIPVAGLGTRMLPATKAIPKEMLTLVDKPLIQYVVNECVNAGIKEIVLVTHSSKNAIENHFDTSFELETMLEQRVKRQLLDEVRSICPTGVTIMHVRQGNAKGLGHAVLCGRAIVGKEAFAVVLPDVLLAEFDSNQKTENLAAMLKRFKETGNSQIMVSPVPDKDISSYGIVDCGGVTLNVGESVKISNIIEKPSFEDAPSNLSVVGRYVFSATIWDLLEKTPVGVGNEIQLTDAIGMLIEKEIVEAFHMTGKAFDCGDKIGYMQAFVEYGLQHPQLGENFKTYLKQLVQDL

SEQ ID NO: 57731 - protein, 185 aa, Oryza rufipogon
FGSVYRGRLSIKGTVTEAAVKQLDRNGMQGNREFLVEVLMLSLLAEHPNLVTLLGYCTDGDHRILVYEYMARGSLEDHLLDLPPGAAALDWTTRMRIAQGAARGLEHLHDAARPPVIYRDFKASNILLDSSLQARPSDFGLAKVGPVGDRTHVSTRVMGTYGYCAPEYALTGKLTTCSDVYSFGV

SEQ ID NO: 57732 - protein, 424 aa, Bartonella quintana str. Toulouse
MGVDISRLSNGLTIATHTMQQIDSVALGIWVKVGSRNETFSQHGIAHLLEHMAFKGTENRTAFQIATDIEDVGGEINATTSTETTAYFARVLKNDIPLAIDILADILMYSKFDEDELEREKQVVFQEIGAARDIPDDIVFDHFTETAFRHQSLGRSILGTPKTVQSFTSADLHSFMDKQYSADRMIVVAAGAVEHENFLQEVESHFRTFRPHSIAPLTNLANYVGGDFREYRDLMDTQVVLGFEGRAYHARDFYAAQILSIILGGGMSSRLFQEVREKRGLCYSIYAFHWGFSDTGLFGVHAATGQEGLKELLPVILDELSKASKNIHANELQRARAQYRASLTMSQENPSSQANLIARQMLLYGRPIPLSETIERLELITPARLTDLAHRLFINSTPTLAAVGPVGSLMNFDDLTSTLSPNIK

SEQ ID NO: 57733 - protein, 1008 aa, Sinorhizobium meliloti 1021
MTTSEFKNVQGIAAIEALLAAEYGIAGEILALPGEHDLNFRIQASDGRAFLLKLHALGAPEELDMQIAVLDHLAREATELPVAKVLPSRSGASFTRVEFNGERVARLLTWLPGETWARAANRSSNSVETLGALLGKLDRSLAGFSHPGARREYAWDIARAEMHLANVDLIEGMEKRRAVRAILEHFVSTVLPRLKACPRQVIHNDANDYNVLVGADGCVSGLLDFGDMVESNRVVEVAVASAYALIGSPDPIGAIARLAGGYHGVNPLGETEAELIFDLVRTRYAVSMCMAARQIRDNPENTYLLVSQEDVWRELRRLEQENRPLAIARLRDACGFAPIPKAARVVRWLESNAHEFSGVIKPGIARPKPAVFDFSANSSETWAGLDKDVAQARIEAHIHAEGADFGLGLYGEDRAVYKGDAYQATTSLRRTIHLGIDLFAPANEPVHAPFAGKVAFYHDDAVPYGFGPTILLEHRTGEGDAFWTLYGHLSRESASRLSIGQPVARGEAFAAMGNRAENGGWVPHLHFQIVTDYLGLEGRMHGVGVKEQWQVWREISPDPSVVLGLSVPASVIVERDKAFLVRERQRRIGRSLSIAYGSAPLKIVAGEGAYLIDDEGTRWLDMVNNVCHVGHCHPRVVKAAQMQMARLNTNSRYLHDSLVEYSRRLAALFPDPLNVCFFVNSGSEANDLAIRLARAYTGNRDVITVDHAYHGHLTSLIDVSPYKFAGKGGEGRPAHVRVAEMPDLYRGRYRYGDTDVGRKYAEDVKRQIDALAAEGRKPALFFSEGILGTGGQLVLPEGYLRGAYAHVRAAGGLCLADEVQVGFGRVGSHMWAHETQGVVPDIVTMGKPIGNGHPMAAVVTTEAIAAAFANGMEYFNTFGGNPVSAEIGLAVLDIIRDERLMHHCAVVGNRLMDGARELASRHTIIGDVRGYGLFNGIELVRDRDTLEPAAAELDFVIAEMKDRHRILLSSEGPQHNVLKIKPPAPFSADDCDRFLEALDAVLAQVKAA

SEQ ID NO: 57734 - protein, 596 aa, Synechococcus sp. WH 5701
MAAAELRRQRWALLPLTALALLPLPAPADVLQEASQRFQPLWSAGGMVASQEVEASRVGRDVLRAGGNAVDAAVATSFALAVTHPQAGNLGGGGFLVLWRPERLSRGRPPQPQEVRVGKGRAVTINFRESAPQAAGPDLLLDASGAVDRRKATRSLLSSGVPGTVAGLLLAHRHYGHLPLGRLIAPSIRLAEEGVVVSKALADSLETAAPLLRTDPESARLFFRPGSQPYRPGERLRQPQLGATLRRIAAQGERGFYQGPVAQQLVALMRRRGGLINAEDLSSYRARLQPPLVGDWRGHPVIAMPPPSSGGVTLIQLLNILEGFDLASLGPNSAAVLHPMAEAMNLAYRDRNRWLGDPRFVAMPLERLLSQGYADELRRTIRPERHRPARDLDPPAEGRSAESLNTTHLSVIDRDGTMVSTTTTLNFPYGNGVSVPGAGFLLNNEMDDFTALPGAANAFGLVQGEANAIAPRKQPLSSMAPTLVLTPGGDPLLATGSPGGSRIITTVLQVLLNRLEHGLNLASAVAASRIHSQHWPDELAVEEGFSPDTLRLLEAKGHRWRLAPAMGAAHSLEALPGGGTLGAVDPRRAEGALAGE

SEQ ID NO: 57735 - protein, 353 aa, Physcomitrella patens subsp. patens
SNNELVVCFGELLIDFVPTVGGLSLADAPAFKKAPGGAPANVAVGIARLGGNAAFVGKVGDDEFGYMLVEVLKENRVETKACRFDPNARTALAFVTLRADGEREFMFYRNPSADMLFETKELDTDILKAAAILHFGSISLITEPSRSTHMEAMKVAREAGCLLSYDPNLRLPLWPSPEAAKEGIKSIWDEADIIKVVSDEEVVFLTGGDPTKDENNMRMFHPKCKLMLVTEGGEGCRYYTPKFRGKVGGIKVQVVDTTGAGDAFCAGLLSNLVKDPGLIDDEQRLREALKFANVCGAITTTERGAIPALPDRDTVMRMMSKLLIVHSDLFTFCCIVSMERRISNTWSTHITKE

SEQ ID NO: 57736 - protein, 393 aa, Glycine max
MYKNQLQELAQRSCFNLPSYTCIREGPDHAPRFKATVNFNGEIFETPHYCSTLRQAEHSAAEAALNSLSHRGPSHSLAAKILDETGVYKNLLQEIAQRVGAPLPHYTTYRSGLGHLPVFTGIVELAGITFTGEPAKNKKQAEKNAAMAAWSALKQLAKETASSSTEPENNDEVEQITIARALLNYRLKEKMTMSNPNAPLPFHERFQIQNPRPISSQPPPATSSKILPLICQKTAPRSKPSLATTTTNESPGSRHPQAAVAVTSDNSNLPQQSCSLECRATRPLKFPAAGAAPYVPIRQMRPSCQRIAPPVTIRTVVPAFAAPPASVPHPVIRAPPVRVAPPVTIRQAVPLYAAPKQQKDLPTANASGQQDKLPVKIQEMDKVENITPESNYA

SEQ ID NO: 57737 - protein, 499 aa, Brucella melitensis 16M
MAHGIASLAQREENNMGKVTGFLEIDRQVAKYQPASDRIRHFREFTIPMTDGEVQKQAARCMDCGIPYCHGPTGCPVHNQIPDWNDLVYNNNWDQAIRNLHLTNNFPEFTGRICPAPCEEACTLNLEDMPVAIKTVEQALGDKAYELGYIVPQPAASKTGKLVAIIGSGPAGLAAAQQLARAGHMVDVYERESRPGGLLRYGIPDFKMEKHLIDRRVAQMEGEGVRFHCGVNIGVDKPLRGLLDTYDAVLYCGGSETPRPAGIPGADLDGVHDAMPYLVQQNRRVGRENIESVAWASVPILAGGKHVVVVGGGDTASDCVGTAFRQGAVNVTQLDIRPQPPEKEDKLSVWPYWATKMRTSSSQAEGASREFQVATLEFIGEDGRLTHVKCCQVDEKRRPIAGTEFFIKADLAFIAIGFAGPVEDSVVKEMDGKLEIATDRRGSKSVKANDRDYRTNVDKLYAAGDIRRGQSLVVWAIREGRQAAHAIDADLMGSSVLPR

SEQ ID NO: 57738 - protein, 118 aa, Arabidopsis thaliana
  misc_feature (33)..(33): Xaa can be any naturally occurring amino acid
MASSMLASAGVVTSPVSSHTWSSPFTGLKSSAXFAVTRKGNNDITSITRKGGRVSCMKVWPPIGKKKFENISYLPDLMEVELDKEVDYVLRNKGMPGVELELEHGLVYREQGSTPGYY

SEQ ID NO: 57739 - protein, 172 aa, Glycine max
  misc_feature (96)..(96): Xaa can be any naturally occurring amino acid
MAEQALEGSQPVDLTKHPSGIVPTLQNIVSTVNLDCKLELKSIALQARNAEYNPKRFAAVIMRIREPKTTALIFASGKMVCTGAKSEQQSTTRPLXDFKIQNIVGSCDVKFPIRLEGLAYSHGAFLKCKCEVHNHLFFLVNFLEKWSSQIPALVISPTYGPLDVGYSIGCCT

SEQ ID NO: 57740 - protein, 209 aa, Triticum aestivum
  misc_feature (178)..(178): Xaa can be any naturally occurring amino acid
  misc_feature (183)..(183): Xaa can be any naturally occurring amino acid
  misc_feature (194)..(194): Xaa can be any naturally occurring amino acid
MAQVVAAAGAAGAARPLGGASGADSLRPVARLPFGPRDLRERWSGSVASRGRREHPVASVISADAEVLPVSPDDDAVVKEEENFQHLKAVQQLATAANGVWSKPNVRRKTKIVCTIGPSTNTREMIWNLAEAGMNVARLNMSHGDHASHQKVIDLVKEYNAQTKDNVIALMVDTKGPXEVRSXGDLPQPIFLGXGQGISPFTIKRGVGD

SEQ ID NO: 57741 - protein, 466 aa, Debaryomyces hansenii CBS767
MSKGTKSLLALAATGGAVYWYDQNVLEILPRQQRIPPQPASTGEKINRNINRQVDKLDNKKDELVDKVSSFTNEQQREAQKASESTLDSIKNSRLVNNISGSVTDSRRRIEANVDQDKNVLYKLTDKYIDFVNDIGGSTTNQVDQLKSTAKSDKKRAEDKANSWFNWFGDKKDEAANNLDNNYDQAKRDAEKKKNEWFSWGSQKKDEAADRANAEAENLKKEKNAWSAWGSKKTDEVADKAAEEKKAWTSWGSKKADEAADKAAAEKNAWSSWGSKKVDDATDKANQEAERLGKEKDAWTSWGSKKVDEATEKANQEAEALRKEKDAWASWGSKKADEAADKFNEETERLKKEWENADKSGNSTAQQYTRGAKNSERAFGDAGDPLSASYVQGKERAIGNYEAAKKNLEDLTNKANANVKSLFQKAEPSSDERLKQAQEDFNSAFHNLRSYGADVVEQIESNFKRN

SEQ ID NO: 57742 - protein, 143 aa, Zea mays
MALAAIYNLFIINKSGGLIYYKDYGSAGRMDTNDSLRLASLWHSMHAISQQLSPTTGCTGIDLLQAHNFDLHCFQSLTGTKFFVVCETGAPNMEMLLKAIYELYTDFVLKNPFYEMEMPIRCELFDHNLAQVIQKDRVALLGR

SEQ ID NO: 57743 - protein, 164 aa, Xylella fastidiosa Ann-1
MHLIAHLDTVRGPIKINLFADKTPLTVANFVNLAKRGFYDGLNFHRVIANFMIQGGCPEGSGRGGPGYHFEDETNNGMCHERGSLSMANAGPNTNGSQFFITHVATPWLDGKHTVFGKVLDGQDVVDAIAQGDIINKITIEGDADGVLALKTDRIIEWNSILAT

SEQ ID NO: 57744 - protein, 158 aa, Triticum aestivum
  misc_feature (28)..(28): Xaa can be any naturally occurring amino acid
  misc_feature (38)..(38): Xaa can be any naturally occurring amino acid
  misc_feature (66)..(66): Xaa can be any naturally occurring amino acid
  misc_feature (104)..(104): Xaa can be any naturally occurring amino acid
GTPQAVSSPCGKSEDNDWLPVTKLLRLXEDLQIHRMQXIYLHSLHIREDHIRNDFRPKFNDDCLKXMPVQKQIRAELRTLFTDIVTHRRLLTSHPPLNTNSSAXVAAAIRVTIIIFNVIHLPGLRAYSGTCLVVYRSLTTYLTGPCLTNAVRIHPLPT

SEQ ID NO: 57745 - protein, 203 aa, Treponema pallidum subsp. pallidum str. Nichols
MRERMHNLVPYVIEQSGGGERSYDIFSRLLKDRIIFVDGEITDAVADLVVAQLLFLESQNPDKDISLYINSPGGAVTAGLAVYDTMQHICPEVQTICLGQASSMAAVLLAGGAPGKRFALPSSRVMIHQPWGGVQGQASDVCIQAQEILRLKTLTIAYFALHTGQSEEQVREDMERDFFLSAEQACSYGIVDTVMKRRKHAQV

SEQ ID NO: 57746 - protein, 457 aa, Lactobacillus brevis
MRKVSTGFVYFFGALGGLLFGYDTGVISGAILFIQKQMNLGSWQQGWVVSAVLLGAILGAAIIGPSSDRFGRRKLLLLSAIIFFVGALGSAFSPEFWTLIISRIILGMAVGAASALIPTYLAELAPSDKRGTVSSLFQLMVMTGILLAYITNYSFSGFYTGWRWMLGFAAIPAALLFLGGLILPESPRFLVKSGHLDEARHVLDTMNKHDQVAVNKEINDIQESAKIVSGGWSELFGKMVRPSLIIGIGLAIFQQVMGCNTVLYYAPTIFTDVGFGVSAALLAHIGIGIFNVIVTAIAVAIMDKIDRKKIVNIGAVGMGISLFVMSIGMKFSGGSQTAAIISVIALTVYIAFFSATWGPVMWVMIGEVFPLNIRGLGNSFASVINWTANMIVSLTFPSLLDFFGTGSLFIGYGILCFASIWFVQKKVFETRNRSLEDIEATLRAKTGEDAAELSTTK

SEQ ID NO: 57747 - protein, 316 aa, Arabidopsis thaliana
SCFICRKRAESDTSVPDAPARAKIFEQRYAGFLEGWKKDPESNGGPPDGVILGRVREHLLRELGFRDIFKKVKDEENAKAISLFPEVVSLSDAIEDDGERLENLVRGIFAGNIFDLGSAQLAEVFSRDGISFLATSQNLVPRPWVIDDLNKFQAKWVKKPWKKAVIFVDNSGADIILGILPFARELLRRGIQVVLAANELPAINDVTYTELTDIVSQLKDGNGQLIGVDTSKLLIANSGNDLAVIDLSRVSHELAYLSSDADLVILEGMGRGIETNLYAQFKCDSLKIGMVKHVEVAQFLGGRLYDCVFKFNEVQS

SEQ ID NO: 57748 - protein, 340 aa, Synechococcus sp. WH 7803
MRIGINGFGRIGRLVFRALWGRPGIELVHVNDPAGDAATAAHLLEFDSVHGRWDRNITSDANGFSVEGSPLTWSSEKDPTAVPWTERGVEMVLEASGKIKTPETLTPYFEQVGLKRVVVACPVKGEVAGEEALNIVYGINHDLYEPERHKLVTAASCTTNCLAPVVKVVHESFGIEHGMITTIHDITNTQVPIDAFKSDLRRARSGLTSLIPTTTGSAKAIAMIFPELKGKLNGHAVRVPLLNGSLTDAVFELKQTVTVEQVNAAFKAASEGALKGILGYEERPLVSCDYTNDNRSSIIDALSTMVVDDNQLKVFAWYDNEWGYSCRMADLTCHVVGLDA

SEQ ID NO: 57749 - protein, 125 aa, Glycine max
MKSYDMIPDLTKAVWNVLELRLLVLISFFLQVFLIVFGNRRKCIADARLQVSVWLTYLSADWIATVALGMLSKDSKNPENDPDFIIMAIWAPFLHVHLGGPDTITAYSLEDNELYLRHFLGLLYQ

SEQ ID NO: 57750 - protein, 390 aa, Thermotoga maritima
MEKMTIRDVDLKGKRVIMRVDFNVPVKDGVVQDDTRIRAALPTIKYALEQGAKVILLSHLGRPKGEPSPEFSLAPVAKRLSELLGKEVKFVPAVVGDEVKKAVEELKEGEVLLLENTRFHPGETKNDPELAKFWASLADIHVNDAFGTAHRAHASNVGIAQFIPSVAGFLMEKEIKFLSKVTYNPEKPYVVVLGGAKVSDKIGVITNLMEKANRILIGGAMMFTFLKALGKEVGSSRVEEDKIDLAKELLEKAKEKGVEIVLPVDAVIAQKIEPGVEKKVVRIDDGIPEGWMGLDIGPETIELFKQKLSDAKTVVWNGPMGVFEIDDFAEGTKQVALAIAALTEKGAITVVGGGDSAAAVNKFGLEDKFSHVSTGGGASLEFLEGKELPW

SEQ ID NO: 57751 - protein, 418 aa, Methanocaldococcus jannaschii DSM 2661
MESYIQNLFAERIGGKKFGKEDVIYKFEKIKRAKQEAMKRHPDMELIDMGVGEPDEMADPEVIRVLCEEAKKWENRGYADNGIQELKDAVPPYMEKVYGVKDIDPVNEVIHSIGSKPALAYITSAFINPGDVCLMTVPGYPVTATHTKWYGGEVYNLPLLEENDFLPDLESIPEDIKKRAKILYLNYPNNPTGAQATKKFYKEVVDFAFENEVIVVQDAAYGALVYDGKPLSFLSVKDAKEVGVEIHSFSKAFNMTGWRLAFLVGNELIIKAFATVKDNFDSGQFIPIQKAGIYCLQHPEITERVRQKYERRLRKMVKILNEVGFKARMPGGTFYLYVKSPTKANGIEFKTAEDFSQYLIKEKLISTVPWDDAGHYLRLAACFVAKDENGNPTTEEKYEDMVLEEFKRRLEGMDLEFE

SEQ ID NO: 57752 - protein, 888 aa, Bartonella quintana str. Toulouse
MTKWVYSFGDGSAEGSARARNLLGGKGANLAEMSNIGLPVPPGFTLTTEVCNFYYAHGKLYPKELQEAVEQALKHIGEQTGCEFGNEKRPLLLSVRSGARASMPGMMDTVLNLGMNDETVKAIASQANNERFAYDSYRRFIQMYSNVVLGLDHSYFEEILDDLKVRNNYVVDTEITAADWKDVIVSYKAYIEEKLGKPFPQDPKQQLWGAIGAVFSSWMTARAITYRRLHNIPESWGTAVNVQAMVFGNMGEDSATGVAFTRNPSTGEKELYGEFLFNAQGEDVVAGIRTPQNITENARIVAGSNKPSLEKIMPEAFGELCQIVQKLEQHYRDMQDLEFTIEKGKLWILQTRSGKRTARAALKMAIEMVEEGLISREEAVMRIDAKSLDQLLHPTLDPKAARFVIARGLPASPGAATGEIVFTSEEAETASVEGRKVILVRIETSPEDIHGMHAAEGILTTRGGMTSHAAVVARGMGKPCISGAGSVRIDYNTNTMFVLGQSFKKGDVITIDGGSGEIFKGKVAMLQPELCGDFAKLMEWADEMRHIKVRANAETPSDARMARSFGAEGIGLCRTEHMFFSGERIIAVREMILSDDESGRRKALDKLLPMQRSDFAQLFEIMCGLPVTIRLLDPPLHEFLPKTDAEILDVAAIIGVSPQVLAERAQQLHEFNPMLGLRGCRLAITYPEILEMQARAIFEAAAEAAQKSGSPVMLEIMVPLVALKSELDFVKAHIDQVACEVMKEKGSTIQYMVGTMIELPRAALRADEIAKTAEFFSFGTNDLTQTTFGISRDDAAPFLETYFQKGLLEQDPFVSIDRDGVGELISVAVQRGRSQRAKIKLGICGEHGGDPASIALCEENDLDYVSCSPFRVPIARLAAAQSAIAKKT

SEQ ID NO: 57753 - protein, 286 aa, Synechococcus sp. WH 5701
MNLFADLLSGTPNTATKAAAATTSTGPRIQKGRRGVEIKSAREIQVMRQASRIVATVLREIMEMAAPGMTTADLDRHAEERIRSMGATPSFKGYHGFPASICASINNQVVHGIPSAKQVIKAGDLVKIDTGAYFEGYHGDSCVSICVGECSEDATRLSRVARESLMCGLGKIKAGNTLLDIAGAVQDHVEAHGYSVVEDYTGHGVGRNLHEEPSVFNFRTSDLPNLKLRAGMTLAVEPILNAGSKECRTLRDRWTVVTVDGSLSAQWEHTIVVTSDGCEILTDRDF

SEQ ID NO: 57754 - protein, 319 aa, Oryza sativa Japonica Group
MDKAGGSGEAPPEPEPAAAATVKSIVVYPIKSCRGISVPQAAITSTGLRWDRPWLVMNSAGRAFTQRVEPKLALIEVEMPQEAFTEWQPTPDSHMVIRAPGLDPLKIPLGAKRATVDDVSIWEWSGSAYDEGDEAAEWFSSYFGKPTRLVRFNEASEIRETNPDYAQGYKVLFADDFPFLLASQGSVDALNSILKEPVPMNRFRPNIIVDGCHPYSEDLWKTIKIGKLTFLGVKLCDRCKVPTINQDNGIPGEEPTEALQALRSDEVLRPSHKNKRRVYFGQNLVCKESLSAKDEGRIIKVGDPVYVLESFPSSDEVPA

SEQ ID NO: 57755 - protein, 519 aa, Listeria monocytogenes str. 4b F2365
MTLTKFSEFGLDEKIVKSVNRMGFEEATPIQEKTIPLGLAGKDLIGQAQTGTGKTAAFGLPMIHKIDQKSNNVQALIIAPTRELAIQVSEELYKLSYDKHVRVLAVYGGSDISRQIRSLKKNPQIVVGTPGRILDHINRRTLKLDHVETLVLDEADEMLNMGFIDDIETILKEVPAERQTLLFSATMPDPIRRIGERFMHSPELIRIKAKEMTALLIEQFFVKVHEKEKFDVLSRLLDVQAPELAIVFGRTKRRVDELSRALDMRGYVAEGIHGDLTQAKRMSVLRKFKEGKIDVLVATDVAARGLDISGVTHVYNYDIPQDPESYVHRIGRTGRAGKEGMAITFVQPREMGYLRIVEETTKKRMQPLQAPTWDEAFAGQLRVATEKIQEAITEENLADYKTFANELLEKYDATDIAAAMLKMLAKEPDKTPVHITEERPLPSRGGGGYKGKNGKGGKGGGYRGGSGKGGSYRDRNNSGKGRRSGGGSGSGGGGNRDRRSGGGEQRSGGNKGNYSQKSK

SEQ ID NO: 57756 - protein, 551 aa, Rubrobacter xylanophilus DSM 9941
MRFLREGQRLNQVEKWKLERHPLDVREAVLEVYSKEGVEAIERVPGEHERLKWVGIYPQNQGGNNFMQRIKVPGGRLTPEQARVIGRIARDFARGPEPNPHFGNNFLDITTRQDIQMHWIQIEEVPEIWRRLEEVGMTTVQACGDSARNVLCCPVSGLDREEAFDAYPAAQAITAYFVGNREYANLPRKFKMSVTGCLEDCAQAEINDIGMLPARLPDGTLGFNVRVGGGLGDGPRMASDIDVFVLPGEAVEITRGIAQVYGELGNRENRWINRLRYLVQELGPEGFREELEKRVSIPLRPAGEDLTRRYRGDHVGVHPQKESGLYYVGLNVPVGRMSGEQFEEAGRLAGEYGRDIRLATDQNLIITGVPEGRLDDLLSEPLLRRYSPDPGPFERGIVACTGSEFCRFAIVETKIRALEWAREMDRRFGDEIGQEAVRMHFSGCSASCAQPQIADVGFRGETAKKGDRIVEGVDIGLGGSLGRDAAFIDWVEGARPAEDVPEALSRVFERFRRERREGERFHEWARRVRNAELRDTLRGTSVPVVGTREGR

SEQ ID NO: 57757 - protein, 1221 aa, Magnetospirillum magnetotacticum MS-1
MADSTPISAGANTLRSLSEWERITRELLEEGQNFLAHDTARDGLKQYPDSFKLAIFGAVALSQTGAVDEARRLLQPVLDVILIDEGPFHRLHNSLRRAVEGLEEADSQDTLASMAELAEALELVRGKKLVASADAETYTSLAGVFREAWLASGLRGDLEHCRELFLRAFHISNAPRDGIDAAVTSWLLGDHDGARDLARRVRDRVSHAETDLTLSPEERYQMLATVAEAHLLLGEVQDALASFAWASTLEGIHYGSTVSALKQLALLQEGGLAVPPAVFDIIKPPTVVVFTGHALDRPGEGPHFPPELESAVRAEIAKSLDELGAQVGYSTAACGSDLLFIEAMLERGAEVNVVMPYAIDDFIAENVRYGGSRWEMRFRNALKLANTVTYATEERYLGHGMLYRFANQCLHGLATLRANFLRTAPYLLAVWDMMPGSLVGGAAEFIDQWEDISLLRIIDLDGLLQQYPNLAGDYVPAIPDLDGGDDEQGEGRVIRSMMFCDIAGYSRLKEEHTPVFLDFLRIISEGMAGLEHQPLAINTWGDAIFAVMDKASPMAEYAQTLQEMVLKADEELADRLPHPLSLRISLHAGPVFQAIDPICGRQNFYGSHINRAARLEPVTVIGHVYATQQFVAVLTAEQSAMRSEALNRGEDFVERFACEYVGVLSLAKDFGRQTVYHLRRRVPSEILDPSEEEEPPPEPNPLAILSTELLAVMRDIPIEEEPAPIEEEPAPIEEESVLVEEEPAPVEEEPAPIEEESVPVEEEPAPIEEESVPVEEEPAPIEEESVPVEEEPAPIEEESVLVEEEPAPIEEEDEPAPPVLEGALSDDDMAAILAMGEVEDLAEDEEPAPHDHIDLGELGSPILSDDDMATLLEDASPLVSEGTLSDDDLAAILAMGEVEELAEDEEPAPCAPADLGDLGSTILSDADLAALLEEAGPEEEVVAPDESQEPVSEGTLSDEDLAAILAMGDPEDEAEDQPFISDADLTSTTLSDADLSALLAEATEEEEFDAQLDVDETAPKPDFSFKTAMSDDDIAALLAESEEDGDDEAGDDEAGDDEAGDDEDGGDEDLTPAADLPEIGTGMGFSDDDLAALSDQAAPCEPDGPPPSLFDLGGAMSDDEIDALLEENDEEPLAEEDLPEIGGSGTGFSEDDMRAMLAEAEEAPAVSSDAELAEVAAAVEAAMAKLEAEDDSDISLAPPRPAPPVRPFTGRVEISLAPPKK

SEQ ID NO: 57758 - protein, 498 aa, Ashbya gossypii ATCC 10895
MRRDHILTASRGDIGLIGLAVMGQNLILNAADHGYTVVAYNRTVSKVDRFLEDEAKGKSIIGAHTVEELCANLKRPRRVILLVMAGSADDAFIEQLLPYMEQGDIIIVGGNSHFPVSNRRFEELKQKGIHFVGSGVSDGEEGARYGPSLMPGGAPEAWPHIKEIFQSIAAKSEGEACCDWVGPAGAGHYVKMVHNGIEYGDMQLICEAYDIMKRLGGFTDKEIGQVFSEWNKGILDSFLIEITRDILLYEDLDGTPLVEKILDSAGQKGTGKWTAINALDMGMPVTLIGEAVFARCLSSLKDERMRASALLSGPEIPKDAVKDRKQFVDDLEQALYASKIMSYAQGFMLMREAGKTFGWELNFPAIALMWRGGCIIRSVFLAQITKAYRENPYLENLLFNKFFADAVTKAQQGWRRTIGLATTYGIPTPAFSTALAFYDGYRSKRLPANLLQAQRDYFGAHTFRVLPEAASAHLPVDKDIHINWTGKGGNISASTYQA

SEQ ID NO: 57759 - protein, 636 aa, Synechocystis sp. PCC 6803
MALITVQSLRKDFGIKEILRDATFNIEPGDRVGLIGVNGSGKSTLLKMIAGLEPFDGGEYWCNSSAKVVYLPQQPEMDGDRTVLEQVFVDSGEQWQLVKQYELLSDKLAHQGSDEQLLNQLSALSAQMETSGAWELETQAKIILTQLGVDHLDAKVGDLSGGYRKRVAIAAALLSQPDVLLMDEPTNHLDAFSVEWLQSYLQRFRGALLLITHDRYFLDRVTNRILEIDQGELYSYNGNYGYYLTKKAEAEESEQSSQKKHRGVLRRELEWLKRGPKARSTKQKARIDRIQDMQETSFKTGTGKVDISTAGRRIGKKVVELENISKGFENKQLIKDFSYIFTPGDRVGIVGKNGVGKSTLMNMITGRLEPDQGTVDIGSTIHFGYFDQHSDDLSLNPNQRVIDYLKSVAELIKTTDGEVITAGQMLERFLFPPNQQFAPIAKLSGGEKRRLFLLRVLMRAPNVLILDEPTNDLDVQTLAVLEDYLEDFNGCVIVVSHDRYFLDRTVETIFAFEEEGELRQYPGNYTLYLEYKKAEQVRANQEETELKKSQPVASVTTKVSQDSSSKKLSYKEKREYEQLEQQIPQLEEEKAQLEAQLYQSSNGNFTELQNLTERLANLSESIDQKTERWLTLAERI

SEQ ID NO: 57760 - protein, 323 aa, Candida shehatae
MSPSPIPAFKLNNGLEMPSIGFGCWKLGKSTAADQVYNAIKAGYRLFDGAEDYGNEQEVGEGVKRAIDEGIVTREEIFLTSKLWNNYHDPKNVETALNKTLKDLKVDYVDLFLIHFPIAFKFVPIEEKYPPGFYCGDGDNFVYEDVPILETWKALEKLVKAGKIRSIGVSNFPGALLLDLFRGATIKPAVLQVEHHPYLQQPKLIEYAQKVGITVTAYSSFGPQSFVEMNQGRALNTPTLFEHDVIKAIAAKHNKVPAEVLLRWSAQRGIAVIPKSNLPERLVQNRSFNDFELTKEDFEEISKLDINLRFNDPWDWDNIPIFV

SEQ ID NO: 57761 - protein, 528 aa, Oryza sativa
MQPTWLATMPAASSLVVGVAFTAAVAVAVAAAVARRAWRHRGLRLPPGPPSWPVVGNLLQVVFAGKPFIHYIRDLRREYGPIVKLQMGVRTLVVISSAELVHEALVEKGREFATRPAESPIRSIFSSGKFTVNSAVYGPEWRSLRRNMVSGMLSAARLREFRPARLRAMERFVARVRAEAAASRDGASVWVLRNVRFAMFCVLLDMTFGLLDLDEELVVRVDAVMKRVVLAVAARIDDYLPFLRPFLWRQHRQAVALRREQIDTVLPLINRRRAIVRGMRAGSPPDPAVAAPYSYLDSLLDLRVEGRDAVPTDEELVTLCAEMINGGTDTTATAIEWAMARVMDNPSIQARLHGEIMQRVGDARPVDDRDTDGMPYLQAFVKELLRKHPPTYFALSHAAVEPGSKLAGYDVPVDANLDIFLPTISEDPKLWERPTEFDPDRFLAGGETADITGSAGVRMIPFSAGRRICPGVGMGTAHIALMVARMVQAFEWRAHPSQPPLDFEDKVEFTVVMKRPLLAMVTPRKLSF

SEQ ID NO: 57762 - protein, 174 aa, Prochlorococcus marinus str. MIT 9312
MKHTLSVLVEDESGALSRISGLFARRGFNIDSLAVGPAESKGISRLTMVVEGDDATLQQMTKQLNKLFNVLGVVDFTNLAAVERELMLLKVSSKEDTRSNILDIVQIFRAKVVDVSDIALTLEVVGDPGKLVALEKLLEPYGILEIARTGKVALKRSSGVNTEMLKINKYSLEI

SEQ ID NO: 57763 - protein, 505 aa, Chlamydomonas reinhardtii
  misc_feature (504)..(504): Xaa can be any naturally occurring amino acid
MAAAGAPAEGASAYEYDLVVIGGGSGGLACAKEAAKLGKKVCLLDYVVPSPAGTSWGLGGTCVNVGCIPKKLMHNAGLLGEGFSDARGYGWKLPEKIEMNWEDLVMGVQNHIGSLNWGYRVALREASVKYLNAKGSFVDAHTVEAVERNGTKHTLTAERVVIAVGGRPKYLGVPGDKELCITSDDIFSRATPPGKTLVVGASYIALECAGFLRALGYEVAVMARSIFLRGFDQEIAELIGKDMERRGVRMIKPAVPTAFERDGEQIKCTFKNLDFGVEMSESFDTVLLAVGRDACTFDLGLEKVGVTYDKSSGKIPVTAEQTNVPSIYAIGDVLESRQELTPVAIKAGIRLARRLYAGATLQMDYDAVPTTVFTPLEYGCVGYSEEAATVKYGADNIEVYVSYLKPLEWTMNHEEHNGEPVRADNSVFVKLITNTADNERVVGAHYLGPNAGEIIQGVAVAVKANATKADFDDCIGIHPTVAEEFTILEVTKRSGKSALKKGCXG

SEQ ID NO: 57764 - protein, 1412 aa, Cryptococcus neoformans var. neoformans JEC21
MHQQRAPAAHHHSYSYAPYPHASVSAENTVPSMAQPQVYYQQPPADFYPHVPGHNPHTGASHGTQAGPSQSAENNAFAMPDVRQSKSARPRPPPSSVTMPMIPTSLPDPSMHSYAPVQAPVPQQQTRTANRRSHNPAATLNSPSAPRPEELTDEYVLHPSVYAFKQEYPRRAMVGLGPYIVLQTLGEGEFGKVKLGVHADYGVEVAIKLIRRGDLQEEAHASKVEREINVLKTLKHPNIVRMFDVLDTHKYIGIVLEFAGGGELFEYILANEYLKDKEGQRIFAQLISGVDYLHKKGVIHRDLKLENLLLDKNRNLIITDFGFANQFDLSKGDLMSTSCGSPCYAAPELVVLDTPYHGSAVDIWSCGVILYAMLAGYLPYDDDPDNPDAGNVVELYRYIMNTELHYPDHVSPLGKNLLQHMLILHPEHRIKIPVIVKHPWLKSYHDMFNKSVEECEAAFQDAMYRKSRQARKELQERRRVQTQARESLQTKERAHVQRSQSSAPGTIINAAALDQIRRRPHSAMPGSTPLPEIIAKHSESVDDVALTMRSATPPTALSQPTEIRSPTTESPRPRSESMAPRLSFTTSVSTPTAMTVETPSSVPVQSPTDALPPAAMTVMQPSVEAAPPMRDHKNRNTIQVEHAGEGLHDRAKEAFDANHGRADGSMETTSTADTGMVASSLLDVKREESTDIEMESGSSDSEQPKPANDGISQQPGEKSMDIPPIVPITIPLAPPAESGTATAANDSSQVLEPQEKLSPALVEHGSASIDEMASPSTPRVSTSVEQEPVNITPRAKMRAPPVATTPKASLVNERKRHGSMPPPMGPSFVSDSRPESSLTATGLPKLPKKDRYRKGMSLDKFGLAKLLGHASQAHTTVHGEGKMAPPSASSSALALQHQLQQHGGQSQAVSESDSVKKSRRRTLQFGFHSRKDSKASSAAVATPGTPLMDKDTNGENRLSSITGGTASLRDKRRKTVQIGLSTQSEQKDTTVNVPGLSSSGHLVKNPATEPPQGISIGPVVGTDASALSQSSPSAVALEAFAAQQGHYPSYRGSSSRASKVMDWFRRKTFVKETLPEPKSPVIKSDSQSSFVRIGEVASPASKTQESAQASTVSQENTDKAEEKIDSTADQENAAKTTPTKSPVLPQPIGATATTPSVMITPPRPTAATTPTIGSSTQQSPPTTIRTRSASTFTFDESKIRVHTGLVDQSALSTKPPQDVFVEVIQVLRGMGVEMKRESDFKLRCTRAKKKAAGTSIGLGSVVSTGSGMSPFSIMNNASASKTDSRGLPRPTSPSAVANRSSAGIKGLLRRGSSRSSAHPARLTRTGDEVPNPPSQSTPNLELPESSMASKPEPLYGKELMDAGDEVKFTVELCKMKNLPGLFILKIKRTKGNLWSFKFIYQTVIERTTTLTH

SEQ ID NO: 57765 - protein, 953 aa, Flaveria trinervia
MMSSLSVEGMLLKSARESCLPARVNQRRNGDLRRLNHHRQSSFVRCLTPARVSRPELRSSGLTPPRAVLNPVSPPVTTAKKRVFTFGKGRSEGNRDMKSLLGGKGANLAEMSSIGLSVPPGLTISTEACEEYQQNGKSLPPGSWDEISEGLDYVQKEMSASLGDPSKPLLLSVRSGAAISMPGMMDTVLNLGLNDEVVAGLAGKSGARFAYDSYRRFLDMFGNVVMGIPHSLFDEKLEQMKAEKGIHLDTDLTAADLKDLVEKYKNVYVEAKGEKFPTDPKKQLELAVNAVFDSWDSPRANKYRSINQITGLKGTAVNIQSMVFGNMGNTSGTGVLFTRNPSTGEKKLYGEFLINAQGEDVVAGIRTPEDLGTMETCMPEAYKELVENCEILERHYKDMMDIEFTVQENRLWMLQCRTGKRTGKGAVRIAVDMVNEGLIDTRTAIKRVETQHLDQLLHPQFEDPSAYKSHVVATGLPASPGAAVGQVCFSAEDAETWHAQGKSAILVRTETSPEDVGGMHAAAGILTARGGMTSHAAVVARGWGKCCVSGCADIRVNDDMKIFTIGDRVIKEGDWLSLNGTTGEVILGKQLLAPPAMSNDLEIFMSWADQARRLKVMANADTPNDALTARNNGAQGIGLCRTEHMFFASDERIKAVRKMIMAVTPEQRKVALDLLLPYQRSDFEGIFRAMDGLPVTIRLLDPPLHEFLPEGDLEHIVNELAVDTGMSADEIYSKIENLSEVNPMLGFRGCRLGISYPELTEMQVRAIFQAAVSMTNQGVTVIPEIMVPLVGTPQELRHQISVIRGVAANVFAEMGVTLEYKVGTMIEIPRAALIAEEIGKEADFFSFGTNDLTQMTFGYSRDDVGKFLQIYLAQGILQHDPFEVIDQKGVGQLIKMATEKGRAANPSLKVGICGEHGGEPSSVAFFDGVGLDYVSCSPFRVPIARLAAAQVIV

SEQ ID NO: 57766 - protein, 253 aa, Arabidopsis thaliana
MQTTRHARHFSGRNQSSPRLQRPYSYVAKRRNCSLITTNLPQQQIDEQQARPSRLCHSDRLIIKPLAPITLYAGDSDITKFGDSTEFVSPPLKKQKTDTDPDSEVKPENRILRRGNWDDPEYARQRMIFEDQFKNSENQMVTMLIGVNVDYNFPAVNFDWGNDFDDQMNNNELMKLLIETAIDEENEETGTRLEFVKYVSANVLGVQGFLFYITFWAKDLSSPNPQPHCYQAKVRKFAAEIDVSEFRLRPTKE

SEQ ID NO: 57767 - protein, 346 aa, Trichodesmium erythraeum IMS101
MSPYLEELKVTAQAMVAKGKGILAMDESNGTCNKRFEKLGIPTTEEYRQAYRQLILTTPDLSNYISGPILYDETIRQSTTEGVPFLKVITDAGMIPGIKVDTGAKNLANHPNEKVTEGLDGLGERIAEYYQMGARFAKWRAVITIGDGIPSRACIEANAHGLARYAALCQEGGLVPIVEPEVLIDGNHTLERCFEVTDETLHTVFNHLYTQGVAFDQMILKPSMVIPGKDCPTQVSVEAVAEATINCLLKNVPVTVAGIAFLSGGQSIEQSSAHLNAMNALFGSRCPWPVTFSYARAIQQPALDYWSGDSARVAEAQQKLLARAKCNSAASVGEYSASMDETPVLV

SEQ ID NO: 57768 - protein, 1078 aa, Populus tremuloides
MESEGETGAKPMKSTGGQVCQICGDNVGKTADGEPFVACDVCAFPVCRPCYEYERKDGNQSCPQCKTRYKRLKGSPAILGDREEDGDADDGASDFNYSENQNQKQKIAERMLSWQMTYGPGEDSGASNYDKEVSHNHIPLLTNGHEVSGDLSAASPEHISMASPGAGGGKRIPYASDVHQSSNVRVVDPVREFGSPGLGNVAWKERVDGWKMKQDKTVVPMSTGHAPSERGAGDIDAATDVLVDDSLLNDEARQPLSRKVSIPSSKINPYRMVIVLRLGILCIFLHYRITNPVRNAYALGLYLGIWGDWFAISRILDQFPKWLPGNRETYLDRLALRYDMEGEPSHLVVVDIFARSGVHLKEPPLVPANAVLSILAGDSPIDKVSCYVSDDGAAMLTFEALSETSEFSRKWVPFCKKYSIEPRAPEWYFAQKIDYLKDKVQPSFVKDRRAMKREYEEFKIRINGLVAKAQKVPEEGWIMQDGTPWPGNNTRDHPGMIQVFLGQSGGLDSDGNELPRLVYVSREKRPGFQHHKKAGAMNSLVRVSAVLTNGPFLLNLDCDHYINISKALREAMCFMKDPNLGKHVCYVQFPQRFDGIDRNDRYANRNTVFFDINLRGLDGIQGPVYVGTGCVFNRTALYGYEPPLKPKHKKPGMLSSLCGGSRKKGSKSSKKGSDKKKSGKHVDPTVPIFSLDDIEEGVEGAGFDDEKSLLMSQMSLEKRFGQSAVFVASTLMENGGVPQSATPETLLKEAIHVISCGYEDKTDWGSEIGWIYGSVTEDILTGFKMHARGWRSIYCMPKRPAFKGSAPINLSDRLNQVLRWALGSVEILLSRHCPIWYGYGGRLKWLERFAYVNTTIYPITAIPLLMYCTLPAICLLTDKFIIPQISNIASIWFISLFLSIFATGILEMRWSGVGIDEWWRNEQFWVIGGVSAHLFAVFQGLLKVLAGIDTNFTVTSKASDEDGDSAELYLFKWTTLLIPPTTLLIVNLVGVVAGISHAINSGYQSWGPLFGKLFFAFWVIVHLYPFLKGLMGRQNRTPTIVVVWSILLASIFSLLWVRVDPFTIRVTGPDVEQCGINC

SEQ ID NO: 57769 - protein, 245 aa, Oryza sativa
  misc_feature (143)..(143): Xaa can be any naturally occurring amino acid
  misc_feature (155)..(155): Xaa can be any naturally occurring amino acid
  misc_feature (179)..(179): Xaa can be any naturally occurring amino acid
  misc_feature (181)..(181): Xaa can be any naturally occurring amino acid
  misc_feature (201)..(201): Xaa can be any naturally occurring amino acid
  misc_feature (210)..(210): Xaa can be any naturally occurring amino acid
  misc_feature (229)..(229): Xaa can be any naturally occurring amino acid
MFKKVNLNYLSAYLNDTSRVVVRTDFNVPIKEGVIQDFTRIKSTIPTIQHLAKHNPKSIVLLSHLGRPDGRKDQKYTLKPLLDPLQNMIGRPITFLNDCIGEHVVDKINNSNGEIFLCENIRFNPEEEGFQKNNEGIKIKVNXRMLLNLENSLVXLGNIFVNDAFGCSHRAHSSVVGIXTXVKAAGFLMEKELKILGSFLXAPKRPVLVXLGGSKVTDKIKLIMKMLDXADELIIGGGMAAPFLR

SEQ ID NO: 57770 - protein, 282 aa, Synechocystis sp. PCC 6803
MEWREISGSWVLVPPQPIAVVHFLGGAFVGTAPNVAYRWLLTELGKAGYVVVATPFVNTFDHQAIARSVLNRFEIILERLQKQGEITTGLLPVYGLGHSLGCKLHLLIGSLYEVERAGNILVAFNNYPVKQAIPFGEQLAQLQLDKFLTGVQKQLRQLNLQVDLNFEFTPSPEETNLLIAENYRVRRNLLIKFSNDDIDQTLGLRPILNQQTADLVAYCPLPGNHLTPLGQDIQWETGQEFSPLDAVGQWLKNSLSQDLRRLQKEILRWLEPTRFYSGFDNL

SEQ ID NO: 57771 - protein, 207 aa, Staphylococcus aureus subsp. aureus Mu50
MKATTIIGIAGGSGSGKTTVTNEIMKNLEGHSVALLAQDYYYKDQKHLTFDERLETNYDHPFAFDNDLLIENLKDLKNGKAVEVPTYDYASHTRSDITIDFKPKDVIIVEGIFALENKVLRDMMDVKIYVDTDADLRILRRLTRDTKERGRSMDSVINQYLSVVRPMHDQFIEPTKKYADIIIPEGGSNKVAIDIMTTKIQSLVSKQ

SEQ ID NO: 57772 - protein, 441 aa, Synechococcus sp. WH 5701
MTDAPERLQLLWGITVFSGALAQLTSLLTGLPSVVLLLASGLLIGRSGLGLVDPFALGSGLETIVGLLVSLVLFDGGLKLSLPGSTTRQAVLRIVVVRLLVALPAGLLAAHWLAGLSWPLAAVYSAIVLGTGPTVVTPLIQQMRLAPPLGDVLEGEGLVLEPVGAVLALLLLELVLTDRYDWQDLALELLQRLGFGVAVGALSGFLLAVLLRRLPVDPESGLRLQLTLGVMFLMFTGCEVVMPESGLPAAVMAGVLLGRFADTDAAMLDDLIRQLAQLAISILFPLLAADVAWADLSPLGWGGVACVLTLMLLVRPVAMQIATYGLPLSGGQKVLLSWLAPRGIVTAAVASLFALRLYEAGVEGAGALQGLVFLTILMTVGLQGFTAIPLAGLLGLRLSEQEMEEEERQREEAKDQQLAAAGVIPAPAAASQSLPLENPQP

SEQ ID NO: 57773 - protein, 230 aa, Triticum aestivum
MATSALATLSATAAAAGARRVLLSRGPASSLSFASRRLAPAGPLRAGPLPRAATRALSATASPAATTTIAVGDRLPDATLSYFDAPDGELKTVTVRDLTAGKKVVLFAVPGAFTPTCTQKHLPGFVARAGELRAKGVDTVACVSVNDAFVMRAWKESLGVGDEVLLLSDGNGELTRAMGVELDLSDKPVGLGVRSRRYALLADDGVVKVLNLEEGGAFTNSSAEDMLKAL

SEQ ID NO: 57774 - protein, 131 aa, Glycine max
MTLLVNSPLLPLPSTRWLKSKQEFRLFSHGPTIIGGGMSRSIFGTGKRNGNRNGVKAFFFNPEQDPIVKEALKEPVAFLGGMFAGILRLDLNEEPLKEWVTRTVEAAGISEEEANTEESTTEEAPQEIQIE

SEQ ID NO: 57775 - protein, 169 aa, Triticum aestivum
  misc_feature (135)..(135): Xaa can be any naturally occurring amino acid
  misc_feature (151)..(151): Xaa can be any naturally occurring amino acid
MNLSSAIQSLHIHTKVIVVMVAHGSASMVVLSLRDGSSHQGTVTSMTHNNATFVLHSELERKGKVKPVHVIDVPGHARLKSKLDEVLPQAAGIVFVVDALDFLSSMQAAAEYMYDILTKATVVKKRIPVLIFCNXTDKVTAHSKEFIKKQXEKEVNNLPGIKGTPISSG

SEQ ID NO: 57776 - protein, 342 aa, Vitis vinifera
MAQCHWIALSFALSFLVRVLNASAGDSDPLYKACIEQCEKTGCVGDKCFQHCKLSSDGNPIGGPWYLQEPLYLRWKQWDCRSDCRYHCMLAREEEREELGDKPVKYHGKWPFRRVYGIQEPVSVALATLNLAMQFHGWVSFLILLYYKLPLRPDKKTFYEYTGLWHIYGILAMNAWFWNAVFHSRDVDLTEKLDYSSGVALLGFTLILAILRAFNVRDEAARVMIAAPLMAFVTTHILYLNFYKLDYGLNMKVCLTMGIAQLLLWTVWAGVTHHPSRWKLWVVVVGGALAMFLEIYDFPPYWGFVDAHAVWHALAIPFTYLWWSFVKDDSEFRTSALMKKVK

SEQ ID NO: 57777 - protein, 367 aa, Ashbya gossypii ATCC 10895
MLRQKLFQGSRRWLASVRQPSIGRYAGKPNAAGKYTVSFIEGDGVGPEISQSVKDIFSAASVPVEWEYCDVTPLLVNGLTTIPEPAVASINKNLVALKGPLATPIGKGHRSLNLTLRKTFGLFANVRPAKSIEGYKTTYSDVDLVLIRENTEGEYSGIEHVVSPGVVQSIKLITREASERVIRYAFEYARTVGRPKVVVVHKSTIQRLADGLFVNVAQELGREYPDIELQTELLDNTVLNVVTKPEAYKDVVAVCPNLYGDILSDLNSGLSAGSLGLTPSANIGHQVSIFEAVHGSAPDIAGQNRANPTALLLSSVMMLNHMGLHEHAGRIEKAVLSTIASSRENRTADLAGTASTSSFTNAVIERL

SEQ ID NO: 57778 - protein, 509 aa, Ehrlichia canis str. Jake
MNFSGLQDLHDRKLKSFYGGGVSRIEKQHIKGKLTARERLTVLLDDNSFEEYGTFVEHRSVNFSMDKSKIPGDGVVVGYGTINGRKVCVYSQDFTVFGGSLSESNAKKICNIMDKAASLGLPIIGINDSGGARIQEGVDSLAGYGEIFQRNVNLSGVVPQISIIMGPCAGGAVYSPALTDFIFMVRNTSYMFVTGPDVIKKVMYEDVSQEDLGGAKVHSNKTGIADLVFNDEIEALLYVRKFMDFITSNNTELSKSQLVSCLDTEDLSLNTLIPKNSSTPYDMNELLEKVCDERLFYEIKPDFARNIIVGFGKIGGYKVGLIANQPLHLAGCLDIDASRKGARFIRFCDAFNIPIITFIDVPGFMPGVNQEHSGIIAHGAKLLYAYAEATVPKISIIVRKAYGGAYIVMNSKHLCGDINYAWPDAEIAVMGAEGAVEIIFRNETDKEKIQNIIDEYRTKIVNPYVAASRGYIDDIIIPSRTREYLFKSLQLLEKKKVNKIMRKHDNLPL

SEQ ID NO: 57779 - protein, 347 aa, Synechocystis sp. PCC 6803
MTVSEIHIPNSLLDRDCTTLSRHVLQQLNSFGADAQDLSAIMNRIALAGKLIARRLSRAGLMADVLGFTGETNVQGESVKKMDVFANDVFISVFKQSGLVCRLASEEMEKPYYIPENCPIGRYTLLYDPIDGSSNVDINLNVGSIFAIRQQEGDDLDGSASDLLANGDKQIAAGYILYGPSTILVYSLGSGVHSFILDPSLGEFILAQENIRIPNHGPIYSTNEGNFWQWDEALRDYTRYVHRHEGYTARYSGALVGDIHRILMQGGVFLYPGTEKNPDGKLRLLYETAPLAFLVEQAGGRASDGQKRLLDLIPSKLHQRTPAIIGSAEDVKLVESFISDHKQRQGN

SEQ ID NO: 57780 - protein, 200 aa, Ehrlichia canis str. Jake
MKLKAIMSKCEFIIGATHVKSFPNFSIPEIAIAGRSNVGKSSLINAITNNKKNAKTSSRPGCTKQINFYLINKSFMVLVDLPGYGYSKATRATINNYLFLMEYYLLNSKNLLKVILLIDVKVGFKEIDLDFINWLELNHIYYQLVLTKIDRVSKEILDVNINYIKNLNLGFVIYPVISASSKYKQGIGELIYEIAQCIKK

SEQ ID NO: 57781 - protein, 259 aa, Triticum aestivum
GRGAFGAAILVNHKIEKKKYVLKKIRLARQTERCRKSAHQEMALIARLQHPYIVEFKEAWVEKGCYVCIITGYCEGGDVDELMKKLNGTYFPEEKLLKWFAQLVLAVDYLHSNYVLHRDLKCSNIFLTKDHDIRLGDFGLAKTLKEDDLTSSVVGTPNYMCPELLTDIPYGFKSDIWSLGCCMYEMAAHRPAFKAFDMAGLISKINRSAMGPLPTCYSSSMKSLIKIMLRKNPEHRPTASEILKNPYLQPYVDQMSCSL

SEQ ID NO: 57782 - protein, 323 aa, Ehrlichia canis str. Jake
MKLHNVLKNNNNNKEDVGPSIEQFGGNAEWFNTTKVLSECLPYIQQFSGETFVIKYGGAAMTDRKLAESFAHDIVLLKQLGINPIVVHGGGNKINSFLEKINKKSTFINGLRVTDAETLEVVEMVLCGLVNKDITQLINKAGGNAIGLCGKDANLIEAKKVCYTYKENQSNNVEKILDMGFVGEPHEVNTDLLFFIEESDFIPVIAPVCSGENNITYNVNADLVAGALANALAAAKLIILTNVSGVTDANGNLLSEISVSDAENLIEQGVANSGMIPKLQTCIKVVKEGYGSAHIIDGRIPHVLLLELFTVHGTGTMVLGNDI

SEQ ID NO: 57783 - protein, 218 aa, Porphyromonas gingivalis W83
MQPIVSPSLLSADFLHLADDVEMINRSEADWLHIDVMDGVFVPNLSFGFPILEAIRPICKKPLDVHLMIVEPMKFVDRLAELGVYMMNVHYEASPHLHRSLAAIRKAGMKSGVTLNPHTPVEVLTDVLEEADMVLLMSVNPGFGGQKFIERTIDKTQRLRRMIDSQGLDTIVQIDGGVNAATGKRLIEAGADSLVAGSYVFGAEKPEEAISLLKSYSR

SEQ ID NO: 57784 - protein, 678 aa, Magnaporthe grisea 70-15
MNGATQALSGASEAPSTEDAQQQQSSSGSNGTPAGEGNGAAAAAAAAAAGLKKRKKDALKPIITTENPAPTSQPALAAGVAACHSSIAETGSPFVILLPARAQSSNAFPPTEPKPSQAYASSQPSREPAHSALGQGLDWTGQDTPPSQRNPHRPPPRCFEIHAPRRSKTAHLSAHSPTSSSSHDDPENTADEEDSEDYCKGGYHPVQIGEKFKDGKYTIVRKLGWGHFSTVWLSRDNSSGKHVALKVVRSAAHYTETAIDEIKLLNKIVQAKPDHPGRKHVVSLLDSFDHKGPNGTHVCMVFEVLGENLLGLIKKWNHRGIPMALVKQITKQVLLGLDYLHRECGIIHTDLKPENVLIEIGDVEQIVKRVVKSEPSDKENNRNGRRRRRTLITGSQPLPSPLNATFNHANLFPSPSSQHSSLGQMLHDGAKSKSSTSPRRDGDDKQKQREKSADLLSREVSGISLDKTGEKRKADDNHGFDVISVKIADLGNACWVSHHFTNDIQTRQYRSPEVILGSKWGASTDVWSMAAMVFELITGDYLFDPQSGTKYGKDDDHIAQIIELLGPFPKSLCLSGKWSQEIFNRKGELRNIHRLRHWALPDVLKEKYHFKEEEAKRIAEFLLPMLELVPEKRANAGGMAAHLWLDDTPGMKGVKIPGLDAGSRGEGIDGWANEVRKR

SEQ ID NO: 57785 - protein, 208 aa, Triticum aestivum
HTPRGTKKQVCRGPEFPGYRRPTRPLVTCGTRGIGRAVVEELAALGAAVHTCSRKEAELGKRLKEWEARGFRVTTSVCDLSVREQRERLIGDVAERFCGKLNILVNNVGTNIRKPTTAFSGEDYSFLMATNLESAYHLCQLAHPLLKASGLGSIVFISSVCGLLAVFSGTLYAMTKGAINQVTWNLACEWAKHGIRANSVASWYITTS

SEQ ID NO: 57786 - protein, 443 aa, Zea mays
MYGPPSRGGGGAGAAGEQPRVYQVWRGSNEFFLQGRFIFGPDVRSLFLTIFLILAPVVVFCIFVARHLINDFPDHWGVSVMVIVIVFTIYDLTLLLLTSGRDPGIVPRNTHPPEPEAIDMHNDAGNGQTPQQLRLPRTKDVIVNGTIVKVKYCDTCMLYRPPRCSHCSICNNCVEHFDHHCPWVGQCIGLRNYRFFYMFVFSTTLLCLYVFGFCFVYIVKIKDAEQSTFWKAMLKTPASIVLIIYCFICVWFVGGLSVFHFYLMSTNQTTYENFRYRYDRRDNPYNRGTVNNFMEIFCTSVAPSKNNFRARVPAEQGLQQARAPARGFMSPNMGKPIGELELGRKPISWDEPRSAADIRDLEVGLGSLLDEKEGRVAHASPDLSREALPELVEGRAGMHSRRSSWGHRSGTSASMDSLAVQMGTADSHWGSISSVHGTNSGAH

SEQ ID NO: 57787 - protein, 397 aa, Flavobacteria bacterium BBFL7
MNLHEYQGKEILASYGVTIQRGKVATTAAEAVAAAKELTEETGTGWHVIKAQVHAGGRGKGGGVKLAKNLEQVEEIAGQIIGMDLVTPQTSAEGKRVHQVLVAEDVYEPGEVEVEEFYMSVLLDRAQGKNMIMYSTEGGMDIETVAEETPHLIFTETIDASHGLQGFQARRIAFNLGLSGKAFKEMTKFVAALYNAYVGSDSALFEINPVLKASDNRIIAVDCKITLDENALFRHKDLAAMRDTREENATEVEAKAVGLNYVDLDGNVGCMVNGAGLAMATMDLIKQAGGEPANFLDVGGTADAKRVEEAFRIILKDDKVEAILVNIFGGIVRCDRVAQGIVDAYKNMGDAINVPIIVRLQGTNAEIAKELIDNSGLDVQSAVEFQEAADKVQAVIG

SEQ ID NO: 57788 - protein, 78 aa, Triticum aestivum
  misc_feature (15)..(15): Xaa can be any naturally occurring amino acid
  misc_feature (19)..(19): Xaa can be any naturally occurring amino acid
  misc_feature (21)..(21): Xaa can be any naturally occurring amino acid
  misc_feature (38)..(38): Xaa can be any naturally occurring amino acid
  misc_feature (46)..(46): Xaa can be any naturally occurring amino acid
GELVPGPPQQWHICXDILXDXWSPAMTVSSVCISILSXMLSSSPAXKERPSDNDRYVRNCRNGRSPKETRWWFHDDKV

SEQ ID NO: 57789 - protein, 182 aa, Gossypium hirsutum
MASSMISSATIATVNCSSPAQANMVAPFTGLKSASAFPVTRKANNDITSLASNGGRVQCMQVWPPLGKKKFETLSYLPDLTPVQLAKEVDYLLRSKWIPCLEFELEEGFVHRKYSSLPTYYDGRYWTMWKLPMFGCTDSAQVLEELENCKKEYPNAFIRIIGFDNVRQVQCISFIAYKPKGY

SEQ ID NO: 57790 - protein, 458 aa, Pseudomonas fluorescens Pf-5
MGIQEYSAAERLERLPISGYHRVIFIIIALAFFFDSMDLAMMTFLLGSIKTEFGLSSAQAGLLASSSFFGMVLGASLSGMLADRYGRKPVFQWSIVLWGVASYLCSTAQSVDSLTLFRVLLGIGMGMEFPIAQSMLSEMIPAQRRGRYIALMDGFWPLGFVAAGVLSYFLLPLIGWRDIFLVLAVPAVFVLVIRFFIPESPRWLEQAGRHADADRVLCGIEDKVRASLGTAQLPEPLHLPRIDSAPGHFFSALKQIWSPLYRQRTMMIWSLWFFALLGFYGLTSWLSALLQQSGFAVTQSVYYTVLISLGGIPGFLMAAWLVERWGRKPVCIVTLLGGGVMAFFYGQSAVFGGNVSLLIGTGLLMQFFLFGMWAVLYTYTPELYPTSARATGSGFASAVGRIGSLLGPLVTGLVFPLTGQGGVFALGAACFVIAAGVVWLFGMETRGKTLEELSEAGS

SEQ ID NO: 57791 - protein, 249 aa, Zea mays
  misc_feature (77)..(77): Xaa can be any naturally occurring amino acid
MEGKEEDVRLGANKFSERQPIGTAAQGTDDKDYKEPPPAPLFEPGELKSWSFYRAGIAEFVATFLFLYISILTVMGXPAVTFGLFLARKLSLTRAVFYIIMQCLGAICGAGVVKGFQQGLYMGNGGGANVVAPGYTKGDGLGAEIVGTFILVYTVFSATDAKRNARDSHVPILAPLPIGFAVFLVHLATIPITGTGINPARSLGAAVIYNQHHAWADHWIFWVGPFIGAALAAIYHQVIIRAIPFKSRS

SEQ ID NO: 57792 - protein, 383 aa, Pseudomonas fluorescens Pf-5
MTWCSLSVISCTRFYSRQRTAMLNSLKQEKFLLLALLAAVAAYPLEHLLLGSGQGIALGAGLVLIGFIVMASMRVAHHAELLAEKVGDPYGTMILTLAAVLVEVVILAIMMSNEASPTLVRDTIYSAVMLDINGILGLAALMGGIKHGEQPYNDDSARTYSVMILTAMGVSMVVPEFIPEADWKVYSAFTIGAMVVLYTLFLRMQVGPHSYFFSYSYPEKRRNKEAQEQPHAINLAWSIGILVFGVVVIGALAEVMSKTLDLGLEGTGAPPVITAILVAAISAAPEILTALRAALANRMQSVVNVALGASLSTVILTVPVMEAMALYTGQPFQMAMTPVQTVMVFITLIVSAINLNDGETNAIEGMTHFVLFATFIMLSLLGL

SEQ ID NO: 57793 - protein, 631 aa, Bacillus cereus
MKKYRVNVQGMTCSGCEQHVAVALENMGAKAIEVDFRRGEAVFELPDDVKVEDAKNAIADANYHPGEAEEFQSEQKTNLLKKYRLNVEGMTCTGCEEHIAVALENAGAKGIEVDFRRGEALFELPYDVDIDIAKTAITDAQYQPGEAEEIQVQSEKRTDVSLNDEGNYDYDYIIIGSGGAAFSSAIEAVALNAKVAMIERGTVGGTCVNVGCVPSKTLLRAGEINHLAKNNPFVGLHTSASNVDLAPLVKQKNDLVTEMRNEKYVNLIDDYGFELIKGESKFVNENTVEVNGNQITAKRFLIATGASSTAPNIPGLDEVDYLTSTSLLELKKVPNRLTVIGSGYIGMELGQLFHNLGSEVTLIQRSERLLKEYDPEISEAITKALTEQGINLVTGATYERVEQDGDIKKVHVEINGKKRIIEAEQLLIATGRKPIQTSLNLHAAGVEVGSRGEIVIDDYLKTTNSRIYSAGDVTPGPQFVYVAAYEGGLAARNAIGGLNQKVNLEVVPGVTFTSPSIATVGLTEQQAKEKGYEVKTSVLPLDAVPRALVNRETTGVFKLVADAKTLKVLGAHVVAENAGDVIYAATLAVKFGLTVGDLRETMAPYLTMAEGLKLAVLTFDKDVSKLSCCAG

SEQ ID NO: 57794 - protein, 502 aa, Alonsoa meridionalis
MEVGNEAKSTALPPAQAAPVKNIIVVAAIAAGVQFGWALQLSLLTPYVQLLGVPHVWAAFIWLCGPISGLLVQPIVGYYSDNCTSRFGRRRPFIAAGAGLVAVAVFLIGFAADLGHMGGDSLGKGTKPRAVAVFVVGFWILDVANNMLQGPCRALLADMSAGNAKKMSSANSMFSFFMAVGNVLGYAAGSYTRLYKVFPFSKTEACAVYCANLKSCFFISVALLLTVTIIALCIVRETPYTAPPEEAGTVKKHTVPVFGELFGALKDLPRPMWMLLLVTALNWVAWFPFLLFDTDWMGKEVYGGKVGEGSLYDKGVRVGALGLMLNSVVLGVASLGVQVTARGLGGVKRLWGSVNLLLAICLAMTVLITKMAQHHREYASVGGAAPTLQPPVHGVKIGALALFSVLGIPLAATFSIPFALASIYSSNSGAGQGLSLGVLNLAIVIPQMFVSVASGPWDALFGGGNLPAFVVGAVAATVSGIIALTALPSPPSDVKILATGGH

SEQ ID NO: 57795 - protein, 486 aa, Pseudomonas putida
MKEIKHFINGEYVESASGKLFDNVNPANGQVIAKIHEAGEAEVDAAVKAARAALKGPWGRMTVAERTEILHRVAAGISARFDEFLEAECLDTGKPKSLASHIDIPRGAANFSVFADLVKNVPTEAFEMATPDGTGALNYGVRRPKGVIGVISPWNLPLLLMTWKVGPALACGNTVVVKPSEETPTTTALLGEVMNAAGVPAGVYNVVHGFGGNSAGAFLTAHPDVDAYTFTGETGTGETIMRAAAKGLRQVSLELGGKNAGIVFADCDLDKAIEGTLRSAFANCGQVCLGTERVYVERSIFDEFVARLKAGAEALVIGPPDDASSNFGPLVSLKHREKVLSYYQQAVDDGATVVTGGGVPEMPAHLAGGAWVQPTIWTGLADNSVVVTEEIFGPCCHIRPFDREEEAIELANSLPYGLASAIWTENASRAHRVAGQIEAGIVWVNSWFLRDLRTAFGGSKQSGIGREGGVHSLEFYTELKNICVKL

SEQ ID NO: 57796 - protein, 428 aa, Bacillus alcalophilus
MTQTDMSIFEQMESEVRSYCRSFPTVFSKAIGSKMWDEAGKEYIDFFSGAGALNYGHNDPAMKAKLVDYILSDGMTHSLDMATTAKAEFLQSFNDIILKPRNLDYKVMFPGPTGTNTVESALKLARKSTGRTDIISFTNGFHGMTIGSLSVTGNSFKRKGAGIPLHNVVTMPYDSFVSEKLDTLEYLERFLEDRGSGVAIPAAMILETVQGEGGINAASFEWLQRIERTCKRWGILLIVDDVQAGVGRTRTFFSFEKAGIKPDIVCISKSIGGYGLPLALTLIRPELDIWAPGEHNGTFRGNNHAFVTATAALAYWENPTFEKSIADKSKKIKSFLEKIVEDYPEIKGEVRGRGFMIGIASEVKDLSAQVAKEAFKRGLIMETSGPEDEVFKLFPALTIDNETLEKGFDVIEESVKAVVGSKEPMTVS

SEQ ID NO: 57797 - protein, 446 aa, Oryza sativa Japonica Group
MAVTIQSVKARQIFDSRGNPTVEVDVGLSDGSFARGAVPSGASTGIYEALELRDGGSDYLGKGVLKAVSNVNTIIGPALIGKDPTEQVDIDNFMVQQLDGTSNNWGWCKQKLGANAILAVSLAVCKAGAMVKKIPLYQHIANLAGNKTLVLPVPAFNVINGGSHAGNKLAMQEFMILPTGASSFKEAMKMGVEVYHHLKSIIKKKYGQDATNVGDEGGFAPNIQENKEGLELLKAAIAKAGYTGKVVIGMDVAASEFYSEKDKTYDLNFKEDNNDGSHKISGDSLKDVYKSFVSEYPIVSIEDPFDQDDWATYAKLTDEIGQQVQIVGDDLLVTNPTRVAKAISEKTCNALLLKVNQIGSVTESIEAVRMSKRAGWGVMASHRSGETEDTFIADLSVGLSTGQIKTGAPCRSERLAKYNQLLRIEEELGDAAVYAGEKFRAPVEPY

SEQ ID NO: 57798 - protein, 257 aa, Staphylococcus aureus subsp. aureus Mu50
MKHQFSRNELAIGQQGLDLLKQQTVVILGVGGVGSFAAEALARTNIGHIILIDKDDVDITNVNRQLHALTTTVGQSKVSLMEERIKLINPDCKVTPLHMFYTEETYEEIFDNYDIDYFVDASDTIMYKVHLMKECLDRGIKVISSMGAANKTDPTRFTISDISKTHTDPMAKIIRQKLKKLGIRKGIPVVFSDESPIVIREDVKDIVGDKNAINRKGQMPPSSNAFVPSVVGLICASYVVNDVLKDIPVRRIKDKGQ

SEQ ID NO: 57799 - protein, 438 aa, Sphingomonas elodea
MRIAMIGTGYVGLVSGACFSDFGHEVVCVDKDARKIELLHQNVMPIYEPGLDALVASNVKAGRLSFTTDLAEGVKDADAVFIAVGTPSRRGDGHADLSYVFAAAREIAENLTKPSVIVTKSTVPVGTGDEVERIIAEVAPNSGAKVVSNPEFLREGAAIEDFKRPDRVVVGTEDEFARQVMREIYRPLSLNQSAPVLFTGRRTSELIKYAANAFLAVKITFINEIADLCEQVGADVQEVSRGIGMDNRIGGKFLHAGPGYGGSCFPKDTLALMKTAADNETPLRIVEATVQVNDARKRAMGRKVIKAMGGDVRGKTVGILGLTFKPNTDDMRDAPSLSIIAALQDAGATVKAYDPEGVEQASKMLTDVEFVENPYAAADGADALVIVTEWDAFRALDLTRIKNSLKSPVLVDLRNIYPPAELERAGLQYTGVGKPSRD

SEQ ID NO: 57800 - protein, 359 aa, Magnetospirillum magnetotacticum MS-1
MMRTYAIAAIPADGIGKEVVAAGLEVLDALAKRDGGFRLNVESFDWGSDYYKKHGVMMPENGRDTLKKFDAIYFGAVGAPDVPDHITLWGLRLNICQPFDQYANVRPTRILPGIKSPLGNVRPQDLDWVIVRENSEGEYAGQGGRSHRGFPEEVATEVTIFTRAGVTRIMRFAFKLAQSRPRKLLTVVTKSNAQRHGMVMWDEIAAEVAAEFPDVTWDKMLVDAMTMRMTLKPETLDTIVATNLHADILSDLAAALAGSLGIAPTANLNPERKFPSMFEPIHGSAFDITGKGIANPIGTFWTACMMLDHLGETAASARLMRAIERVTADPALHTPDLGGKATTRIVTDAVIAAIKADNE

SEQ ID NO: 57801 - protein, 249 aa, Sinorhizobium meliloti 1021
MTLNNDEDLERLKEIGRICANALQAMGEALELGITTAELDAIGRKVLEDAGARSAPELCYDFPGATCISVNEEIAHGIPGRRVIQPGDLVNIDVSAEKGGLFADTGASFPVPPVKTEIDRLCRDGKRAMWVGLKQVKPGQSLAAIGNSIGEFARKNRYSLVANLASHGIGRSLHEEPSEIATWPDPSERRRMTEGMVFTVEPFLSMGAQWAEGGDDDWTLYSEPRAPTVQYEHTVVVTRSGPLVVTLPG

SEQ ID NO: 57802 - protein, 454 aa, Magnetospirillum magnetotacticum MS-1
MIRTLWEAGADVFRLNFSHGSHDDHLERFKEIRRLEAELGRPIAILADLQGPKLRLGVFKAGKVVLKPGQTFRLDLSPEPGDTTRAPLPHPEILSALTPGSELLLDDGKVRLRVEACGSDFAETVVVVAGPLSDRKGVNVPDAVIPLSALTEKDRHDLAFALELGIDWIALSFVQRPEDVEEARALIGERARILSKLEKPSAIDRLDEIVALSDAVMVARGDLGVELPPEDVPGLQKRIIRSCRAAGKPVVVATQMLESMIEAPTPTRAEASDVATAVFAGADAVMLSAESASGRYPVEAVTMMSRIISRAESDPNYLDGLGSGCAKPEANDADAISAAVCQVTGIVSVAAIVAYTTSGFTTLRIARERPASPILSLTPNAATARHVALAWGVHSVHTEDAANVEDMVAKASGIATREGFTEDGKPLVIIAGMPFGTAGSTNLLRIVRVPRTSL

SEQ ID NO: 57803 - protein, 96 aa, Synechocystis sp. PCC 6803
MMATEVLNKPSNSTIRKHAPRYRVLLHNDDFNSMEHVVQTLIQTVAGMTQPQAVDIMMEAHFNGMSLVITCELEHAEFYCETLRSHGLSSTIEPDE

SEQ ID NO: 57804 - protein, 259 aa, Brassica napus
  misc_feature (228)..(228): Xaa can be any naturally occurring amino acid
MSNYEEQPRAKKTKREAFRLSCLPDDLVLNCLARVSRPDLAALSMVSKRYHSLVASPDLYKIRSLIGRTETYVYVCLRIPTPVPSVRWYILRRRKTLDASDLIQIPSLPSQPLEASSVVVLDCSIYVIGGLIKGEQRSSDVWSLDCRTHVWHPVPSMGAARAYGAAGVVDGKIYVFGGCDVDDNYGEVFDPEIQTWNPLPPMPKRKKHIHSSMVRDQKVYALDEKREXFYYSPREGKWGTGNRGQLVGYRRDWCMVDNL

SEQ ID NO: 57805 - protein, 217 aa, Fulvimarina pelagi HTCC2506
MKHPIETAMNLVPMVVEQTNRGERAYDIFSRLLKERVIFITGPIEDSMATLVCAQLLFLEAENPKKEIALYINSPGGVVTSGMAIYDTMQFIRPAVTTLCIGQAASMGSLLLCAGEKDMRFATPNARIMVHQPSGGFQGQASDIERHAQDIIKLKRRLNETYVKHTGQDYETIERTLDRDHFMTAEESLEFGLIDKVYSSRVEQEGTDRTSQHGATS

SEQ ID NO: 57806 - protein, 150 aa, Synechocystis sp. PCC 6803
MAIFDGVIIPWLAGELVVLSSISGSQLVLNQFMDTLNVKGIRAYGYTGYFDAEQFLGQWFEVDLTIWIDLAKAGQSDDLNDTLNYADAVAIVQKLIRESKFKMIEKLAEAIADAILGTGKTQQVKVALTKCQAPIPDFDGDVTLEILRSR

SEQ ID NO: 57807 - protein, 475 aa, Methanococcoides burtonii DSM 6242
MKEYDLIVIGSGSGMNYVSLIIQQYPEMKIAVIDKDKPGGICLTRGCIPSKMLLYPAELVREIGKANRFGIDAEIKSIDFKFVMERMRSSIDKDIEMIHHGLSSDPNLDYYEHVAKFVEPYVLEIGEELITSKMIFLSIGSKPMIPPVKGLDDISYLTSDTVLELTTLPKSLAIIGGGYIAAEYGHFFSAMGSKVTIIGRSPRIVDNEEPEISELARKKMARYVDIITDHEVSEIHPSGRQKKIVAKDRNSENEMEILVDEVLVATGRSPNTDILHPEKGGIETDERGWIKVNDHLETTCSNVWAFGDANGQYLFKHVGNYESTLVYENAILNEGIKIDYNAVPYAIFSYPEIAGVGIGESAAIEQYGEDNISIGFHRFEDTGKGMAMGLDSYFVKVILGDSGNTLLGAHIIGPQASILIHQLITLMNTPGSNVGPVVNGMDIHPSLSEVVKRALYSRMSVEEYHSVLKSLELEY

SEQ ID NO: 57808 - protein, 420 aa, Oryza sativa
MGSGRSSGGGGVVRCSLQGAVVGGRAEWQSSCAVLSSKVAALGAASPHAAAPSFVNGHVAPLVPEQPAAAAEDGGAVLDLVPVSSVNGGGVAKNLPQPLRISDLSPAPMHGSQLRVAYQGVPGAYSEKAAGKAYPGCDAIPCDQFEVAFSAVELWIADRAVLPVENSLGGSIHRNYDLLLRHRLHIVGEVQLPVHHCLMALPGVRKECLTRVMSHPQALAQCEHTLTAMGLNVVREAFDDTAGAAEYVAANGLRDTAAIASSRAAELYGMEVLADGIQDDCGNVTRFVMLAREPIVPRTDRPFKTSIVFAHDKEGTSVLFKVLSAFAFRDITLTKIESRPHRHRPIRLVDDANVGTAKHFEYMFYVDFQASLAEPRAQNALAEVQEYTSFLRVLGSYPMDMTPMTAGSSSTVTSDDSSST

SEQ ID NO: 57809 - protein, 518 aa, Glycine max
METSEWHIERRSSFGSESPLAREAGNVPETGSLSIVVLGASGDLAKKKTFPALFHLYLQGFLPPDEVHIFGYARTKISDDELRNRLRGYLVPKRGASPQQLEDVEKFLQLIKYVSGSYDSEDGFRLLDKEISEHEYLKNSVEGLSRRLFYLALPPSVYPSVCKMIKTCCMNKPDLGGWTRVVVEKPFGKDLESAEELSTEIGKLFEEPQIYRIDHYLGKELVQNLLVLRFANRFFLPLWNRDNIDNVQIVFREDFGTDGRGGYFDQYGIIRDIIQNHLLQVLCLVAMEKPVSLRPEHIRDEKVKVLESVLPINDDEVVLGQYEGYKDDPTVPDESNTPTFATVALRIHNERWEGVPFILKAGKALNSRKAEIRVQFKDVPGDIFKCKKQGRNECVIRLQPSEAIYMKLTVKQPGLEMSTVQSELDLSYGQRYQGVTIPEAYERLILDTIRGDQQHFVRRDELKASWQIFTPLLHRIDEGEFKPLPCKPGSRGPAEADQLLEKAGYVQTHGYIWIPPTL

SEQ ID NO: 57810 - protein, 235 aa, Arabidopsis thaliana
MCRFSYALGYVNTDSCRNYKLLRLIDYYYNAHEKQFFCTYWCAAKRNVDVNEVFANRLICFDFTSERFGPLLPLPFSGGHIDCMTLSCVREEKLAVLLQHDESNPYELDLSITTKIETGEVLWSKFLRVETAGFDSYVPIINGSFFIDEEKKVAIGFEDGNRHTINIIGEAGYLRALDLVGDYGDQRCKTDLCSYVPSLVQIKQPEGGEREEESELEKLRYDENMSRLVLLETNP

SEQ ID NO: 57811 - protein, 145 aa, Erythrobacter litoralis
HDDMPGMDNDDLRRGKPTNHKVYGEDIAILAGDALLSYAFEYVARTPDIPAERLLQVIVRLGQAVGAEGLVGGQLVDLESEGKTDASVETLNFIHTHKTGALLEVCVTAGAVLAGAKPEEVQLLSRYAQNIGLAFQIVDDILDVE

SEQ ID NO: 57812 - protein, 273 aa, Zea mays
MAFRLSNNLIGVLNFVTFLLSVPILGAGIWLGHRADGTECERYLSAPVIALGAFLLAVSLAGLVGACCRVTWLLWAYLLAMFVLILVLFCFTVFAFVVTNRGAGEAVSGRGYKEYRLGDYSNWLQKRVENTRNWDRIRSCLQDSKVCKSLQDKNETVAQFMSSSLSPIESGCCKPPTSCGYTYVGGTDWTPVTTNSTDPDCKTWSNDASALCYNCQSCKAGVVATFQRNWKRVAVVCIVFLVFIIIVYSVGCCAFRNNRRDNAYRGGWKGGYA

SEQ ID NO: 57813 - protein, 299 aa, Bordetella petrii
MAPSTAENVMKPIRKAVFPVAGQGTRFLPATKAMPKEMLPIVDKPLIQYAVEEAVEAGITELIFVTGRHKRAIEDHFDSMPELEAGLQAKHKTALLEAVRHVIPPHVACLYTRQSAPLGLGHAVLCAAPLVGDEPFAVLLADDLIDADTPAIGQLIDAACRHDSSMLAIQNVPRAQTDQYGIISGHRVDARTARLQGIVEKPLPAEAPTTLAVVGRYVLEPRIFDLLRATQAGVGGEIQLTDGIARLLRERPVHGYQYDGVRYDCGSKVGFFEATMELGRKYHGLGVSREQDAVLAGDD

SEQ ID NO: 57814 - protein, 564 aa, Shigella flexneri
MSTLKITGMTCDSCAVHVKDALEKVPGVQSADVSYAKGSAKLAIEVGTSPDALTAAVAGLGYRATLADAPSVSTPGGLLDKMRDLLGRNDKTGSSGALHIAVIGSGGAAMAAALKAVEQGARVTLIERGTIGGTCVNVGCVPSKIMIRAAHIAHLRRESPFDGGIAATTPTIQRTALLAQQQARVDELRHAKYEGILEGNPAITVLHGSARFKDNRNLIVQLNDGGERVVAFDRCLIATGASPAVPPIPGLKDTPYWTSTEALVSETIPKRLAVIGSSVVALELAQAFARLGAKVTILARSTLFFREDPAIGEAVTAAFRMEGIEVREHTQASQVAYINGVRDGEFVLTTAHGELRADKLLVATGRAPNTRKLALDATGVTLTPQGAIVIDPGMRTSVEHIYAAGDCTDQPQFVYVAAAAGTRAAINMTGGDAALNLTAMPAVVFTDPQVATVGYSEAEAHHDGIKTDSRTLTLDNVPRALANFDTRGFIKLVVEEGSGRLIGVQAVAPEAGELIQTAALAIRNRMTVQELADQLFPYLTMVEGLKLAAQTFNKDVKQLSCCAG

SEQ ID NO: 57815 - protein, 279 aa, Synechococcus sp. WH 7805
MPMRLAFLGPKGTYGERAAREMLTLEGIPDGELVACSGLRAVVDHVADGRCDGAVVPVENSVEGGVTASLDALWSHRDLCVRRAVVLPIRHALLSSGSMADITEVLSHPQALAQCSGWLSTNLPGALQLPTSSTAEAARMVRGSRFRAAIADRSVGERMELQQLAFPVNDVAGNCTRFLFLKRGERLREGDVASLAFSLNRNAPGALIEALQAIAGLGLNMSRIESRPSKRELGEYVFFVDVELPSANVEGVLDALEDQLHPLCEHLAQFGAYPSSDLS

SEQ ID NO: 57816 - protein, 154 aa, Campylobacter coli RM2228
MTIIEGKLNLDSNTKIAIINARFNHIITDRLVEGARDAFLRHGGKEENLSLILVPGAFELPFALKKAIESKKFDAICCVGAVIRGSTPHFDYVSAETTKGIANVSLNHNIPVSFGVLTTDTIEQAIERAGSKAGNKGFEAMTTVIEMLNLSKEF

SEQ ID NO: 57817 - protein, 449 aa, Pseudomonas fluorescens Pf-5
MNMPETAPQSLASQLKLDAHWMPYTANRNFQRDPRLIVGAEGSWLVDDKGRKIYDSLSGLWTCGAGHSRKEIQEAVAKQLGTLDYSPGFQYGHPLSFQLAEKITDLTPGNLNHVFFTDSGSECADTAVKMVRAYWRLKGQSTKTKMIGRARGYHGVNIAGTSLGGVNGNRKLFGQAMMDVDHLPHTLLASNAYSRGMPEQGGIALADELLKLIELHDASNIAAVFVEPLAGSAGVLVPPQGYLKRLREICDQHNILLVFDEVITGFGRTGAMFGADSFGVTPDLMCVAKQVTNGAIPMGAVIASSEIYQTFMNQATPEYAVEFPHGYTYSAHPVACAAGLAALDLLQKENLVQSVAEVAPHFENALHGIKGTKNVIDIRNFGLAGAIQIAPRDGDAIVRPFEAGMALWKAGFYVRFGGDTLQFGPTFNSKPQDLDRLFDAVGEVLSKLD

SEQ ID NO: 57818 - protein, 497 aa, Pseudomonas fluorescens Pf-5
MSLIQHLIHGELVSDNGRSADVFNPSTGQAIHKVPLASRETIQQAIDSAKSAFPAWRNTPPAKRAQVMFRFKQLLEQNEARIAKLISEEHGKTLEDAAGELKRGIENVEYACAAPEILKGEYSRNVGPNIDAWSDFQPLGVVAGITPFNFPAMVPLWMYPLAIACGNCFILKPSERDPSSTLLIAELLHEAGLPKGVLNVVHGDKTAVDALIEAPEVKALSFVGSTPIAEYIYAEGTKRGKRVQALGGAKNHAVLMPDADLDNAVSALMGAAYGSCGERCMAISVAVCVGDQVADALVAKLVPQIKALKIGAGTSCGLDMGPLVTAQARDKVSGYVEDGVAAGAQLVVDGRGLSVAGHEDGFFLGGCLFDRVTPQMRIYKEEIFGPVLCIVRVNSLEEAMQLINDHEYGNGTCIFTRDGEAARLFCDEIEVGMVGVNVPLPVPVAYHSFGGWKRSLFGDLHAYGPDGVRFYTRRKAITQRWPQRASHEASQFAFPSL

SEQ ID NO: 57819 - protein, 412 aa, Candida albicans SC5314
MSELHDLCKFPTRPIDQSYIDKLTQYLKDGIPATYTIEEAYNYINNIEEEPTTTTTPLHLICSHAPFDITKEEQEIISTMVEKLFEYGAGWSFTDINNQTPGCILISRRKERENKEEDGKWMNDVYQQIIDAGVRAELLLRKVNEFEEIEFIEEDDEQEEKEEEDIPQLVKDEQEIKEEAKQEQTTTTDIKPVVIDDAPDAPSQNQQSYLNTKLEYINDALITKDDKDGVMMAWENDIMKLASDTITSSASSASDSESEQEVNILNIGFGMGIIDAMIQSKLKSHPNAKHYICEAHPDVLQKMKIDGWYEKPNVIILEGRWQDKLNDLLSSSSSSSEASVFFDGIYYDTFSEHYQDMLELFDIIVGLLKPHGIFSFFNGLGADRQIIYEVYKNLLIIDLENYGLNCQFKEFN

SEQ ID NO: 57820 - protein, 172 aa, Staphylococcus aureus subsp. aureus Mu50
MDLKQYVSEVQDWPKPGVSFKDITTIMDNGEAYGYATDKIVEYAKDRDVDIVVGPEARGFIIGCPVAYSMGIGFAPVRKEGKLPREVIRYEYDLEYGTNVLTMHKDAIKPGQRVLITDDLLATGGTIEAAIKLVEKLGGIVVGIAFIIELKYLNGIEKIKDYDVMSLISYDE

SEQ ID NO: 57821 - protein, 202 aa, Synechocystis sp. PCC 6803
MPNSMDANMDFKTNLLEAIAGKNRGLLASDRDRVAILSAVEKLEDYNPHPKPLQEKNLLDGNWRLLYTSSQSILGLNRLPLLQLGQIYQYIDVAGSRVVNLAEIEGIPFLESLVSVVASFIPVSDKRIEVKFERSILGLQKILNYQSPLKFIQQISTGKRFLPADFNLPGRDNAAWLEITYLDEDLRISRGNEGNVFILAKV

SEQ ID NO: 57822 - protein, 392 aa, Synechocystis sp. PCC 6803
MLNPNLAEIELSQDDYQRYSRHIILPEVGLDGQKRIKAASVLCIGSGGLGAPLLLYLAAAGVGRIGLVDFDIVDTSNLQRQIIHGTSWVGKPKIESAKQSIMEINPFCQVDLYETQISSANALDIIAPYDIVIDGTDNFPTRYLTNDACVLLNKPNVYGSIFRFEGQATVFNYQGGPNYRDLYPEPPPPGMVPSCSEGGVLGILPGIVGTIQATEALKIILGAPNTLSGRLLLFNAWDMKFRELKLRPNPVRPVIEKLIDYDQFCGIPQAKAAEAEQASALSEMTVRELHALMESQEKDFILLDVRNPNEYDIARIPGSVLVPLPDIEEGHGIDKVKELLDGHEGILIAHCKLGGRSTKALSLLKEAGIEGINVKGGITAWSREVDPSVTEY

SEQ ID NO: 57823 - protein, 832 aa, Ashbya gossypii ATCC 10895
MVKDEHKRLLDASGTEPRDEDATATAILKRKKKDNYLLVDDAVKDDNSVIVVNSNTMDLLQLFRGDTVLVKGKMRKDTVLIVLLDDELADGVCRINRVVRNNLRVRLGDLVSIHPCPDIKYAERISVLPIADTIEGLTGNLFDVYLKPYFVEAYRPVRKGDHFIVRGSMRQVEFKVVNVEPEDYAVVAQDTIIHSDGEPINREDEVCNINEVGYDDIGGCRKQMAQIREMVELPLRHPQLFKAIGIKPPKGVLMYGPPGTGKTLMARAVANETGAFFFLINGPEVMSKMAGESESNLRKAFEEAEKNAPAIIFIDEIDSIAPKRDKTNGEVERRVVSQLLTLMDGMKSRSNVVVIAATNRPNSIDPALRRFGRFDREVDIGIPDATGRLEILNIHTKNMRLADDVDLEVLAAETHGYVGADIASLCSEAAMQQIREKMSLIDLDEDEIDAEVLDSLGVTMDNFRFALGNSNPSALRETVVESVNVTWDDVGGLDDIKRELKETVEYPVLHPDQYIKFGLSPSKGVLFYGPPGTGKTLLAKAVATEVSANFISVKGPELLSMWYGESESNIRDIFDKARAAAPTVVFLDELDSIAKARGGSMGDAGGASDRVVNQLLTEMDGMNAKKNVFVIGATNRPDQIDPAILRPGRLDQLIYVPLPDEAGRMSILKAQLRKAPLEPGLDLGAIAKATQGFSGADLSYIVQRAAKFAIRDSIEAQKRAEAERADKPKTEDVEMSDANVASEEEVDAVPFITREHFADAMKTAKRSVSDAELRRYEAYAQQMKASRGQFGNFSFGSEARSDSGAGAAPAGTESSGAAAFNNAADEDDDLYS

SEQ ID NO: 57824 - protein, 338 aa, Arabidopsis thaliana
MPTLYKKAGCQFQLTTMGGVKRKISIELIEKKDSRAVAFSKRSRGLYSKASDLCLLSDAQIAIIATPVSSKSNVSFYTFGHSSVDNVVAAFLTNQRPREGLGLDYWWEDERLSKSEDLEELRDAMDSMSKMLKDLKDLQNQRDCEEDVKKKGVLHGTHQKQTFNPESCSVNFDGFNKNTEEFDLDEIFDYVSTAEALSMNLDMDDVSVVTTNQNPVSASETVEDRELVVHKNMDEDNIHVSDMDDKDTMLMISDKNNVLPENLDEFDQELDLDQLLDFETNYESLLKSCEMEDYASMVTTKQNLCSNPEAVEDGGLMIQKDLPEDNLCFSDYFSDLHC

SEQ ID NO: 57825 - protein, 517 aa, Porphyromonas gingivalis W83
MSFQLERVKELIQLREKARLGGGEKRIEAQHQKGKYTARERIAMLLDEGSFEELDMFVKHRCTNFGIDKTQFLGDGVVVGSGTIDGRLVYVFAQDFTVFGGALSEMLASKICKVMELAMRMGAPVIGLNDSGGARIQEGVNALKGYGEIFENNILASGVIPQISAIFGPCAGGAVYSPALTDFTIMSRGTSYMFLTGPKVVKTVTGEDVTQEQLGGADVHASKSGVAHFAVNSEEDGIRLIRHLLSFLPQNNLEEAPYVECDDPIDRLEDSLNEIIPDEANRPYDMYEVIGSIVDHGEFLEVHRDYARNIIVGFARFNGQSVGIVANQPQVMAGCLDSNASRKAARFVRFCDAFNIPLVTLVDVPGFLPGTGQEYNGVITHGAKLLYAYGEATVPKVTVTLRKAYGGAYIVMSSKHLRSDINYAWPSAEIAVMGPSGAVEVIFAKEVAAAENPQQAALEKEEEYRQAFANPYNAASYGYMDDVIEPRNTRFRIIRALEQLRTKKQTIPAKKHDNVPL

SEQ ID NO: 57826 - protein, 403 aa, Ashbya gossypii ATCC 10895
MDTQTPLLDRRRRRATGGVAARLGRDLRVVFHSSPVNYLLVFVPLGLALGYAGASAGWVFLVNFLAIIPLAAILAFATEELAEHVGSTLGGLLNATLGNAVELIVSVIALRRGQVRIVQASMLGSLLSNLLLVLGFCFLFGGINGGQQKFNQTAAQTMSSLLVISCASLLIPAAFKATLPSETEEQSVIIGDKLLKLSRGTSMVLLVVYVLFLCFQLLTHHEMFEQQEEAVVETYEPRHAQLSVRSSLGYLLASTVLVSLAADFLVDSIDDIVESTGLSKTFIGLIVIPIVGNAAEHVTSVIVAMKNNMSLALSVAIGSSLQISLFVTPFMVLIGWWINVPMTLNFSTFETATLFTSVFLSNYLILDGESNWLEGVMSLAMYALISLAFFYYPDEEAIASVLA

SEQ ID NO: 57827 - protein, 390 aa, Zea mays
  misc_feature (242)..(242): Xaa can be any naturally occurring amino acid
MGALSRPEEVLALVKLRVAAGQIKRQIPPEEHWAFAYSMLQKVSRSFALVIQQLGPELRNAVCIFYLVLRALDTVEDDTSIPTEVKVPILQEFYRHVYNRDWHYSCGTNHYKVLMDKFHLVSTAFLELGQGYQKAIEEITRRMGAGMAKFICKEVETVDDYDEYCHYVAGLVGYGLSRLFYAAGTEDLAPDSLSNSMGLFLQKTNIIRDYLEDINEIPKSRMFWPREIWSKYADKLEDFQYXPNIPQKAVQCLNDIVTNALIHAEVSLQDMSALKNHAIFRFCAIPQIMAIGTCALCYNNVHVFRGVVKMRRGLTARIIDETNSMSDVYTAFYEFSSLIESKIDDNDPNAALTRRHVNSIKQTCKSSGLVKRRGYHLDTSPYRPMLVSNP

SEQ ID NO: 57828 - protein, 238 aa, Zea mays
MGKKAIRYAVVDAFAAEPFKGNPAAVCLLEEEGASAAVDDRWMQSVAAEFNLSETAFLARDSSGGAGAAPRFHLRWFTPVTEVDLCGHATLASAHFLFTTVLPEHGKLEFMTRSGILTAKKVPAPGSTGVPGEEQGKLFIELDFPMIGFLECDETPSILETLNGAPIVSVHKSATDGDLIVELSSGKEVVNILPSIDEIKNLACRGLIFTGPAPAGSGYDFFTRFFCPKIGIDEDPVT

SEQ ID NO: 57829 - protein, 451 aa, Penicillium chrysogenum
MATNGSFSHYHAASSAEAIEAEHEYAAHNYHPLPIVFARAQGTSVWDPEGRHYLDFLSAYSAVNQGHCHPKLNAAAVDPSFASTLSSRAFYNDVFPRFAKFVTGYFGFDMVMPMNTGAEAVETGIKIARKWGYKVKGIPENKAVILSAENNFHGRTFAAISLSSDPESRENYGPYLPGIGCTIPGTEKPIAYNDKVALREAFEAAGPNLAGFLVEPIQGEAGIVVPDEDYLQEARALCDKHNVLLICDEIQTGIARTGKLLCHEWSGIKPDLVLLGKAISGGMYPVSCVLGRKDVMLTIEPGTHGSTYGGNPLGCAVAIRALEVVQEENMVERSEKLGHLFRDGLLGIQSPIIQTVRGKGLLNAIVIDESKTNGHTAWDLCMLMKEKGLLAKPTHQNIIRLAPPLVITEEEIQKALDIIKEAVTDLPNLKGASEDKVIPPPEKKVKIALEN

SEQ ID NO: 57830 - protein, 168 aa, Prochlorococcus marinus subsp. marinus str. CCMP1375
MKHTLSVLVEDQSGALSRISGLFARRGFNINSLAVGPAEAEGISRLTMVVEGDHQTLQQMTKQLDKLINVLKVVDLTTFPAVERELMLLKVSATNEKRTSILDLVQVFRAKVVDVSDDALTLEVVGDPGKLVALEKLLKPYGILEIARTGKVALERASGVNTEMLKSS

SEQ ID NO: 57831 - protein, 147 aa, Erythrobacter longus
HDDLPWMDDDDLRHGKATLHHVYDEATAVLAGDALHALAFEILADHGTSSDPFVRSELIATLGTASGMNGMAGGQMMDMVADEEGVTYDLQAITRLQQLKTGALLSCAVEMGAVLGKVPVEGRAHLRAYSRDIGLAFQIADDILDVE

SEQ ID NO: 57832 - protein, 315 aa, Pasteurella multocida subsp. multocida str. Pm70
MPDIKLFTGNATPELAKRISERLYLSLGDATVGRFSDGEIQVQINENVRGSDVFIIQSTCAPTNDNLMELIVMVDALRRASAGRITAVIPYFGYARQDRRVRSARVPITAKVVADFLSSVGVDRVLTCDLHAEQIQGFFDVPVDNVFGSPVLVHDMLKKIDMQNPIVVSPDIGGVVRARAIAKLLNDTDMAIIDKRRPRANVAQVMHIIGDVAGRDCILVDDMIDTGGTLCKAAEALKERGAKRVFAYATHAVFSGSAAKNLASDALDEVVVTDTIPLSPEIKALNKVRVLTLSGMLAEAIRRISNEESISAMFT

SEQ ID NO: 57833 - protein, 209 aa, Zea mays
  misc_feature (197)..(197): Xaa can be any naturally occurring amino acid
MAGILAWAADVVGGAGGSDDEADDDARAAASAAMTPAQRLRAADLDARAASLRRAIQDLRLRVPPPHVAQRLPHLHADSLASSAALALQLNAHSSTKEQTQQREVTLQEENAAYEKAISECKQKIQEKQMEATQLLSNLEEMEVTEHNLKTQLENALKELEAAQHKASTATSGTAENALLEAKSVTDLKSKDLEEKXRELELLDNKVPT

SEQ ID NO: 57834 - protein, 248 aa, Flavobacteria bacterium BBFL7
MKLLEGKTALITGASRGIGKGIAQVYAQHGANVAFTYSSSEGPALELEKELTALGIQAKAYKSNAASFQESQDLVEEVVKDFGTVDILINNAGITKDNLLMRISEEDFDQVIEVNLKSVFNMTKAVQRTMLKKRSGSIINMSSVVGVKGNAGQTNYAASKAGIIGFSKSVALELGSRNIRCNSIAPGFIETEMTGKLNEEVVQGWRDAIPLKRGGSPEDVANACVFLGSDLSTYVTGQTLNVDGGMLT

SEQ ID NO: 57835 - protein, 431 aa, Methanococcoides burtonii DSM 6242
MKVSIIGSGYVGSVSAACFAELGHEVICIDIDEMKVRMINDGIPPIWEEGLEGLMQKHAEKNLIATSDYDYAIQNSDISFICVGTPSNEHGNIDLSIVGNACKSLGMAMAKKDGFHIVVVKSTVVPGTTEDVVLHLLEEHSCKTAGKDFGLAMNPEFLREGKAVYDFMNPDKIVVGGIDGRTIALVSELYRDLECEVTSTNPRTAEMIKYVNNSFLATKISFSNEVGNICKRLGIDTYEVMKAVGKDFRISEHFLNSGAGFGGSCFPKDVRALIGKAKELDYYPALLESVVEVNDLQPIQMFELLEENVGDVKGKRIAVLGLAFKNDTDDIRESRSIPVIRKLLEKGALVTAYDPMASEHMKAVFEDITYCESSEDALNGADACLIMTEWTEFRKLDSEFSGMKSKVVIDGRKMIDPDNLEQDIVYEGLCW

SEQ ID NO: 57836 - protein, 245 aa, Flavobacteria bacterium BBFL7
MVIGAGQAGVLFKTLGNGVDLENTYGEGFHIIAPWNDMIIYPTRQQSISDKMQVLSVNGLEVKVDATVWYMPEYDKLPFLHQEKGRQYESEILAPAISAAARSVVGRYTPEQLYSSKRDVIQAEILEEVQKELETQYVIVNRVLVKDVTLPIKIKEAIERKLKQEQESLEYEFRLTKATKEAERQKIDAEGKAVANRILSASLTDKILTEKGIEATLMLSQSPNSKVIVIGGSESGGLPIILGNQ

SEQ ID NO: 57837 - protein, 145 aa, Bacillus sp. JL-34
HDDMPGMDNDDLRRGKPTNHKVYGEDIAILAGDALLSYAFEYVARTPDIPAERLLQVIVRLGQAVGAEGLVGGQVVDLESEGKTDVSVETLNFIHTHKTGALLEVCVTAGAVLAGAKPEEVQLLSRYAQNIGLAFQIVDDILDVE

SEQ ID NO: 57838 - protein, 401 aa, Triticum aestivum
LNPCQQNPRLRRAETPSQNTHPHPKPRPPKHSARNRDSRPPLAPACAVLTISLRRGGIRGGEMAPLVPSSQPWVEKYRPRQVKDVAHQEEVVRVLTNTLETADLPHMLFYGPPGTGKTTTALAIAYQLYGPELYKSRVLELNASDERGINVVRTKIKDFAAVAVGSARKGGYPCPPYKIIILDEADSMTEDAQNALRRTMETYSKVTRFFFICNYISRIIEPLASRCAKFRFKPLSEDVMSNRILHICNEEGLTLDAQALSTLSAISQGDLRRAITYLQSAARLFGSSISSSDLISVSGAIPEDIVKSLLVACKSGEFDVANKEVSNIIADGYPVSQLLSQFLDVIVNADDIPDEHKARICRKLGEADKCLVDGADEYLQLLDMASETIRALFNIPQGLVF

SEQ ID NO: 57839 - protein, 145 aa, Bacillus sp. JL-39
HDDLPGMDNDDLRRGKPTNHKVYGEDIAILAGDALLSYAFEYVARTPDIPAERLLQVIVRLGQAVGAEGLVGGQVVDLESEGKTDVSVETLNFIHTHKTGALLEVCVTAGAVLAGAKPEEVQLLSRYAQNIGLAFQIVDDILDVE

SEQ ID NO: 57840 - protein, 433 aa, Streptococcus sobrinus
MSIITDVYAREVLDSRGNPTLEVEVYTESGAFGRGMVPSGASTGEHEAVELRDGDKSRYGGLGTQKAVDNVNNIIAEAIIGYDVRDQQAIDRAMIALDGTPNKGKLGANAILGVSIAAARAAADYLEIPLYSYLGGFNTKVLPTPMMNIVNGGSHSDAPIAFQEFMIMPVGAPTFKEGLRWGAEVFHALKKILKERGLETAVGDEGGFAPRFDGIEDGVETILKAIETAGYEAGEKGIMLGFDCASSEFYEDGVYDYTKFEGEKGAKRSAAEQIDYIEGLVNKYPIITIEDAMDENDWEGWKALTERLGNRVQLVGDDFFVTNTDYLARGIKEGAANSILIKVNQIGTLTETFEAIEMAKEAGYTAVVSHRSGETEDSTIADIAVATNAGQIKTGSLSRTDRMAKYNQLLRIEDQLGEVAQYKGINSFYNLKK

SEQ ID NO: 57841 - protein, 104 aa, Synechococcus sp. WH 7805
MAVETPSLTPGGAAVLDKAPERVRKQSPRYKVLLHNDPVNSMEYVVSTLRQVVPQLSEQDAMAVMLEAHNTGVGLVIVCDLEPAEFYCETLKGKGLTSTLEPDT

SEQ ID NO: 57842 - protein, 603 aa, Xylella fastidiosa Ann-1
MSLFPRCFLLLCVFFSHVSAEQTEVGLLREGVARVPPGAVIASSHYLATDAGLQILKQGGNAFDAAVAVSSTLSVVEPISSGLGGGGFFLLHDAKTGRDVMLDAREYAPASVNLGTFLNKDGQLDHDRSINGPWSAGIPGLPAALVELAEHYGKLPLRQTLAPAIRIASAGFPVYRRMVEGYQSRREVMERYPGTREVYLRGGKPMDEGDIFKQPELARTLSLLANKGFDGFYKGETAKRLLAGVNQAGGRWTAEDLAGYRVKSRVPITFDYRGWKITTAPPPSSGGIALAEMLQILEGWDLARLDDVHRVHLVVEAMRRAYRDRTFFLGDPDFVSIPQRVLTSQDYARGLRAGINPEKATPSVLLSGHPTPLEDEETTHFSIIDAEGNRVGATQTVNLLYGSGLIPNGTGVLLNNEMDDFALQPGVPNVFGVMGYEANAPKPGKRMLSSMTPTFLESADKVAVIGTPGGSRIITMVLLGILGYDAGLDAQRVAALPRYHHQWLPDVIETEAATFPAEVIKGLETMGHTIKQPSDTVAGGRGSSHVWGNVQTVEWDRRSNVLIGGHDPRHVVGKAAVWLTDKAVVLPPMDHLPTPCLQDCHAQ

SEQ ID NO: 57843 - protein, 536 aa, Photobacterium profundum SS9
MTLPPDLKMKKGSGAIRTKLPIYSNSLPPCNHACPTGSNIQEWLSLAQSEHYEDAFQALIKNNPMPAIHGRVCYHPCESACNRTNVDQAVSIHAVERYLGDQALVNNWQVRFQAEPTGKRVLVVGAGPSGLATAYHLKRKGHEVEIRDSAPMAGGMMHFGIPAYRLPRDILENEIARIEAMGIKIILNHKVENLLAEKVKGQFDAVFLAIGAHVGRGVDIPNDEPGKVNDAVSYLRDVEMGTAPILGKRVAVYGGGNTAMDAARTARRLGADVTVIYRRDRAHMPAHDFECVEAMEEGVTFHWQRTIKEIDGTAFTLEKMAIDDNGRPQPTGEFETVKADSLILALGQNIDTKLTESIPCVEHKHDGTVIVNEQMMTGYKGLFAGGDMVPSDRTVTIAVGHGKKAAAHIDAFLNHRSFNKISKQPLIRFDKLHLWYKTDAEQSEQPAIPVIQRATSFDEVVGGLTEEEALYEAQRCYSCGNCFECNGCLGACPQGAITHLGKGKGYKVDYDKCTGCEACYSQCPCHAIEMVAALTE

SEQ ID NO: 57844 - protein, 150 aa, Virgibacillus halodenitrificans
TKERTFLMVKPDGVQRNLVGEVVKRFESKGLKLAGAKLMVISKDGAAAHYAELGGGPFFGGLVGGATSGPVFAMVWEGLNAAATARQILGATNPSDAAPGTIRGDFGVSAGRNAIHGSDSAGSAAKEIGAFFGGGEAASGTPAAAADIYG

SEQ ID NO: 57845 - protein, 117 aa, Sonneratia alba
VMAKLASILILFAAFLFVLLLEETEASSSVVAANELQLQGRDINKMYGISEGSLRPQECGPRCTRRCSATSYKKPCMFFCQKCCAKCLCVPPGTYGNKQVCPCYNNWKTKRGGPKCP

SEQ ID NO: 57846 - protein, 316 aa, Synechococcus sp. WH 7805
MGAFCFGLKSIHLTCFTFHTSRPSTLIELILSVGLAFIMLSLGLSLQPADFSRALGQPRALMGGALAQLILLPLVAFGLLSLSGLDGDLALGIMILSCCPGGITSNVMTRLSRGDVALSISYTALASLVTAFTLPVVLSLTAPFLLPSQTLELSILPLSLKVFSISTVPVVIGVWTAQQAPGFCERNRQKAERLANLLFVLIVAGTLISQWSVFTSNLKSIGPTLLALNLLMLAIGLSLGKLLQMSTEQTTSLSIEAGFQNGTVGIVVGSLLGPDLMQSQLNSFSLPSAVYGVLMTVTILPFIAWRRSIKPMTTQP

SEQ ID NO: 57847 - protein, 528 aa, Candida albicans SC5314
MAIVETVIDGINYFLSLSVTQQISILLGVPFVYNLVWQYLYSLRKDRAPLVFYWIPWFGSAASYGQQPYEFFESCRQKYGDVFSFMLLGKIMTVYLGPKGHEFVFNAKLSDVSAEEAYKHLTTPVFGTGVIYDCPNSRLMEQKKFAKFALTTDSFKRYVPKIREEILNYFVTDESFKLKEKTHGVANVMKTQPEITIFTASRSLFGDEMRRIFDRSFAQLYSDLDKGFTPINFVFPNLPLPHYWRRDAAQKKISATYMKEIKSRRERGDIDPNRDLIDSLLIHSTYKDGVKMTDQEIANLLIGILMGGQHTSASTSAWFLLHLGEKPHLQDVIYQEVVELLKEKGGDLNDLTYEDLQKLPSVNNTIKETLRMHMPLHSIFRKVTNPLRIPETNYIVPKGHYVLVSPGYAHTSERYFDNPEDFDPTRWDTAAAKANSVSFNSSDEVDYGFGKVSKGVSSPYLPFGGGRHRCIGEQFAYVQLGTILTTFVYNLRWTIDGYKVPDPDYSSMVVLPTEPAEIIWEKRETCMF

SEQ ID NO: 57848 - protein, 471 aa, Campylobacter coli RM2228
MIINGVNVFRLNFSHGTHEYHKNNLETIRKVSRELNTRVGILQDISGPKIRTGELKTPFELKKGDRLDFYYEKIIGEQIAPNHYKLSINQSEILNMLKLDEYVYLYDGSIRAKVTAKDSEKIETLIENDGFLNSNKGINFPNTKINIDVITQKDKKDLLWGIENEVDFLAISFVQNAHDIDEVREILAQNNAKISIFAKIEKFDAVENIDEIIASSDGIMVARGDLGIEVPYYKVPNIQKAIIHKANNASKPVITATQMLFSLAKSKTATRAEISDVANAVLDGTDAVMLSEESAVGIDPANAVDVMCQTIIETEKRYPYNKFNEFENLDNTDKIMRSSAHLATDLNADAIFSLTSSGKSAIKISRYRPDMEIIAVAHSEKTLNSLSIVWGVNPAILVNKSEDLTDLLRDSVKSSVEKGFMNKEKCYLLTAGFPTGVEGTSNLIRILAKSKLLTILNRLKFLSLFKSTSKI

SEQ ID NO: 57849 - protein, 508 aa, Pseudomonas fluorescens Pf-5
MNASLKPDGTTLQQVKLLIDGEWIQSQSQEWHDIVNPATQEVLAKVPFATAAEVDAAIAAAQRAFQTWKLTPIGARMRIMLKLQALIREHSKRIAVVLSAEQGKTIADAEGDIFRGLEVVEHACSIGTLQMGEFAENVAGGVDTYTLRQPIGVCAGITPFNFPAMIPLWMFPMAIACGNTFVLKPSEQDPLSTMLLVELAVEAGVPAGVLNVVHGGKDVVDALCTHKDIKAVSFVGSTAVGTHVYDLAGKHGKRVQSMMGAKNHAVVLPDANREQTLNALVGAGFGAAGQRCMATSVVVLVGAAKQWLPDLKALAQKLKVNAGSEPGTDVGPVVSKRAKARILELIESGVKEGAKLELDGRDIKVPGYEQGNFIGPTLFSGVTTDMQIYTQEIFGPVLVVLEVDTLDQAIALVNANPFGNGTGLFTQSGAAARKFQSEIDVGQVGINIPIPVPVPFFSFTGSRGSKLGDLGPYGKQVVQFYTQTKTVTSRWFDDDSVNDGVNTTISLR

SEQ ID NO: 57850 - protein, 117 aa, Sonneratia caseolaris
VMAKLASILILFAAFLFVLLLDETKASSSGVAANELQLQGRDINKMYGISEGSLRPQECGPRCTRRCSATSYKKPCLFFCQKCCAKCLCVPPGTYGNKQVCPCYNNWKTKRGGPKCP

SEQ ID NO: 57851 - protein, 117 aa, Sonneratia ovata
VMAKLASILILFAAFLFVLLLDETKASSSVVAANELQLQGRDINKMYGISEGSLRPQECGPRCTRRCSATSFKKPCMFFCQKCCAKCLCVPPGTYGNKQVCPCYNNWKTKRGGPKCP

SEQ ID NO: 57852 - protein, 390 aa, Oryza sativa Japonica Group
MDSIMEPYVADLLADDITASMVELLSGDGGAAQMDVGVLDAYLRAIGALPAHPAAPGADLAAAAEVESMASNDDTNGNWDTKVDAKVPSAFLPPPPGFPPLPVPALADEPVYAAPVDEGDAIRAFMQQLEWSEQYNGDDDAPAPDDSMASRPQLCAPYDDDIDANLRAMEKDAAERPSPDYLDTVHNGQISAASRASLVAWMGRLTHRYELAAGTLHRAVSYFDRFLSARALPSYTEHQLSLVGATAVYTAAKYEDQGTVFKLDAREIASYGEFASAQEVLAMEREMMAALGYRLGGPNAETFVEHFTRYSKGKEELRVQRLARHIADRSLESYGCLGYLPSVVAAAVISIARWTLNPPGALPWSSELHELTGYSSQDISSCVLTVLNTQ

SEQ ID NO: 57853 - protein, 464 aa, Burkholderia pseudomallei K96243
MSTAALVEGKIVQCIGAVIDVEFPRESMPKIYDALILEGSELTLEVQQQLGDGVVRTICLGASDGLRRGVVVKNTGNPISVPVGKPTLGRIMDVLGRPIDEAGPIESENKRSIHQKAPAFDELSPSTELLETGIKVIDLICPFAKGGKVGLFGGAGVGKTVNMMELINNIAKEHGGYSVFAGVGERTREGNDFYHEMKDSNVLDKVALVYGQMNEPPGNRLRVALTGLTMAEHFRDEGLDVLFFVDNIYRFTLAGTEVSALLGRMPSAVGYQPTLAEEMGKLQERITSTKKGSITSVQAVYVPADDLTDPSPATTFGHLDATVVLSRDIASLGIYPAVDPLDSTSRQIDPNVIGEEHYSITRRVQQTLQRYKELRDIIAILGMDELSPEDKLSVARARKIQRFLSQPFHVAEVFTGSPGKYVPLKETIRGFKMIVDGECDHLPEQAFYMVGTIDEAFEKAKKIQ

SEQ ID NO: 57854 - protein, 117 aa, Sonneratia apetala
VMAKLASILILFAAFLFVLLLDETKASSSVVAANELQLQGRDINKMYGISEGSLRPQECGPRCTRRCSATSYKKPCMFFCQKCCAKCLCVPPGTYGNKQVCPCYNNWKTKRGGPKCP

SEQ ID NO: 57855 - protein, 626 aa, Oryza sativa
MAFQLLPAMIIAASLLHVAAAVGNETSSNNNTSCAPARCGNLTITYPFSLSGVQPLYCGYPVLDLTCDNRTGHAFLSRTFREHLFRIDNIFYENSSLVAAVQTTFAGDADCPIPDFNTTMGAYISDRWNSTPPSGIPGNCISVSLPVRGGDGMKLLDQHYEQLIADTIGGRTIIHGDGGGSIGGNGNGSIQQYERLISDGFVLEWQRAVTRDPDCDACRRNGGECRFQQLMFQCVSCHGLICSNSTSPCDQDDDCVKAFSLLLRELFSCIHPPVDEGCLRKLAWQPMTLSQEDWSNRKLNVRAILIAGVVFMCLVWIMHRRKQTLGFIIHHKYTGNESNTEEELKRYQSLSPKRYRYSDLKKITKCFKEKLGEGGFGTAFKGNLKDGRMVAVKLLKGAKGNGEEFLNEVTSIGRTSHVNIVNLLGFCLERSKRALVYEYMANGSLGKYIYSESLRLAIGLESLQKIAIGVARGLEYLHQGCSTRIIHFDIKPHNVLLDEDLCPKIADFGLAKLCHLKDSAISMAEARGTIGFIAPEVFSRGFGVVSTKSDVYSYGMMLLEMVEGRKNVKTNTDNSSAYFPNWIYDHLAKDLQSHEVTCENEEIARKITLVGLWCIQTAPRKSSFNE

SEQ ID NO: 57856 - protein, 151 aa, Synechococcus sp. CC9605
MAERTFIAIKPDGVQRGLVGEILGRFERKGFKLVGLKQITPSRALAEQHYGVHKERPFFAGLVDFITSGPVVAMVWEGDGVIASARKLIGATKPLEAEPGTIRGDLAVNIGRNVIHGSDAAETAQFEIGLWFQASELNDWSPSDQGWRVEG

SEQ ID NO: 57857 - protein, 641 aa, Ehrlichia canis str. Jake
MFRRNILNILLILIFSFVVSCSNKIKYQFSRKYSPIYNPEGEAFGNDEEFYRAYSIYKERRDSATSDIGKNSKHVDTRKKLRRKVQVKNVDPLEEYDVFLEKEDHDLMIDRNGVNLVDVEGAKFIVPIENDMPDTMRDKKHVGVGVSGPNVDDSKLPIVKVEDKSKLQDTKDKKRDDSKLPVIKVEDKSKLQDTKDKKRDDSKLPVIKVEDKSKLQDTKDKKRDDSKLPVIKVEDKSKLQDTKDKKRDDSKLPVIKVEDKSKLQDTKDKKRDDSKLPVVKVEDKSKLQDTKDKKRDDSKLPVVKVEDKSKLQDTKDKKRDDSKLPVIKVEDKSKLQDTKDKKRDDSKLPVIKVEDKSKLQDTKDKKRDDSKLPVIKVEDKSKLQDTKDKKRDDSKLPVIKVEDKSKLQDTKDKKRDDSKLPVVKVEDKSKLQDTEDKKRDDSKLPIVEKVEDKSKLQDSSDYSNDNQSDKKEHGLLSLLKFPKIEDDKHEDSNDELEDDKVNNDDGILLSQPKDSVESSQHIPKEDEQKNNRKPLHFLSFLKEPSDEQHDAKKGVQKVENKNDQDKSPILPVKEEENVKIIEDNEQGNVIKDGDNNHQVVLSQEEEELLQNIKKIKEYDEDYTITYYYDDDDYDDTEYYRK

SEQ ID NO: 57858 - protein, 241 aa, Thermoplasma acidophilum DSM 1728
MADYEKQKMNAAIKAAEYVRSGMIVGLGTGTTSYYLINEIGRRVREEGLKIRAVCTSRRTEDLAKQNGIEVIQGTKDQIDLTIDGADQVGMYGTLIKGGGGALLREKIVAYNSKEMYVIVDSRKIEAAHFGSFPLPVEIVPFMHMRTLENLRGICTQTDLRMNEKGEPFVTDNGNYIADMHMGMIDDPINLERSLKSIPGVVEVGLFNGIAKRIFEGTDEGCNIYSITNSGIKKEEVYFDP

SEQ ID NO: 57859 - protein, 614 aa, Glycine max
MEEEGDIYDGVRAQFPLSFGKQSKPQTPLEAIHNATRRSNSNPKTANDLPSVSSSSRDWLNSLRPPKTPTPPPPLPPPDHDDGPMVGPPPPPPTAADEEEDDDDAEMIGPPPPPPIASESEDDSDQDEVGTRFRIPLSNEIVLKGHTKVVSALAVDHTGSRVLSGSYDYMVRMYDFQGMNARLESFRQLEPFEGHQVRNLSWSPTADRFLCVTGSAQAKIYDRDGLTLGEFVKGDMYIRDLKNTKGHISGLTCGEWHPKTKETILTSSEDGSLRIWDVNDFKSQKQVIKPKLARPGRVPVTTCAWDHDGKCIAGGIGDGSIQIWNIKPGWGSRPDVHIEKSHEDDISGLKFSSDGRILLSRSFDGSLKVWDLRKTKEPLKVFEDLPNHYAQTNIAFSPDERLFLTGTSVERESMTGGLLCFFDRVNLELVSKVGISPTCSVVQCSWHPKLNQIFATTGDKSQGGTHILYDPTVSERGALVCVARAPRKKSIDDFEAKPVIHNPHALPLFRDQPSRKRQREKVLKDPLKSHKPELPMTGPGFGGRVGTSQGSLLTQYLLKKGGMIKETWMEEDPREAILKYADAAAKDPKFIAPAYAETQPEPVFAKSDSEDEEK

SEQ ID NO: 57860 - protein, 401 aa, Thermoplasma acidophilum DSM 1728 [sequence omitted]

SEQ ID NO: 57861 - protein, 317 aa, Capsicum annuum
KVGINGFGRIGRLVARVILQRDDVELVAVNDPFITVDYMTYMFKYDSVHGQWKNNEVKVKDEKTLLFGEKPVTVYGIRNPEEIPWAEAGAEYVVESTGVFTDKDKTAAHLKGGAKKVVISAPSKDAPMFVVGVNEKEYKPDLNIVSNASCTTNCLAPLAKVIHDRFGIVEGLMTTVHSITATQKTVDGPSAKDWRGGRAASFNIIPSSTGAAKAVGKVLPSLNGKLTGMSFRVPTVDVSVVDLTVRLEKEATYDEIKAAIKEESEGKLKGIVGYTEDDVVSTDFIGDNRSSIFDAKAGIALSKTFVKLVSWYDNEWG

SEQ ID NO: 57862 - protein, 886 aa, Thermoplasma acidophilum DSM 1728
MAQIEKFVYRFDEGGKEMVDLLGGKGAGLAEMTKIGLNVPPGFTITTKACIAFLKHGGFPEGMMDQVMQALHDLENKVGRVFGDEKNPLLVSVRSGAPVSMPGMMDTVLNVGLNDSTVEGLAFMTDNRRFAMDAYRRLIQMFGEIVYGLPHEEFREKIEEVKRMRGYDEDRFTVQDLQGLIDQYTVIYRKHGKIFPQDPETQLVESIKSVFNSWNSKRAVAYRKMNGIPDDMGTAVSIVAMVFGNMGDDSATGVAFTRDPNTGEKKVFAEYLTNAQGEDVVAGIRTPKYIDDMQNEMPQVYADLMKTCDILEHHYRDMQDIEFTVERGKLYLLQTRTGKRSAKAAIRIAIDMVDEGIISEEEALMRITPATFDRTMHPQVKTTGREIPLGKGLAASPGAASGMIVFSSERALEIGKSKKMILVRPETTADDVRGMAVCEGFLTQKGGMTSHAAVVARAMGKPAVVGVESMSVNANEKTLTIGGKKLREGDVVTIDGTSGYFYEGELPVEKPTVDDYSKRLLEIADKYRRLGVRANANTPEEAKIARENGAEGIGLARTERMFLGNDRIGIMRSMIMSETPEDRKKYLDQLLPMQIHDFVEFFRTMEGYPVIIRLLDPPLHEFLPNKEDIIRQIYDVNNGKGKIEDLPYLEKLLKTVRDLEEFNPMLGFRGCRVGLVYPEIYDMQVRAIIEAAAKVIEEGREIYPEIMIPLVGHHNELRKIRARLEETAKSVRNHEKVKYKFGTMIEIPRACVTADKIAQYADFFSFGTNDLTQMTFGYSRDDAEGKFMFFYLENGILESDPFSSVDRDGVGELMKMAVERGKRAKPDLEVGICGEQGGDPDTIEFCDEIGLDYVSASPHRIPVARLAAARSSIARNRPEMTQISKY

SEQ ID NO: 57863 - protein, 143 aa, Halomonas sp. JL-104
HDDLPGMDDDDLRRGLPTNHKVYGEAVAILSGDALLTKSFELVADSPFDDRSKVKIISMLSKAAGAEGMVGGQVADIEGESMALSLEQLESVHKRKTGKLLEFAAVAGGVISGLDEHELNKLRLFAEHIGLAFQIRDDILDVE

SEQ ID NO: 57864 - protein, 313 aa, Capsicum annuum
GFGRIGRLVARVALQRDDVELVAVNDPFISTDYMTYMFKYDTVHGQWKHHELKVQDEKTLLFGEKSVRVFGIRNPEEIPWAEAGADFVVESTGVFTDMDKAAAHLKGGAKKVVISAPSKDAPMFVVGVNENEYKPDLDIVSNASCTTNCLAPLAKVINDRFGIVEGLMTTVHAMTATQKTVDGPSMKDWRGGRAASFNIIPSSTGAAKAVGKVLPALNGKLTGMAFRVPTVDVSVVDLTVRLEKEASYDDIKAAIKEESEGKLKGILGFTEDDVVSTDFVGDSRSSIFDAKAGIALSKKFVKLVSWYDNEWGY

SEQ ID NO: 57865 - protein, 297 aa, Fulvimarina pelagi HTCC2506
RQPEKLVILGGGYIAVEFANIFLGLGTDVTLVYRGQEILQGFDDDLRKSLHEQMSAKGMSVRCRETFQEVRQKPGGGFEAELDNGEVLDADEILLAIGRKPNTENLGCEKAGVELDQRGAVKVDDYSRTNVENIYAVGDITNRLQLTPVAIHEAMCFVETVFKNNAKKPDYESVPTAVFSQPEIGTVGLTEAEAARRFDEVAIYKTDFKPMKHTLSGRNERTVMKIVVDQATERVLGVHILGSDAAEIAQVLGIAVKAGLTKSHFDETMALHPSGAEELVTMYEPTYVLRKGERIAA

SEQ ID NO: 57866 - protein, 144 aa, Exiguobacterium sp. JL-24
HDDMPAMDDDDLRRGNPTNHKVFGEAMAILAGDGLLTFSFQLLAEDEHLPDEKKVELIALLARCAGPEGMVGGQVADIEGENGELTVEELQSIHVRKTGKLLMFSVMAGAIMSDASPGELASLEEFAYHVGLAFQIQDDILDVE

SEQ ID NO: 57867 - protein, 384 aa, Porphyromonas gingivalis W83
MELDFVRSRFIKHFDGSTGQIFTSPGRINLIGEHTDYNGGFVFPGAIDKGVMAEIKPNGSDKVRAYSIDLKDYVEFGLGPDDAPRTTWAKYIYGVCREMIARGVEVKGFNTAFSGDIPLGAGMSSSAALESTYAFALNELFGNGMIDKFELAKVGQATEHKYVGVKCGIMDQFASLFGKKDHLIRLDCKTLEHKYFPFHPQGYRLVLLDSVVKHELASSAYNKRRESCENVVKEIKKKHPEVEFLRDASMSMLEEVKGEVSAEDYMRAEYVVEEVQRVLDVCDALERDDYETVGQKIYETHDGMSRLYEVSCEELDFLNGIARDCGVTGSRVMGGGFGGCTINLVKKELYDLFVENAKKRFKERFGREPKVYNVVISDGSRRLD

SEQ ID NO: 57868 - protein, 419 aa, Capsicum annuum
MAFSSLLKPTASLVRPSHRSQASCVGLQHSSNSVKLQSAIFGDVVSIAQSSSLQNSGACSIQPIRATATELPPTVPKSQTGGKTRVGINGFGRIGRLVLRIATFRDDIEVVAVNDPFIDAKYMAYMLKYDSTHGVFRGSISVLDDTTLEINGKQIKVSSKRDPADIPWGDLGADYVVESSGIFTTVDRASGHKKGGAKKVVISAPSADAPMFVVGVNEKTYKANMDVVSNASCTTNCLAPLAKVVHEEFGIVEGLMTTVHATTATQKTVDGPSMKDWRGGRGAGQNIIPSSTGAAKAVGKVLPELNGKLTGMAFRVPTPNVSVVDLTCRLNKSASYDDVKAAIKYASEGPLKGILGYTNEDVVSNDFVGDSRSSIFDAKAGIGLSKSFMKLVSWYDNEWGYSTRVLDLIEHMALVAATS

SEQ ID NO: 57869 - protein, 143 aa, Bacillus sp. JL-26
HDDLPAMDDDDLRRGLPTNHKVYGEAVAILSGDALLTKSFELVADSPFDDRSKVKIISMLSKAAGAEGMVGGQVADIEGESMALSLEQLESVHKRKTGKLLEFAAVAGGVISGLDEHELNKLRLFAEHIGLAFQIRDDILDVE

SEQ ID NO: 57870 - protein, 145 aa, Erythrobacter sp. JL-316
HDDMPGMDDDEMRHGKPTLHKAFDEATAVLAGDSLHALAFDILTQPDTSTDPFVRAELVATLARASGHDGMAGGQMMDIVSEEQSYDLRQVTRLQQLKTGALLAASVEMGAVLGRVAPEGRTHLRAYARDIGLAFQIADDILDVE

SEQ ID NO: 57871 - protein, 175 aa, Triticum aestivum
  misc_feature (49)..(49): Xaa can be any naturally occurring amino acid
MAPTVMASWATSIAPFQGLKSTTGLPVTRRSKGDSLGRVSHGGRIRCMXVWPIEGIKKLETLSYLPPLSTEALLKQVEYLIRSKWVPCLEFSKVGFIFREHNASPGYYDGRYWTMWKLPMFGGTDATQVINEVEEVKKEYPDAYVRIIGFDNMRQVQCVSFIAFKPPGFEESGKA

SEQ ID NO: 57872 - protein, 230 aa, Vibrio harveyi
MSSTSLLDEFGTPVQRVERAIEALKNGLGVLLMDDEDRENEGDLIFSAQHLTEAQMALMIRECSGIVCLCLTEERANWLELPPMVKDNRSKNQTAFTVSIEAKEGVTTGVSAKDRVTTVKTATYFDAQPEDLARPGHVFPLVAKTNGVLARRGHTEGTIDLMYLANLVPSGILCELTNRDGTMAKLPETIEFARRHGMPVLTIEDIVDYRTVIELRNEYESGLVCEVSWS

SEQ ID NO: 57873 - protein, 281 aa, Ustilago maydis 521
MEQKDNANPIVYQSSSRLTQRRSSSSANAEWWRDQSIHSSAQSAGRPSASSSSIAGIGAVGSSAISSNNFAASFARATRSTIDQDDDEELEDEADDSDDDVEMSRRSGTPATSPEIECAAPHTKAVATSMDEEIDSQEIYDLIRSITDPEHPLTLEQLAVVNASHITVSHGDAAANKLPHVLLEFTPTIPHCSMATLIGLSLRVRLLRALPDRFKVDIRVRPGTHQSENAVNKQLNDKERVAAALENSHLFNGEEEKVPMRSQHTSVGLRAAMAKRTRIIS

SEQ ID NO: 57874 - protein, 1079 aa, Zea mays
MEGDADGVKSGRRGGGQVCQICGDGVGTTAEGDVFTACDVCGFPVCRPCYEYERKDGTQACPQCKNKYKRHKGSPAIRGEEGDDTDADDASDFNYPASGNDDQKQKIADRMRSWRMNAGGSGDVGRPKYDSGEIGLTKYDSGEIPRGYIPSVTNSQISGEIPGASPDHHMMSPTGNIGRRAPFPYMNHSSNPSREFSGSVGNVAWKERVDGWKMKQDKGTIPMTNGTSIAPSEGRGVGDIDASTDYNMEDALLNDETRQPLSRKVPLPSSRINPYRMVIVLRLIVLSIFLHYRITNPVRNAYPLWLLSVICEIWFALSWILDQFPKWFPINRETYLDRLALRYDREGEPSQLAAVDIFVSTVDPMKEPPLVTANTVLSILAVDYPVDKVSCYVSDDGAAMLTFDALAETSEFARKWVPFVKKYNIEPRAPEWYFSQKIDYLKDKVHPSFVKDRRAMKREYEEFKIRVNGLVAKAQKVPEEGWIMQDGTPWPGNNTRDHPGMIQVFLGHSGGLDTEGNELPRLVYVSREKRPGFQHHKKAGAMNALVRVSAVLTNGQYMLNLDCDHYINNSKALREAMCFLMDPNLGRSVCYVQFPQRFDGIDRNDRYANRNTVFFDINLRGLDGIQGPVYVGTGCVFNRTALYGYEPPIKQKKGGFLSSLCGGRKKGSKSKKGSDKKKSQKHVDSSVPVFNLEDIEEGVEGAGFDDEKSLLMSQMSLEKRFGQSAAFVASTLMEYGGVPQSATPESLLKEAIHVISCGYEDKIEWGTEIGWIYGSVTEDILTGFKMHARGWRSIYCMPKRPAFKGSAPINLSDRLNQVLRWALGSVEILFSRHCPLWYGYGGRLKFLERFAYINTTIYPLTSLPLLIYCILPAICLLTGKFIIPEISNFASIWFISLFISIFATGILEMRWSGVGIDEWWRNEQFWVIGGISAHLFAVFQGLLKVLAGIDTNFTVTSKASDEDGDFAELYMFKWTTLLIPPTTILIINLVGVVAGISYAINSGYQSWGPLFGKLFFAFWVIVHLYPFLKGLMGRQNRTPTIVVVWAILLASIFSLLWVRIDPFTNRVTGPDTRTCGINC

SEQ ID NO: 57875 - protein, 125 aa, Brassica napus
MILSQLPRFHLSIFTKPPSSLPSSHFNFLNHRSNPPVSLPKTIFSFASKSNLVTVEPIPLPVVSDSSDLDEAPVEISLDKLFIPPETDISGDDPSSLTARILKGSNIVLSKYARDAQVAQADYVK

SEQ ID NO: 57876 - protein, 516 aa, Oryza sativa Japonica Group
MATSFVYLAIFACLAWAGTALLYWAHPGGPAWGKYRRARGQSPRCSIPGPKGLPVVGSLGLMSGLAHCSLAAEAARRPGAKRLMALSLGPVRAVVTSHPDVAKEILDNPAFADRPLNHAAYGLMFHRSIGFAEHGPVLARAPARRRGPPCSARGRWTRSPRTARASRGAWSPRCAARPGKPAFQLRGVLRRASLYYIMRFVFGKEYDVSRGAPESGEEVEELLEMVHEGYDLLGKENWCDYFPGLAAVDPQGVGARCAELMPRVNRFVRGIIQEHRGKAIAGGEARDFVDILLSLQESEGLADADIAAVLWEMIFRGTDAMAVLMEWTLARVVLHPDVQANVHRELDAVVGRSNTVAESAVPSLPYLQALLKEALRMHPPGPLLSWRHRAISDTYVDGHLVPAGTTAMVNQWAMSRDADVWDAPLEFQPERFLPGGKAHGVSVLGADGRLVPFGSGRRSCPGKSLAMTTVTAWMATLLHEFEWTPASGAVDLSEVLRLSCEMAVPLEVRVSARRNV

SEQ ID NO: 57877 - protein, 99 aa, Phaeodactylum tricornutum
MVTYKVTLLSEEHDINTTIDCNDDVFVLDAAEEQGIELPYSCRAGACSTCAGKVTAGEIDQSEQTFLDDDQVEAGFVLTCIAYPKSDCTISVHQEDELY

SEQ ID NO: 57878 - protein, 528 aa, Photobacterium profundum SS9
MFFNLEGLLPEAIESIEEQTERAYQQYQKFDKDMDKHIYLRNIQDTNETLFYRLVENHITEMMPIIYTPTVGAACEDFSNIYRRGRGLFISYPNRDRIEDMLNNASRQNVKVIVVTDGERILGLGDQGIGGMGIPIGKLALYTACGGISPAYTLPVVLDVGTNNPQRLSDPMYMGWRHTRISGQEYDNFVDEFIQAVKRRWPDALIQFEDFAQKNAMPLLERYKNKICCFNDDIQGTAAVTVGSLLAACKAAKSKLSEQRISFLGAGSAGCGIAEAIIAQMVSEGISEAQARSQVFMVDRWGLLIDDMPNLLNFQQALVQKRDTVNEWDLADNNVSLLDVMRNAKPTVLIGVSGVPGLFSEDVIREMHAHCKRPIVFPLSNPTSRVEATPADIINWTDGNALVATGSPFEPVVHNGKTYPIAQCNNSYIFPGIGLGILAVNARRVTDEMLMASSRALAECSPLAINGHGALLPPLEDIQKVSRKIAFAVAKKAIEQGKAPKNSDERILDKIDANFWQSDYRNYKRTSF

SEQ ID NO: 57879 - protein, 475 aa, Oryza sativa Japonica Group
MGGGQSRSPRDGSGHGRYGHSPSFQQQWGGGGGGGGGGGGGYPYGQDAHGGGYYGAPAPQGGYAAPYPAYQQPPPPMPSPAATQPPARAGGASKPRLDRRYSRIADDYHSVDQVTGALAQAGLESSNLIVGIDFTKSNEWLGKFSFHGRSLHHISNAPNPYEQAISIIGQTLSKFDEDNLIPCFGFGDATTHDQDVFCFYPDLRPCNGFSEALSRYRELVPHLRLAGPTSFAPIIEMAMTIVEQSGGQYHVLLIIADGQVTRSVDTASGQLSSQEQKTVDAIVRASELPLSIVLVGVGDGPWDMMKEFDDNFPSRAFDNFQFVNFSEIMNKNMPQSRKEAAFALSALMEIPQQYKATVELGILGRRSFKSPERVPLPPPGGSHDAYSYGSKSFSKPSTYPQSSTSSSSYPHYETAQSSSPAVPSSTYDNQVCPICLVNPKDMAFGCGHQTCCDCGQSLESCPICRSPISTRIKLY

SEQ ID NO: 57880 - protein, 145 aa, Brassica napus
LVNLLETGGFRAKKDASTALYSLCSAKENKIRAVESGIMKPLVELMADFGSNMVDKSAFVMSLLMSVPESKAAVVEEGGVPVLVEIVEDGTQRQKEMAVSILLQICEESVVYRTMVAREGAIPPLVALSQAGGTSRAKHKAEALI

SEQ ID NO: 57881 - protein, 337 aa, Zea mays
MGKIKIGINGFGRIGRLVARVALQSEDVELVAVNDPFITTDYMTYMFKYDTVHGHWKHSDITLKDSKTLLFGDKPVTVFGIRNPEEIPWGEAGAEYVVESTGVFTDKDKAAAHLKGGAKKVVISAPSKDAPMFVVGVNEDKYTSDVNIVSNASCTTNCLAPLAKVIHDNFGIVEGLMTTVHAITATQKTVDGPSAKDWRGGRAASFNIIPSSTGAAKAVGKVLPDLNGKLTGMSFRVPTVDVSVVDLTVRIEKGASYEDIKKAIKAASEGPLKGIMGYVEEDLVSTDFLGDSRSSIFDAKAGIALNDHFVKLVSWYDNEWGYSNRVVDLIRHMFKSQ

SEQ ID NO: 57882 - protein, 394 aa, Methanosarcina acetivorans C2A
MFSINSECILSKQSEDIPPFYVMEVLESAKELEAQGRHIIHLEVGEPDFPTAPHICEAACAAIGKGLTKYTHSQGLPALREAIAESYYRKFGVDLDPNQVIVTSGTSPGLLMVFMALLEKRDEVIMSNPHYACYPNFVKYLGGTPVFVYTSEANGFALEPETVRQCLSPNTKAILINSPSNPGGHVMSPDTLQGLAAIADEKGIPVVSDEIYQGLIYSGEEHSILEYTKNAFVLNGFSKLYAMTGWRLGYIICPPGCVRAIQKIHQNFFICANSFVQEAGIAALKGSQEHVVEMVQIYNMRRQYMLKRLLGMGLEVRKEPMGAFYVLADARKFGNDSLELSRSILNEAGVAVTPGVDFGNGAEGYLRFSYANSLENIAEGMDRLEAFLEKELDG

SEQ ID NO: 57883 - protein, 466 aa, Pseudomonas fluorescens Pf-5
MDQTLKQGELKRGLKNRHIQLIALGGAIGTGLFLGSAGVLKSAGPSMILGYAIAGFIAFLIMRQLGEMIVEEPVAGSFSHFAHKYWGGYFGFLAGWNYWVLYVLVGMAELTAVGKYVQFWWPEIPTWVSAAVFFVLVNLINMMNVKFFGEAEFWFAIIKVVAIVGMIVLGCYMLFSGSGGSQASVSNLWSHGGFFPNGGTGLLMAMAFIMFSFGGLELVGITAAEAAEPRKVIPKAINQVVYRVLIFYVGALAVLLSLYPWDELLVSLNAGGDAYSSSPFVKIFSLIGSDAAAQILNFVVLTAALSVYNSGVYCNSRMLYGLAEQGDAPKALMKLNKQGVPILALGISALITLLCVLVNYLAPHEALELLFALVVAALMINWALISLTHLRFRKAMAEQGVVPSFKAFWSPLSNYLCLAFMVMIVGVMWMIPGIRASVYAIPVWVLVIWGFYLLSRAKKASQPALR

SEQ ID NO: 57884 - protein, 524 aa, Bacillus subtilis
MEHLDLHHIFELGFFVVMIAAGITAIAKKCRQPYPIALVIVGTIIGLVHIPLFEPLKEFITEGEVFNFVIITLFLPALLGEAALKLPFSHLRENKRPVLALFGGTLISFLIVGFSSMWLMHLAIPAAFVFAALMSATDPVSVLSIFKSVGAPKKLSIVVEGESLFNDGLAVVLFNISAFYLMTYLDLGIQGAGLGLWEFVKVISLGLIIGGVLGYVFSQLTKYFDDYPLEIIFSIILFYSSFLLAEMAGASGVIAVVVAALIFGNYGAKIGMSPTTKLNINNFWDVAALLANSLVFLMVGLEITRIDLTDKWGLAIMAIVIVLIARSAAVYISLAFIKKFPVTWKHTINWGGLKGSLSIALVLSLPRDFPGREDILVFAFSVVLFSLVVQGLTIKPLLERLGVNQKEEGNQEYEELLAKGHRLETAIKEVQQVKHNLLIHEAVSSELTDQYKKEVSQLHQQTNKLFETYPELKNKQQTILKKHSLYAQYQAIENLSREDIISNEVAELEQARIIDEIVRLQNDH

SEQ ID NO: 57885 - protein, 463 aa, Oryza sativa
IHQFRVQSRVSLVLCRGERSSYRASLAAAMATGRRLSMILLLLLLGLASGDKILFQGFNWESWKKQGGWYNFLHGHVDDIAATGVTHVWLPPPSHSVAPQGYMPGRLYDLDASKYGTGAELRSLIAAFHSKGIKCVADIVINHRCADYKDSRGIYCIFEGGTPDSRLDWGPDMICSDDTQYSNGRGHRDTGADFGAAPDIDHLNTRVQTELSDWLNWLKSDVGFDGWRLDFAKGYSAAVAKTYVDNTDPSFVVAEIWSNMRYDGNGEPSWNQDGDRQELVNWAQAVGGPASAFDFTTKGELQAAVQGELWRMKDGNGKAPGMIGWLPEKAVTFIDNHDTGSTQNSWPFPSDKVMQGYAYILTHPGVPCIFYDHVFDWNLKQEISTLAAVRSRNEIHPGSKLKILAAEGDVYVAMIDDKVITKIGTRYDVGNLIPSDFHVVAHGNNYCIWEKSGLRVPAGRHHY

SEQ ID NO: 57886 - protein, 301 aa, Candida albicans SC5314
MVDSNFFVDFMMGGVSAAVSKTAAAPIERVKLLIQNQDEMIKQGRLEKRYTGIVDCFKRTAADEGVVSFWRGNTANVIRYFPTQALNFAFKDKFKAMFGFKKDENYWKWFAGNLASGGLAGATSLAFVYSLDYARTRLANDAKSSKGDGKREFNGLVDVYKKTLASDGIAGLYRGFGPSVIGIVVYRGLYFGLYDSLKPVVLVGPLEGSFLASFLLGWAVTTGASTASYPLDTVRRRMMMTSGQAVKYDGALDCFRKVVAAEGVGSLFKGCGANILRGVAGAGVISLYDQLQVILFGKKFK

SEQ ID NO: 57887 - protein, 559 aa, Ashbya gossypii ATCC 10895
MAVNLELVKYLIENHVTILAHPVDGRLKDLYALFCMYLQQWADKDQETPSYGEFHEDLVLIAQVVQGAIGVVCDSIFPEGEQLDYVHVTPLKYLVNRFHPGYYNLREQAAAEEAECAPATLLERLTNALETRIETPSTQALNRLEELLACKLASFRLARERVKRTVPHAPYIPTCKDLQHSSILSTVAYISNNKIVSLQKEKLFKADKEYPGLVQCIQTHIHFIPNLKPQTDLSLGDCSYLDTCHKLNSCRYVHYLQYIPERLMQSVEQSVNQLNETQEKNRRIGFYTHGDCCSSVVKSILPSQWIKCDVRKFDFTILGKFSAVIADPAWNIHMNLPYGTCNDNELLLLPLDILQDEGLLFLWVTGRAIELGKESLMNWGYKVINEISWIKTNQLGRTIVTGRTGHWLNHSKEHLLVGLKGDPEWLNKQIDIDLIISSTRETSRKPDELYGMVERIVGTHARKLEIFGRDHNVRPGWFTIGNQLTGTCIHELDVKRKYENFIATSRRQNEGRAFDYRDDIPQKGQYNKQVYLQQQQHHSKQMPAMKAAQYVTTTYRSTI

SEQ ID NO: 57888 - protein, 380 aa, Methanosarcina mazei Go1
MTSARLKRVEESATIRISNIATRMIKEGTDVINFSLGEPDFDTPKNICDAAAKAMYEGKTHYAPSAGIPELRSAIAEKLRTENHLDVSEKDVLVTPGAKQGIFEIMMGSLDDGDQALLFDPAWVTYDACIRFAGADTVWVPTVPEKGFLPDNFAEYINDKTKLIVVNSPGNPTGGVFGKKTLQCIADIAIDHDLLVVSDEIYEKIIYDREHISIGSFDGMQERTITVNGFSKAYAMTGWRLGYLTAPPEIFKLLQKIQSHSVSSATTFVQYGGLEALQGPQEGVKAMVDRFKMRRDILIDGLNKMGLECKKPDGAFYAFANVSDYGNGTEVAEKLLKEAHVAVTPGIAFGSSGEDFIRISYATSIDRIREALDRLEKVFA

SEQ ID NO: 57889 - protein, 389 aa, Methanosarcina mazei Go1
MWSIKNMDLEDTLLMMPGPVSVAPRVLRAMSKPMINHRSAEFAGIYTDCRGILADVFQTKNDIFLLSGSGTAGMEAAVGSVAGSGEKVIAIENGKFGERFKDLAALYAELVPLEFEWGLPVDLEKVKEKLEEGAKAITLVHNETSAGIMNPAAEIGKLAKKYDALFIMDGVTSLGGDEVKVDEWGVDIAIVGSQKCFAAPPGMAAVSVSEKAFEAMNCMKKRLYYNDLKAYKKSGDKPRPETPYTPAIPLFYALQEALHIVKEEGMEARIKRHRTLSEAVRAAAGALNIEMFPQLNEYSQYSNTITALKSPAGIDGEDIKNDMKKRGVIIAGGQERLKSKIFRIGNMGNVTARDVLSTIQQLEIVLHKHGYIDSVGAGTEAATRVIDRL

SEQ ID NO: 57890 - protein, 528 aa, Solanum lycopersicum
SDAIRILREIKLLRLLRHPDIVDIKRIMLPPSKRDFKDIYVVFELMESDLHHVIKANDDLSHEHHRFFLYQMLRALKYMHTANVYHRDLKPKNILANANCKLKVCDLGLARVSFSDTPTTALWTDYVATRWYRAPELCGSFFSKYTPAIDIWSIGCIFAEVLTGKPLFPGKSVVHQLHLMTDPLGTPSADSKSGVRNEKARKYLTSMRKKNPVPFTEKFPGADPLVLRLLQRLLAFDPKDRPTAEEALSDPYFKGLAKIEREPSCRPISNLEFEFERRRVTKEDIKELIFREILEYHPQLQKDYIAGNDGTNFLYPSATDQFRRQFAYLEENNDKSGPVIPLGREHVSLPRSAVNSSTDPPKLAEFSGFDHTQVTEKSSTDVRVAEKTSGTIQNISRPPHGVHAAKPGRVVGPILPYDGRMLTQNTGLLPHGISPHYMFRMNPGNREKCGTESKDATQVRPLPAQCNMSVEMNTNPYYPAQEKVAQLGGQIAIDAKLLQAQTKFGAVGAAAVAVAAHREVGTIQYSLT

SEQ ID NO: 57891 - protein, 107 aa, Rubrobacter xylanophilus DSM 9941
MVGSLTRDIRCSAATKTAPARKTRRAPSREPRYRVILHNDDWTPMDHVVAALMKVVPRLSLRRAVSIMLEAHTKGQAVVTRCHRELAELYREGLKAEGLISTIEPDG

SEQ ID NO: 57892 - protein, 365 aa, Triticum aestivum
  misc_feature (338)..(338): Xaa can be any naturally occurring amino acid
ITLDVGTNNEELLNDEFYIGLRQRRVTGQEYADFLHEFMAAVKQNYGEKVLIQFEDFANHNAFDLLARYGTTHLVFNDDIQGTASVVLAGLVAALKLVGGTLAEHTYLFLGAGEAGTGIAELIALEMSRQTKTPIDECRKKIWLVDSKGLIVSARKESLQHFKKPWAHEHEHVGNLLDAVNAIKPTVLIGTSGKGQTFTQEVVEAISSFNEMPIILALSNPTSQAECTAEQAYTWSKGRAVFATGSPFDPVEYNGKTHVPGQANNAYIFPGFGLGVVMSGAIRVHDDMLLAASEALAQQVTQENFDKGLIYPPFSNIRKISAHIAANVAARAYELGLXASRRPRPKDLVKYAESCMYSPIYRNYR

SEQ ID NO: 57893 - protein, 346 aa, Fulvimarina pelagi HTCC2506
MKSRKPNAAEGDLYGEDQPVFAVAPMIDWTDRHCRFFHRQLTAKALLYTEMVVADAILHGPQEKLLDHDAAEHPVALQLGGSDPEKLGAAVTVAREWGYDEFNLNVGCPSDRVQSGTFGACLMREPERVGDCLQAMRDAANETPVTVKCRLGVDDQDIEESLDRLADEAIRAGVSVIWVHARKAWLEGLSPKENRDIPPLDYDRVGRLKRRLPNVFVGLNGGLRSVAVANETIADLELDGMMFGRAAYQTPDLLSEVDHCIYGEPERAIDYPALIAVMEDYAARHIALGGRLNHITRHMVGLFNGLPGARRWRQVLSTKSTGSEAKPAIIREAFSHIRLDANQEAA

SEQ ID NO: 57894 - protein, 135 aa, Synechocystis sp. PCC 6803
MMSFLKNQLSRLLALILVVAIGLTACDSGTGLTGNYSQDTLTVIATLREAIDLPQDAPNRQEVQDTARGQINDYISRYRRKGDAGGLKSFTTMQTALNSLAGYYTSYGARPIPEKLKKRLQLEFTQAERSIERGV

SEQ ID NO: 57895 - protein, 124 aa, Brassica napus
  misc_feature (121)..(121): Xaa can be any naturally occurring amino acid
MSNEENITSIEAVHNSGGDSSNALDLVPEDPDLIEDLKNLTIKRTFDTKKLSPKVTKRVLFLKDIQVKHDELEEKFLEEKAALEAKYDSLYKPLFDKRYEIVNGVAEAETEKGVPNFWLIXMNT

SEQ ID NO: 57896 - protein, 441 aa, Prochlorococcus marinus str. MIT 9312
MTSDKRELINNFKENLCKKDKSIAIVGLGYVGLPLALTFAEKNFSVIGIDIDKKKVAKLRNKESYLRHINNSRISEVIQNSKFKPTSDFSEAEKCIAIILCVPTPLNKNREPDLQYITTTLNSLKKYFQKGQLLSLESTTYPGTTEEVLKPLIESSGFKIGNNFFLVYSPEREDPGNKDYSTGSIPKIIGGITPICREIGIELYSKIIERLVPVSSTRAAEITKLLENIHRAVNIGLMNELKILSDKMNIDLYEIIDAAATKPFGFTPYYPGPGLGGHCIPIDPFYLTWKAREYGMNTKFIELAGEINASMPQYVIEKIFNLLNNRSKSIKNSKILVLGLSYKKNIDDIRESPSLDIIYELLKRGAVVKYNDPYIPKLPKVRKYNLEIEHCKITADLLSSFDCVLLLTDHDDFPYELIKKHSNLIIDTRGRFTLSENIFRA

SEQ ID NO: 57897 - protein, 544 aa, Thermoplasma acidophilum DSM 1728
MKTKIVATIGPASSSPEIMKQMIDNGLSLVRINSAHADIKDVSKITQMVRSINRDVGIMIDLKGPELRTGEFAGGTLKISSGKDYVMGKDIVLNNMNVLSAVQVGDRILMSDGEVSFEVESTDPFTIRALNDGVLRDRSRVNIPGRFIELGTITDRDRAFIREGIADGVDFFALSFVQKSENVDSLRDFVIDSGGDQYIISKIETKSGLDNIEEIVKSSDGIMVARGDLGVELPLKEVVLAQKHIIKTAHEDGDFTIVATQVLESMVNNSSPTRAEISDITNAIIDNADALMLSEESAIGKYPVQAVRTLKEVSDYVEDKVSFDSSYYFKGNTIAYSVARAAKILSDDIKSDGIVALTHTGSTVRMISSLRPKAMVYAATVSESLARKLNIYFGVLPLHMEGNAEDLSFSEIMEYIVRSGRFADGSKLVMTSGDPYFTFGGTNDVKVAVVGKFIGRGYSFGDSLSGTATYGTKGDILMSEDGRIPGTDFRAFIFTSDIKPSLMSSLKGKTVVTKARLVRQIKEGERIYIDGNTGIILMASPDQK

SEQ ID NO: 57898 - protein, 145 aa, Exiguobacterium sp. JL-25
HDDLPAMDNDDLRRGKPTNHKVYGEDIAILAGDALLSYAFEYVARTPDIPAERLLQVIVRLGQAVGAEGLVGGQVVDLESEGKTDVSVETLNFIHTHKTGALLEVCVTTGAVLAGAKPEEVQLLSRYAQNIGLAFQIVDDILDVE

SEQ ID NO: 57899 - protein, 432 aa, Thermoplasma acidophilum DSM 1728
MTAIFPFGYYLDVSLILVLGAIALPISRKMSVVEIPILVFLGIIIGPMLHLISPNFSVYLFSSFAGVGIGMMGLVIILYSESHNMNLKVLRSEFYRIASLDTLGVIITAVVAGLVFTVLTGAPIIVGFLFGAIVSPTDPVTLIPLFRRVKVSEDISEILVGESLFNDPVGIILVSVGIALLAPQSSYVSLFSAMNRVITFYPSIVAYFLIQVAVPSIVGIAIGFSVIYLDKKIKFENYLTAMLLGLVIFEFTVFESLSITPFPAIIATGAIVGNFSDKNIFWSREQNFQESLSFLSAAIIFILIGSSFTLSEIVSYILLGIALTILIVFLVRPLAVFPSLMIADARKPKMKSYYKIAAFISLVGPRGVVPVVLSTLPYVVGEEYNIPVLVTWGPLISVSALFVVLFSIVLQTLYTPIIRNIFLPDSGNGSEK

SEQ ID NO: 57900 - protein, 200 aa, Triticum aestivum
  misc_feature (94)..(94): Xaa can be any naturally occurring amino acid
RGRGRVPDRSCLLTHPKFLAAASQEQKEIMMKYKDKIEYDALLEMNTLHNCIKEALRLNPPTTMLVRKALKHFTVRTRQGQEYGIPKGHTLASXPIIPNQLLCPYIYKGPPRYIIPDRFGPVRQEDVVGGKFSYTSFGGGRHFCSGDAYAYMQVKVIWSHLLNNFDLKLLSPYPKTDWSKLIPEPQGNMMVSYKRRQLLG

SEQ ID NO: 57901 - protein, 143 aa, Micrococcus sp. JL-76
HDDMPGMDDDDLRRGLPTNHKVYGEAVAILSGDALLTKSFELVADSPFDDRSKVKIISMLSKAAGAEGMVGGQVADIEGESMALSLEQLESVHKRKTGKLLEFAAVAGGVISGLDEHELNKLRLFAEHIGLAFQIRDDILDVE

SEQ ID NO: 57902 - protein, 183 aa, Pyrobaculum aerophilum
MPVEKTLLILKPDAVARGLVGEIISRFEKAGLKIVALKMVKASPEEIERFYPSSEEWLRSAGQKLLKAYQELGIDPRAKIGTDDPVEVGRIIKRSLVKYMTSGPIVVMVLKGNRAVEIVRKLVGPTSPHSAPPGTIRGDYSIDSPDLAAEEGRVVFNLVHASDSPSEAEREIRFWFREEEVLE

SEQ ID NO: 57903 - protein, 272 aa, Burkholderia pseudomallei K96243
MARSRQVPIRSKAEIAMARRAGTMAAQVLSMIAPHVKAGVTTNALDRLCREYIVDVLRARPANIGYHGYPKTICASVNHVVCHGIPSDHALQDGDIVNIDVALDHDGWYGDTSRMYCVGEPAAPARRLVDATYEAMMAGIAAVRPGATLGDVGHAIQSVAHREGFSIVREYCGHGIGRIYHDEPQVLHYGRPGAGLRLAPGMIFTIEPMLNAGRAETRQLADGWTVVTQDRSWSAQWEHMVVVTEDGFDILTPWPDGEPARSPAATGAAGAA

SEQ ID NO: 57904 - protein, 524 aa, Ustilago maydis 521
MRFELSSESLATVPLFVWLSATLVVGHILYTAVKRPKINLPGPRGWPYVGNLFQLGEDAAQTYYKWSKRYGPVYKVQLGEREVIIINSAQASKELLTDLGSIYISRPLFYTFHTVVSSTAGFTIGTSPWDESCKRKRRAAATALNRVAVQSYVPIIDRETFSLVEDLYSAKGKAIAPFAYFQRLALNVSLSVNYGSRLDKISDELLQEIVEVETHVANFRSVSNSAADYLPIVRYVQMLVGGNNSFAAQIRARRDKYMRRLLEDLKARVKAGTDIPCITGNIIRDPTAKLTDLELSSICLSMVSAGLDTLANTFIWSMGFLAKHPEIQEKAYSELSKVYQGQVPNSDSEQVEYITALHKECSRYFSVLKLALPKATISDSSYKGVNIPAGTTVFLNAFAIHQDAERYGDVENFRPERFLEPGEENKQSHYSFGAGRRMCAGVHLANRELYIAFCKVIHFFHIQLSDVEEEKHFDINPKTGCANPKGLSSTPKPFKVRFVPRHPAALEQWIESEREKTDLMASAA

SEQ ID NO: 57905 - protein, 304 aa, Ralstonia sp. M1
MSQDNASGAGISAASTSNFLRQIIEGDLAQGTYAGRKDAAGQPIPPVVTRFPPEPNGYLHIGHAKSIWVNFGLAKEYGGRCHLRFDDTNPVKEDTEYVDSIIDAVHWLGYSWNDAGGEHLYYASDYFEQLYGFAEVLIQRGVAYVDSQSAEQIAANRGDFTKPGTPSPFRDRSVDENLALFRDMRAGKYKDGEHVLRAKIDMAAPNIVMRDPVLYRIRHAHHHRTGDAWCIYPMYDFTHCISDALENITHSLCTLEFENNRPLYDWVLDHLRDAGVLPRTLPHQYEFARLHLTYAITSKRKLLQ

SEQ ID NO: 57906 - protein, 146 aa, Triticum aestivum
  misc_feature (104)..(104): Xaa can be any naturally occurring amino acid
MGLKTAVFLSVPAAVAPLPTTLRRHHLYSSSRGSRAAASRISAAVMATAVQPAVVVGGGRVGQALLSMGPPAGGDLLLRRGEALPPAAPAGPILVCTRNDDLDXVLDANPKSRWADLVFFQKGDAGPRGWRSKGLGRGQTSAPLIS

SEQ ID NO: 57907 - protein, 170 aa, marine gamma proteobacterium HTCC2143
MAFNDSKKQDDSEGLQEKLVQVNRVAKVVKGGRIFGFTALTVVGDGNGKVGFGRGKAREVPVAIQKAMEAARRNMITVDLNGDTIQYAIKANHGASNIYMQPASQGTGVIAGGAMRAVLELAGVHNVLAKCYGSTNPVNVVRATFKALETMASPEQVANRRGKTVEEILN

SEQ ID NO: 57908 - protein, 317 aa, Bacillus pumilus SAFR-032
MSNRYADANLKIFSLNSNPELAKEIADRIGVDVGKSSVKRFSDGEVQINIEESIRGCDCYVIQSTSAPVNEHIMELLIMVDALKRASAKTVNIVIPYYGYARQDRKAKPREPITAKLFANLLETAGATRVIALDLHAPQIQGFFDIPIDNLMAVPILTNYFEQKNLNDIVVVSPDHGGVTRARKMADRLKAPIAIIDKRRPKPNVAEVMNIIGNIEGKTAILIDDIIDTAGTITLAANALVENGAAEVYACCTHPVLSGPAVERITNSKIKELVVTNSIHLTDDKKVGKFIPLSVGPLLAEAIIRVHEEESVSYLFS

SEQ ID NO: 57909 - protein, 334 aa, Oryza sativa Indica Group
MVGGGRRGAAAEEVKLNTGNVFAALETLKKKKKGGDKAKGGSSSSSGRKREQQGAQPSSQQQQQQQQQQKEVFWAPAPLTTKSWADVEDDDDDDYFATTAPPRPVWGTGHGDDGAKEEDEEDDDDAVHAALQEEVESEDEDLDDEVDDGAVDEPEHEVDDTSAEPAGKKAAVPVAPPKDTERQLSKKELKKKELAELDAVLAELGISGGSSNAAQDENNAEKKGSNQTGDGDAPAPSESKSSKKKKNKKAKEAKESQEPADGTEETASAEPDEDTTSVDVKERLKKMASMKKKKSGKESDTAAKIAAAEAAARSARLAAAKKKEKNHYNQQPVR

SEQ ID NO: 57910 - protein, 494 aa, Pseudomonas fluorescens Pf-5
MRRPGQRHKDGPSQRFIRAHNNKEALKVTTSNKGFEAISNREHGLRRQLTAGQMSMIAIGGAIGTGLFMGSAYAIGYAGPSVLLSYAIGALITLILMGCLAEMTVAHSTSGSFGAYAEFYVSPLAGFLVRYAYWAAIVLAVGAEVTAIAMYMKYWFANVPEWVWIISFSSVLIVLNGISVKTFGNFEYWFSTIKIAAIVGFIILAVYVVFGSGNPDYGLHNYSAHGGFFPNGFEGMWIAVIVSIFSYLSVEMIAVAAGEAKDPQRAVKQAFRATIVRLVVFYLLTLALMLAIVPWAQAGKAQSPFVTVMQTIGIPGATGVMNFVILIAALSAMNSQLYITTRMMFSLSRAGYAPKSMGALSKNGIPLNALLLSSSGIALATLVNVLYPESSFTLMMAISMFGAIFTWFMIFLTHYCFRRYHQRHGEQQLSFRMRLFPYSTLLGLVLMGAVMITTFFTEAFKMTLVFGVPFLLLLTLVYYLCFRKPRVVAGLSEV

SEQ ID NO: 57911 - protein, 338 aa, Solanum tuberosum
MANGKIKIGINGFGRIGRLVARVALQRDDVELVAVNDPFISTDYMTYMFKYDSVHGQWKHHELKVKDEKTLLFGEKAVTVFGIRNPEDIPWGEAGADFVVESTGVFTDKDKAAAHLKGGAKKVVISAPSKDAPMFVVGVNENEYKPELDIVSNASCTTNCLAPLAKVINDRFGIVEGLMTTVHAMTATQKTVDGPSMKDWRGGRAASFNIIPSSTGAAKAVGKVLPSLNGKLTGMAFRVPTADVSVVDLTVRLEKEASYEDIKAAIKEESEGKLKGILGYTEDDVVSTDFVGDSRSSIFDAKAGIALSKNFVKLVSWYDNEWGYSSRVIDLICHMAKA

SEQ ID NO: 57912 - protein, 555 aa, Pseudomonas fluorescens Pf-5
MRILLFKTLALTAAIAASSSAFAVTLEGGAVAAPNQYGADVAAQILKKGGNAVDAAVATAFALAVTYPEAGNIGGGGFMTMYIDGKPYFLDYRETAPKAATRNMYLNEKGEVIENLSLVGARAAGVPGTVMGLWEAHQKFGKLPWSELITPAVGYAKNGFKVADKQYQYREDALKLFNGTTNFGDYFGSMKPGETFRQPELAATLERIADQGAKEFYSGKTADLLVAQMQADKGLITKQDLQDYKVQWRQPLQVTFRGNTLYTAPPPSSGGVALAQLISIKEERAADFKGVELNSAKYIHLLAEIEKRVFADRADYLGDPAFSDVPVKQLTDPAYLKKRAAEVNPNAISATEKVRPGLEPHQTTHFSIVDAQGNAVSNTYTLNWDYGSGVVVKGAGFLLNDEMDDFSAKPGVANAFGVVGGDANAIAPGKRMLSSMSPSLVTRDGKVTLVLGTPGGSRIFTSIFQVLNNLYDYHLPLEKAVAAQRVHHQLLPKDTIYYDAYAPLTGKVADELKAMGYTLEDQGWEMGDIQAIRVNGTALETASDPRGRGVGKVVK

SEQ ID NO: 57913 - protein, 518 aa, Pseudomonas fluorescens Pf-5
MQAPTAGWSEAAQFRNIPRLLSALPRAAPAGPSIRSIMKAKRLRADVLAGLTTSFALLPECIAFALVAHLNPLMGLYGAFFICTLTALFGGRPGMVSGAAGSMAVVIVALVVQHGVQYLLATVLLGGLVMVAFGLLRLGKLVRMVPHPVMLGFVNGLAIVIALAQLEHFKSGEHWLSGQPLYLMAGLVALTMAIVYLLPRLTRAVPPALVAILGVGALVYLLGLPTRTLGDMAHIAGGLPSLALPQVPWNLETLGIIAPYAFLMAMVGLLETLLTLNLTDEITESRGYPDRECVALGAANVVSGMFGGMGGCAMIGQTVINLSSGGRGRLSGVVAGALILLFVLFLSPLIERIPLAALVGVMFVVSQQTFAWASLRVINKVPLNDVLVILAVTVITVFTDLAMAVFCGIVIAALNFAWQQARELYADSHLEADGSKHYQLHGTLFFASTTPFLNQFDPAGDPRHVTVDCRHLSFVDYSAIAALKTLRERYAKAGKQLRVLHLSERCKKLLKRAREHHD

SEQ ID NO: 57914 - protein, 364 aa, Gibberella zeae PH-1
MADAQNDAPATAPFKAVQVEALVIMKIAKHCSSAFPSVATGAIVGMESEGLLEVTNTFPFPTVDPATTDGHQSDASQLAAAAPRQQKNITYQNEMIRHLKEVNVDANNVGWYTSATMGNFVNMNFVENQFHYQSANENAVALVYDASKSSQGNLTFRAFRLSPAFMSAYKEGKFTTEILQKSKLTFKDILAEVSVSVHNSHLLTTFLHQIPSAPVKGAIEQPTSLDDLHRNALEPPLYPSIDNLDLAIDPFLEKTCDLLLESIESHYTDLNNFQYYQRQLGREQTKITQWQAKRKAENAQRAAAKQEPLPEDEWQRLFKLPQEPSRLEGMLNAKQVEQYSKQVDGFTANVSAKMFAVREDLMPK

SEQ ID NO: 57915 - protein, 508 aa, Burkholderia pseudomallei K96243
MTGSTHSNDSRVRALAHFIGGRALDGASDRYGDVFDPALGTVTARVPLASGAEVDAAVAAAAAAFPAWSETSPLKRARVMFKFKELLDRHHDELAELITREHGKVFSDAKGEVMRGIEVVEFACGIPNLLKTDFTDQIGGGIDNWNLRQPLGVVAGITPFNFPMMVPCWMFPVAIACGNTFVLKPSERDPSASIRLAELLKEAGLPDGVFNVVHGDKTAVDALIAHPDVAALSFVGSTPIAEYIHTQAARRGKRVQALGGAKNHLVVMPDANLDQAVDALVGAAYGSAGERCMAISVAVAVGGVADALVERLAERAKALKIGNGMNADVEMGPLVTAAHRAKVSAYIDAGVAAGAKLVVDGRRHVVAGGENGFFLGGTLFDDVTTDMSIYREEIFGPVLAVVRVPDFASAVELINAHEFANGVSCFTSDGGIARAFARKIQVGMVGINVPIPVPMAWHSFGGWKRSLFGDHHAYGEEGVRFYTRYKSVMQRWPDSIAKGAEFTMPVAK

SEQ ID NO: 57916 - protein, 355 aa, Triticum aestivum
GRLRRRAGINQPTSSTVARKVVHQGIARSSVGTPRRQASFLRRLGAGRAGVMAASSSTASSYRSRFGDTTQTKVFVGGLAWETPSEGLRQHFEQYGDILEAVVITDRLTGRSKGYGFVTFREAEAARRAVQDPNPMITGRRANCNIASLGPPRPAHPRGRPSAVPYWQQGPPAPVPPQGPQYYIPSPRAPPQQQQQMGLMPSPGPAMYHHPPPPQPGFWGPPDYLYPLALMTPQMVQNYYAQLYAAGLASPTGPPPYHQYVGYMQMQAPTPRAAVLSPVAQQIAAGQPYAPHPAAAQMQGFSMQVPSLPHNFALQLPSHAVSMLPPNATDMQPAGGQASSSAAAATNANNTHQGA

SEQ ID NO: 57917 - protein, 483 aa, Magnaporthe grisea 70-15
MAASASSSFDDPAEAETAQLMFEFEDFAHQPPAEPLSTRRLLLLTCPSLGLQVCWFLLQTSGTPCLRSLGITPSWISLIWALGPIFGAFVQPVIGQLSDELHHPLGRRKPVMLAGAGAVISSVLAMACALALAPPGAQAWWPRAVAVGCLVVLLFAINAYSVGVRAIVVDVCPPAQQPAAAAWAMRWNVLGSAALSALGVVSTLQGRRDADPVAVFLKLALVAAVLSAVTVGLVCVLVSDTAPPRPKVQEGGGGGVGRVLAMCRLGEIYRRWGRLPPVTGQVCGVQLFAWLGWFPVLYYMSTYAYETALYQASHLTDPEAYAEPYPLYASLSFALGTLLSTLILTLLTATRLLAPAHLPRLWLCSQLLAAVSLLLTMALRTTAAALVLLALVGATWAVTMWVPFALINTELAELGSTGVAGAQGLHNMAVSLPQVASALLCACVLAGLDMLGMAHGAVWLLRLAAVPVGWSTWLIWRLDGGGA

SEQ ID NO: 57918 - protein, 179 aa, Synechocystis sp. PCC 6803
MNIPNWVTVSRLLALPLLFLWLPTPEAETRWWGVGIFLLAASTDWLDGYLARRLNQVTELGKFLDPLVDKLLVLAPLLILLTWQVVPPWAVGLILARELVIAGWRVNPQLASQTEIAGANLWGKVKTVTQITAIALLLAPLPEIYGQIGTVIFWIAVVLTLISGAIYLFPPGNNKVEAG

SEQ ID NO: 57919 - protein, 299 aa, Magnetospirillum magnetotacticum MS-1
MTTEIKVPTLGESVTEATVAKWFKNVGDAVRADEPLVELETDKVTVEVNAPAAGTLTDIVAATGATVEVGALLGVLGAAGAAAAAPAPKPAAPAPAPAPAAAPAAAGVMPSAKKIAADSGVDTSAISGTGKDGRVTKGDVLAAAAAPAPAPAPKPAAPSGPRPKAELEDRVKMTRLRKTIAGRLKEAQNTAAMLTTFNEVDMGALFDLRNQYKDQFEKRHGVKLGFMSFFVKACVAALKDWPAVNAEIDGEDLVYKKYYDIGVAVGTPQGLVVPVLRGADALSFAGVEQGIANLGKKAP

SEQ ID NO: 57920 - protein, 190 aa, Fulvimarina pelagi HTCC2506
MSQPVQPPASAYFITPEQEETQTRTLSVIVDNEPGVLARVIGLFSGRGYNIESLTVSETEHERHLSRITIVTRGFPHVIEQLKSQLDRIVPVHRVIDLTQGGAGSEAAKPIQRELAIIKVAGKGDKRVEALRLADIFRARVVDSSIEHFVFEIVGRPSKIDRFVGIMQPLGLVEICRTGVAALSRGPNAD

SEQ ID NO: 57921 - protein, 382 aa, Thermoplasma acidophilum DSM 1728
MSVKIGLVGEPNVGKSTFFSAATQNEAEIGDFPFTTVKPNLGMTFFTVKCPDTEIGARCNPREGYCENGIRHVPVQVIDVPGLIEGASEGRGMGNEFMDAIRDVDAIVLIVDVSSGSVDEIRKSITLVTDEIRKWFADRIYSDWEHFSRRSEAAGERREVALRRKLALFGVSEKKIYEILETEFFPARLSIWTMDDAYNLASAILKHAKPIIYAGNKGDKIDANTIGKIKVSIPDIYVVSAEYELAVKRARNAGLIDSVLTGFNITGGNQKQRDALAMIDRWFRTPDVIRIHDLIEKVVKDTLHYIVVYPVYDENKWTDKAGNVLPDAYVMIQGSTALDLAFRVHTDIGEGFIRAINGRTKMVLGKDYVLKDSDVIKIISKK

SEQ ID NO: 57922 - protein, 308 aa, Streptomyces vinaceus
MTEPRGLYSLADLDDASVQRIVRRTIELHADRDAHTRPLAGLVAGLLFTKTSTRTRTAFTSGAIRLGGAPIAFGPTDLQTNTGESAADTGRMLAGMLDLLVVRTAGPMRELRELSGEGELPVVNAMSAEEHPTQGLADLATLIHHFGGLDGVRVLYVGEGNNTAVALARVLSRQPGCHAVFASPAGYRLPDAVLAETAAIADRRGGSVTQAHAPGDVVGEVHAVYTSRWQTTGSTKPDPSWRDVFRPFHVDAALMNRWPDAVFLHDLPAHRGEEVSGEVLDGKSSLAWTQAGLKAAGAMAVLEWVVTT

SEQ ID NO: 57923 - protein, 346 aa, Fulvimarina pelagi HTCC2506
MSRYNSILDAIGNTPLIRLNRASEETGCEIYGKAEFLNPGQSVKDRAGLFIIRDAEEKGLLEPGGIIVEGTAGNTGIGLSLVANTLGYRTVIVIPDTQSEEKKDALRLMGAELIEVPAVPYKNPNNYVKLSGRLAESIAKTHPSGAIWANQFDNVANRDGHVVTTAEEIWHDTDGEVDGFICAVGTGGTLAGTALGLKRHSGHIKIGIADPMGAALYNFYAHGEMRAEGSSITEGIGQGRVTANLEGFEPDFAYQIPDGEALKIAFDLVTEEGLCLGGSSGINIAGAIRLAKDMGPGHTIVTILCDYGNRYQSKMFNPAFLKEKGLPVPEWIGGTPDFEVPFEKVD

SEQ ID NO: 57924 - protein, 474 aa, Prochlorococcus marinus str. MIT 9312
MTFEIKNICCIGAGYVGGPTMSVLADKCPEIQINVVDLNVSRIEEWNSDDLSKLPIYEPGLKEIVKRCRGKNLHFTSEVYENISIADMIFISVNTPTKTKGIGAGQASDTKWVEACARDVAKFAKGYTIVVEKSTLPVRTAEVIKTILEASESSKGRNNSEPVTFDVLSNPEFLAEGTAIKDLEFPDRVLIGGDNQKAINTLSAIYRKWVPSKKILHTNIWSSELAKLTANAFLAQRISSINSISALCEATGADIREVSRAIGSDSRIGSKFLESGPGFGGSCFKKDILNLVYLSNYFGLPEVARFWEEVVNINIWNQHRISQLVVKKLFGTVSGKKICILGFAFKPNTNDTRESSSIQICKDLIEEGAELFIHDPKVTPKQISKDLGMEQSKKDKIYNGEGRWFFIDDIDSEFVNADAVVILTEWDDYMKINWASAAFLMRKPAWIFDVRSIVNPKEIIKNDFNLWRIGDGTL

SEQ ID NO: 57925 - protein, 355 aa, Prochlorococcus marinus str. MIT 9312
MLMNLRGKNILVTGAAGFIGYALAERLLKEGEINIIGIDNLNSYYNPALKKRRIEILNQKDENRLWHFLKVDLKDKNKVNEIFEKYNPHLVVNLAAQAGVRYSLENPDTYLESNLLGFLNILEGCRNFNVEHLIYASSSSVYGGNIIMPYSEDHSVDHPLSLYAATKKSNEMLAHSYSHLFKIPSTGLRFFTVYGPYGRPDMAPMIFADSILNRKPINVFNNGDMSRDFTFISDIVEAIYKCCLKKPISNKSFYDHRPEPSTSFAPHRIFNVGSNNPINLMSFIEKLEDELGISAIKKMRPMQPGDVKSTFADITKLSEWINYHPSTSFNKGIHLFAKWYKDYFKSDYYRKPSKN

SEQ ID NO: 57926 - protein, 476 aa, Prochlorococcus marinus str. MIT 9312
MEKLKLQPVILCGGSGSRLWPLSRESFPKQFLKLVGNNNQSLLQNTILRLKKLKNIESPILICNEKHRFIVAEQLREINVKPKSIILEPEAKNTAPAVAVGAIRSKNDLKDSILFVLAADHSIQNVDKYVEVVKQGYEVACKGKLVTFGIIPTSPETGFGYIESAEKLTTDIKSSSIIRFIEKPDIKLARKLILDKHFSWNSGMFMFKASNIIGEFTKYAPKILESCHKSLEFAESDLDFLRLNENYFSKCQEISIDNAIMEKTSFGSVLPLSAGWSDIGSWQALWENEEKDKNGNFISGKVISNNIKNCYVRSENRIIACLGVEDLIIIETSDSILVSTKSDSQKIKSIVKSLNENGYQEAKSHKQAYRPWGNYISIAQDKRWQVKKITVNPGSSLSLQMHHHRSEHWIVVKGTALVQIDESKKLLSENESVYIPLGSKHRLSNPGKLDLILIEVQSGSYLGEDDIYRFKDNYGR

SEQ ID NO: 57927 - protein, 1095 aa, Oryza sativa Indica Group
MSTRLELLVVFVFIVAPALAATKPSYIVYLGGRHSHGDDGGVISPEEAHRTAAESHYDLLGSVLGDREKARDAIFYLYTKNINGFAARLEAEEAAAVAERPGVVSVFPDRGRRMHTTRSWQFLGLERPDGSVPPWSPWEAARYGQNIIIGNLDSGVWPESLSFNDRELGPIPNYWKGACRNEHDKTFKCNSKLIGARYFNNGYAKVIGVPLNDTHKTPRDANGHGTHTLATAGGSAVRGAEAFGLGGGTARGGSPRARVAAYRVCYPPFNGSDACYDSDILAAFEAAIADGVHVISASVGADPNDYLEDAIAIGALHAVKAGITVVCSASNFGPDPGTVTNVAPWILTVAASTMDRAFPAHLVFNRNRVEGQSLSPTWLRGKTFYTMISAANAAVPGYPPADALLCELGALDGKKVMGKIVVCMRGGNPRVEKGEEVSRAGGAAMILVNDEASGNDVIADAHVLPAVHINHADGHALLAYINSTKGAKAFITRAKTVVGVKPAPVMAAFSSQGPNTVNPEILKVRNFSWRELDVAPRAHERRVAFNAQSGTSMSCPQVSGVAGLIKTLHPDWSPAAIKSAIMTTATELGNDMRPIMNSSMSPATPFSCGAGHVFPHRAMDPGLVYDLTVDDHLSFLCTIGYNATALALFNGAPFRCPDDPLDPLDFNYPSITAFDLAPAGPPATARRRVRNVGPPATYTAAVVREPEGVQVTVTPTTLTFESTGEVRTFWVKFAVRDPAPAANYAFGAIVWSDGNHQLDQEYSNSYQISYVYESSMSLTDKMRKLKELLHKSENRICADCSSPDPKWASANIGVFICLKCSGIHRSLGTHISKVLSVTLDEWTDDEINSMLEVGGNSYANAIYEAFLPGGYHKPHPDSSQEERADFIRSKYELQEFLKPSLRIVSNKSSLQAMDSRKDIGNASNSYSFKSEAGMVEFIGIIKVKVIRGTKLAVRDILSSDPYVVLTLGQQKAKTKVIKSNLNPVWNEVLTLSVPQKYGPLKLQVYDHDVLSRDDIMGEAEVDLQPMITAAMAFGDPGLLSDMQIGRWLMSRDNALARDSAVSVVGGRVKQEVSLRLQNVECGEVDLELEWIALNQ

SEQ ID NO: 57928 - protein, 303 aa, Burkholderia pseudomallei K96243
MRPAAHCVQALVERAAHDRRIWLLDGDLADSYGADRFAVAYPQRFLMAGIAEQSMVSTAAGMAACGLRPWVFSFAAFLCYRAYDQIRVGLAQTGMPVTLVGSHSGGCGGPNGKSHLALNDIAVMASLPNVDVWAPACDRDTRFVVEAVMLTDRPAYVRYPREPWGELPGEPAECRWIGARRRIALVSCGLFSHVAHDAAEQLRALGVDAGALHLARLAPFPGEAFGTLVDGVDGIWVVDDHTRFGGLADLLRANGYAVREPVFSWPANWSGDVGPTAELLRRYGLCAADVAARIAAELERRGR

SEQ ID NO: 57929 - protein, 141 aa, Zea mays
  misc_feature (52)..(52): Xaa can be any naturally occurring amino acid
  misc_feature (67)..(67): Xaa can be any naturally occurring amino acid
  misc_feature (102)..(102): Xaa can be any naturally occurring amino acid
  misc_feature (128)..(128): Xaa can be any naturally occurring amino acid
TWPYSEAAGCVLHSTFINTVDLSDHIANKYCILLFYPLEFTSTSSSEITALXDRYNEFAKVNTEVLXIPLHQAVSHLAWGHTNRKSGGVGDPKYTLASDVSXSISKAFGALITDHGIALRGLFIIDKXGVLQHSTINNLAI

SEQ ID NO: 57930 - protein, 1120 aa, Ustilago maydis 521
MSNQAQDQPERRDSSSENSSPFKDDEVAADQSVSAHGNTSLNKKDRVSAVRDADASSAREGQQPGVTRIEALYRIFPRNSPIVYTVYASLAAVTICFALDQSTTAAYQLYATRTLGSHAKLFGVIATVEAILNAVSKPFIAKICDIFSRQTAYFLVAVFYTIGFVVVASAQTPAAFAVGRIITEVGQAGFDLVTDIVVADLSPLEWRGVVTALTSSPFIVLPWVGNLIQARLNTGRPEGWRWGYGMFAIMAPVCVAPIILVLMYVDRKAQKAGELSFASSRLETRRAQEQGTVKVQRDSLRDRFANLVQLCKEMDLVGLFLLALSFSLLLVPFSIYKDADKQWRNPSIIAMFVCGGVILGMFLAWEILLASHPVMNKRVWYNRTFLLAVTIDIFYFMGGNARSTYYGSFVLVGTNLSTANWGYVVNALATCALSVFGLAAGFYLRIFHRYKFLQIGGLVIRIVAMGLYLYGRNGNLTTMVVAWSQILNSLGGACSVVGTRVASQASVPHQDLASIISQLALWTRLGGAIGSAIAAGIWTGTLPDYLAATNLTPAQQSRAYNSPTTIKTSYPWNTPLRNQINQAFSKTMKPIFIVALVLAFIPLFAGLLMPNYYLGKTQNAVDGTDNSGRVIESAEDNPNAEINRKNVKYAKATKSDQPGILTVCRGVRLLRRKAIHIVYLIKVGYESKIFAASITLHLFTRVWSVAILYLITVLVALAAFAAMTIDLSLKSNQQKTIAVLGASYAGHRAIQVLVASLPEDWRVVVLERNTHANHLYAFPRMSVVRGHEQKVFIPYTNMFKPALDRRDQHVLLHANVLELDQEQRRVSYELIDDKQSGVQWLHWDFLVYALGSHLPDPINVWSNSEHVNTHDGSKMMGVKWLRDAQDRIEKAESIVIVGGGALGVQLATDIAVTYGSSKKVTLTHSRPQLLPRFDPWMHEKTAARLQELGVELALGSRVDLSTVSEDKKRFKLLDGRELQGDLTLFCLGQTPNTSLLGASSLNDSGMAKVEPTLQLSANERIFVIGDAADAFGAINAGHTAWDQAEVAAKNILALIDNKGQAMKLEEYKPTPPAIKVSLGIDRAIRQTMAGELVEVDSGSIDLNSTNMWTRRGLSTDDLWQ

SEQ ID NO: 57931 - protein, 235 aa, Glycine max
MRVVCCSNSGVSATLPSFPCPRFPPLIAISSIRFLNSTPLRSTASPRQVTRMASKNAQQDTRLARIASAIRVIPDFPKPGILFQDITTLLLDTKAFKDTVDLFVERYRDQNINVVAGVEARGFIFGPPIALAIGAKFVPMRKPNKLPGEVISEEYSLEYGTDKMEMHVGAVQPGERALIIDDLIATGGTLGAAIKLLERVGVHVVECACVIELPELKGRDRLGDKSLFVLIKGGA

SEQ ID NO: 57932 - protein, 267 aa, Glycine max
MAEASIGSKSSRWSLQGMTALVTGGSKGIGYAIVEELAQLGATVHTCARNEAELNESLNEWNTKGYRVTGSVCDVASRAERQDLIARVSNEFNGKLNILVNNVGTNVPKHTLDVTEEDFSFLINTNLESAYHLSQLAHPLLKASEAANIIFISSIAGVLSIGIGSTYGATKGAMNQLTKNLACEWAKDNIRTNCVAPGPIKTPLGDKHFKNEKLLNAFISQTPLGRIGEAEEVSSLVAFLCLPAASYITGQTICVDGGLTVNGLYIN

SEQ ID NO: 57933 - protein, 518 aa, Oryza sativa Japonica Group
MAFIPPRDLVVVLPFLALLLPLYIYLRYSRSAKANPSLPTEWPLVGMLPSLVANIHNLFDYATALLAASGNSFEARGPPMSSLRFFVTCDPDNVRHIFINNFANYPKGEEFASFFDVMGDSFFNADGESWRRQRARVQHVMSNPRLLASMAACCRGKVEKGLLPILDRMASAGAPFDLQRLLTRFAFDVTAMAVFGVDTCRLSIDMPPLDVANAMDAVMEVGFFRHTVPVSCWKLMRSLRIGPERKLTAAQRLLRRFVAEMIEKRRVAGGACKATDDEQGGVPPPADIVSSYINDPEYVDEDGNPREFMYATFINYMVAGRDTVGTALSWLFFNLTEHPRVVARIREELEPIASSKAGGGGMVVFDPEETKPLVYLQAALFESMRLYPPGPIERKATLAEDVLPSGHTVRAGDNILIPVYSMGRMASVWGKDSGEYRPERWVTEDGKLRHVPAHRFMPFNAGPRLCLGKDISVLQMKSVAAAVAWNFDLEVVAGHAVEPKVSIVMQIKNGLMVKVKKR

SEQ ID NO: 57934 - protein, 525 aa, Campylobacter coli RM2228
MVEVKNLTMRFANQLLFENVNLKLVRGQRYGLIGANGAGKSTFLKILSGEIESSSGEIVFDEGLKIAVLGQDQFAFENYTIKDAVMCANKRLYEALKEKEKLYMSEEFTDEINERLGELEIITAEEDPNYDCETRCEKILSSLKIKDFDVLMSTLQSADKFKVLLAQVLFLGADVLFLDEPTNNLDLEAISWLENELLRHEGTLVVISHDRHFLNKICTRILDVDFKQIRDFAGNYDDWYMASTLLAKQAELKRDKTLKEREELENFIRRFSANASKAKQATSRAKALEKLELEEIKISSRRDPSIVFRTNREIGNEVLELKGISKAYDKELFSNLELKIEKNDKIALIGANGVGKSTLAKIIANAIAPDSGSIHLGATIELGYFPQDTSNLICENLKLYEWLMSEKFKDLDEIRKCLGRMLFSGSDQEKMAASLSGGEKHRLMLSRLMLERPNFLLLDEPDNHLDLESIIALGEALYNFKGVALCISHDRELVSAFANRIWHLKDGELTDFRGTYQEFLGENDG

SEQ ID NO: 57935 - protein, 448 aa, Staphylococcus aureus subsp. aureus Mu50
MHFIAISINHRTADVALREQVAFRDDALRIAHEDLYETKSILENVILSTCNRTEVYAVVDQIHTGRYYIQRFLARAFGFEVDDIKAMSEVKVGDEAVEHLLRVTSGLDSIVLGETQILGQIRDAFFLAQSTGTTGTIFNHLFKQAITFAKRAHNETDIADNAVSVSYAAVELAKKVFGKLKSKQAIIIGAGEMSELSLLNLLGSGITDITVVNRTIENAMKLAAKHQVKYDELSSLPNLLESADIVISSTSAQSYIITNEMIERIAENRKQDSLVLIDIAVPRDIEPGISAITNIFNYDVDDLKGLVDANLRERQLAAATISEQIPAEIHAHNEWISMLGVVPVIRALREKAMAIQAETMDSIDRKLPGLSERERKIISKHTKSIINQMLKDPIKQAKELSSDKKSNEKLELFQNIFDIEAECPHEQAKQQKESKVKEISARRIFSFE

SEQ ID NO: 57936 - protein, 404 aa, Polaromonas sp. JS666
MNAALPQPIEAASPHVMNTYGRLPIALSHGQGCRVWDVNGKSYLDALGGIAVNTVGHNHPKLVPALQEQIGRLIHTSNYYHVPLQETLAAKLVELSGLENVFFCSTGLEANEAALKLARKFGHDKGIERPEIVVYEKAFHGRSIATLSATGNPKVQAGFGPLVEGFIRVPLNDLEALKAATVGNPNVVAVFFEAIQGEGGINSMKDEYLREVRALCDERDWLLMIDEVQCGMGRTGKWFAHQWSGIKPDVMPLAKGLGSGVPIGAVVAGPKAAHIFSPGNHGSTFGGNPLAMRAGVETLRIMEEEGLLANAVKVGDHLRAALTRELADEPGLKEIRGRGLMLGIELTKPCGELLARAAEKGLLLSVTADTVIRLVPSLIMTTAEADEVVAIVVPLIKQLLKEKA

SEQ ID NO: 57937 - protein, 329 aa, Polaromonas sp. JS666
MTKSATKATKSGAGESAEAKSTAARPIRHYLQFSDLNASEYAYLFERAAVIKKKFKAYEKHQPLADRTLAMIFEKASTRTRVSFEAGMYQLGGSVVHLTTGDSQLGRAEPIEDSAKVISRMVDLVMIRTFEQTKIDRFAEHSRVPVINGLTNEFHPCQILADIFTYIEHRGSILGKTVAWVGDGNNMANTWLQASEILGFKVHVSTPGGYEVDQSIAGIRSAESYQVFKDPMQACAGADLVTTDVWTSMGYEAENEARKKAFADWCVDADMMRAAKPDALFMHCLPAHRGEEVEADVIDGPQSVVWDEAENRMHVQKALMEFLLLGRVE

SEQ ID NO: 57938 - protein, 196 aa, Staphylococcus aureus subsp. aureus Mu50
MKVNPNNIELIISAVKEEQYPETELSEVALSGRSNVGKSTFINSMIGRKNMARTSQQPGKTQTLNFYNIDEQLIFVDVPGYGYAKVSKTQREKFGKMIEEYITKRENLQLVIQLVDLRHDPTQDDILMYNYLKHFDIPTLVICTKEDKIPKGKVQKHIKNIKTQLDMDPDDTIVSYSSIQNNKQQQIWNLIEPYIS

SEQ ID NO: 57939 - protein, 301 aa, Candida albicans SC5314
MTTMTTEEILASYPQITAPTDQTGYTSNLTPEQKTTLDIFRQQLTELGYKDRLDDASLLRFLRARKFDIQKAIDMFVACEKWREDFGVNTILKDFHYEEKPIVAKMYPTYYHKTDKDGRPVYFEELGKVDLVKMLKITTQERMLKNLVWEYEAMCQYRLPACSRKAGYLVETSCTVLDLSGISVTSAYNVIGYVREASKIGQDYYPERMGKFYLINAPFGFSTAFKLFKPFLDPVTVSKIHILGYSYKKELLKQIPPQNLPVKFGGMSDVSDDDLLLKDVGPWRDPEFIGPEGECPRAYNI

SEQ ID NO: 57940 - protein, 547 aa, Magnetococcus sp. MC-1
MSSLTQLPQWQALQTHLEENRSVQMRDLFDQDSQRFSRFSLQQGELLFDYSKNRITAETMARLLDLARAQDVEGWRDRMFAGEAINETEGRAVLHVALRNRSGRPIRVAGEDVMPAINQVLQQMRQFSEAVRSGAWKGQSGQAITDVVNIGIGGSDLGPVMVCEALKPYHQPGLSVHFVSNVDGTHMAETLKGLNAETTLFIVASKTFTTQETLTNAHTARDWLVAQLGEAAVRKHFVALSTNAEAVSAFGIDTDNMFAFWNWVGGRYSLWSAIGLPIAIAVGFEGFMALHDGAYAMDEHFRTAPLASNMPVIKALIGIWNHNFLGAESFAVLPYDQYLHRLAAYLQQADMESNGKYVTRDGARVDYTTGPVLFGEPGTNGQHSFYQLIHQSTRLVPADFIAAAHTHNPVGDHHAKLLSNFFAQTEALMTGKTAAQVRQELEAAGLHGAALEALVPHKVFDGNRPTNSILVRQFTPYTLGQLIALYEHTIHVQGMVWGINPYDQWGVELGKQLAKKILPELTTPGEVHSHDGSTNGLINHYKAWLAE

SEQ ID NO: 57941 - protein, 407 aa, Bradyrhizobium japonicum USDA 110
MISQASRFAPDQPPKLSCEYLTERVRALFGPHPFASQMSGDQVASLLPEYLAMSQAFPYLQAGSQRDLIFDAMHQNRDIGRDIELTSVVANFICWDETGGHGGILRGGKAALPDILLTENFHSNLLRKDAARLLGRAIRPNYSDRTKQYLHSLYAGLSSKDPLVRCAYMVAFELHAADMIQSLWTTLVKTFKARPDDLEYFRGHVGGEDPAEKYHGEMTGRLIGELVQPGLNDRFLNEFGRAYRLSVQWCRDLLGTAARTGDDHSEMQHHGRCHCGAIKFYVNAPRELSAVRCNCSICQMSGFVHLLVPGDKLRIECGEEFLTTYQFNKNIARHTFCRLCGVKPFYRPRSNPSGYSVNIRCLDRKTIEHLRISEFDGAHWEQAFLSMQQDPESCFEDQRSELEWRAQ

SEQ ID NO: 57942 - protein, 129 aa, Ostreococcus tauri
MGTDFHLFKEGIQPKWEDETCAKGGKWTYYVPKQKDGGELDECWLNLLLCMIGEQFSESTEICGAVVSVRQKQHRIALWTKTASSEPEQTAIGRHFKDILEVPESEKIGYMVHDDAIRLDRRAKDRYTV

SEQ ID NO: 57943 - protein, 535 aa, Arabidopsis thaliana
MASSCLFNASVSSLNPKQDPIRRHRSTSLLRHRPVVISCTADGNNIKAPIETAVKPPHRTEDNIRDEARRNRSNAVNPFSAKYVPFNAAPGSTESYSLDEIVYRSRSGGLLDVEHDMEALKRFDGAYWRDLFDSRVGKSTWPYGSGVWSKKEWVLPEIDDDDIVSAFEGNSNLFWAERFGKQFLGMNDLWVKHCGISHTGSFKDLGMTVLVSQVNRLRKMKRPVVGVGCASTGDTSAALSAYCASAGIPSIVFLPANKISMAQLVQPIANGAFVLSIDTDFDGCMKLIREITAELPIYLANSLNSLRLEGQKTAAIEILQQFDWQVPDWVIVPGGNLGNIYAFYKGFKMCQELGLVDRIPRMVCAQAANANPLYLHYKSGWKDFKPMTASTTFASAIQIGDPVSIDRAVYALKKCNGIVEEATEEELMDAMAQADSTGMFICPHTGVALTALFKLRNQGVIAPTDRTVVVSTAHGLKFTQSKIDYHSNAIPDMACRFSNPPVDVKADFGAVMDVLKSYLGSNTLTLISSLQCPKA

SEQ ID NO: 57944 - protein, 444 aa, Rubrobacter xylanophilus DSM 9941
MIEQRRPAVLPPELSDGSVTSVRVLYADLHGVARGKDVPIGEFERAVEHGLAFCSAIMGTDLRHTPVVGGEEGYPDLVAYPDLSTMTLVPWEPGVACCLADLRPVGDHAPPADPRGAVRRAVAAFEELGLSPVVGPELEFFLCERDPAGGVRRYVDNLSMVYTVGPQADPRGIVREIAEMLSGMGLGAFAANHEFMNSQYEINLHHADALAAADRAFRLKCAVKDVAAMRGLVATFMGKPFNDQGGSGFHIHFSLERGGENAFAGGEEGGVTGLLRHFVAGVLEHASGLMAFLNPTINAYRRLVPDSLAPTHANWGWDNRTAFVRIPPERGGATRVEVRVGDGSANPYLATAATLFAGLHGVRERLPLGPPVGGDAYALAGEKAGPPLPATLEEALDALEADEVLRGAMGEQIVGTFLALKRYEAERHRTWVSDWEISEYLHHL

SEQ ID NO: 57945 - protein, 499 aa, Vigna unguiculata
MARKMLIDGEAESVPGVEQGTNFDFDLFIIGAGSGGVRAARFSSNYGAKVGICELPFNPISSETIGGVGGTCVIRGCVPKKILVYGASYGGELEDARNYGWELNEKVDFNWKKLLQKKTDEINRLNGIYKRLLSNAGVKLFEGEGKIVGPNEVEVTQLDGTKLSYTAKHILIATGSRAQRPNIPGQELGITSDEALSLEDLPKRAVVLGGGYIAVEFASIWRGMGSEVDLVFRKELLLRGFDDEMRAVVARNLEGRGINLHPRTNLTQLIKTENGIKVITDHGEELIADVVLFATGRAPNSKRLNLEAVGVEVDKAGAIKVDEYSRTSIPSIWAVGDVTNRMNLTPVALMEASCFAKTVFNGQASKPDYSNIACAVFSIPPLSVVGLSEEQAIEQTKGDLLIFTSTFNPMKNTISGRQEKTEVMKLIVDAETDKVLGASMCGPDAPEIIQGIAIALKCGATKEQFDSTVGIHPSAAEEFVTMRTVTRRVTGSGKPKTNL

SEQ ID NO: 57946 - protein, 404 aa, Pasteurella multocida subsp. multocida str. Pm70
MSNFEIITPDLPESVADATVVTWHKKVGDVVKRDEILVEIETDKVVLEVPAQSDGVLEAIIEAEGATVISKQLLGKLSATAVAGGVTKETVVTQEPTPADRHHANLSTESVGSDSVSPGVRRLIAEHDLNAEDIKGSGVGGRITREDVEKVIAQKANKAPNKPAEPAFVVGNREEKRVPMTRLRKRIAERLLEAKNSTAMLTTFNEVDMAPIMKLRKTYGEKFEKQHGTRLGFMSFYIKAVVEALKRYPEVNASIDGDDIIYHNYFDISIAVSTPRGLVTPVLRNCDKLSMVDIEKEIKALADKGRDGKLTVEDLTGGNFTITNGGVFGSLMSTPIINPPQSAILGMHAIKDRPVAVNGEVVIRPMMYLALSYDHRLIDGRESVGFLVTIKELLEDPTRLLLEI

SEQ ID NO: 57947 - protein, 388 aa, Pasteurella multocida subsp. multocida str. Pm70
MNLHEYQAKQIFAEYQLPVGKGYACKSADEAADAIKKLNGDVWVAKCQVHAGGRGKAGGVKLVRNEAEVRAFADQWLGQRLVTFQTDVNGQPVNTLYVEEGSSIARELYLGAVLDRASQRVVFMVSTEGGVNIEEVAEKTPHLLHKMAIDPLTGGMPYQGRELAFKLGLKGDQIKQFAHIFVQMAKMFVEKDLALLEVNPLVVTKEGNLLCLDAKIVVDSNALYRQPALKAMQDPSQEDPREALAESHQLNYVALEGNIGCMVNGAGLAMGTMDIIKLHGGQPANFLDVGGGATKERVAEAFKIILSDSAVKAVLVNIFGGIVRCDLIAEGIIAAVNEVGVNVPVVVRLEGNNAPLGREILANSGVNIIAANTLTDAAIQAVKAAEGK

SEQ ID NO: 57948 - protein, 258 aa, Triticum aestivum
MLMLRAATARAASTVVAGARRRPGLLPVAVAGLSSSSSGPPSGGKRRKGQRRGEAKPQPQPQPLPGHSEIPSNKKANARPAKDRRKVRPAEEAPQGPSGQGQEIELRKQPPEKPKRVVRWRCATGCGACCKLDKGPEFPTPDEVFADFPDHLQLYKSMIGPDGWCNNYDKSNRTCNIYEDRPFFCRVEPKVFEEFFGVPRSKFDREACSACVDNIKMVYGQDSPELGNFKRVIREESSKHEASMNEVKLLDTTNTTGT

SEQ ID NO: 57949 - protein, 284 aa, Magnetospirillum magnetotacticum MS-1
MVEKRILDLDLRIRIGQDFDLCDPEDDPRFNEYWRLYHSIMERHGVSPEYARTVVRTRNTVIGTLMLKRKEADAMICGTIGRYDKHLSHILNVIGTRDGVKVPAAMNLLIMPAGTFFICDTYVTPEPTPEQVCDMTLLASEEVRRFGIEPKVAFLSHANFGNRSSASAARQREALALLREKAPYLEAEGEMHGDAALSEEIRTRIFPNSKLKGAANLLVMPTLDAANISFNLLKVAGDALSVGPILMGIAQPAHILTPSATVRNIVNITALAAVDAQMHAGKGR

SEQ ID NO: 57950 - protein, 240 aa, Prochlorococcus marinus str. AS9601
MTFTKFQYNNFCYWPSNPKKIVEFIGGSYLASKPDLTYRRFIESLINKNYAVHAYKYTPQFDHQQLAIKAWKDFKNCRISLSKRIGASIPSIRIGHSLGCKLHLISPDGGRNCEKFISISFNNFSANKSIPLLKQISQKLEFNSEFSPSPERTLRLIEKTYNQKNNFLIKFNQDELDQTDNLFSCLKARKEDNSKGVMLKGTHTIIASAGLRENFLGDWADDEFKRNTIKKISNLIDESI

SEQ ID NO: 57951 - protein, 277 aa, Thermoplasma acidophilum DSM 1728
MHVQAKFSNNLNIFEYSIVIRKIFYLGPPGSFSQEAAEIFGSDLVPVRSISEIFHKISVTGDYGIVPIENSIEGPVNETLDGLFRHEDIYIVDHVEIPIEIFLASNCDTENIRRIYSHPHAIAEAGDYLERTENIEVIRTSSTSEAAKLASMDEAGAALCSMKAAQHYGLANTVKIESKSRNITRFILIGRERNVEGSRHIILCVIPDRPGSLHSLIGVLASRGINMNMIYSRPLRDTIWKYYFYIEFSGKLDEDLLLTMGKQSLRILYKGSFKCCR

SEQ ID NO: 57952 - protein, 309 aa, Alkaliphilus metalliredigens QYMF
MKKVNYIYDLIGDTPLVKLNRLVEEDMAEVYLKLEFFNPGSSVKDRIALSMIEDAEEKGLLKPGATIVEPTSGNTGIGLAMIGAAKGYSVILVMPDTMSMERRKLLKAFGAELVLTSGALGMKGTIEKAKELLEKNPTYYMPQQFENPANPQVHQDTTAKEVWEQTDGEIDAFVAGVGTGGTITGVGGFLKQKNPNIKIIAVEPEKSPVISGGQPGPHKIQGIGAGFIPKNLNVNVIDQVIQVKDDDSLVMARKVAAIEGILVGISSGAAVVAALQVAKELGKGKRVVVMIPSSGERYLTTALFDFDQE

SEQ ID NO: 57953 - protein, 322 aa, Deinococcus radiodurans
MTNADEQNMGQQEGTDTATTAQDTNTQTVGTQSENTQNTQQASDAQTEQTPAELRDVLPQLTGEVDEDDVLDAQEEQAAGQSARKVDEDGEEYEEEFIDADDLMGLLGEMKEMLEAQSKEIRGLRREMRELRESQGGGFRGGDRGGDRGGFRPREDRGGFGGDRDRGGFRPREDRGERSFGGDRGGDRGGFRPREDRGGFGGDRDRGGFRPREDRGERSFGGDRGGDRGGQGGFRPREDRGGFGDRDRGGFRPREDRGERNFGGDRGGDRGGQGGFRPREDRNFGDREFRPRTDDAQGNQEGGFRPRARADRGWANRRTDEE

SEQ ID NO: 57954 - protein, 203 aa, Phaeodactylum tricornutum
MLEHIQIGQMAPNFIGVGVYKNQLGKIRLSDYHGKKYVVLIFYPSNFTAVSPTELVELNNRITEFKKLSTQILAISVDSPFSHLQFLLSKRNQGGLEHLNYPLISDLSQTITSNYKLLTKDGFSLPGVFIIDKEGIVQYYTVNNLLCGRSVNELLRILQSLQYLKENPGQACPVDWKYGDKILYSHPLKSKLYFKTLYSQKKT

SEQ ID NO: 57955 - protein, 618 aa, Oryza sativa Japonica Group
MAVSVAPVEAPRNRRATGDQGLVSRRVVEFPLPELKMELVYLERRNGFDEDSTSPEFSGRSAIDHQQLSIATPEVESDLGQTIYKQPLPSDEKKSRSCQSCHKSPCSCRSEVFHSDLYPTLPAKMMILEFLIRSLRHPRRTHNVSDLDDMISNGASTGSVVLGPSEKMMLDSLHSLVDAKTRPKSPSFFHSGTKMRKARSKSHIITQSEILKLISPETWEISSPGVSPLKKSTAELSMHEKMVSSDTPSMSSNQPVLSSCPSSLSAGLLQCIWKDGLPHFELSLDNPMAVYTANPTKAHDNDKPLDYVYLFHSGEQGRKDWLGNSSSVSRLVGKMKVSSSLVLNPDKSTSMETEFVLYGSPDDYLRQMQSSYGVTKGKGLAKRVADIMKPSNLNSSPKHVWKFGKSSSQQIDEMTEIPEGEQCSAKESVLKNLVADDLPTNQEIAAIVVRKQRRERRKSPVLGGWGLKFLEKAGATHPGSTEDGDVQNKKNNAGSVSAIFPRGYHGGAASKNGSPASLIGRWRSGGRCDCGGWDIGCPIRVLQNDGCGTSPQAESQSQDRKSVELSVKGAKKGPMFRLVNITDDLHIIYFDSSLSPLQCFSAGIAIIHSQAPHLYPKL

SEQ ID NO: 57956 - protein, 156 aa, Spiroplasma kunkelii CR2-3x
MDIKILTIGSLDKKYLIIGCETFFERIKHYAKLEIIELKEVNNKNEQVTINDQTALVIKKLLDYSEYYKVLLASQGQILTSEQIAAYIKEVKEFKKSKLLFIIGGSHGFNNNELLSKVNFQLSFGAITLPHQLCRLVLLEQIYRSFKIINNESYHK

SEQ ID NO: 57957 - protein, 307 aa, Bacillus pumilus SAFR-032
MARIANSVFELIGNTPVVKLNRLVDEDSADVYLKLEYMNPGSSVKDRIALAMIEDAEAKGTLKAGDTLIEPTSGNTGIGLAMVAAAKGINAILVMPDTMSQERRNLLRAYGAELVLTPGAEGMKGAIKKAEELAEEHGYFMPQQFSNEANAEIHRRTTGKEILEQFDGELDAFIAGVGTGGTITGAGEVLKEAIPSIQLYAVEPTDSPVLSGGKPGPHKIQGIGAGFIPSILNTEVYDGIIQVKNEDAFELARKAAKEEGILGGISSGAAIYAALQTAKKLGKGKKVLAIIPSNGERYLSTPLYQFD

SEQ ID NO: 57958 - protein, 416 aa, Burkholderia pseudomallei K96243
MALIVHKYGGTSMGSVERIKNVAKRVAKWHQAGHQMVVVPSAMSGETNRLLGLAKEISSQPSPRELDMIASTGEQVSVGLLSIALQDIGVEAVSYAGWQVPIKTDSAYTKARIHSIDDERVRRDLDAGKVVIITGFQGVDPDGHITTLGRGGSDTSAVAVAAALEADECLIYTDVDGVYTTDPRVVEEARRLDSVTFEEMLEMASLGSKVLQIRSVEFAGKYRVKTRVLSSLTDPQIPLDEEMRSGTLITFEEDETMEKAVISGIAFQRDEARIAVMGVPDKPGIAYQILGPVADANIDVDMIIQNQSVEGKTDFTFTVGRGDYQKAMDILTNQVKGHVNAEQVLGDPKVSKVSVVGVGMRSHVGVASTMFRTLSEEGINIQMISTSEIKISVLIDEKYMELAVRALHKAFELDQA

SEQ ID NO: 57959 - protein, 504 aa, Oryza sativa Japonica Group
MAFSSILQLTLCFLCFSVFYYYHIKSKRKNPAIPVCWPLVGMLPDLLVNRHQLHDWITSFLTASQLNFRFIGPTMSSNMRFFFTCDSANVRHIFTSNFANYPKGPDFAEIFDDTLGDGIFNVDGDSWRRQRAKTQLLMYNHRFQSFVSRCSSDKVENALLPLLSHFAGTGERCNLQDVFMRLTFDMSTMLASGEDPGCLAISLPMPKVPFVRAVDYTTRVLLVRHIIPLSLWKLARRLGVGFERKMAEALRTINQFIYETIVKRRAKKANEGIEDSEDLLSSYLKDDDENADTFLRDTTMTLIAAGRDTIGSALSWFFYLLTKNPHVASKILEELDSVERATTTPDGMVTFDPDELKSLVYLHAAVCESLRLYPPVPLDHKGVVAADVMPSGHKVRPGDKIVVSIYAMGRTESVWGSDCMEFRPERWISDDGKLRYVPSYKFTPFITGPRTCLGKDMALVQLKVVAATVVKNFEIEAVPGHIVEPKLSMVLHMKNGLMVRVKRR

SEQ ID NO: 57960 - protein, 197 aa, Bacillus pumilus SAFR-032
MILMIDNYDSFTYNLVQYLGELGEELIVKRNDQVTIQEIEELKPDFLMISPGPCSPDEAGISMEAIKHFAGSIPIFGVCLGHQSIAQVFGGDVVRAERLMHGKTSEIEHDGKGVFTGLQNPLVATRYHSLIVKNETLPECFDATASTKEGELMAIRHKELPIESVQFHPESIMTSFGKEMLKNFIETYRKKGHEVNA

SEQ ID NO: 57961 - protein, 190 aa, Synechococcus sp. WH 7805
MDVESFSRMTGTPDSTSLTSLQKGLLLVSAIALAVSLFLVRNGGIAESPLDQLARRSLAPEIALSNGRPTILEFYADWCEVCQEMAPAMMTMEEAHSDELDVVLVNIDNPRWLDLTDRYDVTGIPQLNLFAADGELRGRSLGGRSESELNALAAALVTNTSLPTLTGVGSASPLPEPTMLETAAGPRSHS

SEQ ID NO: 57962 - protein, 492 aa, Campylobacter coli RM2228
MRQKCILVITDGIGFNKEKDFNAFEAAKKPNYERLFREVPNSLIKTSGLAVGLPEGQMGNSEVGHMCIGSGQIIYQNLVRINKAIESCELEKNANLKKLLQKCKRVHVIGLYSDGGVHSMDTHFNALLEICAKNGNEVFAHAITDGRDVSPTSGLEFIRKLKNHCEEIGVHFATLCGRFYAMDRDKRWERVKEYYDCLLGKSKGVSNWVDYIEECYQNETTDEFIQAAKNENYKGMQEDDGLIFVNFRNDRMKQLIEVLNSQNFKEFEREKVFENLLTMSVYDDKFNIPVLFEKEEIKNTLSETISKAGLTQLHTAETEKYAHVTFFFNGGKEELLENETRVLIPSPKVKTYDEKPEMSAFEVCDVVKKGIEKGEDFIVVNFANGDMVGHTGDFNAAVKAVEAVDVCLGEVVECARKHDYAFIITSDHGNCEAMQDKKGNLLTNHTTFDVFVFVEAKGVDKLKENMGLSNIAASVLKILNLEIPKEMNEALF

SEQ ID NO: 57963 - protein, 498 aa, Ostreococcus tauri
MLHAVVRPELAFTFLRSLPGVRRIVERSKRQILLELEVSLKSGAKEQKICELPTSGLSVEDILKTAARLKNGDYKQLFYASKLTGTIYASDTRHRDLCNTVYCDFAHTNPLHSDAFPSVGRMELEIVHMTSRLLSSDSRIEICGTVTSGGTESILTAIRASRDFICHTKGITNPEMYVFIKRHINVSVTSVYKAAEYFKIKIRRVPMDENGRMNILAVKKALRRQTVLVYASAPTYPHGTIDPVDDLSNIALQHGCCLHVDACLGGFVLPFLSDVEHESRVPKFDFSLPGVTSMSVDTHKYGYAQKGSSVILYSTAIMRQFQYTSVADWSGGLYISPTPAGSRSGGLIAQTWAAMLHMGYEGYSKAAHDIFAGAKKLREAIAATEGLELIGTHITMIVAWHTSTGSNIYVLNDILTSKGWRLAVLQNPKALHFCITPANLSAIDELITDLRSAVRLSQTLKTVPGGKAPIYGLAHGLPDRGVIKALLKDVQDVMLNNM

SEQ ID NO: 57964 - protein, 955 aa, Arabidopsis thaliana
MRLRHQGGQYLARGMEPVYWSNKVDSTHDLYDNYTLGSYQNNSYNILAHTGFGYDHEFQIYEINSNSWRIIDATLDFKLGYIGRGVSLKGKTYWIASGEEEKRLGKFLISFDYTTERFERLCLPNKYPCYATLALSVVREEKLSMLSQRGIKSKAEIWVTNKIGETQVVSWSMVLALDLQPKRCIGESGSFLVDEKKRVVVCCDNIRDQGKTTFDSNLPRYHRQKKKGRMIIVFDVESMRLPVTVKATKPSFLVIWIRYSSAASSPTVSLNPSGRLQQTLAGSVEVKGKSLHSGKFSTVKLNPEIAGAGRFFEFRSRFIPASIEFAQESPLCTTLLKDELKIRTVEHLLSALEAKGVDNCRIQIESESSDDREVEVPIFDGSAKEWVDAIQGVGINAAQNHDGESVEKMVAHVNKPVYVCKNDTFVAAFPALETRITCGIDFPQVPAIGCQWFSWRPIHESSFAKDIASSRTFCVYEEVERMREAGLIKGGSLDNAIVCSAEHGWMNPPLRFDDEACRHKILDLIGDLSLVSRGGNGGLPVAHIVAYKNEEEEVRSSTEENENVRSSTEENEYVRSSTEAGRGEDPHEDSDNISESGAIHLQIMERFNQRSGSGKEEEEDTMDLSIKQVDLLNQVEISRVYHCDGLLLCVAKDNSRVVVWNPYLGQTRWIRPRTESNIGDSYALGYDINRNHKILRMVQTRNVSVYRYEIYDLRSNSWRVLEVTPNGEMDPNHPLYGVSVKGNTYFFAHEDSSSGEIDEDGDIIDLEDFLLCFDFTTETFGLRLPLPFHSTIDATVTLSCVRDQQLAVLYHNEGLHSDDRFTTVEFWVTTSIEPNSVSWSKFLTVDMRPLALTGVRFDNDMGATFFIDEDEKVAVVFDLDGYLSTESARYHTAFISGKDGFFKPVTLGVAPNVGEPCPRTGHIPTTYRPPLVCSSTYLPSLVQVNQQRKRKERHV

SEQ ID NO: 57965 - protein, 78 aa, Bartonella quintana str. Toulouse
MSDTVERVKKIIVEHLGVNADKVVENASFIDDLGADSLDTVELVMAFEEEFGVEIPDEAAETIFTVGDAVKFIDKASA

SEQ ID NO: 57966 - protein, 341 aa, Staphylococcus aureus subsp. aureus Mu50
MSTNIAINGMGRIGRMVLRIALQNKNLNVVAINASYPPETIAHLINYDTTHGKYNLKVEPIENGLQVGDHKIKLVADRNPENLPWKELDIDIAIDATGKFNHGDKAIAHIKAGAKKVLLTGPSKGGHVQMVVKGVNDNQLDIEAFDIFSNASCTTNCIGPVAKVLNNQFGIVNGLMTTVHAITNDQKNIDNPHKDLRRARSCNESIIPTSTGAAKALKEVLPELEGKLHGMALRVPTKNVSLVDLVVDLEKEVTAEEVNQAFENAGLEGIIEVEHQPLVSVDFNTNPNSAIIDAKSTMVMSGNKVKVIAWYDNEWGYSNRVVDVAEQIGALLTSKETVSAS

SEQ ID NO: 57967 - protein, 188 aa, Haemophilus somnus 2336
MKFNIPTILTLFRVGLIPFFIVTFYLPFHWAPFLTTIIFFIASITDWLDGYLARRWNQSTPFGAFLDPVADKVMVIAALTLVVEYQHVFWVTIPAIIMIFREIVISALREWMAEIGSRGIVAVSWLGKIKTASQMLALGGLLWHYNTLMEITAIVFLYIAAMLTVWSMFQYLAAAKKYLLADNKQKSE

SEQ ID NO: 57968 - protein, 479 aa, Haemophilus somnus 2336
MSRRLRRTKIVCTLGPSTDRGNNLEKIIVAGANVVRMNFSHGTPEDHLARAEKVREIAKKLGKTVAILGDLQGPKIRVSTFKEGKIFLNIGDNFTLDADLPKGEGNQEAVGLDYKTLPQDVVPGDILLLDDGRVQLKVLSTDNTKVFTEVIVGGPLSNNKGINKLGGGLSANALTEKDKEDIILAARIGVDYLAVSFPRSSADLNYARELAQQAGLKAKIVAKVERAETVIDDEAMDDIILASDVIMVARGDLGVEIGDPELVGIQKKLIRRSRQLNRVVITATQMMESMISNPMPTRAEVMDVANAVLDGTDAVMLSAETAAGQYPSETVSAMAKVCLGAEKMPSVNISRHRLDKEFDTIEETIAMSTMFAANHMKGVAAIIAMTSSGHTAKLMSRISSGLPIFALSRNESTLNLCALYRGVIPIHFDQDSRTLEGLKAAIQSLKDKGYLVSGDLVLLTQGDHLTSNGTTTCRALVVE

SEQ ID NO: 57969 - protein, 338 aa, Pasteurella multocida subsp. multocida str. Pm70
MAILVTGGAGYIGSHTVVELLNANKDVVVLDNLCNSSPKSLERVAQITGKQVKFYQGDILDTALLQKIFAENQIQSVIHFAGLKAVGESVQKPAEYYMNNVTGSLVLIQEMKKAGVWNFVFSSSATVYGDPEIIPITESCKVGGTTNPYGTSKFMVEQILKDIAKATPEFSITILRYFNPVGAHESGLIGEDPNGIPNNLLPYISQVAIGKLPQLSVFGSDYETHDGTGVRDYIHVVDLAIGHLKALDRHEGDAGLHIYNLGTGSGYSVLDMVKAFEKVNDIKIPYKLVDRRPGDIATCYSDPSLAKTELNWTAARGLEQMMKDTWHWQKKNPKGYRD

SEQ ID NO: 57970 - protein, 93 aa, Brassica napus
  misc_feature (65)..(65): Xaa can be any naturally occurring amino acid
  misc_feature (74)..(74): Xaa can be any naturally occurring amino acid
  misc_feature (81)..(82): Xaa can be any naturally occurring amino acid
  misc_feature (86)..(86): Xaa can be any naturally occurring amino acid
  misc_feature (88)..(88): Xaa can be any naturally occurring amino acid
MASSMLSSAAVVTSPAQATMVAPFTGLKSSAAFPVTRKANNDITSIASNGGRVSCMKVWPPVGKXKKFETLSYXLPDLTEXXWRKXGXYLFPQ

SEQ ID NO: 57971 - protein, 486 aa, Kineococcus radiotolerans SRS30216
MSVAPSSTIVLDHRFARELPEMAVPWQGEAAPDPHLLVLDEQLAVELGLDPRWLRGPEGLGLLLGTEVPEGAEPVAQAYAGHQFGGFSPRLGDGRALLLGELVDVHGRVRDLHLKGSGRTPFARGGDGLAAVGPMLREHVVSRGLHALGIPTTRALAVVATGRAVHRETTLPGAVLARVAASHLRVGSFQYARATGDPDLLRRLADHATARHHPAAATAANPPLALFEAVVAAQASLVARWMLVGFVHGVMNTDNTTISGETIDYGPCAFLDAFDPATVYSSIDHAGRYAYGNQPAVAEWNLARLAEALLPLLHEDQEQAVALATEALGTFRTRYDAAYSGGMRAKLGLPDDLGDAVTTPLTGDLLDLLTRDRPDHTSFFRALAVAARGDAAPVRALVADPAFGDWLERWLALSPDGTAMDRVNPVYVPRNHLVEEALTAATGGDLGPVQRLVEVLDAPYEERPGLERYAAPAPEDFGAYRTFCGT

SEQ ID NO: 57972 - protein, 246 aa, Frankia sp. EAN1pec
MGKLDGKVAVITGAGSGIGRSAAFLFAREGARVVCADVSGREALTAKAVGDGAIAVHVDVTSTEDIERMITTAVDRFGKLDVLYNNAGFTGPIVPLAEAGEDYFDAVMAVNVKGVYLGMKAAIPVMLAGGGGSIINTASAAGLVGWKGLAVYAATKGAVVQLTRSAALDYAAKGIRVNAVCPGATWTRQADAEDDSLPPEGVVPPQPMRRWGMPDELAAAALFLASDDASFVTGVALPVDGGYVAR

SEQ ID NO: 57973 - protein, 407 aa, Zea mays
MSHGGGGGRAKVTPNLAVDGEGTRTLNLTVLQRLDHAVEDILITAAHVTLYDFDTDINQWSRKDVEGSLFVVKSLLRDTYLDLYICQFQSSMYYLVRNAQPRFQFIVMNRRNTDNLVEDLLGDFEYQLQAPYIMYRNAAQEVIGIWFYNSQECQQVANLFSRILNAFSKVAPKPKIPSVQSEFEELEAAPSLVDGPLEAQTSNIMSTTTHVQEDPLSAFFSAAANVGGNSAVAVARQPIQPFGATPVAAHAATSITTTQSPGLHYLLPSQASSVSGRPADAHGGTGSIGRSTSLVYPSLFSPLTSSQTKMVHTNSAVPTAPPQHPRIAQQPQSAPLLQPFPLPTASSPPYGTPLLQPFPPPNPSPSLASAPVLSPALTRDKVRDALLRLVENDEFVDLVYREIMNRQ

SEQ ID NO: 57974 - protein, 540 aa, Synechocystis sp. PCC 6803
MIKLPVLLADINIQSLPTEPELILNNLAITTLVENLIILLLVATLVALVARWLKIPYVIGLVLAGLAIPRGLSVGLNPELILNFFLPILIFEAAINTDISRLRSTIKPITVLAGPGVVISAAITAVLLKIGLGLAWVTAAGVSVILTITDTVSVIAAFRSVPVPRRLATIVEGESMLNDGVAMVLLSVITTIHIQGGFSAGEGIRQIFVAFVGGGLVGLGLGYLCVGLFRQLNDDLSDILLTVSVSLGTFQIGQMLGVSSAIAVVVAGLVIGNLALKQTSASIKVTLLSFWEYAGFGVNTLIFLLVGIEVYPSILLSTIPAALIAIVAYQIGRVFSIYPLLYLLSFFDRPLPLRWQHVLIAGNVKGSLSMALALALPLTLPGRDQVVTLVFSTVMVSLIGQGLSLPWVVKKLQLSKPSPLAQKIAMLQLNLVTAKAAQGELKYLLEAGSLPKFLYEELFADYQARIANSEQELREFYNQRNLIFSEGEVEKKYIDGLYRRLYIAEKSAINDALAKGILADDISDEYLQVLNEKLLALQDD

SEQ ID NO: 57975 - protein, 523 aa, Pasteurella multocida subsp. multocida str. Pm70
MNNIHNHKILILDFGSQYTQLIARRVREIGVYCELWAWDVSEADIREFNPTGIILSGGPESTTEENSPRAPEYVFNAGVPVLGICYGMQTMAMQLGGLTETSTHREFGYASVNLKAADALFAQLNDDVTSSQPKLDVWMSHGDKVTRLPDHFQVTAMTSTCPIAAMSDERRRFYGVQFHPEVTHTKSGLELLTNFVVKICGCERNWTPENIIEDAVARLKAQVGDDEVILGLSGGVDSSVTALLLHRAIGKNLHCVFVDNGLLRLNEAEQVMEMFGDKFGLNIIHVKAEDRFLDALKGIDEPEAKRKMIGKVFVDVFDDESKKLTSVKWLAQGTIYPDVIESAASKTGKAHVIKSHHNVGGLPDYMKLGLVEPLRELFKDEVRKIGLALGLPAEMLNRHPFPGPGLGVRVLGEIKKEYCDLVRLADAIFMEELHASGWYYKVSQAFTVFLPVKSVGVMGDGRKYDWVVSLRAVETIDFMTAHWAHLPYDLLGKISNRIINEVNGISRVVYDVSGKPPATIEWE

SEQ ID NO: 57976 - protein, 382 aa, Kineococcus radiotolerans SRS30216
MRAMVYRGPYRVRVEEKDVPRIEHPNDAIVRVTLAAICGSDLHLYHGLMPDTRVGTTFGHEFIGVVESVGSSVQSLVPGDRVMVPFNISCGSCFYCARGMLSNCHNVNPNATAVGGIYGYSHTAGGYDGGQAEYVRVPFADVGPTLIPEWMHDEDAVLLTDATATGYFGAQLGEIREGDVVVVFGAGPVGLVAARSAWLMGAGRVIVVDHLDYRLEKARTFAQTETVNFAEHDDVVVHLKRITDHLGADVAIDSVGAEADGNFRQHVTGAKLKLQGGSAVALNWAIDSVRKGATISVMGAYGPIPNSVKFGDAVNKGLTLRMNQCPVKRQWPRLFEHVRNGHLTPRDLVTHRIPLEHIAEGYHIFSSKLDDCLKPLIVPTPA

SEQ ID NO: 57977 - protein, 363 aa, Vibrio vulnificus YJ016
MTDKTYKIAVLPGDGIGPEVMAQAHKVLDAIEKKHAIHFEREEHDVGGIAIDNHGCPLPQSTVTACEESDAVLFGSVGGPKWEHLPPNDQPERGALLPLRKHFQLFCNLRPAQIHSGLEAFSPLRADISGRGFDIVVVRELTGGIYFGQPKGREGEGANEKAYDTEIYHRFEIERIAKIAFESARLRRKKVCSIDKANVLQSSILWREVVEEIAKDYPDVELSHMYIDNATMQLIKDPAQFDVMLCSNIFGDIISDECAMITGSMGMLPSASLNESKFGLYEPAGGSAPDIAGKNIANPVAQILSAALMLRYSLGEEAAAQDIENAVSQALAAGELTADLAGDKPALSTAEMGDKIAQYILNS

SEQ ID NO: 57978 - protein, 265 aa, Mycobacterium smegmatis str. MC2 155
MLRDDALEGTVALVTGGGTGIGRATALDLARSGSDVVVAGRRREPLEKTVADIELLGRRALAVPTDIRDDEQVSALVEHTLAKFGRIDILVNNAGGQFAAPAEEITSKGWRAVHRLAVDATWSVTREVAVTAMIPQRSGVVFFIAFSPRRGIPTFVHATSARAALENMASGLALEWSRYGIRTLCVAPGTIATDGMDANYTQEAKDRWSSAIPLGRPGAADEVSAVIAFLASPGARYVTGTTVVVDGGADAWGAGHPVPGLETHL

SEQ ID NO: 57979 - protein, 278 aa, Xanthobacter autotrophicus Py2
MSVEPTRGPDGPAPAPLARQLTETVTAAGGIALAMFQAGVKSWTKDNNSPVTEADMAVDAFLHRHLTALDAGIGWLSEESADGPARLGTRRLWVVDPIDGTRGFMAGGHDWAVSVALVEEGRPVLAALFAPATGELFTAEAGRGAMLNGAPLKVAPRHTLDGARVAGPPADLDALARRAAVERLPRVRSLALRLARVATGEIDVAFAAGNSNDWDLAAADLIVHEAHGLLTTRDGTPLTYNAPEPRHPALLCAGPTLHAALVETAPQPPFFNATLDQR

SEQ ID NO: 57980 - protein, 253 aa, Brassica napus
MPIRNIAIGGVQGEVTHPSALRAALAEFISTLIFVFAGSGSGIAFNKLTDNGATTPSGLVAAALAHAFGLFVAVSVGANISGGHVNPAVTFGAFVGGNITLLRGILYWIAQLLGSVVACLLLKFATGGLAVPAFGLSAGVESLNGLVFEIVMTFGLVYTVYATAVDPKNGSLGTIAPIAIGFIVGANILAGGAFSGASINPPVAVSTHASGWSWSNHWIYWVGPLVGGGLAGIIYDFVYIIENGHEQLPTTDY

SEQ ID NO: 57981 - protein, 112 aa, Bacillus pumilus SAFR-032
MEFYGYHGVFAEENKLGQRFRVDLTASLDLSKAGQTDDLNETINYAELYQICKSIVEGESVNLVETLTERIASQVLKDFLTVQECTVKVIKPDPPIPGHYQSVAIEMTRSRA

SEQ ID NO: 57982 - protein, 197 aa, Triticum aestivum
  misc_feature (126)..(126): Xaa can be any naturally occurring amino acid
MATDTFVTDVTFGADVIVTTVTNSGAAVEGWLQEIRSVLGDLVVGIDVEWRPSYSPSQNPVALLQLCVGRRCLIFQLLHADFVPQALSGFLADPNLRFVGVGVQEDVERLSDDHSLAVANAVDLRXLAAEGMQMPELRQAGLQAVARTVMGANLQKPQRVRMGPWDAYCLSYDQIKYACIDAFVSFEVGRKLLTGDL

SEQ ID NO: 57983 - protein, 171 aa, Xanthobacter autotrophicus Py2
MSQSPEPIERHTLSVLVDNEPGVLARVIGLFSGRGYNIDSLTVSEVSHEGRLSRITLVTTGTPMVIEQIKNQLDRLVPVHRVRDLTVEGTALERELAMVKVRGLGEARGEALRLAEAFRARVIDATRESFVFEITGKSDKIDQFAWLMEPLGLVEVARTGVVAISRGPEAM

SEQ ID NO: 57984 - protein, 448 aa, Mycobacterium smegmatis str. MC2 155
MTAEATAHEHTGDTADSKLARKITGPLLFLFILGDVLGAGVYALMGVLAGKVGGALWAPLLAALMLALLTAGSYAELVTKYPKAGGAAVFAERAFKQPLVSFLVGFSMLAAGVTSAAGLSLAFAGDYLATFIDVPAVPAAIVFLALVGALNARGISESVKSNVVMTVIELSGLLIVIIAGAVMVGGGRGDLGRLGEFPESTAPAVAILAGAIIAYYSFVGFETSANVAEEIRNPSKVYPAALFGSLITAGVVYVLVGMASAAVLAPDELAASSGPLLEVVSESGLGVPDWVFSAIALIAVANGALLTMIMASRLAFGMAEHRLLPSVLSRVLTKRRTPWVAIVATTAVAMVLTAIGELSTLAETVVLLLLFVFTATNIAVLVLRRDTVEHDHFRVWTAVPVLGVASCVLLMTQQTAKVWMFAGILMAVGVVLYFVARAATNRTADETV

SEQ ID NO: 57985 - protein, 626 aa, Oryza sativa Indica Group
MAAAAVADEVTEAMEQVEGEREEADAVADEAAEVMEQAEGEREEAIDAVAGEAGEVMKEVVEGEREEANAMADEADEAMEPEGEREEEADAVADEATEPMEQVEGEGEDGDAATQRTALTLGRVKRIIRVDRDIKKKCQHTACLMSDNNLISTDNTNSLEIFCWTELLLNLHYIHDKVADVLREAGCTFMVSGPWFLNMNFLITCDPATVNHCFNANFKNYPKGSEFAEMFDILGDGLLVADSESWEYQRRMAMYIFAARTFRSFAMSTIARKTGSVLLPYLDHMAKFGSEVELEGVFMRFSLDVTYSTVFAADLDCLSVSSPIPVFGQATKEAEEAVLFRHVIPPSVWKLLRLLNVGTEKKLTNAKVVIDQFIYEEIAKRKAQASDGLQGDILSMYMKWSIHESAHKQKDEQFLRDTAVGFIFAGKDLIAVTLTWFFYMMCKHPHVEERILQELKGLQSSTWPGDLHVFEWDTLRSAIYLQAALLETLRLFPATPFEEKEALVDDVLPNGTKVSRNTRIIFSLYAMGRIEGIWGKDCMEFKPERWVSKSGRLRHEPSYKFLSFNTGPRSCLGKELSLSNMKIIVASIIHNFKVELVEGHEVMPQSSVILHTQNGMMVRLKRRDAA

SEQ ID NO: 57986 - protein, 505 aa, Oryza sativa Indica Group
MELLQWLLGFVVKYPEIMASAACFLLLFCRFRRRSKRIPTNWPVVGALPAIVANAGRVHDWVTEFLRAAAMSHVVEGPWGSPGDVLITADPANVAHMFTANFGNYPKGEEFAAMFDVLGGGIFNADGESWSFQRRKAHALLSDARFRAAVAASTSRKLGGGLVPLLDGVAASGAAVDLQDVFMRLTFDLTAMFVFGVDPGCLADDFPTVPFGAAMDDAEEVLFYRHVAPVPWLRLQSYLKIGHYKKMAKAREVLDASIAELIALRRERKAADANATGDADLLTAYLACQDEIGMDGAAFDAFLRDTTLNLMVAGRDTTSSALTWFFWLLSNHPGVEARILAELRAHPPSPTGAELKRLVYLHAALSESLRLYPPVPFEHKAAARPDTLPSGAAVGPTRRVIVSLYSMGRMEAVWGKGCEEFRPERWLTPAGRFRHERSCKFAAFNVGPRTCLGRDLAFAQMKAVVAAVVPRFRVAAAAAPPRPKLSIILHMRDGLKVKVHRRQED

SEQ ID NO: 57987 - protein, 261 aa, Burkholderia pseudomallei K96243
MFTRLREDVATIRERDPAARSAWEVLTCYPGLHALVFHRLAHACWRSGWRWLGRFVSQLGRFLTGIEIHPGATLGRRVFIDHGMGVVIGETAVIGDDCTIYQGVTLGGTSLARGAKRHPTLERGVIVGAGAKVLGGFTVGAGAKIGSNAVVVKPVPAGGTAVGNPARVVVPAEAKRTPERTAFCAYGITPNADDPMSLAIHGLIDHAAKEAQRVDEIVVALERLGAHLDALQGTDGARLDLRRLSAAFEGRALDGGTAAER

SEQ ID NO: 57988 - protein, 267 aa, Burkholderia pseudomallei K96243
MHPMLNIAVKAARRAGQIINRASLDLDLIEIRKKQQNDFVTEVDKAAEDAIIETLKTAYPDHAILAEESGESGDASEFQWIIDPLDGTTNFIHGFPYYCVSIALAHKGVVTQAVVYDPNHNDLFTATRGRGAYLNDRRIRVGRRDRLADALIGTGFPFREKDGLDAYSRLFTEMTQACTGLRRPGAAALDLANVAAGRLDGFFEQGINVWDVAAGSLLITEAGGLVGNYTGDADFLHRREIVAANPKVYAQMIPILSRYTHTRPASE

SEQ ID NO: 57989 - protein, 339 aa, Clostridium thermocellum ATCC 27405
MNKKISIIGAGSWGTALAVLLANNGMSVTMWSIFEDEIKMLNEKREHVHKLPGVIVPENVTFTSDLEKAVCDAEVVVVVVPSQTVRQTAKDISKYIRDDTVIVSCSKGLEEGTGLRMSEVIGQEIKDAKTVILSGPSHAEEVGRGVPTAIVAASCDIKAAELIQDIFMSPEFRVYTNTDVVGVELGGALKNVIALCAGISDGLGFGDNTKAALMTRGITEISRLGVSMGANPQTFAGLTGIGDLIVTCTSMHSRNRRAGILIGQGKSPQEAMDEVKMVVEGVTTTKAAYELARKMDVAMPITFEAYEVLFNGKNPRQAVYDLMMRNKKNEVEELDAKWL

SEQ ID NO: 57990 - protein, 188 aa, Hyphomonas neptunium ATCC 15444
MSDGTATPGPAPKSAYFLAHEDEEVERRTLAVIVDNEPGVLARVVGLFSGRGYNIDSLTVAEVDASQHRSRITIVTQGTAHILEQIEAQLLRIVPVAEVIDITNSKRGIERELALVKVAGTGEKRVEALRIGEIFRAHVIDTTNESFIFEVTGASDKLTQFVDLMRPLGLVEVSRTGVLSIKRGKEKG

SEQ ID NO: 57991 - protein, 327 aa, Triticum aestivum
MASRAATMVALLLAAVAATCAQAQLHEKFYGETCPSVEDVVRWERVRALSLAPSLAGPLLRMHFHDCFVRGCDGSVLLDSANKTAEKDAQPNQTLRGFGFVERVKAAVEKACPDTVSCADILALIARDAVWLSKGPFWTVPLGRRDGSVSISNETDALPPPTSNFTVLTQLFAAVNLDAKDLVVLSAGHTIGTSHCFSFSDRLYNFTGMENPSDIDPTLEPQYMMRLKSKCASLNDNTTLVEMDPGSFKTFDTDYFKLVSKRRGLFHSDGALLSDPFTRAYVQRHATGAFKDEFFADFAASMIKMGNANPLTGSQGEIRKKCSVVNH

SEQ ID NO: 57992 - protein, 501 aa, Bacteroides fragilis NCTC 9343
MMNQELLMSPNRLVTFLQKPAAEFTKADIINYIQQNEIRMVNFMYPAADGRLKTLNFVINNASYLDAILTCGERVDGSSLFPFIEAGSSDLYVIPRFRTAFVDPFAEIPTLVMLCSFFNKDGEPLESSPEYTLHKACKAFTDVTGMEFQAMGELEYYVISEDDGLFPATDQRGYHESGPYAKFNDFRTQCMSYIAQTGGQIKYGHSEVGNFMLDGKVYEQNEIEFLPVNAENAADQLMIAKWVIRNLAYQYGYDITFAPKITVGKAGSGLHIHMRMMKDGQNQMLKDGALSDTARKAIAGMMQLAPSITAFGNTNPTSYFRLVPHQEAPTNVCWGDRNRSVLVRVPLGWSAQTDMCALANPLESDSNYDTTQKQTVEMRSPDGSADLYQLLAGLAVACRHGFEIENALAIAEQTYVNVNIHQKENADKLKALAQLPDSCAASADCLQKQRTVFEQYNVFSPAMIDGIISRLRSYNDATLRKDIQDKPEEMLALVSKFFHCG

SEQ ID NO: 57993 - protein, 482 aa, Picea sitchensis
MMLGIRRLVSANGIFNGSKKRIGISMRAMTSVSAAESHEPAVLLPQMPAFDYKPQPYTGPLADEILKKRKQFLGPSNFYFYDKPLNIVEGKMQYLFDEDGRRYLDAFAGIVCISCGHCHPEVVDTIVKQTKLLQHTTTIYLHHAVTELAEALAAKMPGNLKVVFFVNSGTEANELATMMARLYTGNHDMISVRNGYHGNSANTMGLTSQSKWKFNIVQSGVHHAVNPNPYRGVFGSDGPQYAKDVQDIIEFGTTGRVAGFIAETIQGVGGAVELAPGYLPAVYDSVRKAGGVCISDEVQTGFGRMGSHYWGFETQGVIPDIVTMAKGIGNGLPLGAVVTTPEIAQVLTQRSHCVTFGGNPVCTAGGHAVLKVLDKEKRQEHCAVVGAHLINRLKELQDKYEIIGDVRGRGLMVGVELVTDRTSKTPAREETSLAFERMKDLGVLVGKGGMYGNVFRIKPPMCFTKEDSDFLVDVMDYSLSKL

SEQ ID NO: 57994 - protein, 361 aa, Burkholderia pseudomallei K96243
MSEKVYRIAVIPGDGIGVEVMPEGLRALDAVSRRFGLRFAYEPIEWASCDYYAKHGQMMPDDWKTQLSGMDALLFGAVGWPETVPDHISLWGSLIKFRREFDQYVNLRPARLFDGVPCPLAGRKAGDIDFMIVRENTEGEYSAVGGTMFEGTEREFVVQQAVFTRHGTERVLKFAFELAQRRAKRLTVATKSNGIAISMPWWDARAAEMAARYPDVAWDKQHIDILCARFVMQPDRFDVVVASNLFGDILSDLGPACTGTIGIAPSANLNPERNFPSLFEPVHGSAPDIAGKHIANPIAMIWSAAMMVDFLGAGTGPAREAHDAIVAAIEHVLKHGPRTRDMGGRASTREVGDAIVAHLLG

SEQ ID NO: 57995 - protein, 175 aa, Cytophaga hutchinsonii ATCC 33406
MIITAMKVRHAQPYKGDIIHVVVETPQYSLEKYAYDRDLKAFSLKKTLPAGSAFPFDFGFVPNTLCDDGDPVDALVLVEGETYPGCILAARLVGVLEAVEADKNNKQVRNDRLIAVSVESQLYKNITDVKELDKKMIHSIEDFFTSYNKQEGRTFKPLKWNNAKAAHKKVLTCKE

SEQ ID NO: 57996 - protein, 392 aa, Ostreococcus tauri
MRRALPRYGSFDSRWKTNSSTKLLPVRGQITRSKLHFPTSAVYAGWMQTEQEVIGFVSICLSALLMSKFASGEGRRGLSREEVGKPRGALKAGLDLDWGVCDDMGPRECMEDTYQVMKGRDHIFASVYDGHGGSGSSQYLRSNFYGFISSVLMKNRRLLSDATVTVDELHDITKNLFTDVFETADSALIDHIASLGDPECWSGSTATMCLVGSLRLTCANVGDSKAVLCRAGKPIELSVDHRPTTLTTSGRGEIKRVVEAGGWVSQSRVCGVLAVTRALGDYEFKGGRFELLAELQDMDDRQAATATMQTPPVISIPHCVTLARSSEDEFLILATDGLWDTMNGAQAVTFVRTELKKTPDKSMQAVADALVARALRCRTQDNVACIVIKLNK

SEQ ID NO: 57997 - protein, 422 aa, Staphylococcus aureus subsp. aureus Mu50
MTAEKITQGTEGLNVPNEPIIPFIIGDGIGPDIWKAASRVIDAAVEKAYNGEKRIEWKEVLAGQKAFDTTGEWLPQETLDTIKEYLIAVKGPLTTPIGGGIRSLNVALRQELDLFTCLRPVRWFKGVPSPVKRPQDVDMVIFRENTEDIYAGIEFKEGTTEVKKVIDFLQNEMGATNIRFPETSGIGIKPVSKEGTERLVRAAIQYAIDNNRKSVTLVHKGNIMKFTEGSFKQWGYDLALSEFGDQVFTWQQYDEIVENEGRDAANAAQEKAEKEGKIIIKDSIADIFLQQILTRPAEHDVVATMNLNGDYISDALAAQVGGIGIAPGANINYETGHAIFEATHGTAPKYAGLNKVNPSSVILSSVLMLEHLGWQEAADKITDSIEDTIASKVVTYDFARLMDGAEEVSTSAFADELIKNLK

SEQ ID NO: 57998 - protein, 483 aa, Pseudomonas fluorescens Pf-5
MSDNHHNYIAGQWLKGASEIENRNPSDTRDLIGLYAQASRAQLDSALAAASEAQRIWARSGLEQRYKVLMAIGQELMQRSAEIGRTLSREEGKPMAEGAGEVYRAGQFFTYYAAETLRQLGQTADSVRDGIEIDIRREPIGVVAIISPWNFPMATACWKIAPALAFGNAVVWKPANLTPASAVILSEIIARQDLPAGLFNLVMGAGSEIGQALIEHPGINAISFTGSVDVGKGIAASAAANLTKVQLEMGSKNALAVMDDADLDLAVSCAVNGAFGGTGQKCTASSRLIVHAGIHDAFVEKLLAATQALKVGHALEAGTQIGPVASAAQLEANLANLQLGQQEGAELLTGGQRLELESPGYYQAPALFIGGSNAMRINREELFAPIACVIKAGSYEEALSLVNDTRFGLTAGIMTRSLARASHFRRNARVGCVMVNLPTAGTDYHVPFGGRGESSYGPREQGRSAVEFYTHVKTGYIAAGAPL

SEQ ID NO: 57999 - protein, 405 aa, Methanosarcina mazei Go1
MYHLKCIECGAEYSKDEVIYTCSKCDGLLDVIYDYSSIKLDMEKLKTECPSVWKYAELLPIEREPVTIHEGGTPLYRCDRLAEKIGIKELYVKHEGMNPTGSFKDRGMTVGVTKALELGMSTVACASTGNTSAALAIYGAKAGIPVVVLLPAGKVALGKVAQALMHGAKVLSIRGNFDDALALVRTLCSQEKIYLLNSINPYRLEGQKTIGFEIADQLGFKVPDRIVLPVGNAGNITAIYKGFREFKLLGITDSLPKMTGIQAAGSCPIVKAIKNGAPEITPEENPETVATAIRIGNPVNATKALNAIRESGGTAESVTDEEILAAQKDLARLEGIGVEPASAASVAGLKKLVDMGVIGRDETVVCITTGHLLKDPQTVIDICEEPTVVDANIESIREAIFGKGK

SEQ ID NO: 58000 - protein, 181 aa, Campylobacter coli RM2228
MDGHFVPNLTFGPCVIEKISTITEIPLDVHLMVKDVGKFVDLFIPIKPKFISFHIESEAHPIRLCEYIRSQGIHPAIVLNPHTPINSIKHMIDFVDMVLLMSVNPGFGGQKFLPLVYDKIKELRRLIDEKNAKVFIEVDGGVNGLNASDLEAAGADILVAGSYIFSSNDYKTSISSLKLEF

SEQ ID NO: 58001 - protein, 453 aa, Staphylococcus aureus subsp. aureus Mu50
MAEKLQRELSNRHIQLIAIGGAIGTGLFLGAGQTIALTGPSILLTYIIIGFMLFMFMRGLGEIIIQNTEFKSFADVTNTYIGPFAGFVTGWTYWFCWIITGMAEVTAVAKYVSFWFPEIPNWISALFCVLLLMSFNLLSARLFGELEFWFSIIKIATIIGLIVVGFVMILFAFKTQFGHASFTNLYEHGIFAKGASGFFMSFQMALFSFVGIEMIGVTAGETKDPVKTIPKAINSVPIRILIFYVGALAVIMSIIPWQQVDPDNSPFVKLFALIGIPFAAGLINFVVLTAAASSCNSGIFSNSRMLFGLSSQQQAPPNFSKTNKYGVPHVAIFASSALLLVAALLNYIFPDATKVFTYVTTISTVLFLVVWGLIIIAYINYSRKNPDLHKNATYKLLGGKYMGYLIFVFFIFVFGLLFINVDTRRAIYFIPIWFILLAFMYLRYKRIAAKSNK

SEQ ID NO: 58002 - protein, 585 aa, Staphylococcus aureus subsp. aureus Mu50
MRKTKIVCTIGPASESEEMIEKLINAGMNVARLNFSHGSHEEHKGRIDTIRKVAKRLDKIVAILLDTKGPEIRTHNMKDGIIELERGNEVIVSMNEVEGTPEKFSVTYENLINDVQVGSYILLDDGLIELQVKDIDHAKKEVKCDILNSGELKNKKGVNLPGVRVSLPGITEKDAEDIRFGIKENVDFIAASFVRRPSDVLEIREILEEQKANISVFPKIENQEGIDNIAEILEVSDGLMVARGDMGVEIPPEKVPMVQKDLIRQCNKLGKPVITATQMLDSMQRNPRATRAEASDVANAIYDGTDAVMLSGETAAGLYPEEAVKTMRNIAVSAEAAQDYKKLLSDRTKLVETSLVNAIGISVAHTALNLNVKAIVAATESGSTARTISKYRPHSDIIAVTPSEETARQCSIVWGVQPVVKKGRKSTDALLNNAVATAVETGRVSNGDLIIITAGVPTGETGTTNMMKIHLVGDEIANGQGIGRGSVVGTTLVAETVKDLEGKDLSDKVIVTNSIDETFVPYVEKALGLITEENGITSPSAIVGLEKGIPTVVGVEKAVKNISNNMLVTIDAAQGKIFEGYANVL

SEQ ID NO: 58003 - protein, 302 aa, Synechococcus sp. CC9605
MGWSAADIPNQQGRIALITGANSGLGLETARALKRCGATVVLACRSPRKAELAKQELLQERDGGAVDLVDLDLADMTSVERAAATVGERYGCLDLLINNAGVMAPPRRTTAQGHELQFGVNHLGHMALTQALLPLMQNRPDPRVVTVTSGAQYFGKIRWDDPSWSKGYDRYGAYGQSKLANVMFALELDARLHKKGSPIRSLAAHPGIARTELQPTAIANVGNRFEALAYRLMDPLFQSAGMGALPQLHAATAATAQGGEHYGPEQFGGLRGAPALCRVAPAASQPAERQRLWSLSEELLSA

SEQ ID NO: 58004 - protein, 336 aa, Colwellia psychrerythraea 34H
MTIKIGINGFGRMGRLSMRAAFDWDDIEIIQINDPAGNAETMAHLMTFDSIHGRWHHEATHEGDSIVINGKAISYTQNTATSDTDWSQCDVVIEASGKIKTKTLLEAYLAQGVKRVVVTAPVKEEGVLNIVMGVNEELYDKAIHPIVTAASCTTNCLAPVVKVIHEKIGIKHGSMTTIHDITNTQTILDAPHKDLRRARACGMSLIPTTTGSATAITHIFPELKGKLNGHAIRVPLANASITDCVFELARGTSVEEVNQLLKEAAEGELKDIMGYEERPLVSIDYKTDPRSSIIDALSTMVVNDTQVKLYVWYDNEWGYANRTAELALMVGLADKV

SEQ ID NO: 58005 - protein, 205 aa, Magnetospirillum magnetotacticum MS-1
MTGLCYAFEGMVPVVDPTSYVHPTAVLIGDVRIGPGCFIGPGASLRADFSSVIIGAGVNIQDNCILHGTPGFHTVVEDYGHIGHAAVVHGCRIRRNALVGMASSIYDGAEVGEEAIIAAMAFVPAGFKIPPRTLVAGLPAKVLRELSDEEVARKTRGTEAYQQLAQRALKSMVPCEPLSAPEPGRAQLNPSALWPDDLTRHKPKG

SEQ ID NO: 58006 - protein, 242 aa, Oryza sativa Indica Group
MAAASSSSSSSAYYGGANKSVAFLVATVVTVPLCALLLGGGGVAVVRDNNNNAGGGEAEVYRSELTPLQKHVAFFDRNKDGIIYPSETYQGFRAIGAGVVLSAVGAVFINGGLGPKTIPENTKTGLKLPIYVKNIHKGKHGSDSGVYDANGRFVPEKFEEIFKKHAHTRPDALTDKELKELLQSNREPKDFKGWLGGFTEWKVLYYLCKDKDGFLHKDTVRAVYDGSLFAKMEQEKQSAKKK

SEQ ID NO: 58007 - protein, 468 aa, Thermotoga neapolitana DSM 4359
MAKGSKGYIVGVMGPVVDVKFPEEELPDIFNALEVVNPQTGQKIVLEVEQLIGDGVVRTVAMDSTDGLMKGLEVVDTGEPITAPVGKEVLGRILNVIGEPVDEAGEIKSKERWPIHRPAPELIEQSTEIEILETGIKVIDLLAPFPKGGKIGFFGGAGVGKTVLVMELIRNIAIEHKGFSVFAGVGERTREGNELWLEMQESGVLGNTILVFGQMNEPPGARFRVALTALTIAEYFRDVEGRDVLLFIDNIFRFVQAGSEVSALLGRMPSAVGYQPTLATDMGELQERITSTRRGSITSVQAIYVPADDITDPAPATTFAHLDATVVLSRRIAELGLYPAVDPLDSSSKILDPAVVGREHYEVARGVQEVLQRYKDLQDIIAILGVKELSPEDKLVVHRARRIQRFLSQPFHVAERFTGRPGKYVPLEETIRGFKEILDGKLDDVPEQAFLMAGTIDEVKERAKEMRS

SEQ ID NO: 58008 - protein, 518 aa, Nicotiana tomentosiformis
MVFPVEAIVGLVTFTFLFYFLWTKKSQKPSKPLPPKIPGGWPVIGHLFYFDDDGDDRPLARKLGDLADKYGPVFTFRLGLPLVLVVSSYEAIKDCFSTNDAIFSNRPAFLYGEYLGYNNAMLFLANYGSYWRKNRKLIIQEVLSASRLEKFKHVRFARIQTSIKNLYTRIDGNSSTINLTDWLEELNFGLIVKMIAGKNYESGKGDEQVERFKKAFKDFMILSMEFVLWDAFPIPLFKWVDFQGHVKAMKRTFKDIDSVFQNWLEEHIKKREKIMEVGTEGNEQDFIDVVLSKMSNEYLGEGYSRDTVIKATVFSLVLDAADTVALHINWGMALLINNQNALKKAQEEIDTKVGKDRWVEESDIKDLVYLQAIVKEVLRLYPPGPLLVPHENVEDCVVSGYHIPKGTRLFANVMKLQRDPKLWSNPDKFNPERFIARDIDFHGQHYEYIPFGSGRRSCPGMTYALQVEHLTMAHLIQGFNYRTPTDEPLDMKEGAGITIRKVNPVKVIITPRLAPELY

SEQ ID NO: 58009 - protein, 719 aa, Pasteurella multocida subsp. multocida str. Pm70
MKQLFATTARGFEELLKVELTDLGAMDCQITQGGVHFHADEETQYRVLLWTRLASRILLPIVTCKVYSDLDLYSAVVGQNWLDYFDEKAHFMVDFNGTNREIRHTQFGAMRVKDGIVDYFERVGKPRPNVDKSQPDIRIHAYLNREELVISLDLSGDALHMRGYREDTGKAPLRETLAAAIVLRSGWQLGTPLMDPMCGSGTLLIEAAQMQANIAPQLHRLHWGFDFWKGHNQQAWDKVKGEAIELAEQTFNQNQKANFYGCDLDHRVLQKAKRNAQNAGVAHLIQWQQGDVAALKNPFVEAKGTVICNPPYGERLGTTPALIALYSVFGQRLKQQFADWNVSIFSGEPALLDCLRLRSHRQFKAKNGPLDCVQKNYHISARATASDENTQNSPEIDRTLTSSQVAVDFANRLQKNSKKIEKWAKQQGINAYRLYDADLPEYNLAVDRYDDHIVVQEYAAPKNIDENKARQRLLDAVTATLQVTGVETNKLILKVRQKQKGTNQYEKLANKGDYFYVNEYGAKLWVNLTDYLDTGLFLDHRLTRKMLGEMAKGKDVLNLFAYTGSATVHMALGGAKSTTTVDMSNTYLNWAEQNLLLNDLEGKQHKLIQADCLQWLARCDRQFDLIFVDPPTFSNSKRMEDSWDVQRDHIKLMTQLKRILRPNGTIVFSNNKRGFKMDVEGLAALGLSAVEISAKTLPLDFERNKQIHNCWVVRLKADL

SEQ ID NO: 58010 - protein, 471 aa, Prochlorococcus marinus subsp. marinus str. CCMP1375
MLEKINNICCIGAGYVGGPTMAVIADKCPEIQVNVVDINQARINNWNDSDFSNLPIYEPGLAEIVKNCRGRNLHFSTVIEENIALADMIFISVNTPVKKKGIGAGQASDLKWIEASARQISKYAVGKTIVVEKSTLPVKTAQTIKNILEAHVLNTSNDKKFSILSNPEFLAEGTAINDLENPDRVLIGGEDQDAINLLIDVYLNWVDKEKILTTDLWSSELSKLTANAFLAQRISSINSISALCESTGADVNDVALAIGMDKRIGLEFLRPGPGFGGSCFKKDILNLVYICNHYGLYQAAKYWQTVINLNDWQQKRISKIIVEKLFGTISGKKIAVLGFAFKANTNDTRESPAINICRDLLEEGSNLHIYDPRVSQDQIKMDLGHSQIIDSQNLLFEGKWEFSKSVELAANGADAILVLTDWEEFKTLDWEKLSKIMRSPSWLFDTRSISNAIEAKSFGINIWRLGDGALN

SEQ ID NO: 58011 - protein, 231 aa, Brassica napus
MSEDQADTENKSHTDGGDDVGEIVNGVTVNGRRGTDYVAVDKEDDTESLYSLVCIIIGSILFPDSKTSDAYSSPLLQRIRNSVSENGPKLREASRKTSREILQWTRQGSPLRSLLVITMGTIALLTTMALAVFALFFVAATANAIIISLLVSLAVAGGFLALFFLSLTAIYIGALSVAAFVISTAAVSAVVCVLIASGWIGFFYAVWLGARGSLRFAKQVTGLAISGNSTQ

SEQ ID NO: 58012 - protein, 265 aa, Triticum aestivum
MRKRERENPCGICGHYHKYEEGEPCGVCGHRPPALGPAGAAAAPRQESAFPSEILKDFLFLGSYDNASRSELLKTIGISHILNTVPLCQNLYRNSFTYHCLQDDKTLQFDDAIQFLEQCERDKARVLVHCMSGKSRSAAFVVAFLMKSRGWRLAQCFQWVKERRPQVQLADAAQQQLIEYEQKLFSCNVAPTDSFPSLGFGFPKPSGDVQVPIFNQQAPGSIFERVSPNNIPSNFTFGATEAKLPDGSNFGVVNLAGTDSMMDSS

SEQ ID NO: 58013 - protein, 550 aa, Thermoplasma acidophilum DSM 1728
MMMYEDDIRRIALINAYQHEGKADLKSVMGKVMAEIPDLRRDPRSAREMVSRIVDEVNSMSAYEIRETVETRYTSSIRKEKKVEEHRLPDLEGVNGPVVMRMAPSPSGPLHIGHTRMAILNDEYVKRYGGELILRIEDTNPKNIDPDAYHMIPEDLEWLGVNVTKIVIQSDRFDLYYAEAKKLMENGHMYVCTCPREEFKKRKLESIPCKDRDNPPETNLELFDKMIDGTIKEGDAVAVVKTDLKHPNPSVRDWIAFRIIEARHPRVDDKYRVYPMMSFSVAVDDHYLGLTHVLRGKDQLTNTDKQRYIFDYNGWKKPYYYHYGMIKFPGIKLKTSLMKKGILSGQYEGWSDIRLGTVRAFAKRGYRPETFRRYWINSGLREIDAIFSIEIFDSINREIVDPRAYRFSFVKDPVPVRIEGMPNISAKLPLHPTHPEYGFREYEVKGSVYIASRDFAAISEGERIRLKDLCYIRKKGNGIIYDGVEMTEKTKIINWCPEGSRDFSVLKPDGSKDSGLIEPKSSGYRGIAQLERYGYVNFADGDDLAYFTHP

SEQ ID NO: 58014 - protein, 521 aa, Prochlorococcus marinus str. AS9601
MSNFSRYLSKNWLDDPKSNILSGLVVAFAMIPEAIAFSGIAGVDPKVGLFGAFCLSITIAIVGGRRGMITSATGSTALLMTGLVAYGESQAPGLGVPYLIAAGILTGIFQILWGYLRLAYQMRFVPTGVLSGFVNALALLIFQAQLPQLGIGIKESKELVEQTISQYPINSQIPVVWILVILGLVIIYGLPKITKVVPSQLIAIVVITLISIFFNLDVPTVSDLGKLPDGLPSISLPFGSIENGKVPFSLETLGIILPTSLAISLVGLMETFLTQDILDDVTDTSSNKNKEARGQGIANIVASLFGGMAGCALVGQSVMNTENGGKSRLSTLSSGISLLIMIILLKSWIGAIPMAALVAIMITIAISTADINGLKNIRKIPKSDTAVMLMTFSVTMLTKPHNLALGVIAGVALAAILFSRKVAKVITVSGAKENNLTTYKVKGQLFFVSKIYFLQGFDIHEHPENIVIDMSLAHIWDQSGVVALEQIIRKFQNGGSKVEIVGLNKESLNLFERLGGIESAH

SEQ ID NO: 58015 - protein, 347 aa, Prochlorococcus marinus subsp. marinus str. CCMP1375
MNRILVTGGAGFIGSHTCITLLESGYDLLIIDSFINSSEVSLKRVKEMSDNKNINYLKGDIRNLEFLDSIFSNAIQEGKPIDAVIHFAGLKSVSESTKIPLTYWDVNVVGSIALFSIMRKYKCYTIVFSSSATIYGNTDKVPIKEDSLISPINPYGESKATVEKILSDLSLSAPFDWRIACLRYFNPVGAHPSGRIGEDPLGIPNNLFPYITNVAGGQIKQVEVFGNDWPTQDGTGVRDYVHVLDLAEAHKSALECLFAEPAQLLILNLGNGFGLSVLEIINTFSRVNNCEVPYVFAARRPGDIAISYADIALSKARLNWYPKRSIEDMCRDTWRWKLNNPIGYRSK

SEQ ID NO: 58016 - protein, 445 aa, Oryza sativa
MAIEKIQARMVLDSRGNPTVEVDITTEKGLFRAAVPSGASTGIHEAVELRDGDKNAWMGKGVSKAIDNVNNIIAPELIKSGLPVTSQKEIDDFLIKLDGTANKGKLGANAILGVSIAVAKAGAGEQGLPLYKYLANLSGVKAPYVLPAPAMNVINGGSHAGNALAFQEFMIVPTGAKSFTESVKIGTEVYHNLKKVINTKYGIDATNVGDEGGFAPNVQSADEALEILTEAIAKAGYEGQVHISLDVASSEFYKEGKYDLDFKNPNSDSSKWLTGKELADVYLGFIKKYPITSIEDPFDQDDWEAWSHLRANAGITIIGDDLTVTNPLRIKTAIEKKACNGLLLKINQIGTISESIQAAQLAQSDNWGVMVSHRSGETEDVTISDLVVGLGVGIIKTGAPCRSERTAKYNQLLRIESLEPSAVYAGIDGFTQGETAPKVITNKSA

SEQ ID NO: 58017 - protein, 164 aa, Vibrio vulnificus YJ016
MRHIISLLMENQPGALSRVVGLFSQRGYNIESLTVSPTDDETLSRLNITTMTDEMQLEQIQKQLHKLIDVLKVQEVTEFDHIERELMMVKVKASGFARAEVKRTADIFRGQIVDVTASQYTVQLAGTSEKLDAFIQAISEVTEVIEVARSGVVGIARGERALKA

SEQ ID NO: 58018 - protein, 341 aa, Prochlorococcus marinus subsp. marinus str. CCMP1375
MRPVLITGAAGFIGAALVKKLLSEGERVIGIDNINEYYDTSLKYARLQYIESSSQEYLKNWVFHKLGIENIDEIKEIFTKESPRIVVNLAAQAGVRYSLDNPHAYVQSNLVGFCNLLEMCRHYEVENLIYASSSSVYGGNTNLPFNETQAVNHPVSFYAATKKSNELMAHTYSHLYDLPATGLRFFTVYGPWGRPDMAPMKFAKAILEGDPIQVFNFGRMKRDFTYIDDVVESIFRCCYLQATVNNNFDKSNPDPCTSFAPHRIFNVGNSQPTELDIFINLLEKSLSTKAIRDLLPMQPGDVVATAADTQKLKDWTGFSPSTSLEDGIQCFAEWYLSFYQS

SEQ ID NO: 58019 - protein, 207 aa, Triticum aestivum
MHNPSSNHPAPAAAAAGKSKSSGQAAATASGQGHQPSPTTPAAAKSKSSAAAGASGHGHNSSPATPAAGKSKVSAHAVAPGQASSSNQPHAVGGADAAASSLKRKRGVFQKDLQHMMYGFGDDPNPLPETVALVEDIVVEYVTDLVHKAQNVASKRGKLLTEDFLYLIRKDMRKLHRATELLSMNEELKQARKAFDVNEETLVVTNE

SEQ ID NO: 58020 - protein, 495 aa, Vibrio vulnificus YJ016
MGHVKALGYKHRLSNCNYIDRRVSSMKKTKIVCTIGPKTESVEKLTELVNSGMNVMRLNFSHGDYVEHGTRIANFRQVMENTGKQLAILLDTKGPEIRTIKLENGDDVDLVAGQEFTFTTDTSVVGNKDIVAVTYPGFAADLSAGNTILVDDGLIEMEVIATTATEVKCKVLNNGALGENKGVNLPGVSVNLPALSEKDKNDLKFGCEQGVDFVAASFIRKASDVKEIREVLAANGGANIQIISKIENQEGVDNFDEILELSDGIMVARGDLGVEIPAEEVIFAQKMMIEKCNRARKVVITATQMLDSMIKNPRPTRAEAGDVANAIMDGTDAVMLSGETAKGKYPVEAVTIMAQIANRTDSVLKAELGSRLDSPRLRITEAVCKGAVDTAEKLAAPLIIVATEGGKSARSVRKYFPTANILALTTNKKTAAQLVLTKGVTPVVVDSIDNTDAFYVAGKELALESGLGSKGDIVVMVSGALVASGTTNTASVHVL

SEQ ID NO: 58021 - protein, 448 aa, Pseudomonas putida
MNQAQNSVGKSLDVQSFINQQPLSRYQWRVVLLCFLIVFLDGLDTAAMGFIAPALSQEWGIDRASLGPVMSAALIGMVFGALGSGPLADRFGRKGVLVGAVLVFGGFSLASAYATNVDQLLVLRFLTGLGLGAGMPNATTLLSEYTPERLKSLLVTSMFCGFNLGMAGGGFISAKMIPAYGWHSLLVIGGVLPLLLALVLMVWLPESARFLVVRNRGTDKIRKTLSPIAPQVVAEAGSFSVPEQKAVAARSVFAVIFSGTYGLGTMLLWLTYFMGLVIVYLLTSWLPTLMRDSGASMEQAAFIGALFQFGGVLSAVGVGWAMDRYNPHKVIGIFYLLAGVFAYAVGQSLGNITVLATLVLIAGMCVNGAQSAMPSLAARFYPTQGRATGVSWMLGIGRFGAILGAWSGATLLGLGWNFEQVLTALLVPAALATVGVIVKGLVSHADAT

SEQ ID NO: 58022 - protein, 385 aa, Cytophaga hutchinsonii ATCC 33406
MKAAVFHKPGHISVDTVEDPKIEKSDDIILKVTSTAICGSDLHIYDGFFPQARPLIMGHEFMGIVEEVGNAVTHLKAGDRIVVPFPIACGHCYFCNHDMQPNCEHSNPEHYGPEGDVLSGKGGGLFGYTDLYGGYAGGQAQYVRVPYADYSPRLVPESLSDEQVLFLTDIFPTGWSAIDWAQLKGGETVAIFGSGPVGLMAQKAAWLKGAGRVIAIDPLNYRLAKAKMVNNVETLNPHEVDVIEAIRAMTNGRGADVCVDAVGVEAERTFFDKVKAVVRFEKGTDKVLENCFKAVRRGGTVTVVGVYGTPYDNFPLHTMFDKGLTVRLGQAPVQKYIDHLFTLVQNEKVVLNDIVTHVLPLSHASHAYDIFKNKQEDCVKVILKP

SEQ ID NO: 58023 - protein, 358 aa, Clostridium thermocellum ATCC 27405
MIIYSYKYYKYSFYDNSFGIMKGEEFMSFLEQIIERAKSDVKTIVLPESTDLRVIKAASMIMKKGIAKVVLIGNEKEIKSLAGDIDLEGVMIEDSLNSEKLEDYANTLYELRKSKGMTIEAARETIKDPLYYGVMMVKKGEADGMVAGAVNSTANTLRPALQILKTAPGTKLVSSFFVMVVPNCEYGHNGTFVYADCGLVENPDADQLSEIAISASKSFEMLVGAKPQVAMLSYSSYGSAKSELTEKVIKATQLAKEKAPHLAIDGELQVDAAIVPEVAKSKAKGSSVAGKANVLIFPDLDAGNIAYKLTQRLAKAEAYGPITQGLARPVNDLSRGCSAEDIVGVAAITAVQAQYVKA

SEQ ID NO: 58024 - protein, 158 aa, Bacillus pumilus SAFR-032
MLRIGQGFDVHQLTEGRPLIIGGVTIPYEKGLLGHSDADVLLHTVADACLGAIAEGDIGRHFPDTDPEFKDADSFQLLQHVWALVKEKGYTLVNIDCTIMAQKPKMAPYIQPMCEKIAEALEADVTQVNVKATTTEKLGFTGRGEGIASQATVLLQKK

SEQ ID NO: 58025 - protein, 322 aa, Solanum tuberosum
MYQSKLAGTATSYDRHLFLCYKSHETCPARLEASDSDLLPKSFSAALKARKDDIKIKTLLTICEVRDDMEVSEGDILIFPEMIKYRDLKESDVDAFVDDVLVNGNPWSSGLQESLSGSYVFVCAHNLRDRRCGVCGPILIEEFSKLIESKGLKDKVRVAACSHIGGHKYAGNVIIFSSGKDGDIVGHWYGYVTPSDVPALLDEHIGEGKVIERLWRGQMGQYEKVTDKVDEQKVPEVTNEEKKPLENGSQESSVTSFSCCQGAAGVSCCRDASAEQEENKKGQGTVSNWFGKWEQREILARVGVVGAVAVVAVAYGFYKKSR

SEQ ID NO: 58026 - protein, 365 aa, Cytophaga hutchinsonii ATCC 33406
MFSILSCSEHAEKKTTTEVIQKETKDSIVKENKKKDLKPAGEAPEWGKSMTPEMLVVIEKLKSLGGKPIETLDAKEARQQPTPADAVLAVMKDYDMTMPPALCDTVNKQIPVTGGTTTIRIYTPKQGTAPYPVIVYYHGGGFVIADLDAYGASAQSLCEQSGAVVVSVEYPKGPEHKFPAAHNVCFDAYKWIIKNAASLNADASKIALVGESAGGNIAINVSILARDKKIQMPLYEVLIYPVVNNDLNAESYVTYAAAKPLNKPMMEWFVKNYLNTPKQSEDPRISVVRANLNGLPPTLIIGAEIDPLQSEGELLNKKLKDAKVDSQYELYKGVTHEFFGMAAVIPQAKDAQALAVKKIKAAFDK

SEQ ID NO: 58027 - protein, 217 aa, Bacillus pumilus SAFR-032
MFFKMLKEDIDTVFDQDPAARSYIEVVLTYSGLHAIWAHRIAHAFYKRKLYFLARIISQVSRFFTGVEIHPAATIGRRFFIDHGMGVVIGETCEIGDNVTVFQGVTLGGTGKEKGKRHPTILDDALIATGAKVLGSITVGKGAKIGAGSVVLKDVPDHSTVVGIPGRVVVQNGKKINRDLNHQDLPDPISDRFKELEREMEKLKGELASLSRKEEQS

SEQ ID NO: 58028 - protein, 304 aa, Nonomuraea longicatena
MTGGAGFIGSHFARGLGGAEVTVLDKLTYAGNRANLDGVPHAFVHGDICDAGLLREVLPGHDLVVNFAAESHVDRSIEGAAEFVRTNVLGTQTLLQGCLEAGVRKVVQVSTDEVYGSIGVGSWTESAPLRPRSPYAAAKAGGDLVAQAYAITHGLDVSITRCGNNYGPRQYPEKIIPLFVTRLLRGERVPLYGDGGNVRDWVHVADHCAGIRLVAEVGLPGEVYHIAGTAEMTNKELVGHLLAASDADWGRVEYVEDRKGHDRRYSLDDRRLRALGYRPEVEFDQGLRDTVRWYAANPGWWAGS

SEQ ID NO: 58029 - protein, 515 aa, Oryza sativa
  misc_feature (212)..(212): Xaa can be any naturally occurring amino acid
MAMVQYVTGYLCLSLALLLLTLVLHKVARKATGNGAGKPRLPPGPWRLPVIGNLHQVAMGGPLVHRTMADLARRHDAPLMSLRLGELRVVVASSADAAREITKTHDVAFATRPWSSTIRVMMSDGVGLVFAPYGALWRQLRKIAVVELLSARRVQSFRRIREDEVGRLVAAVAAAQPGEPVNVSERIAALISDSAVRTIIGGRFERRDEFLXEGLAEAVRIASGFSLGDLFPSSRLASFVGGTTRRAEANHRKNFGLIECALRQHEERRAAGAVDDDEDLVDVLLRVQKDGSLQVPLTMGNIKAVVLELFGAGSETSASTLHWAMTELIMNPRVMLKAQDELSNVIKGKQTISEDDLVELRYLKLVIKETLRLHPVVPLLLPRECRETCEVMGYDIPIGTTMLVNVWAIGRDPKYWEDAETFRPERFEDGHIDFKGTDFEFIPFGAGRRMCPGMAFAEAIMELVLASLLYHFDWELPDGISPTKVDMMEELGATIRKKNDLYLVPTVRVPMSTAL

SEQ ID NO: 58030 - protein, 409 aa, Staphylococcus aureus subsp. aureus Mu50
MSLRDEALEMHKRNQGKLEVKPNVKVTNKEELSLAYSPGVAEPCKDIYEDKRKVYDYTIKGNTVAVITDGTAVLGLGNIGPEASIPVMEGKAVLFKSFAGINGVPIALNTTDTEEIIKTVKLLEPNYGGINLEDISAPRCFEIEERLKKETNIPVFHDDQHGTAIVTMAGLVNALRVVNKDIAKIKVVLNGAGAAGIAIVKLLYAYGVRNMVMCDSRGAIFEGRSYGMNPTKDVVAKWTNKDKIEGSLEEVVKDADVFIGVSVANALSQDMVKSMADNPIIFAMANPNPEIIPDDAKAAGARVVGTGRSDYPNQINNVLAFPGIFRGALEVEATHINEEMKKAAVEAIADLIDSSELNEDYCIPGPFDKRVAPSVARNVAKAAMESGVARIEVDPQDVYDKTMKLTDLQ

SEQ ID NO: 58031 - protein, 791 aa, Triticum aestivum
  misc_feature (103)..(103): Xaa can be any naturally occurring amino acid
  misc_feature (173)..(173): Xaa can be any naturally occurring amino acid
  misc_feature (378)..(378): Xaa can be any naturally occurring amino acid
MGGARSQVNKAHKTRFASKASRHSHKIDKVRSGKPAGSHRAALKGARAARLQHSKAIRDQKRAALLKEKRSSNGSSSAPRVIVLCGLSSSANIGPLAEDLLTXAAGGDEKLTSNTVASPAYKVRTTVLQAPYGDLTSCMELAKVADLLAFVVSANSLYNSNSGNPIDEFGSQXLSVLRAVGLPSTAVFIRDLPSDTKSKQELKKAAVSFLSPELPEDCRFYAAETKDDLHMFMRLFKEQHLSSPHWRNQRPYVMSEEACIKPGDSMGLCTLLVSGYLRAHNLSVNQLVHVSGAGDFQLGQIDILKDPCPVSGRKNSDVMDSDDNQIQIIDTFVPDPLNQEPLLVENIPDPLAGEQTWPTEAEMEEAYESNKQRPTSPXRVRRKLPRGTSEYQAAWIVDDTDDEGDDSENDNPDGAGMVIDEKDHSEHDSDSSDIDAVSHFMEKFDQETIGGSEMGDDENLTKEQIEEDIKRIKESNADDEEFPDEVETPLDVPARKRFAKYRGLKSFRTSSWDPKESLPPEYARIFAFDKFTRTQKHVLAKRAELDEESSKDCARIGSYVMLHVKNVPTDVASKLCHPSRRLPVVVSGLLEHESKISVLHFSIKKHDSYEAPIRSKEPLIFNVGFRQFTARPLFSSDNINCNKHKMERFLHHGRFSIASVYAPISFPPVPLIVWKNIDGQQPVIAAVGTLKSVDPDQIILKKIVLTGYPQRVSKLKAMVRYMFHHPEDVRWFKPVELWTKHGKRGRIKETVGTHGSMKCIFNSSVQQHDTVCMSLFKRAFPKWPEQFYHQI

SEQ ID NO: 58032 - protein, 594 aa, Picea sitchensis
MAELPLSPSDSPGKAAIETQAAGVGILLQIMMLVLAFVLGHVLRRHKFYYLHEASASLLIGLIVGGLANISNTEENIRKWFNFHEEFFFLLLLPPIIFQSGFSLQPKPFFSNFGAIITFAILGTFISSMVTGILVYLGGIFLLMFRLPFQESLMFGALISATDPVTILAIFQELGCDTNLYALVFGESVLNDAVAISLYRTMLSVRQHAATNPSLFTAVWRFIETFFGSMSTGAAVALSSALLFKYAGLGIDNLQNLECCLFVLFPYLSYMLAEGLGLSGIVAILFCGIVMKHYTFSNLSENSQTFTAGFFELISSLAETFVFIYMGLDIATEQQSWSHVGFIFFSILFIGVARAANVFPCAYLINFVRPASRKIPMKHQKALWYSGLRGAMAFALALQSIHELPDGHGQTIFTATTAIVVLTVLLIGGSTATMLETLEVTGDSQGVLLGESSEEESDYRAPDETTSSSSGQNLKMKLKELRKSTATFTAIDKNFLTPFFTAHNGDVHGHRTSRGNEAHNSARQILKTSNDRGSSTSSPLLQSTALNGQDHRVESNDGRSRWLSPGNHLHNDKYRNMYAQSKEHERPGQAAGIS

SEQ ID NO: 58033 - protein, 145 aa, Zea mays
AAAETLSLVARILNRSRAHLNSVLSKNNSSVVEEFFRTLVDSVPDLTEHIHRTSARMLLHIDGYPDKIANAKWEVKELGIEHNGYVDLLLGEFKHYKTRLDHGGISRELQHLLLEYGVESISEVLVEGLSRVKRCTDEGRALMSL

SEQ ID NO: 58034 - protein, 596 aa, Methanosarcina mazei Go1
MSLAARALSYYFRLPFIIFLLIEGIIAGPEVLNLLDPSLYIEGLSAIVAISISVIVFDGGLHIDLKHIRMVQESVLKLTTIGVLVTFLGTTALTSILIDIPLEIAALFGALVTATGPTVITPIVRNIQISHRLGKILELEGVLNDAASVILAAMVFEWVAAELSGTDAVIFIFYRLGIGIALGSLSGFALRWFFTRKIAFSKQTVRLVSLTAVFACFVLSECLGNESGILAVAIFGIILGTSEFPYKETIKEFKGDIVTVMLSLIFILLAAMLEFEDIQRIGVSGIVLVLLLVFVIRPMAVFISMWNSQVRTNEKLFLSFIGPRGVVPTSVATYFAIKLDSMGILGGQSLVGLVFLTVIITVFLSGSLSKKVAEMLEVIPMEILIIGGGKVGRILAERFDRRGENVIVVDISESNCKKCMELGIRIIQGDAGDVNVMKKAGIENAKYVVATTNKDDTNLLFCQIAKTCFGFRGDQLVARVNEIENLQAFWNLGIRAISPSMTTAVMLENMIGRPHLFSMCEVGGEGEMMEVKVTNPRVVGRAIKDIQFPEKSLLVMVQRGSDSIIAHGSLVLEYEDIVTIIGEGDAAKQTASILYK

SEQ ID NO: 58035 - protein, 613 aa, Triticum aestivum
  misc_feature (92)..(92): Xaa can be any naturally occurring amino acid
  misc_feature (348)..(348): Xaa can be any naturally occurring amino acid
  misc_feature (435)..(435): Xaa can be any naturally occurring amino acid
  misc_feature (445)..(445): Xaa can be any naturally occurring amino acid
  misc_feature (462)..(462): Xaa can be any naturally occurring amino acid
  misc_feature (478)..(478): Xaa can be any naturally occurring amino acid
  misc_feature (530)..(530): Xaa can be any naturally occurring amino acid
HPLPLPSPSPKPPAELETTDSAGVAEGGNERASLQIPRVTGQTVQKFPEHNDFCSNGTKRSTSSHHRKALRRPSLPKSSAETGNFRLTIPTXSAPTSGFSSPVGSPPRLSNADVSSTVASSHAPQAWSAPSIHTIDFLGALSPRTLPEKLTGASEPSPYSSTFRSPILMPRNTSAPPSPLPKLFPENQISRTEVNGSASLHPLPLPPSAISPMQTSFSNQPAPKVEMPSVSCQWQKGKLLGSGTFGCVYEATNRNTGALCAMKEVNIIPDDAKSAESLNQLEQEIKFLSQFKHENIVQYYGSDTIEDRFYIYLEYVHPGSINKYVQQHYGAITESVIRNFTRHILRGXLAFLHGQKIMHRDIKGANLLVDINGVVKLADFGMAKHLSSAAPNLSLKGTPYWMAPEMVQATLAKDVGYDLAVDIWSLGCTIIEMFXGKPPWSDLEXGPAAMFKVLHKDPPIPXNLPLEGKDFLQCCFKXRNPAERPTASELLGHPFSRNSSHYSKHGSIHAFAGIKVHDNGRACGDKPSSXKSEPYVKGRNTIGEPNNSRPFESSAFRLTPLTIQEVAPNFTPQPFGLASNPGSFAISTNPMHFPMANPQPSPLPRPNGKEVLF

SEQ ID NO: 58036 - protein, 292 aa, Physcomitrella patens subsp. patens
KGLTVFVWDMDETLIIFQTLLDGRYVGLFDGYKDCQKATHLGRRWEQLILEVCDEYFFYQQVEEHDYPNLNSLQEYDDGIDLDDYKFGEISLTSPLGAENLRKLRYLHRYIIQRYEQGLETLLSPEQAKKWNGIYEETDKYTDSWLSSGNPNVRSITLRDRSSKSATELVVVPSYSYNYLVTSGTLIRSLVKCLLFKLNPYFRSNSEPTPLALVGKLQCFRWIRERKQDSDGSAWFCVIGDGPDEKEAARVLAWPFVKVSIDPSVYEQQLPRLSFKTIQKDIKAVYRDSDSA

SEQ ID NO: 58037 - protein, 469 aa, Kineococcus radiotolerans SRS30216
MQLAPQEQSGLGTGLKPRHITMISIAGVIGAGLFVGSKTAIAEAGPGVLLSYAFAGLLVVLVMRMLGEMATAHPDTGSFSTYADRALGRWAGFSVGWLYWWFWVLVIPVEATAAADILSSWIGAPQWVWALLVTLALTASNLTSVGNYGEFEFWFAGVKVVAIVGFIAVGLLAIFGVLPGSDISGTPGFSLTGDAGGFLPNGFSAVLAGILLTMFSFMGTEIVTIAAAESPDPQKGVRRAVNSVIGRIGVFYLGSIFVVVALVPWNSAALDADGSFQTTLQAIGIPGAATIMDVVILTAVASCLNSALYTASRMVFSLSRRGDAPVWLSHVSRRGVPYPAILASTVVGFLAVVGNYLLPEKIFEYLLATSGALALVIYAFIALSQVVVRRRLDEAGERPAVRMWLFPWLTYATIAFIAVVLVLMVVLPGQRVQLALSLVLTVVVVALGLRHQRRRGPAARPADEAAAHR

SEQ ID NO: 58038 - protein, 72 aa, Glycine max
  misc_feature (26)..(26): Xaa can be any naturally occurring amino acid
SLTEKTTSGRLADRKVEKFANHMTKXGFEPYTPTTKGIDYPVGPQLLGLFGPADIGSIVLHMIEYSTSGSMA

SEQ ID NO: 58039 - protein, 637 aa, Solibacter usitatus Ellin6076
MLPTSRTAEESRSLADVHSSVGTSQVSFWKRMFAFAGPAYLVSVGYMDPGNWATDLEGGARFGYKLLWVLVMSNLMAVLLQTLSARLGIVRGRDLAQACRETYPRAVNLALWALCEIAVAACDLAEVIGAAIGLNLLFHIPLLMGVLITSADTLLLLWFQSFGIRTIEAVVLALITVIAACFCIEIFWARPAVSELFTGLVPRLNGSSLYVAIGILGATVMPHNLYLHSALVQTRNIGQSEAAKRTACKYNFIDSVVALNGALLVNAGILVMAAAVFFRRGIVVTEIQQAHLLLAPLLGTGLAGVLFAIALLASGQSSTLTGTLAGQIVMEGFLNFRMRAWLRRLITRTIAVAPAAFTIWYAGEKSTYQLLILSQVILSMQLPFAVIPLIHFTSDRQRMGNFANALWVRILAWLTAAVIIALNIRLAAAAIADWLDAAGRWKPLVIAGLVPVLGGFLLLLLWVSFEPLLSGRTGKYGRSPVSLPEPAGAEVPAPIYQRILVPLDHTDLDRLAISHAVAMGKLYGARVYLLHVEEGVTSQIYGGDASSAEEEAGQRYLERVAQSLRDQGVTVETAIRHSSSPTKEILSYAREVGPDLVIMGAHGHGGLKDLIFGTTISPVRHHLQVPMLIVRPGKPKN

SEQ ID NO: 58040 - protein, 678 aa, Oryza sativa Indica Group
MARGGNSNNGEQGHPCPIFYENPSSNGVIFSRESNGKYSIFQSFFMVAVMASSALICDTEQWKGLQAHYDFVFRHACGGEQAHVGAIQKTHLRNLMDDAERCKAMTAEYEGIFLDYSRQRATGETMEKLFKLAEAAKLKEKIEKMFSGDKINSTENRSVLHVALRAPRDEVIKSDGVNVVPEVWGVKDKIKQFSETFRSGSWVGATGKALTNVVSVGIGGSFLGPLFVHAALQTDPEAAESAKGRQLRFLANVDPVDVARSIKDLDPETTLVVVVSKTFTTAETMLNARTLKEWIVSSLGPDAVAKHMIAVSTNLELVEKFGIDPKNAFAFWDWVGGRYSVCSAVGVLPLSLQYGFPIVQKFLEGAASIDKHFRSSSFEKNIPAILPYSQALEKFAPHIQQLSMESNGKGVSIDGVQLSFETGEIDFGEPGTNGQHSFYQLIHQGRVIPCDFIGVVKSQQPVYLKGEIVSNHDELMSNFFAQPDALAYGKTPEQLHSENVPEHLISHKTFQGNRPSLSLLLPSLSAYEIGQLLSIYEHRIAVQGFLWGINSFDQWGVELGKSLASQVRKSLHASRMEGKPVQGFNSSTASLLTRYLALLSIYEHRIAVQGFLWGINSFDQWGVELGKSLASQVRKSLHASRMEGKPVQGFNSSTASLLTRYLAVEPSTPYNTTTMPKV

SEQ ID NO: 58041 - protein, 437 aa, Bradyrhizobium japonicum USDA 110
MRKAYARLRGDGARTAGHRRTQCRRNGLTRQRSLLTPGPLSLSLAVKSQMQLDLASRDDEFKEVTACMRRLMLNLLGNAKDYSVVPIQGGGSFAMEAALSSFVSRADRPLVCVNGIYGERVLQILRLWGVEALKLVKRATDPLDPQEIGEYLSRNPGVTHLCFVHCETTTGIVNPLQEIVEEARRCGVKTIVDGMSSFGALNIDLSQRGPDVLVTSSNKCIEGPPGVAFVIASRELLENAAQEPRSFVLDVRDQWRSLERTGEWRSTPPTHIVQATTMALKILHEESIDARRFRYEKVRDDLIKELEGTVSPLLSPELQSPVCVAFSAPPGIVDQEGFDGLYRHLAAHNLYVYSKLHLATRSFRVGCIGEIQSSWIERLGCAFRSYFRSGQARSARPAPDQEAYAARVKMPAQAVGDRQLPFSAETAVLQRVIGATR

SEQ ID NO: 58042 - protein, 538 aa, Alkaliphilus metalliredigens QYMF
MVHMFQRNKKSMLVHWVKLSGLFGKNKTIIKDEVLSGLTVALALIPESVAFAFVAGVSPILSLQTAVMMGLVAAIFTGRPGMISSSTAAISVVFASLIALHGLEYLFATVILMGIIQIAIGVLRLGKYARIIPYPVMLGFLNGLSIVMFLAQWAQFKVDEVVMVNGVEMVKKVWMPSTDLIIMLLFVVFTMAIIYFVPKFTKAVPSSLVAIIVMTIIAVVLDKSGYHLRTVQDFAGMELKGGLPKFYIPQVQISIDMLRVIFPYALVGALVGLTEAVLTLRVIDEMTDTRGKTNKECVAQGIANTVNGFFGGMGGDAMIGQSIINIKSGGRTRLSAIVAPMALLAFIMFGSALINAIPLAGLVGVMFMVVVGTFEWQSLKYGKKIPKQDVAIILVVTIVTIFVDLATAVIIGVVLSALMFAWEKGKVIYVNVENDENGSKTYKINGSIFFGSVLNFKDLFDIKNDPDDIIIDFKYAKVMDHSAIEAINSIAEKYNSLGKKLTLVRLSEDCQVLFKNAETITCVNIETSINLQSQHHYV

SEQ ID NO: 58043 - protein, 478 aa, Colwellia psychrerythraea 34H
MTSSEPDNSIQKLHDTEEVQTSFLYVLFISSVAAIGGFLFGFDSGVINGTVTALGNAFNASDVASGFNVASVLLGCAVGALMAGPISDRFGRKPIMIITAIIFAISAFGSGISSSSAEFIFYRLIGGLGIGAASVLAPAYIAEVAPAALRGRLATLQQLAIVLGLFAAFLSNFLIASVSGGAEAMLMLDIAAWRWMFWVELLPAVLFLVGVIFIPESPRYLVAQGKIEEARTIFKRIATGVENEQIEEVKKSLHGDKKPSIRDLFIDGKKKIHPIIWIGIGLSVFQQFVGINVVFYYGAELWQAAGFDESQSLFINLIAGTTNIISTFIAIALVDKIGRKPLLLVGSVGMFISLGALTFIFGTGGLDEAGKLALSDTTGTVALIMANLFVVFFGLSWGPIVWVLLGEMFNNRIRGAALAIAASAQWLANFAITMTFPILLGSFGLAGAYGLYTVSALLSIFFVIKYIKETRGIRLEEM

SEQ ID NO: 58044 - protein, 71 aa, Chlamydia trachomatis
GAQETFFDFGGDPSSLTIVRVPGAFEIPCAIKKLLSTSGQFHAVVACGVLIQGETSHYEHIADSVAAGVSR

SEQ ID NO: 58045 - protein, 575 aa, Cryptococcus neoformans var. neoformans B-3501A
MKGGRFLLPALFKTLLLPPLIAALFIHHFPSLFPTFTALIYLISFPALYVFRSYASLVASSWKASALGAIDIPRVNGTWPLNIDILLNWAKSGTEEEVGRMMVLMGRQYGGTYNTRVLGEDQIISSDPKVIKHVLIDDFDNFVKGQKFKERAQDFLGDGIFNSDGDNWKFHRSFMRPFFQPKYISPLHFSTNVQNFFAKLPSYGKVFDMQAHIGQLALELAIMWLCGEDMSRDTNNVAWTEEWKKAKGEISWAMTEAQKIVGKRVKIGTIWPLFEVRHDPLERPMKVIRAFFRPIISRALNRKRQRCKLDNTEDVYMIDRLVEATDDIKLVEDQLINVLLASRDTLASLLTFSVYAIVLHPDIAVRLKDEVFTIANQECEVTKDTIRQLRYCRAFINEVLRLFPPVPLNIRRTLRPSLLPTPNHLAYMPANTSIILATILMQRDPAVWGEDAQVFNPDRWLEGGGLGKEKEGFMSWNLGPRMCLGQSFALAITHTFLVYFFRHIAHVGTLVGHNTTVQLALDAQPPETVLPKEWMTPEGGDGRARGGRDKVWIVADVVLAIKGGLWIRFGAEETE

SEQ ID NO: 58046 - protein, 331 aa, Oryza sativa Japonica Group
MEEKKPYVIAMLIQVIYAGMFVVTKAAFDEGMNTFVFIFYRQAAATLLLLPLALLLERKNARSMSLMLLIKLFFCAFIGNTFSLNLYNVSMKFTSATVASAASNSLPVITFFLALITRMECVKVRSSSGIAKLAGVALCFAGVMVLALYKGPALNPAAVLREFPNKMLVTAAQCVFSTVQTAVVAAAAEREMARWKLRLDISLLAVLYTGLVVTGVSYYLQAWCVELKGPVFLAMSNRDRPPRQLIEFMDSIIGGILLVGGLYSVLWGKSAEMTMNGNGDDQQQQQQQQQSHHKISTEMVVVEKTMISGSQEKDQNNNEQSTPTKSPLQQV

SEQ ID NO: 58047 - protein, 492 aa, Triticum aestivum
  misc_feature (149)..(149): Xaa can be any naturally occurring amino acid
  misc_feature (182)..(182): Xaa can be any naturally occurring amino acid
  misc_feature (191)..(191): Xaa can be any naturally occurring amino acid
MDLTSLTTMWWAIALLSITVLATKITRARIKNIDPPRTTGQLPPMVNGLALLGILPTLLKKGLPPMVNYLYVNYGSVFTVSCFGVIKVTLLIGPEATTHFFQGLESEISHGNLLEFTVPMSGKAVGYGRDTATRMEQMRFHSEATEGIXRLRSHVSPMLQEVEDFFAKWGEEGVVDLKLEFXQLLMLISGXCLLGKEVRENMFDEVYTLFREIEKGVTLISFLFPYLPTPANWQRDRARIRLTEILSNVVESRKSSGRVEEDTLQKLIDSKYKDGRPTTVEEVAGLIIGLLFAGKHTSSHTSTWTGACLLSHPAFLRAAIEEQHQVAKKYKDGPEYNAFLEMDTLHNCIKEALRKNPATPLLVRRVHKRFTVQTKEGQQYDIPQDYIVATPTIVNNYIPYIYTDPQVYDPNRFGPERREDKVGGKFSYTSFGGGRHVCTGEAYAYMQLKVIWSHLLRNFDLELVSPFPNTDWSKFLPDPQGKLLVRYTRNGI

SEQ ID NO: 58048 - protein, 334 aa, Geobacillus stearothermophilus
AVKVGINGFGRIGRNVFRAALKNPDIEVVAVNDLTDANTLAHLLKYDSVHGRLDAEVSVNGNNLVVNGKEIIVKAERDPENLAWGEIGVDIVVESTGRFTKREDAAKHLEAGAKKVIISAPAKNEDITIVMGVNQDKYDPKAHHVISNASATTNCLAPFAKVLHEQFGIVRGMMTTVHSYTNDQRILDLPHKDLRRARAAAESIIPTTTGAAKAVALVLPELKGKLNGMAMRVPTPNVSVVDLVAELEKEVTVEEVNAALKAAAEGELKGILAYSEEPLVSRDYNGSTVSSTIDALSTMVIDGKMVKVVSWYDNETGYSHRVVDLAAYIASKGL

SEQ ID NO: 58049 - protein, 388 aa, Arabidopsis thaliana
MTTISDLPYDLVKEIFSWVPFTSLRAVRSTCKTWNALSKNQIFGKKSVARNQFLELMILDSRVCSLRFDLQKIRNEDEEDLVDPSMKQISIPNNDDQVEISRVYHCDGLLLCIPKDNSSLMLWNPYLGQTKRIRPKNTFHRDDSFALGYNNRNHKILRLNEENESHIDVYDFSSDSWRTVPDDNPYRDELIYQSGVSLKGNAYFFDREVTTEAEVGTEDLLITGIEDYLRCFDFTTERFGPRLPLPFILPSPSFEYLALSWARDDKLAVLYSHYDTFDIIEIWISTKIEPNAVSWSTFLKVDMSLINGLTDDFLIRFEPKSFFIDEEKKVAVLFDTKVTETCRYQMAYIVGDDGYFKSVNIGVISNSHWIGGELVRSSYVPSLLQLQV

SEQ ID NO: 58050 - protein, 174 aa, Burkholderia pseudomallei K96243
MTIYKLGENAPSIHESVFVADSATIVGKVVLEENASVWFGATIRGDNEPITVGAGSNVQEGAVLHTDPGCPLTIAPNVTVGHQAMLHGCTIGEGSLIGIQAVILNRAVIGRNCLVGAGAVITEGKAFPDNSLILGAPAKVVRTLSDEDIARMHMNTKSYAMRRAYFKEQLVRIG

SEQ ID NO: 58051 - protein, 434 aa, Saccharomyces cerevisiae YJM789
MREEGSELEMEKGFLKWKPVNLMKKILSLPMKKTKNDIGLRLDISYILVNLIVCSYPVNTYPKLLYRNSLDDLILFLTVYHGKGNFRIFNFRGEKEDSDYKDNDLIGIAAKYESKDFEIQELRSTLINDGKIPISPIDLETRTLVEEETNNVICERIGWLDHFPPPFELLEEIVDGIENYLSVSKNRVAVLHCRMGKGRSGMITVAYLMKYLQCPLGEARLIFMQARFKYGMTNGVTIPSQLRYLRYHEFFITHEKAAQEGISNEAVKFKFKFRLAKMTFLRPSSLITSESAIVTTKIQHYNDDRNALLTRKVVYSDIMAHECGGNMTFIFGRDYLTLENDCRIEFTLGTSKSKAASSIISWTSCASCWLNIYLETLMHIIKDDSSPDYFQVERLKRDEMLGTTISWQELDGFGELSTHGLKLFQALKLEWEII

SEQ ID NO: 58052 - protein, 379 aa, Polaromonas sp. JS666
MLLPHQYGHEQPYKKIATMKIAILPGDGIGTEIVAEAVKVLNVLDLKFETETALVGGAAYEAHGHPLPEATLKLAKDADAVLFGAVGDWKYDKLDRPLRPEQAILGLRKNLGLFANFRPAICYPQLVEASSLKRELVAGLDILIIRELTGDIYFGQPRGRRVATDGHFPGAEEAFDTMRYSRPEIERIAHVAFQAARKRKASGGEGRVTSVDKANVLETFQFWKDVVTEIGLQYPDVALDHMYVDNAAMQLVRAPKKFDVVVTGNMFGDILSDAAAMLTGSIGMLPSASLNDKNQGLYEPSHGSAPDIAGKGVANPLATILSAAMMLRFSLNQPETAARIEKAVDAVLSQGLRTPDIYSEGTTKVGTVQMGDAVVKALR

SEQ ID NO: 58053 - protein, 78 aa, marine gamma proteobacterium HTCC2143
MSSIEERVKKIVAEQLGVKEDEVQTSASFVEDLGADSLDTVELVMALEEEFETEIPDEEAEQITTVQLAIDYINKNLG

SEQ ID NO: 58054 - protein, 222 aa, Hyphomonas neptunium ATCC 15444
MKPVLISPSILSADFAKLGEEIRAIDAAGADMIHVDVMDGHFVPNLTFGPPVIEKLRPHTKKLFDVHLMIAPVDPFIQDFAKAGADILTVHPEAGAHLHRTIQAIRAAGMRPGVALNPGTPASVIEPVIGDIDLVLVMSVNPGFGGQSFIESQLRKVEQLRRMIDASGRDIILEIDGGLNAETAPRAIAAGVTAIVAGSAVFKGGPDAYAANIRALRPQVNA

SEQ ID NO: 58055 - protein, 194 aa, Zea mays
MAIKKVFARSVYDSRGNPTVEVDVVTETGLHRAIVPSGASTGQHEACELRDGDKSKWNGKGVTKAVENVNTVIAPALIEKNLDVKDQSAVDAFLKSCNALLLKVNQIGTLTESIQAAKDSYADGWGVMVSHRSGETEDVTIADIAVGLRAGEIKTGAPARSERLAKLNQILRIEEELGDQAIYPGKDFRKSVNL

SEQ ID NO: 58056 - protein, 323 aa, Pelargonium x hortorum
MENFPVIDMEMLNGEERSAAMNMIKDACENWGFFEIKNHGISHELMDKVERLTKEHYAKFMEQRFKEMVASKGLDATQSEIDDLDWESTFFLRHLPTSNISEIPDLEHDYRLAMKEFAERLEKLAEELLDLLCENLGLEKGYLKKAFYGSKGPTFGTKVSNYPPCPKPELIKGLRAHTDAGGLILLFQDDKVSGLQLLKDGRWIDVPPMRHSIVINLGDQLEVITNGKYKSVMHRVIAQTDGNRMSLASFYNPGSDAVIYPAPALIEEENQNPIYPKFVFEDYMKLYAGLKFQAKEPRFEAMKAMPLPMAMDTTPLQGPVATA

SEQ ID NO: 58057 - protein, 342 aa, Zea mays
MPLGDDAAADFALPDELLAALPRDPYEQLDLARRITALAVAGRVSGLEREAGRLRAEAAGKDRESAELRERVALLDAALQETNARLRAALEDNIKLSKERDSLAQTSKKLARDLHKLESFKRHLMQSLRDDSSSTQETVDITTCDQPVASKASSSADGGSVSNPATNIFTESLDVGSTNRDGAAARPPIQKYSLTTHITPRLTPEATPKVMSTSASPRRMSTTGTPKLMSGSTSPSKTRIESHMSMTPWYPSSKQSSAANSPPRGRSNPGRTPRIDGKEFFRQARSRLSYEQFGAFLANIKELNAHKQSREETLKKAEEIFGPDNKDLYLSFQGLLNRSMVA

SEQ ID NO: 58058 - protein, 382 aa, Zea mays
MRQPTSAGGDAGFLRADQIDLKSLDEQLERHLGHPAERVVGPVSGTGSRRGETAKLGPEELTPLQRCREDWEIDPTKLIIKGVIARGTFGTVHRGVYDGQDVAVKLLDWGEDGHRSEQEIGALRAAFAQEVAVWHKLEHPNVTKFIGAIMGARDLNIQTEHGQLGMPSNICCVVVEYLAGGALKNFLIKNRRRKLAFKVVVQIALDLARGLCYLHSKKIVHRDVKTENMLLDKTRTVKIADFGVARVEASNPSDMTGETGTLGYMAPEVLNGHAYNRKCDVYSFGICLWEIYCCDMPYPDLSFSEVTSAVVRQNLRPEIPRCCPSSLANVMKRCWDANPDKRPEMAEVVSMLEAIDTSKGGGMIPKDQTQGCLSCFRQYRGP

SEQ ID NO: 58059 - protein, 267 aa, Pasteurella multocida subsp. multocida str. Pm70
MNPMLNIAIRAARKAGNVIAKGYERRDDLQTTLKSTNDYVTNIDKASEEAIIEVIRKSYPDHTIITEESGALEGKDSDIQWVIDPLDGTTNFVKGLPHFSVSIAIRVKGRTEVGVVYDPIRNELFTAVRGEGAKINDMRLRVENKRDLAGTVLTTGFPFKQTRLMPMQFAMMNNLIQDCADFRRMGSAALDLCYVAAGRVDGYFEVGVKAWDIAAGDLIVREAGGLVCDFNGGHSYLTSGHLVAAAPRIVKEILNKIQPCLSDEFKK

SEQ ID NO: 58060 - protein, 231 aa, Alkaliphilus metalliredigens QYMF
MQNKSILVVEDDPTTQRLIRHTLEQHQFQVLSAEDGAMTLDLLSNHKDIDAIILDLFLPDCNGLELLKTVRSHSIHSDIPVVILTSNDDKLDLVIALEMGADDYITKPFHKRELIARINVCLRRAQNTIRSHNTSRSISGITLDITTREVKKDDGLISLTFAEFELLLLFVTHPGKVFSRDDLLTKLWGESFVSETRVIDMHISSLRKKLDDSDNQLIETIRGVGYRLRKT

SEQ ID NO: 58061 - protein, 307 aa, Burkholderia pseudomallei K96243
MSKSARNWGLEQIVAELRESREKLHRTRHPRGIRELPSRDAVCTIVSGLRASMFPTHYGAPDLTDETVDYYVGHTLESTLRLLAEQIRRALRFLPEHAQTPLAVLEERAFEIAREFGTQLPRIRALLVSDIQAAYTGDPAAQHITEILLCYPGVLAMMHHRLAHALYRLGVPLLARFINEIAHSATGIDIHPGAQIGPSFFIDHGTGVVIGETAIIGERVRVYQAVTLGAKSFPADGDGMLVKGNARHPIVEDDVVIYAGATILGRVTIGKGSVIGGNVWLTHSVPPGSSVAQGKIRESDKDQAEKD

SEQ ID NO: 58062 - protein, 445 aa, Bradyrhizobium japonicum USDA 110
MPTDPRFTGANPARAAMVGVSDFDGVLRGKHVLGEDLSDGDKVIKFSEAVLAWDCTDRVIPASFTQKPLSAFGDADLRILSGTGRSVSHLGSQYLYLAEFTGAHENICPRGVLRKVLRRAADHGYDCTAGFEFEFILFKENADTIEEKPFGEWAPLTRGPFGYSIARSIAQHELFGEILALCEKARIPLSGLHFETGPGVVEASLRHCDALEAADRATIFKSMIKAWAQTRGMMATFMAKVSEKWPGQSGHIHISMSSDSQNAFYDGDAFGNVSDLMRQFIAGQLEYMNEFCVLAAPNFNSYKRLVPGSWAPICPSWGVDNRSCAVRAIPGEPSAHRLEYRLPGADANPYLALACAIGSGILGVETGPALPASIVGDASVEMCRPSARLPQSLSEATSRFAESAAASDVFGERFVGAFSCSRHWEWQAVQHRVTDFERRRYFEII

SEQ ID NO: 58063 - protein, 128 aa, Pasteurella multocida subsp. multocida str. Pm70
MAYSNKVIDHYENPRNVGSLDKKDANVGTGMVGAPACGDVMQLQIKVSEEGIIEDAKFKTYGCGSAIASSSLITEWVKGKSLDEAQAIKNSQIAEELELPPVKVHCSILAEDAIKAAIADYKAKKEAK

SEQ ID NO: 58064 - protein, 344 aa, Thermus thermophilus HB27
MRAVVYKGPFQVAVEEVPEPRLEADTDALLEVELSAICGSDLHIYHGKIAGVLPGTVLGHEFVGRIVEKGPLVPFPVGERVVGSFQVACGECPACRKGQFFACSRGGVFGFGLALGNLPGAQAERVRVPFARHTLFPIGDLPAEEAILAGDILTTAYGGVRPFLTPGMSVAVVGSGPVGLMAQMVAHALGAGQVYAIDPEEARLEKAKALGSLPIHPKAEDPVARVRRETEGLGADLVVEAVGGDGEALKLALRLAGPGGVVSSLGVPTAERLDYPWLPAFSRGITLRSALANVPRWIGEVLALQKAGRLKGSFVFSHRLPLEEAPEGYRLFHERKATKVALVP

SEQ ID NO: 58065 - protein, 403 aa, Alkaliphilus metalliredigens QYMF
MNKFNTIEEAIEEIKAGKMIVVVDDEDRENEGDLLMAAEKATPETINFMARYGRGLICTPMTKSALQKLNIFPMVTDNTDPKETAFTVSVDSVECTTGISAGERACTILKLVDPGATARHFTKPGHIFPLVAKEGGVLKRAGHTEAAVDLARMAGLDPSGVICEIMNEDGTMARVPELMEYVKEHNLKIITIADLISYRSKHEKLVEKVTEAVLPTKYGDFKMVGYENKLNGEHHLALVKGDVSGGEPVLVRVHSECLTGDAFGSLRCDCGEQYAEAAKKIQDEGRGVLLYMRQEGRGIGLINKIKAYALQDEGMDTVEANLALGFPEDMRDYGIGAQILADLGIEKIRVMTNNPKKLSGITGYGIEIVERVSIEMNHNERNEFYLKTKKDKMGHLLNMEEEK

SEQ ID NO: 58066 - protein, 517 aa, Nicotiana tomentosiformis
MLSPIEAIVGLVTFTFLFYFLWTKKSQKPSKPLPPKIPGGWPVIGHLFHFNDDGDDRPLARKLGDLADKYGPVFTFRLGLPLVLVVSSYEAVKDCFSTNDAIFSNRPAFLYGDYLGYNNAMLFLANYGPYWRKNRKLVIQEVLSASRLEKFKHVRFARIQASIKNLYTRIDGNSSTINLTDWLEELNFGLIVKMIAGKNYESGKGDEQVERFKKAFKDFMILSMEFVLWDAFPIPLFKWVDFQGHVKAMKRTFKDIDSVFQNWLEEHINKREKMEVNAEGNEQDFIDVVLSKMSNEYLGEGYSRDTVIKATVFSLVLDAADTVALHINWGMALLINNQKALTKAQEEIDTKVGKDRWVEESDIKDLVYLQAIVKEVLRLYPPGPLLVPHENVEDCVVSGYHIPKGTRLFANVMKLQRDPKLWSDPDTFDPERFIATDIDFRGQYYKYIPFGSGRRSCPGMTYALQVEHLTMAHLIQGFNYRTPNDEPLDMKEGAGITIRKVNPVELIIAPRLAPELY

SEQ ID NO: 58067 - protein, 153 aa, Alkaliphilus metalliredigens QYMF
MRVYEGKLISKGQKFGIIVGRFNEFIGGKLLSGAIDALKRHGVDEENIEIAWVPGAFEMPLIAKKMAKSQKYDGVICLGAVIRGATPHFDYVSSEVTKGVASVSLETEVPVIFGVLTTDTIEQAIERAGTKAGNKGFEAAVTAIEMANLLKEF

SEQ ID NO: 58068 - protein, 458 aa, Oryza sativa Japonica Group
MATGQCMQALPMEVWNSWLLEKAVLPALDVAPPVKIGGPRRTSVLRNPNMEKLQKGYLFPEISIKREEHLKKYPDAKVISLGIGDTTEPIPSIVTSAMAEDVPFPFCRYALALSTPEGYQGYGPEQGHKNLRKEIADKVYPDMGIKESEVFISDGAQCDIARLQTLFGPNVTIAVQDPTFPGYVDNGVIMGQTGKADDGGRYAGIEYMRCAPENAFFPDLSRVRRTDVIFFCSPNNPTGHAASREQLRQLVELARRNGSIIVFDSAYSSYISSSSSSSTPRSIYEIPGAREVAIEVSSFSKFAGFTGVRLGWAVVPDELLYSDGVPVARDFDRVVCTCFNGASGIAQAGGVACLSTEEGRGAVARVVGVYRENARVLVETFRSLGKEVHGGGDAPYVWVRFPGRRSWDVFAEILEKTHVITVPGSGFGPGGEGFIRVSAFNSRDKVLEACQRLKSFLA

SEQ ID NO: 58069 - protein, 318 aa, Prochlorococcus marinus subsp. marinus str. CCMP1375
MNMNSLSVSRVLADLAGKDFISCSDFTSDQVKALLQLSSQLKNGDRRIDLGNRVLGLIFSKASTRTRVSFQVAMARLGGQTIDLSNQATQLARGEPLKDTARVLSRYCDALALRTFGNDELIEYAKWSSIPVINALTDLEHPCQALADFLTIKEAFGSLDGITLAYIGDGNNVLNSLMICGTLLGVNIQIASPKGFEPLPSIVERAKTLAHPTLKICVSNNPIDAVSGAHVIYTDVWASMGQESEQAQRKEIFEGYTVNKDLVDKAEKESIILHCLPAHRGEEITDDVLESSASRIFDQAENRLHVQQALLAALLGGL

SEQ ID NO: 58070 - protein, 427 aa, Burkholderia pseudomallei K96243
MSAIVDIIGREILDSRGNPTVECDVLLESGTMGRAAVPSGASTGSREAIELRDGEAGRYGGKGVLKAVEHINTEISEAIMGLDASEQAFLDKTLLELDGTDNKSRLGANAMLAVSMAVAKAAAEEAGLPLYRYFGGSGAMQLPVPMMNIVNGGAHANNSLDIQEFMIVPVSQPTFREALRCGAEVFHALKKILGDRGMSTAVGDEGGFAPNFGSNDECLSTILQAIEKAGYRAGEDVLLALDCAASEFYHDGKYQLAGEGLQLSSAEFTDYLATLADKFPIVSIEDGMHEGDWDGWKLLTERLGKKVQLVGDDLFVTNTRILKEGIEKGIANSILIKINQIGTLTETFAAIEMAKRARYTAVISHRSGETEDSTIADIAVGLNAGQIKTGSLSRSDRISKYNQLLRIEEDLGDIASYPGKSAFYNLR

SEQ ID NO: 58071 - protein, 566 aa, Gibberella zeae PH-1
MRFYNLLSAGLFGLAQANAHRHAMLHRRASCDGNTASTRSTWCDYSIDTDYSTEVVDTGVTKEYWLELTDVTVAPDGYSRSAMAVNGTIPGPTLFADWGDTVVVHVTNSLTTSLNGTSMHWHGIRQNYTNQYDGVSSITECPLAVGETVTYTWKATQYGSTWYHSHWALQAWQGIFGGIIINGPATADYDEDLGMVFLNDWDHQTVDELYYSAETNGPPTLDNGLINGTNVYGDDDDSSQTGSRFNVSFESGTSYRMRLVNAAVDTHWKFSIDNHTMTVIAADLVPIEPYETTVLDMGMGQRYDIIVTADQADVADNFWMRAIPQSACSDNDSTDNIKGIVYYGDSPDTPSTTAYDYTDGCDDETDNLVPYISKTVDDANWSDLETATVGKNTAGLFKWQLNSTSMLMDWANPTLAQIMNGTTEFETDDAVIELSEASQWVYFVIETSLAVPHPIHLHGHDFSILAQGTGTYSSSVTLNTSNPPRRDTAMLPGNGYLVMAWETDNPGVWLCHCHIGWHTSEGFALQFIERASEIPDITTSSYVSDVCDSWTTFQSENSIEQEDSGV

SEQ ID NO: 58072 - protein, 431 aa, Escherichia coli
MVSLEKNDHLMLARQLPLKSVALILAGGRGTRLKDLTNKRAKPTVHFGGKFRIIDFALSNCINSGIRRMGVITQYQSHTLVQHIQRGWSFFNEEMNEFVDLLPAQQRMKGENWYRGTADAVTQNLDIIRRYKAEYVVILAGDHIYKQDYSRMLIDHVEKGARCTVACMPVPIEEASAFGVMAVDENDKIIEFVEKPANPPSMPNDPSKSLASMGIYVFDADYLYELLEEDDRDENSSHDFGKDLIPKITEAGLAYAHPFPLSCVQSDPDAEPYWRDVGTLEAYWKANLDLASVVPELDMYDRNWPIRTYNESLPPAKFVQDRSGSHGMTLNSLVSGGCVISGSVVVQSVLFSRVRVNSFCNIDSAVLLPEVWVGRSCRLRRCVIDRACVIPEGMVIGENAEEDARRFYRSEEGIVLVTREMLRKLGHKQER

SEQ ID NO: 58073 - protein, 274 aa, Vibrio sp. Ex25
MKLAVMAFIVREKFLQNPPLAQQLMRTGNACLTEHSHKDAFWGDGGDGKGENHLGEILMNVRAELRHVEPYNLVKFIDKAKLPTQWGTFMMYGFVETATNKEHLALVYGEPANSAAPLIRLHSECLTGDALFSTRCDCGFQLNRALQNIVEEGCGVLLYLRQEGRGIGLINKIRAYHLQDDGADTVEANERLGFAADMRDYAFCKGMLEHLGIDAVRLMTNNPRKLAALKAVDINVIERVPLQEGNNPSNQHYLQTKASKLGHMFDPKFVNHTK

SEQ ID NO: 58074 - protein, 334 aa, Geobacillus stearothermophilus
AVKVGINGFGRIGRNVFRAALKNPDIEVVAVNDLTDANTLAHLLKYDSVHGRLDAEVSVNGNNLVVNGKEIIVKAERDPENLAWGEIGVDIVVESTGRFTKREDAAKHLEAGAKKVIISAPAKNEDITIVMGVNQDKYDPKAHHVISNASSTTNCLAPFAKVLHEQFGIVRGMMTTVHSYTNDQRILDLPHKDLRRARAAAESIIPTTTGAAKAVALVLPELKGKLNGMAMRVPTPNVSVVDLVAELEKEVTVEEVNAALKAAAEGELKGILAYSEEPLVSRDYNGSTVSSTIDALSTMVIDGKMVKVVSWYDNETGYSHRVVDLAAYIASKGL

SEQ ID NO: 58075 - protein, 232 aa, Triticum aestivum
MAPSQEVAITKDPSTNGNGNGNGNGTAAPAPKTKTPALNERILSSITRRSVAAHPWHDLEIGPDAPTIFNCVIEIPKGSKVKYELDKKTGLIKVDRVLYSSVVYPHNYGFIPRTLCDDSDPIDVLVIMQEPVVPGCFLRAKAIGLMPMIDQGEADDKIIAVCADDPEYRHFNDIKELPPHRLAEIRRFFEDYKKNENKEVAVNDFLPSEDAYEAIQHSMDLYATYICEGLRR

SEQ ID NO: 58076 - protein, 333 aa, Deinococcus radiodurans R1
MTAAPRPPHTLSVAPMMDWTDRHCRMFHRTLTRRTLLYTEMVTTGAILHGDQGRHLDFSAPEHPLALQLGGSDAAALAECARLAEDWGYDEVNLNCGCPSDRVSSGSFGACLMGTPDVVARAVEAMRAATRLPVTVKHRIGIDDLDSYEHLTGFVRTVAAAGCEQFIVHARKAWLSGLSPKENREIPPLRYEVVQQLKADFPQLTVVLNGGVKSLTEAQQALAWADGVMIGRAAYQEPYLLAAADRDVFGEDAQAVSRREAIEAYLPYVAAQVEAGQPLNRMMKHTLGLFAGQPGARHWKRTLSEQGHKPGAGLDVVRAALAGVPDDVLDARA

SEQ ID NO: 58077 - protein, 400 aa, Deinococcus radiodurans R1
MTLIESSREPGDKLAVLSCRCDKSVTVHRVHWAHQRNHNQAGRVKFAAPGGRFLGGWPFFFGLEQFSELRRRRNSTATRSILRPARWFALAPLAKKRCTLFVKCSRVQSPGPALFMVGVMNTQQGAQDLTGRRILITGATGGIGLETARELAGRGAQVVIVGRDPGRTARVAAEVGAAGTLLADLSELVQVERAAAEYRERFGELDVLVNNAGALHRERQESREGIELTWALNHLAPFLLTRELLPLLRRSSETRRVPARVVTVASAAHVVGRIRFDDPEFRRGYAAWPAYAQSKLANILFARELARREPSVLSVSLHPGMVASGFGKNGGGRFAQAYGLLDRFSLTPEQGAQTSLHAVSAPVHTGGYYANARRVTPAPQALDDGAAARLWALSEGYLQV

SEQ ID NO: 58078 - protein, 543 aa, Physcomitrella patens subsp. patens
MHVQHRAKDVDKLPEPKVPEPRRPPTQPGADPRKKPHVKVGSNVKDNKGTIPLGKRTNFGYERDFKSKYTLGKLLGHGQFGYTYVALEKATGEKVAVKTIEKKQMTLQISVDDVKREVKILRTLSGHENVVQFYASFEDDDLVYIVMELCEGGELLDRILAKKDSRYSEKDAAKIVRQMLNVAARCHLNGVVHRDMKPENFLFKSPKEDSPLKATDFGLSDYIQPGKRFQDVVGSAYYVAPEVLKRKSGPESDVWSIGVITYILLCGRRPFWDKTEQGIFNEVLKKKPDFREKPWPTISLSAKDFVKKLLVKDAAARLTAAQALSHPWAKEGGDALDIPLDISVLSNMREFVKYSRLKQLALRALASTLEDSDIADLRDQFNAIDIDRNGTITLEEMREALQKDRPWVIKESRVGEILQAMDSNRDGIVDFNEFVAATLHVHQLEETDSEKWQKRSRAAFSKFDFDGDGYITTEELKIATGLKGSMDSFLGEADIDGDGRISLPEFQKLLRQASLGSRNNSEHQAPVSHNPRRREAHHHHVAS

SEQ ID NO: 58079 - protein, 335 aa, Deinococcus radiodurans R1
MLYAPELQTAVRLAREAGALLLRHRAAGLTVEHKTSADDPVTAADREASALIVAGLHAAFPGDGLLSEEEVDSPGRLRHERVWIIDPIDGTKEFTTGSPDFCVSIGLAVRGEAVMGVVYAPATDELFSGVVGEGVQKNSEPVEPSTPTTFRLSVSDTEYQRELHRHDIPGMFPSGSIALKLARMAAGEADATFSMSPRAEWDICAGDALLRAAGGELRRRDGRPIVYNAPRPSLEQGIIGGTPAALAWLEDQLRAHHLPTAHLGLTPQDPAWAVLSDADRTELAGHPGVCVRYSGSDLLALLVIDPQTHTVQRAEGDAHHLDRLTRDVVRAGLVK

SEQ ID NO: 58080 - protein, 388 aa, Physcomitrella patens subsp. patens
MAAAMQNARSRLSALVASSRFLSFSSRAASSSSSSVPHHDFDPSRRSFSSESDHEKLITATLFPGDGIGPEIAVSVKEIFEAVKAPIQWEEHWVGTKVDPRTGSFLTWESMESVRRNGIGLKGPMTTPIGKGFKSLNLTLRKELGLYANVRPCLSIPGYKTRYDNVDLVTIRENTEGEYSGLEHQVVSGVVESIKIITKNASMRVAKYAFHYARLHGRKRVSVIHKANIMKKTDGLFLECCREIAAEYPDIVYEEVIIDNCCMMLVKNPALFDVLVMPNLYGDIISDLCAGLIGGLGLTPSGNIGDNGLALMEAVHGTAPDIAGKNLANPTALLLSSVMMLHHLKLHNYADQIHSAVLKTISEGKYLTSDLGGKSTTSDYTKALIDNL

SEQ ID NO: 58081 - protein, 614 aa, Cryptococcus neoformans var. neoformans B-3501A
MTTLSQSNLPLDPEAHQDAKKARDLEEAGAAPQDELYYEDTSSEEVLTGVSKVEAAAAVWGPKSQWFLFIGIALSAYIYSLDGVTTYQYLSYATSYVLDHSVSGTISTANAIIIAVGKPLMAKLADVVGRGETFIIVTILYVVGYIVIATANDVGQIAGGQVIYSFGYTGLQMLQQIIIADMTNLRWRGLVTGLVSAPFIINNFVSAEIAEGVLPNWRWGYGMFAILVPVSLSPIIIALMWAQHKAAKQLKIRYSRPPIKVGFWITIREACLEMDFMGLILIAASLALILLPLGLAPSASNGWKTPSMIVMLVIGGLLFPVFLYYESRFPRKPVLPMRWLKRGPILGACLIGFFDFVSFYLQYTYLYSYVYVTEDWSYRNLTYFSSTQSLALTIFGIMAGFIMYATRRFKWMLFIGLLIRLLGVGLMLKARSATGNTAELVMCQILQGMGGGAAATAIQVSAQAAVAHVDVATVTAVVLLITEVGNSVGSAVASGIWASYMPKELAKNVPTTNATLLAELYGSITDIALYPSDDPIRLGAIAAYQNVMFRLVLGAVIVAIFPPIWCLLFTKDVKLTRAQNAVDAKDLSGRPTDEPTLDERTPSEAGMSDPRRKD

SEQ ID NO: 58082 - protein, 704 aa, Neisseria meningitidis MC58
MAYQVLARKWRPKTFADLVGQEHVVKALQNALDEGRLHHAYLLTGTRGVGKTTIARILAKSLNCENAQHGEPCGVCESCTQIDAGRYVDLLEIDAASNTGIDNIREVLENAQYAPTAGKYKVYIIDEVHMLSKSAFNAMLKTLEEPPEHVKFILATTDPHKVPVTVLSRCLQFVLRNMTAQQVADHLAHVLDSEKIAYEPAALQLLGRAAAGSMRDALSLLDQAIALGSGKVAENDVRQMIGAVDKQYLYELLTGIINQDGAALTAKAQEMAACAVGFDNALGELAILLQHLALIQAVPNALAHDDPDSDILHRLAQTISGEQIQLYYQIAVHGKRDLSLAPDEYAGFMMTLLRMLAFAPLAAASCDANAVIENTELKSPSAQTAEKETAAKKPQPRPEAETAQTPVQTASAAAMPSEGKTAEPVTNQENNDIPPWEDAPDETAAGTAQASAKSIQTASEAGTPPKNQVSKNEAADNETDAPLSEVPSENPIQATPNNEALETEAFAHEAPAKPFNGYSFPNDDYLVEDGAEIPPPDWEHAAPADAEEENNADESSNNEDHTPYAPPPEFSTENWAAIVRHFARKLGAAQMPAQHSAWTEYHPDTGLMVLAMTAEARATADKKRLDKIRDTLAQAYGLQLTLQTQDWRDEAGRETPAMQDKRVQAEDRQKAQALLEADPAAQKILQAFGAQWQPESLELAANRP

SEQ ID NO: 58083 - protein, 392 aa, Prochlorococcus marinus str. AS9601
MSQVNLSDRALSIEPSLTLQISAKANQLSAEGVDICNLSAGEPDFDAPKEVIDATSKAIFDGFTKYGPAAGNLDLRKAIANKLQIQNDLNYEFENVMVTNGAKQAIYNLFQVLLNTGDEVIIPSPYWLSYPQMVRLAGGKPIFTNSSAEDGFKINIEDLKSKISSKTKFIIINSPNNPTGRVMSKEELLQIADLARENPNINILSDEIYELILKKEFKHYSLSSLANDLKDRIFIINGFAKGWAMTGWRIGYLVGPKDVIKASSALQSQSTSNVCSFVQKGALEALKINNEFFSMINSHYDQRRRLLYEGLNNINGIYIEEPNGAFYAFPKLPNSSITSVDFCNKALQDYGLVVVPGKAFGADQCIRISCAASEIKIKDGLHRLEKAISEYY

SEQ ID NO: 58084 - protein, 119 aa, Halobacterium sp. NRC-1
MATDTAATTGTASPDEPLYVNGQTELDDVTSDNDVVLADFYADWCGPCQMLEPVVETLAEQTDAAVAKIDVDENQALASAYGVRGVPTLVLFADGEQVEEVVGLQDEDALKDLIESYTE

SEQ ID NO: 58085 - protein, 524 aa, Saccharomyces cerevisiae
MSQRSSQHIVGIHYAVGPKIGEGSFGVIFEGENILHSCQAQTGSKRDSSIIMANEPVAIKFEPRHSDAPQLRDEFRAYRILNGCVGIPHAYYFGQEGMHNILIIDLLGPSLEDLFEWCGRKFSVKTTCMVAKQMIDRVRAIHDHDLIYRDIKPDNFLISQYQRISPEGKVIKSCASSSNNDPNLIYMVDFGMAKQYRDPRTKQHIPYRERKSLSGTARYMSINTHFGREQSRRDDLESLGHVFFYFLRGSLPWQGLKAPNNKLKYEKIGMTKQKLNPDDLLLNNAIPYQFATYLKYARSLKFDEDPDYDYLISLMDDALRLNDLKDDGHYDWMDLNGGKGWNIKINRRANLHGYGNPNPRVNGNTARNNVNTNSKTRNTTPVATPKQQAQNSYNKDNSKSRISSNPQSFTKQQHVLKKIEPNSKYIPETHSNLQRPIKSQSQTYDSISHTQNSPFVPYSSSKANPKRSNNEHNLPNHYTNLANKNINYQSQRNYEQENDAYSDDENDTFCSKIYKYCCCCFCCC

SEQ ID NO: 58086 - protein, 670 aa, Arabidopsis thaliana
MRDQKFNEKFSLDLLVTMEPEMVRLPIHEHWLTPARDNRWGKCCGLQFKTISDGYNCRKCRYFFHKSCSNCPKEINHPSHKCDKNLSLITNFASWSVRCRTCKETIQPYIQNYECQRCEFNIHLDCFKYPPPKVIDFPQNHDHKLKLEMVRSSFTCFTCGKGGSGYPYKCHECDLAFHVDCEKYGAEVNHPSHSLHTLKLITGKPPAYTDGNCSLCGKKIFDEMFYHCSACNFTLDLRCVSLPPPLNLHDQNTHNHELTLMPKLISFTCTTCGLHGDRSPYVCLQCNFTSHNNCSGFPWVININRHDHRVSRTSLLGIIDSVCGVCRKKMDWSCGGYSCKRCSESTFHTKCATREDVWDGIEMKDEPEEDEPMEPFEVISEGIIRHFSHIEHNLRLDKSGTFVEERSCKACAYPIYHDPFYSCMSCDFLLHENCAKHPTRKRHVLSNKPYILHASQRNYSKCKACGVFFNCFIYGTFPFGLDVRCASFSGSLVHPSHQHPLFYTSPKGVCSACNKETSHVLRCVEDKCGYALDFKCALLPHEVKHRVDDHFLSLCYGERDASGKYWCDICEKETDPTKWFYTCKDCGVTLHTNCVLGDFRGLEPETNIVLDDDRMQMTLYETVRNNSMSRPVCYKCKYHCIFPIILKVTDEDKYFCSISCCDIKTLPFYN

SEQ ID NO: 58087 - protein, 336 aa, marine gamma proteobacterium HTCC2143
MDVLVTGGAGYIGSHTCIELLGAGHNVIVVDNLSNSSYEALRRVEEITGQRVKFHQIDICDKEALETVFRGNPIDAVIHFAGLKAVGESVDKPYLYYHNNVHGTLVLCDVMSRHEVFNLVFSSSATVYGDPASVPINESFPLSATNPYGRSKLMIEEILRDFYVSDQRWNAILLRYFNPAGAHISGRIGEDPNGIPNNLMPYISQVAVGKLKKLSVFGSDYPTIDGTGVRDYIHVVDLALGHVKALDKLADAPGAVAYNLGTGRGYSVLEMITAFEQASGKTVPYQLVDRRPGDVASCYADPDMASTELNWRAERSVDQMAADSWRWQSDNPNGYP

SEQ ID NO: 58088 - protein, 575 aa, Lotus japonicus
MMFCAPHPENGCKNVKGFALQVLQGRWFMMLASFMIMAVSGASYMFSLYSREIKFALGYDQSTLNLLSFFKDVGSNIGILSGLINEVTPPWVVLSMGAVLNFFGFFMIWLAVAKKIANPRVWHLCLYIVIGSNSHCFTNTAVMVTSVKNFPGIRGIVLGILGGYLSLSAIIITQLYYAFFINDSQSMILIMACLPTATALILLPVIKNHKSIQQKNDSKVFYRFIYLVLALAGFLMIMIILQISFNFTQSEYYATTTVMLLLLTLPLAVVIVEDCKIWKSKQELINCENPPRPVDTTTKSNELKSEQTIPEGLSCWQNILRHPERGEDHTVLQAIFSLDMVILFFATVCGFGSNLTVYNNLSQIGKSLGYPSYTITTFVSLMSIWIFLGKIAQGVLSEFMITKLKLPRPLMFTIVHVLSCIGHLLIAFNVPNGLYAASIFIGFCLGASWPIINSLISELFGLKHYSTLYNVGTVASPIGSYLLNVKVAGYLYDREARRQMAALGLQRKPGEELNCNGSDCYKLAYIIITAVCLFGALVSFILVLRTRQFYKTDIYKKFTEEPRTAETKMVIPGKD

SEQ ID NO: 58089 - protein, 135 aa, Burkholderia pseudomallei K96243
MSYSNKVLDHYENPRNVGSFAKDDDTVGTGMVGAPACGDVMKLQIRVGADGVIEDAKFKTYGCGSAIASSSLVTEWVKGKTLDEALAIKNTQIAEELALPPVKIHCSILAEDAIKAAVADYKKRHETAEDGKAAA

SEQ ID NO: 58090 - protein, 140 aa, Zea mays
MAATALSMSILRAPPPCFSSPLRLRVAVAKPLAAPMRRQLLRAQATYNVKLITPEGEVELQVPDDVYILDFAEEEGIDLPFSCRAGSCSSCAGKVVSGSVDQSDQSFLNDNQVADGWVLTCAAYPTSDVVIETHKEDDLL

SEQ ID NO: 58091 - protein, 327 aa, Streptococcus thermophilus LMG 18311
MHSLFGELREHISGKGVRIVFPEGNDDRVVRAAARLKFEELVDPIILGDPTEVHKILNDLGFVDFNCTIINPETYEGFEEMKEKFVEVRKGKATIEDADKLLRDVNYFGVMLVKLGLADGMVSGAIHSTADTVRPALQIIKTKPGISCTSGVFLMNREDTNHRLMFADCAINIEPNSQELAEIAINTAETAKVFGIDPKVAMLSFSTKGSAKSPKVDRVVQATNIAKEMRPDLAIDGELQFDAAFVPATAAIKAPDSDVAGQANVFVFPCLQAGNIGYKIAQRLGMFEAIGPILQGLNKPVNDLSRGASAEDIYNLAIITAAQALNN

SEQ ID NO: 58092 - protein, 692 aa, Cucumis melo
MQDIFASVRRSLVFRPPLDNDDSHSPAIGVGALVDKINSSIRKSRVFSRHSPSSSSLPPIPKDTDPPIRWRKGELIGCGAFGRVYMGMNLGSGELLAVKQVLIAANGASKEKAQAQVQELEEEVKLLKDLSHPNIVRYLGTVREDDSLNILLEFVPGGSIASLLGKFGAFPEAVLRTYTKQLLLGLEYLHKNGIMHRDIKGANILVDNKGCIKLADFGASKQVVELATISGAKSMKGTPYWMAPEVILQTGHSFSADIWSVGCTFIEMATGKPPWSQQYQEVAALFHIGTTKSHPPIPEQLSVEAKDFLLKCLQKEPNLRPTASELLKIFHHQEPLKIYSPQCTSELEMSKTPTHPGSSDICNLDSLSCSKVYSTNKLESDMWGRNSDDEMCQIDDKDDFMLDEVKIGSSIIHENMKSYNPICEPSDDEDCQFDRSPVVDQGSSLHEEALAPGSCSGAFDEEQNFSFPSGRSLSEDEDELTESKIKAFLDEKALELKKLQSPLYEEFYNSLNASCSPVFIESKQDESTPKYLKLPPKSRSPSRSPGNPSPAHDAFGTGSPGSGSRGNANDQRSQLNDWKGLHGQSEAGSPSSKNYSEIQRKWKEELDQELERKREMMRQAGVGGKTSSPKDKAMGRPRERTRFASPFRKYKLYYGNLHDCEELLTGMMCRVLGGTTGKTSSPERLASSNDSS

SEQ ID NO: 58093 - protein, 185 aa, Triticum aestivum
MSSPSKRREMDLMKLMMSDYKVETVNDGMQEFLVEFRGPEESLYQGGVWKVRVELPDAYPYRSPSIGFVNKIYHPNVDELSGSVCLDVINQTWSPMFDLVNVFEVFLPQLLLYPNPSDPLNGEAAALLMRDRPAYEQKVKEFCEKYAKPEDAGITPEDNSSDEELSEEDDDDSGDDEPILGHADP

SEQ ID NO: 58094 - protein, 339 aa, Triticum aestivum
MHPTRWELSHMVDLQAAGLVISSGRPGRCSGINAEPGAGVDELGNPTGGLFGTAVAPGRGLSTAAYVLTMDMFGPIADNAGGIVEMSQQPESVREITDILDAVGNTTKATTKGFAIGSAALASFLLFSAYMDEVAAFAQLPFKEVDIAIPEVFVGGLLGSMLIFLFSGWACSAVGRTAQEVVTEVRRQFIERPGIMDYKEKPDYGRCVAIVASASLREMIKPGALAILSPMAVGIIFRILGHATGQPLLGAKVVASMLMFATVTGILMALFLNTSGGAWDNAKKYIETGALGGKGSEAHKAAITGDTVGDPFKDTAGPSIHVLIKMLATITLVMAPIFL

SEQ ID NO: 58095 - protein, 437 aa, Bacteroides fragilis NCTC 9343
MKIAIVGTGYVGLVTGTCFAEIGVDVTCVDTNSEKIEALKKGIIPIYENGLEEMVIRNTKAGRLKFTTSLESCLDDVEVVFSAVGTPPDEDGSADLSYVLAVARTIGQNMKKYKLVVTKSTVPVGTACKVRNAIQEELDKRGAKMEFDVASNPEFLKEGNAVNDFMSPDRVVIGVESERAEKLMTKLYKPFMLNNFRVIFMDIPSAEMTKYAANSMLATRISFMNDIANLCELVGADVNMVRSGIGSDTRIGRKFLYPGIGYGGSCFPKDVKALIKTAEQNGYQMRVLQAVEEVNENQKSLLFDKLVKQYNGNLEGKTVALWGLAFKPETDDMREAPALVLIDKLLKAGCKVRAYDPAAANECKRRIGETIYYARDMYDAVLDADALMLVTEWKEFRLPSWAVVKKTMSQQVVMDGRNIYDKKEMEEQGFIYHCIGK

SEQ ID NO: 58096 - protein, 436 aa, Deinococcus radiodurans R1
MDSRSPSLPDDRPDPPEQHLDARAGATLRGTAGPRGVRRILPFLGPAVIASIAYMDPGNFATNIEGGARYGYSLLWVILAANLMAMVIQNLSANLGIASGRNLPELIRERWPRPLVWFYWIQAELVAMATDLAEFLGAALAIQLLTGLPMFWGAVVTGVVTFWLLNLQKRGTRPLELAVGAFVLMIGVAYLVQVVLARPDLAAVGAGFVPRLQGPGSAYLAVGIIGATVMPHVIYLHSALTQGRIQTDTTEEKRRLVRLNRVDVIAAMGLAGLINMSMLAVAAATFHGKNVENAGDLTTAYQTLTPLLGPAASVLFAVALLASGLSSSAVGTMAGDVIMQGFMGFHIPLWLRRLITMLPAFIVILLGMDPSSVLILSQVILCFGVPFALVPLLLFTARRDVMGALVTRRSFTVIGWVIAVIIIALNGYLLWELLGG

SEQ ID NO: 58097 - protein, 431 aa, Physcomitrella patens subsp. patens
MAKVKSITARQIIDSRGNPTVEVDLVTDRVFRSAVPSGASTGIYEALELRDGDNKVFGGKGVLKAVDNINNVLAKKLVGLDTRNQKEIDNIMLDLDGTPNKGKLGANAILGVSLSVCRGGAHAEGLPLYRHIQAISGTKQLVMPVPALNVINGGSHAGNKLAMQEFMILPVGASSFKEAMQMGCEVYQVLKGIIKKRYGQDACNVGDEGGFAPNIQDNREGLVLLVDAIEKAGYTGKVKLGMDVAASEFLTKEGQYDLDFKEERNDGSKVLSGHALGELYKEFVRDFPIVSIEDPFDQDDWASWSALQAGLDAQLVGDDLLVTNPKKIAEAISKKACNALLLKVNQIGSVTESIQAALDSKAVGWGVMVSHRSGETEDNFIADLSVGLASGQIKTGAPCRSERLSKYNQLLRIEEELGRVRYAGESFRQPL

SEQ ID NO: 58098 - protein, 119 aa, Wolinella succinogenes
MAKPQVTILATGGTIAGSGESSVKSSYSAGAVTVDKLLAAVPAINDLATIKGEQISSIGSQEMTGKVWLKLAKRVNELLAQKETEAVIITHGTDTMEETAFFLNLTVKSQKPVVLVGAM

SEQ ID NO: 58099 - protein, 264 aa, Salmonella enterica subsp. arizonae serovar 62:z4,z23:--
MAISIKTPEEIEKMRIAGRLAAEVLEMIEPYIKPGVTTGELDRICNDYIVNEQHAISACLGYHGYPKSVCISINEVVCHGIPDDAKHLKDGDIVNIDVTVIKDEYHGDTSKMFIVGKPTILGERLCRVTQESLYLGIKMVKPGIRLRTIGAAIQKYAEGEGFSVVREYCGHGIGRGFHEEPQVLHYDADDGGVVLQPGMTFTIEPMLNAGDYRIRIMKDGWTVKTKDRSLSAQYEHTIVVTENGCEILTLRKDDTIPAIITHDA

SEQ ID NO: 58100 - protein, 325 aa, Solibacter usitatus Ellin6076
MEWWQLSDLCTPWCVHVAATLRVPEHIAAGHGEIGQLAAAAAADRDSLERVLRHLVSKGLFAEPSPGVFALNEAARPLLEEGARIGLDLDGFGGRMAHAWGTLLSAVRTGRPAYHEAFGRPYWEDLEANPPIAASFDALMGVAGHGVPDPNVLPDPADWEKVRMVVDVGGGAGDLLAAVLRAHPGTRGTLVDLPRTVARAAATFEAAGVADRVTLAGQSFFEPLPSGGDVYLLSKVLCDWPDREATAILRRCAEAAGATGRVVALGEGGPGSPELLMLVLVGGKDRSLEQLRAIARDAGLEVSAVGRQAKGRPMVELRAASANRT

SEQ ID NO: 58101 - protein, 294 aa, Saccharum officinarum
MEQYEKQEKIGEGTYGVVYKGLDKATNETIALKKIRLEQEDEGVPSTAIREISLLKEMNHDNIVRLHDVIHSEKRIYLVFEFLDLDLKKFMDSCPEFAKNPTLIKSYLYQILRGVAYCHSHRFLHRDLKPQNLLIDRRTNTLKLADFGLSRAFGIPVRTFTHEVVTLWYRAPEILLGAKQYSTPVDVWSVGCIFAEMVNQKPLFPGDSEIDELFKIFRVLGTPNEQSWPGVSCLPDFKTAFPRWQAQDLATIVPNLEPAGLDLLSKMLRYEPSKRITARQALEHEYFKDLEMVQ

SEQ ID NO: 58102 - protein, 363 aa, Haemophilus somnus 2336
MGFKCGIVGLPNVGKSTLFNALTKAGIEAANYPFCTIEPNTGVVPMPDPRLDALADIVKPERILPTTMEFVDIAGLVAGASKGEGLGNKFLANIRETDAIGHVVRCFENDDIVHVAGKIDPLDDIETINTELALADLDSCERAIQRLQKRAKGGDKEAKFELSVMEKILPVLENAGMIRSLDLDKDELHAIKSYNFLTLKPTMYIANVNEDGFENNPYLDKVREFATKEGSVVVPVCAAIEAEIAELDDDEKTDFLQDLGIEEPGLNRVIRAGYALLNLQTYFTAGVKEVRAWTVSVGATAPKAAAVIHTDFEKGFIRAEVIAYDDFIQYKGEAGAKEAGKWRLEGKDYIVQDGDVMHFRFNV

SEQ ID NO: 58103 - protein, 856 aa, Cryptococcus neoformans var. neoformans B-3501A
MPRHKVALYLPHPLPSLPIEPPPTPSPLQQVIASTLSTTDYDLVSFPLTNAAWQARWEKLCLRPIEEEGLSEAELERRAIEERKVDQEADIWRRDGGLKRSEVVVSRLEESQGVIPLASEWLELDSPDEGIRFDSELALRAEFAHALYLSLPVLILPAPSLANREYLPSYARAISNLLQMGGQSAVTNISIRIPVSNPLELIAPESAMPNGLPGSPSPIAPPLASGAPQTDKKHKRLSSLSTRPQSMQTSLFGQPANQGTNQNQQQGMRITSGASSLMSANTAYGSVAGVGQASLGVAAHGGDLSSTWEMWDCIRTLCGYHPRLSVTLDLTNPLPPSAGALARWSAEPVNYIWLPASSFIPNAKGYPVLSKACQAFIREMGKQNPTYILSQTTMKRHSAGGHNAYLQYIRHITSTPQPGPNAQPRAIMALPAGASEKFQDYSDYLQAPLQPLMDDLGSMTYNIFENDPVKYAQYESAITQALLDLPANKKHVVTVVGAGRGPLIDCTLRALLHSGRQASIYAVEKNTNAFVTLQERKELEWRDKVHIISGDMRAVDVPEKCDILVSELLGSFGDNELSPECLDGALRLMKSTGVSIPSSYTAHIAPLSTSKLYQETHSPTRGPSSAETPYVVMLSQVDPISGDNNVPGVSARCGERIQQCWQFVHPNRDITVDSNGVPLSNSHNARASTHTFHIPHAATLHGFGGYFEAHLYGDVGLSIHPENAHAVSPDLTSWFPLFFPLKEPMYLPSGAELQVNLWRMGDGKGKKVWYEWAVESYLPVVQSVSSGPGAATVPGSRNVSSASASGIGFGGQPSPLMDAQFSPGTGHMGLSGELGRVKIGQSTLHNPGGIHSWVGL

SEQ ID NO: 58104 - protein, 399 aa, Bacillus cereus ATCC 10987
MLENQINERSLLLHKELVGKIEITSKVEVNSADDLSLTYTPGVAESCKAIAADEETVYDYTARGNMVAVISDGTAVLGLGNIGPKAAMPVMEGKSILFKKFANVDAFPLCLGTTDVDEIVTLVKNLEPTFAGINLEDIAAPRCFEIEKRLKEETNIPVFHDDQHGTAIVVLAAVINALKVVRKQMDHVKIVINGAGSAGIAIGKLLLKAGAQHITLVSLEGIVCEGETWMNEAQIEVSKKTNREHVRGTLKEAIHQADIFIGVSAPNVLTKEFVQTMNEKAIVFAMANPIPEIFPEDALEAGAAVVGTGRSDYANQVNNVLAFPGIFRGALDVRATDITEEMKLAAAYGIANIITDEERNANYVIPNPLDKRVVPSVAEAVAKAAIDSGVARITRIPSY

SEQ ID NO: 58105 - protein, 396 aa, Mycobacterium smegmatis str. MC2 155
MTDYSQARAVVVGGSIGGLTTALLLRDSGFHVDVFERTPTALDGRGSGIVLQPDTVRWFQERSSQDLGDLQTATRFVQYLDRSGDVVHREPATWTYTSWGTFYRALLADFGTEHYHYGEYACGFDQDEAEAVVRFVSGRTAAADLVVFADGITSAARERFDPDATLRYAGYIGWRGTVALSALSEPTRNTLRDAITYDVVPHSHITMYPIPGEDGLGESQRLMNYVWYRNVPAGPELTEMLIDKRGFGGSVSVHPGQVQDRYVDAIRADAAELFAPAVAETVVRTEQPYLQVLSDVRSTRMAMGRVALIGDAACASRPHAAAGTAKAAADAWTLAGALAASDGDIAAALRKWEPAQLQLSDSLLRRVVDMGDRSQFHNTWWPGDPDLRFGLYGPGH

SEQ ID NO: 58106 - protein, 546 aa, Zea mays
MGLGAAMALALGDPPADYASIAAVGLFVALMCVCIVVGHLLEENRWMNESITALFIGLGTGAVILFASSGKHSRVLVFSEDLFFIYLLPPIIFNAGFQVKKKQFFRNFITITLFGAVGTLISFTVISLGALGLISRLNIGALELGDYLALGAIFSATDSVCTLQVLSQDETPFLYSLVFGEGVVNDATSVVLFNAIQNFDPGNISSAKLLNFIGSFLYLFGSSTILGVASGLLSAYTIKKLYFGRHSTDREVSIMMLMAYLSYMLAELLDLSGILTVFFCGIVMSHYTWHNVTESSRVTTKHAFATLSFISETFLFLYVGMDALDIEKWKIVGQTYSPVKSIALSSTILALVLVSRAAFVFPLSFVSNLTKKTPNGKISFRQQVIVWWAGLMRGAVSIALAYNKFTRSGHTQQPSNAIMITSTISVVLFSTIVFGLLTKPLIRLLIPSRHLSREPSALSEPSSPKSFFEQLAANSPGHPDLENGISLRRPASLRFLLVSPARSVHHYWRKFDDSFMRPVFGGRGFVPFVPGSPTESSLPLLPGNEN

SEQ ID NO: 58107 - protein, 667 aa, Glycine max
  misc_feature (214)..(214): Xaa can be any naturally occurring amino acid
WLRLCHAPAPPSPSEFAMLPQKHTLVATLAVVLAVAQAVDLASERAALLALRSAVGGRTLFWNATRESPCNWAGVQCEHDHVVELHLPGVALSGEIPVGIFGNLTQLRTLSLRFNALRGSLPSDLASCVNLRNLYIQRNLLSGQIPPFLFDFADLVRLNLGFNNFSGPFPTAFNSLTRLKTLFLENNQLSGPIPDLDKLTLDQFNVSDNLLNGXSVPLKLQAFPPDSFLGNSLCGRPLSLCPGDVADPLSVDNNAKDSNTNNKSKLSGGAIAGIVVGSVVFLLLLVFLFIFLCRNKSAKNTSAVDIATVKHPETESKVLADKGVSDVENGAGHANGNSAVAAVAVGNGGSKAAEGNAKKLVFFGNAARAFDLEDLLRASAEVLGKGTFGTAYKAVLEAGPVVAVKRLKDVTISEKEFREKIEAVGAMDHESLVPLRAYYFSRDEKLLVYDYMSMGSLSALLHGNKGAGRTPLNWEVRSGIALGAARGIEYLHSRGPNVSHGNIKSSNILLTKSYDARVSDFGLAHLVSPSSTPNRVAGYRAPEVTDPRKVSQKVDVYSFGVLLLELLTGKAPTHALLNEEGVDLPRWVQSVVREEWTSEVFDLELLRYQNVEEEMVQLLQLAVDCAAQYPDMRPSMSEVVRRIQELRRSSLKEEDQDQIQHDNDIQL

SEQ ID NO: 58108 - protein, 397 aa, Wolbachia endosymbiont of Drosophila melanogaster
MCAKKYKIAALIVAAGVGSRCNSTIPKQYIKLAGKSVLFHTIKRFLANQYIDYIRIAINRDHESFYEKAISLITDTKLLSPVYGGENRQSSVKLGLESLQKINPDFVVIHDACRPFVSDVLIDNLVESMINDQYTGVVPAIEVEDTMSLVSNSFIESTISRGKLRAIQTPQIFNFKELLSCHQSVKEFTDDSSLMVEHKKHVAIIKGEKSNFKLTTKEDINMAKLLFEEPKFRVGAGYDIHKFIKVQNGAESFIKICGVKIEHNMAIEAHSDGDVAIHAIVDAILGALGCGDIGEHFPPSSSEWKDCNSSHFLDFAAKKAKEKGYSVSNLDITIVCEEPKISPYKVEMKKFISKALEIDDEFVNIKATTAEKLGYIGRNEGIAVHASVLLHTNFYWK

SEQ ID NO: 58109 - protein, 526 aa, Burkholderia sp. 383
MHSDARPDSPRPSGSPPAKPTLHRALQARHLRMIAIGGSIGTGLFVASGASISQAGPGGAMLAYMVIGLMVYFLMTSLGEMAAFMPVSGSFATYGAKFVDEGFGFALGWNYWYSWAVTLAVELVAGQLVMNYWFPHVPGVWWSALFLTLIFALNALSVRGFGEAEYWFALIKVLTVLAFVGVGLLMIFGIMQGGPSAGWGNFTIGDAPFAGGWATMLGVAMIAGFSFQGTEMIGVAAGESENPRTTIPRAVSQIFWRILLFYVFAIFVIGVLIPYTDPSLLKSDVTDIGVSPFTLVFRHAGLAFAAGVMNAVILTAVLSAGNSGMYASTRMLYNLAVEGRAPKIFAKLSRGGVPRNALYATTAVGALCFLTSLYGDKTVYLWLLNTSGMAGFITWLGIAVSHYRFRKGFLKQGYRLDQLPYRSKWFPFGPLFAFALCAVVALGQDYQAFFSDKIDWVAVAATYIGLPFFLAIWLGYALVRKCRLVRYEDMEIAPWIERNATPEPAPQAETGYAGYVARPANPTPGA

SEQ ID NO: 58110 - protein, 99 aa, Thalassiosira pseudonana
MATYKVTLISEEHDINATIDCNDDVFVLDAAEEAGIDLPYSCRAGACSTCAGKVSDGTIDQSEQTFLDDDQMGAGFVLTCIAYPKSDCTILVHQEDELY

SEQ ID NO: 58111 - protein, 348 aa, Xanthobacter autotrophicus Py2
MNHVTRKAAPAAPPAAAAAGKPRLTTSAMIASIAAEGQRTRPAPFGHALVALARENPAVVGMTADLGKYTDLHIFSQAFPERFYQMGMAEQLLFGAASGLAAEGFMPFATTYAVFASRRAYDFIHQTIAEENRNVKIVCALPGLTSGYGPSHQAAEDLALFRAMPNMVVIDPCDAHEIEQAVPVMAAHDGPVYMRLLRGQVPLVLDEYGYTFELGKAKMLRDGPDALIVSSGIMTMRALEAADLLRQDKVEVAVLHVPTIKPLDEATIVEAARKSGRPVIVAENHTVIGGLGEAVAGALLRSGVAPASFHQIGLPDTFLDAGALPTLHDRYGISAAAVAEQVKGWTGR

SEQ ID NO: 58112 - protein, 337 aa, Streptococcus thermophilus LMG 18311
MGFASYFFKGVTIVMVHQKANPKLKLFSLSSNPEIAEKIAENTGLPLGKVSSRQFSDGEIMINIEESVRGDDIYIIQSTSNPVNDHLWELLIMIDACKRASANSVNVVMPYFGYARQDRIAASREPITAKLIANMLVKAGVNRVLTLDLHAVQVQGFFDIPVDNLFTIPLFAEYYNEKGLTGADVVVVSPKNSGVKRARSLAEYLDAPIAIIDYAQDDTGREEGYIIGEVEGKTAILVDDILNTGKTFAEAAKILERGGVNDIYAVASHGLFAGGAGEVLNASPIKEILVTDSVATKENVPTSVKYLSASELIANAITRIFERQPLSPLFAYTANEE

SEQ ID NO: 58113 - protein, 456 aa, Zea mays
MGSILSATSTTAKSMDQHEASGTDPNKRVKISTYEYGSNPRIIPTLPDELSLQILARSPRIHYLNLKLVCRAWKAAIIGYELSQLRRELGVSEEWVYVLTKAEAYKLHWYALDPVFQKWQRLPPMPSFVNQEESNRTASSAFWMWNVVGSSIRIADYVRGLFWRRNSLDQMPFCGCSVGVADGYLYVIGGFSKAVALNRVCRYDPFLNLWQEVSPMMTGRAFCKAAFLNGKLYVVGGVSRGRNGLLPLRSAEAFDPKTGLWSDLPEMPFARAQVLPTAFLVDVLKPIATGMAPYKGKLYVPQSLYSWPFFFDIGGEIYDPDLNAWSTMPDGLGDGWPARQAGTKLGVVIDDRLYTLEPSSSLDSGKIKRYDSEEDAWVTITPQVPVNDFTGAEAPYLLAGLGGRLHVITKAANNTLQVMQAVVQNNSVSEENVVWTTVASRNFGTAELVSCQVLDV

SEQ ID NO: 58114 - protein, 218 aa, Ustilago maydis 521
MSSQDNSKKDGSADWANKDGHYRRQESSFRTTIEKGGKHEPELGRYHLVVALACPWAHRTLIVRKLKGIDRVPDLLPVHVVDSLLGSEGWSFVPYEEPKGYGVPGTGIKIPGHENKKRIRDLYLAADPNYSQRCTVPIIWDNKLNTIVNNESSEVIRNLNYCFDDFIPEELRGVTFYPQQLAKEIDAFHDVPVQHQAAVRQPRSHRKDVARWQDLSVR

SEQ ID NO: 58115 - protein, 357 aa, Burkholderia sp. 383
MFSERQTMTHSIASRRTFLKLSAALAGTALLPETGAFAAGGDAARRTVIIDTDPGQDDAIAILFALGAQDRLDVRALTAVAGNVPLDLTERNARIIRDWAARTKTLPVYAGCPRPLVRDLVTAANVHGKTGLEGVELHEPRAPLAGGHAVSYLVDTLSRAAPGSVTLCALGPLTNIATALVEAPQIRGALREIVLMGGAFFERGNITPAAEFNIYVDPQAAEVVFGSGVPIVVLPRDVAVKAPITPARVAPFRALGNRCGTIVADIMDAELAYNKKRRGVEDAPMYDPTAVGYLVDPTLFGGRKVNVMVETTGQWTLGETVVDWNGRSGRTANATWINEVDADRFYAALVERIAKLP

SEQ ID NO: 58116 - protein, 75 aa, Zea mays
  misc_feature (7)..(7): Xaa can be any naturally occurring amino acid
  misc_feature (21)..(21): Xaa can be any naturally occurring amino acid
HDPFEVXYRVGVAELVKLATXRIRKARLNFKVGICGEHGAEPSLVALFDKAGLDCVSCSTFRVSIARIGAAQVLV

SEQ ID NO: 58117 - protein, 96 aa, Zea mays
IFKNPDLFDPDRFGPGREEDKAAGAFSFISFGGGRHGWLGEPFAYLQIKAIWTPLLRNFEFEVVSPFPENDWNAMVVGIKGGGVVKFKRGKVSVGN

SEQ ID NO: 58118 - protein, 327 aa, Brassica napus
AVIENIQLKQKIFKEIEEVCPPHCILASNTSTIDLNVIGEKTNSKDRIVGAHFFSPAHIMTLLEIVRTENTSAQVILDLMSLGKAIKKVPVVVGNCIGFAVNRTFFPYTQGAHMLVNLGVDLFRVDRVITSFGLPLGPFQLGDLAGHGIGMAVKEIYAKAYGDRMFRSPLTELLASGGRNGKINGRGYYIYEKGSKPKPDSSVLSVVEESRKLTNIMPGGKPISVTDKEIVEMILFPVVNEACRVLDEGVVIRASDLDVASVLGMSFPSYRGGLLFWADTVGPKYIYERLKRLSETYGGFFNPSRYLEERATKGMLLSEPKSSRSRL

SEQ ID NO: 58119 - protein, 79 aa, Polaromonas sp. JS666
MSDIEARVKKIIAEQLGVEEGQVTSEKAFVADLGADSLDTVELVMALEDEFGIEIPDEDAEKITTVQNAIDYANTHQKA

SEQ ID NO: 58120 - protein, 424 aa, Deinococcus radiodurans R1
MQAVTEVMTSIWPFVQAHPEYAEHALLERLIEPERVISFRVTWVDDAGQVQVNRGYRVQHSSSIGPYKGGMRFHPSVNLSILKFLAFEQTFKNALTTLPLGGGKGGSDFDPKGKSDGEVMRFCQALMTELWRHLGPDTDVPAGDIGVGGREVGYLAGMMKKLANHAGGVFTGKGLSYGGSLLRPEATGYGTVYFVEHMLRDQRMEMEGLRVSVSGSGNVAQYAIEKALHLGAHVLTASNSGGTVVDEDGFTYDKLAVLMDIKNERRGRVEDYAREVGAEFRPGVRPWDVPVDVALPCATQNELGADDARTLIAGGVRVVAEGANMPCDLAAIQAFEEAGVLYAPGKATNAGGVATSGLEMSQNAQRLSWTREEVDQRLRSIMSAIHDSCLEYGRRPDRHVSYLDGANIAGFVKVATAMREQGVL

SEQ ID NO: 58121 - protein, 188 aa, Magnetospirillum magnetotacticum MS-1
GFPKSLCTSLNEVVCHGIPDSTELVEGDIVNVDITAYVGGVHGDTNATFTVGEVDPESALLVERTREALARGIKAVAPGRQINVVGRVIERYAARFGYGVVREYTGHGVGRAFHSGLVVPHYDAAPDHATVIEPGMVFTIEPMLTLGTSEWRMWDDGWTVVTADASRTAQFEHTLLVTDDGAEILTLP

SEQ ID NO: 58122 - protein, 445 aa, Deinococcus radiodurans R1
MVPAPPFLGHAAEMGTIKLRPFLTRCYQAYGPVFQLTVPGQKITVLAGPEANLFAMKEGHRVLRSLEAWRDNDHEMGSDRSMISLDGAEHRAYRRVEGRAFARSFFAAGLRPALAVLAEDLAPFQPGDVLPVATWCKKTITEQLARMAVGGTVRPYLPDLLHFIQTALQVTVNRQLPPAVLRLPKYRRAKARIFQMVDDLIEDHRQNPPEKSGRAPDLIDDVLADQQVNPERWEHPDVRLAALGAFIAGMDTAANSLAFVLYRMHLHSEFLPALRAEADALFRDGPPTAEALGRSPLLHRFVMETLRVHPIAPALSRTLTEDVEFAGHRIPAGTPVIIGTTVPHGLPELFPDPEHFDPGRFAPGRAEHRQPGAYAPFGVGSHTCAGSGMAEGLIMLGAAAALRTLDLSLEPDYVLRQTAKPTPSLDNKLQLRVNAVRHNPVFLVH

SEQ ID NO: 58123 - protein, 306 aa, Thermus thermophilus HB27
MRFFVLGDVSVDLLFFLERIPEPGEEVPSRRALMKPGGAGGTLAAQLASLGHRVFLAGRVGKDPFAELALSRVREVGVDLRHLQEDPEHTTSSVLILVVPGGERAMVSAEGASRYLDPALFKPRFLDQVDAVVLSAYALVGGPSRSYAAEVLEAARRRELPVFADLGAGAVRAAGKELLKHLRGVGWLLMNEGELKALTGASSISQGVARLRQEGFQHLAVKVGAMGSIVVTPEGEELIEPFPVEDIVDSTGAGDAYTAAFAHAILEGLSPVEAGRLANLAGALAATAIGAQGRLVTLEDLKVAAG

SEQ ID NO: 58124 - protein, 163 aa, Wolinella succinogenes
MNLESVMEGFERFLEEEAPLFEGFHPHYNEYLWEMVRNGGKRFRPRLLLGVVSALAPLLVKSAYAPALALEILHTYSLIHDDLPAMDNAATRRGHPTLHVKYDEASAVLAGDALNTHAFYLLAQAPLGSDTKVALVRELASAGGAGGMVLGQALDCYFEHQKL

SEQ ID NO: 58125 - protein, 310 aa, Brucella suis 1330
MKLFAGNSNRVLAESVAQYLNIPLGKASVRRFADQEIFVEIQENVRGEDVFVLQSTSYPANDHLMELLIMIDAFRRSSARRITAVLPYFGYARQDRKPGPRTPISAKLVANLITEAGASRVLTLDLHAGQIQGFFDIPTDNLYAVPVIARDVKANYATGNCMVVSPDVGGVVRARSLAKRIDAQLAIVDKRRERPGESEVMNVIGDVSGKDCLLFDDIVDSGGTLCNAAEALLNKGANSVTAYITHGVLSGGAVARIASSKLKELVITDSIQPTNAINDAPNIRVLSISDLIGEAIARTAAEESVSSLFD

SEQ ID NO: 58126 - protein, 443 aa, Nocardia farcinica IFM 10152
MVAHETALALIQLGAVFFGLGLLGRVAARIGMSPIPLYLLGGLAFGTGGLVELHQVDEFIHLASEIGVVLLLLLLGLEYSASELVTGLRKSWAAGVLDFALNATPGVLVAFALGWGFTGAIAMAGVTYISSSGIVAKVLNDLGRLGNRETPVILSILVFEDLVMAGYLPVLTAVLAGVGFVAGLQTLGIALAAVTVVLVVALRYGRFVSLIVDSKDREIFLLKLLGSALLVAGIASAVQVSAAVGAFLLGIAISGSTAHNATKLLEPLRDLFAALFFVLFGLSTDPATIPPVLGWALLLAVVTTATKVATGWWAAQRAGASRLGRARAGTALVAHGEFSIVIAGLAVTAGAVPAEFAALATTYVLLMAVAGPVAARVVEPVMGLLARTSAKPAPASRSRLDEPDADGVAGQRQPVAQPQLLEDVRPVPVDRLDTDDESVGDPA

SEQ ID NO: 58127 - protein, 1403 aa, Arabidopsis thaliana
MVHSESSILSSLRGGDGGGIPCSKDELAINGSYTDPMGRRKSKRFKVAAESEFSPDFGSITRQLRSRRMQKEFTVETYETRNVSDVCVLSSQADVELIPGEIVAERDSFKSVDCNDMSVGLTEGAESLGVNMQEPMKDRNMPENTSEQNMVEVHPPSISLPEEDMMGSVCRKSITGTKELHGRTISVGRDLSPNMGSKFSKNGKTAKRSISVEEENLVLEKSDSGDHLGPSPEVLELEKSEVWIITDKGVVMPSPVKPSEKRNGDYGEGSMRKNSERVALDKKRLASKFRLSNGGLPSCSSSGDSARYKVKETMRLFHETCKKIMQEEEARPRKRDGGNFKVVCEASKILKSKGKNLYSGTQIIGTVPGVEVGDEFQYRMELNLLGIHRPSQSGIDYMKDDGGELVATSIVSSGGYNDVLDNSDVLIYTGQGGNVGKKKNNEPPKDQQLVTGNLALKNSINKKNPVRVIRGIKNTTLQSSVVAKNYVYDGLYLVEEYWEETGSHGKLVFKFKLRRIPGQPELPWKEVAKSKKSEFRDGLCNVDITEGKETLPICAVNNLDDEKPPPFIYTAKMIYPDWCRPIPPKSCGCTNGCSKSKNCACIVKNGGKIPYYDGAIVEIKPLVYECGPHCKCPPSCNMRVSQHGIKIKLEIFKTESRGWGVRSLESIPIGSFICEYAGELLEDKQAESLTGKDEYLFDLGDEDDPFTINAAQKGNIGRFINHSCSPNLYAQDVLYDHEEIRIPHIMFFALDNIPPLQELSYDYNYKIDQVYDSNGNIKKKFCYCGSAECSDLLLMMTPETPEAKLYKILTGFTGFYVLEKSSVTERRLIGKDDSDPNQIPNPIHHHHQTQNKNRTAIDNKGSGFTKYNHPQGQNHHHTVDIPTGVDHFRRRSARARSGSISSFFPSNLLSSLSSYRPVIARFLRKLLRYTLRARLICFHLRFLLLLAVPPLYIFFLVINLRIFLRLVFVIIALSFILSISLRFALPHLTSIRLFVARLLTFIPARFSSSQPSTDRVVWSIGSKPVAENNKTNSGSWVQKYGTNDMYEGEFHRGKCSGSGVYYYSMKGKYEGEWIDGKYDGYGVETWSKGSRYRGQYRLGLRHGIGVYTFYTGDVYAGEWSNGQCHGCGVYTSEDGSRYDGEFKWGVKHGLGSYHFRNGDAYAGEYFADKMHGFGVYHFANGHKYEGAWHEGRRQGLGMYTFRNGDTQAGHWEDGVLSCPTEQTIRPGSSFTISHSKVVDAVEQARKAAEKAHEVVKVEERIKRAVMAANRAANAARVAAVKAVQSQTFHRNDGDLETNYESGLEKLCMSRRSLALSLFSEPSDGTPNSYSTSSIHRVGTSSLNFPTVLTSPNSNSLPFNSILATELAEVFAVLTHFHLLDLLPKTGTISGPLTDNISTDSETM

SEQ ID NO: 58128 - protein, 116 aa, Oryza sativa
  misc_feature (48)..(48): Xaa can be any naturally occurring amino acid
MDANRRQSGIQQLLAAEQRRLSNIVHCCLGTAKTLATDLRQRNKTDGXDGTIAEYRAQMEAESQRKVAESSGDSGANVKRLEQETAHKIAQIKQQAASISPEVIHMLLRHVTTVKN

SEQ ID NO: 58129 - protein, 367 aa, Brucella suis 1330
MGFKCGIVGLPNVGKSTLFNALTKTAAAQAANYPFCTIEPNTGEVAVPDPRQNEIARIAGSKEIIPTRINFVDIAGLVRGASKGEGLGNQFLANIREVDAIVHVLRCFEDDDITHVEGRIDPVSDAQTVETELMLSDLESIERRIVQIRKRATGKDKEALAILPVMEKALELLQNGQPVRLMLKDISPEDLLTLKGLNLLTSKPVLYVCNVAEGDAANGNAFSAAVDKMAEEQGAQTVIISAAIEAEVAQLPDEEAGEYLESMGLEEPGLDRLIRAGYKLLDLITYFTAGPKETRAWTIKRGTKAPAAAGVIHTDFERGFIRAQTIAYEDYVKYNGELGAKEAGKARDEGKEYIVHDGDVMLFRFNT

SEQ ID NO: 58130 - protein, 345 aa, Mycobacterium smegmatis str. MC2 155
MEYRRVGDSGLVVSELSFGAATFGGSGDFFGAWGDTGVDAARAMVDMCLDAGVTLFDTADVYSDGASEEVLGAALRGRRDRVLISTKAALPTAPDDWGTSRSRLLRAVDTALRRLQTDHIDLFQLHAYDAYTPIDEVLHTLDTLVEQGKVRYTGVSNFSGWQLMKSLSLAERHGRTRYIAHQVYYSLIGRDYEWELMPLAAAEGVGALVWSPLGWGRLTGRIRRDTPLPQRSRLHATAAAGPPVDEDLLYAVVDELDAIAAETGRSVAQIALNWLLRRTSVSSVIIGARDEHQLRENLGAVGWQLDDDQVARLERVSSREAPYPHFPYYRQDGFARLNPPVGADR

SEQ ID NO: 58131 - protein, 508 aa, Wolbachia endosymbiont of Drosophila melanogaster
MQDFKILENLKTKALEAEKGGGSDRITKQHEKGKLTARERLSILLDESSFAEYDKFVKHHANDFGMQNANFLGDGVVIGRGTIYGRKVFVYSQDFTVFGGSLGASHAKKICKIMDMAINARVPIIGLNDSGGARIQEGVNSLAGYGEIFQRNVNASGVIPQISLIMGPCAGGAVYSPALTDFTFMVKNSSYMFITGPDVVKKVTYEDVSFEDLGGAKIHTSKTGVADFAFNNDVEMLLKMREFFTFLPANNQESPKSAPICNDVDDIDESLNTLIPTNPNTPYDMYELIEKVCDERNFFELKPDFARNIITGFGRIGGNTVGIVANQPMHLAGCLDIDSSRKAARFVRFCDAFNIPIITLIDVPGFLPGTNQEYNNIIQHGAKLLYAYAEATVPKISLITRKAYGGAYIVMNSKHLKGDINYAWPTAEIAVMGPESAVEIIFRHEKDQQTLIKEYKEKFANPFFAASYGYIDDIIVPSKTRYHFCKALELLKNKKVERIWKKHDNLPL

SEQ ID NO: 58132 - protein, 613 aa, Xanthobacter autotrophicus Py2
MPNFLPLATTPLETPLLRAIRDIHTRFTPLHDGEVASYIPELGKADPDHFGIAVATTDGHVYEAGDTAVPFTIQSVSKAIVYALALDMLGSEKVEAAIGVEPSGEAFNSIRLKADNRPFNAMVNAGAICCSGLLAEAAGDEAFELIRTTLSRFAGRELEVDDAVFQSERQTGDRNRAIAYLLRTYGGVRGDVDHILDTYFRQCSVLVTARDLAVMGASFANHGVNPVTGEMVASNYAVARTLAVMISSGMYDFAGEWIYRVGVPAKSGVGGGILAALPSQLGLGIFSPRLDAHGNSVRGLRTCSALSDAFDLHMLSRRDDVRTCIAADYDFRTVPSKPGRQPHEQSILEQRSGSIRVLELAGKLSFATMDYVTRRLTDPAGVPAFLILNLHRVSTITDAGLRLFTGLIRNQLPASTTTVIAGVEGNSPVAPQVKAMKEEGVRVRIFPTYDAAVDWAEDQIVYRHGGFSQIGIEADLSGQALLAGLSPQELADLSRLGTRVVFDAGTRIIDANEPPARVYFLVRGMVSVRSMHDVRLSTLIPGMAFGELALIDQPRSADVWADTEAVCLEISAEQFRAFQETHARAADRIMRNLAILLAGRVRMATARIDMLTG

SEQ ID NO: 58133 - protein, 820 aa, Clostridium thermocellum ATCC 27405
MKAVIMAGGEGTRLRPLTCNRPKPMVPVVNKPVMEHIIELLKKHGFTDIAVTLQYLPDMIKDYFGDGSDFGINLRYYVEDKPMGTAGSVKNAEEFLDDTFLVISGDALTDIDLGKAVEYHYSKGSMATLVLKKVDIPLEYGVVVTDENGRITRFLEKPSWGEVFSDTVNTGIYILSPEVLKYFNKNEMFDFSKDLFPMLLKENKPMYGYITDEYWCDIGDLMAYSKAHMDVLDGKVKINIPGNKIKDRVWVGEGTVIEENVVIEEPCVIGANTRIKKDSVIGSYSVLGDNNIIGERSGIKRSILWKNNVLETNTQLRGTVVCSKVNIKEGVFAFENSVIGDDTQIGKNAVIKPSIKIWPNKIVEGGTEVNSNLVWGSKFVRSIFGFRGVAGEINVDITPEYASKLGAAYGAIFKGKGKIGVSSDDSAAAKMLKMSFMSGLLSAGLKVLDFGVLHLPVARSAVRFYGADGGIHISTSSTNFGRLTVDFLDKNGSNIKREVERKIENAFQREDFSRCEGEAIKDVEVIPDYTKYYLRNIINNTRSKDFGYRIALNSLSGFILETVGNLLETFGCTVEKTSLDLRNAKTMRNGNKSAEMTYFTDMIKMGNYDLGVSIEDTSEKMMLVDNNGRIVSDDMFTALISLIVFKTVQGGTVVVPISTSSVVDKLAEQNNGKVIRTKTSPQDIMNKMLGNETKENVYEQFTLHFDAIAGLVKILDFMKSENYSLSDLVNMIPDFYVSEKEVECSWNVKGKVIRQIIQENEGQSIETLEGVKIFKDGGWVLVLPDAEQPVCRIKSESYSAEFAEELTNFYVNKVREISQK

SEQ ID NO: 58134 - protein, 112 aa, Zea mays
  misc_feature (41)..(41): Xaa can be any naturally occurring amino acid
  misc_feature (85)..(85): Xaa can be any naturally occurring amino acid
MLRSGAMELGAPGLGGVGLGTGAFGQVGPAVAAAVMRAYHXRVVDHYNNPRNVCSFYMEDPNVCTGLVGAPACCDFMKFQIRVYXDSGKIVYAWFKTFGCCSIIASLSVFTE

SEQ ID NO: 58135 - protein, 230 aa, Brassica napus
  misc_feature (202)..(202): Xaa can be any naturally occurring amino acid
MELITLMNPILALLVLLFVVPKMYNALIILVWQPFVLTRRFKKQGISGPKYRFLYGNIEEINKIKRESHVSVLDPNSNDIFPRIFPHYQQWMTLYGETFLYWNGTEPMLCISDLELVKQILSNKSGFFVKSKIRPEFFKLVGMKGLVFVEGVDWVRHRRILNPAFSIDRLKIMTKVMVECTLRILEEWSDVKREQKMEMNTXFRRLTADIIATAAFGSSYNEGIRSVLGH

SEQ ID NO: 58136 - protein, 332 aa, Glycine max
MTSAHVGAMSSSTCFPSLPRLLRPSFTKTKSSPKFSMSMSKDPVREWILSDGKAMEITKISPVGGGCINLASRYDTDAGSFFVKTNRSIGPSMFEAEALGLGAMYETGTIRVPKPYKVGPLPTGGSFIIMEFIQFGASRGYQSDLGRKLAEMHKAGKSSKGFGFDVDNTIGSTPQVNTWSSDWVQFYGEHRLGYQLKLALDQYGDRTIYDKGQRLVKSMTPLFANVVIEPCLLHGDLWSGNISSDKNGEPVILDPACYYGHSEAEFGMSWCAGFGGSFYNSYFEVMPKQPGFEERRDLYMLYHYLNHYNLFGSGYRSSAMSIIDDYLAILKA

SEQ ID NO: 58137 - protein, 475 aa, Physcomitrella patens subsp. patens
MTLPLLFLATVVWWIWQRHKANLESGLPGTFGLPFIGETLTYVAKMKSPLGNFVDEKTKRYNGAQAFKSSLFFQPTVIATEVETVKMIVAKEGRSFVSNYPSSFALLLGRFNGLNMNGENWKRLRKFVISHIMRVDLLKERMADIEDLVVRTLDSWADDEGRTIYVEDETKTIAFNITALIVLNLKPGKVSQTMQRDYYPLIEGMFSLPINLPWTIYGKATQARVRILKTLEEFLQSRTVKDDVFDNYVQLLQEELPPGSPPALKHEMGLDLLTSLLFAGHDTTAATMVFSVKYIGENPKVLAELRREHEELLKRKQPGERISWDDCKTLSFSNSIITETLRMCNISTTVFRKSLEDVHVGDYVIPKGWLVLPYFRAVHFNPSIYPDPYTFNPFRYQDAAGSKLPFFGFGGGARLCPGMDLARAELCLFLHHLVMKFESWELLGNDVVSYFPFPRLSARLPIRVKRRTPPQQPST

SEQ ID NO: 58138 - protein, 780 aa, Deinococcus radiodurans R1
MDMIRPFGTLRMTDVEIVGGKNASIGEMIQGLAQADVRVPGGFATTADAFRLFLRENQIEEKINAKLQALDVNDVNALVAAGKEIRGWVEEARLPAALEDAIRQAYGEMGDDPDVAVRSSATAEDLPEASFAGQQETFLNVRGIEEVLNHVKLVFASLYNDRAISYRVHHNFEHSEVALSAGVQRMVRTDLGVSGVAFTLDTESGFRDAVFVTSSYGLGEMVVQGAVNPDEFFVYKPALEQGKKAVLRRTRGSKQKKMIYAEAGGVKTVDVDEAEQRAFSLSDDDLTELARQCVTIEKHYGRPMDIEWGKDGRDVQIYILQARPETVQSRAGRTLERFELTGKGDVLVEGRAVGSRIGAGVVRVVKSLDQMDSVQDGDILVADMTDPDWEPVMKRASAIVTNRGGRTCHAAIIARELGIPAVVGTGNATRELHNGDEVTVSCAEGDTGYVYAGRLDFHVNRVELDAMPEVGMKIMMNVASPDRAFSFAALPNEGVGLARVEFIISNVIGIHPRALLDYPDVPADVKAQIEEKTAGYASPRDFFREKLAEGVASIAAAFAPKPVIVRLSDFKSNEYHHLIGGPAYEPTEENPMIGFRGASRYRSADFAEAFALECQAMKQVRDDMGLTNVQLMIPFVRTVAEGQRILEILAANGLTQRENDLKVIMMCEVPSNALLADQFLDLFDGFSIGSNDLTQLTLALDRDSGLVADMFDEQNEAVLALMGMAIKAAKAKGKYVGICGQGPSDHPALAQWLMDQGIDSVSLNPDSVLSTWLHLAGEQA

SEQ ID NO: 58139 - protein, 290 aa, Saccharomyces cerevisiae YJM789
MLRRQARERREYLYRKAQELQDSQLQQKRQIIKQALAQGKPLPKELAEDESLQKDFRYDQSLKEGEEADDLQVDDEYAATSGIMDPRIIVTTSRDPSTRLSQFAKEIKLLFPNAVRLNRGNYVMPNLVDACKKSGTTDLVVLHEHRGVPTSLTISHFPHGPTAQFSLHNVVMRHDIINAGNQSEVNPHLIFDNFTTALGKRVVCILKHLFNAGPKKDSERVITFANRGDFISVRQHVYVRTREGVEIAEVGPRFEMRLFELRLGTLENKDADVEWQLRRFIRTANKKDYL

SEQ ID NO: 58140 - protein, 696 aa, Physcomitrella patens subsp. patens
MATAVVHGMASAQGFSALVGGAELVQSPAPPSFSSFSGLRVRRNGEHEAQVSSSRGAAVGTLRVRAVATPVRPPTTMPPKRSKVEIIKQNSDFLRHPLKEELETEAPNVNEDAVQLIKFHGSYQQDNRELRGPGHKAYQFMLRTKNPSGIVPNRLYLVMDELADKYGIGTLRLTTRQTFQLHGVLKTDLKTVMSSIIKNLGSTLGACGDVNRNVLAPAAPYKSKEYVHAQELASKLAMLLAPQAGAYYDIWVDGEKITQDEPEDVTIARNDNSYGTNFDNSPEPIYGVQFLPRKFKIAVTVPGDNSVDVLTNDIGIVVISDEHGDVQGYNIYVGGGMGRTHRNEQTFPRLADELGYVSKDDILYVVKAIVATQRDYGRRDDRRMSRMKYVVEEWGIHKFKTVVEQYFGKHIQPFKELPPFQFQSYLGWHEQGDGNVFFGLHVENGRIKGEAKKALREVIEKFKLDVHITPNQNLILCNVRPSWKARITRALANVGLLAPKFVDPLNITAMACPALPLCPLAIAEAERGAPDILKRVRAMMDKVGLKASESLVVRITGCPNGCARPYMAELGLVGDGPNSYQIWLGGASNQTRLAETFMDRVKLDKLESVLEPVFYMWKSERHEKEGFGDFVYRQGFGACKTYIENYTGPRKPVRRGGLFLDADVHSSLAKLAADEGLTVSKFASKVLAEHLEKAQH

SEQ ID NO: 58141 - protein, 243 aa, Oryza sativa Japonica Group
MASFLAASLLIALVVSGSNVAATPSPSAVVGNGDIASTAQEMQRARYFTFVMLIRMVQEKIPHNTTFLMPNDRMLSTATIPESQVMEFLSRHSIPAPLMFDDLIKLPNATIVPTAHSSQTITITNVKHQKIYFNNIELISPDVCRVGDLFRCHGINGVIRPIVPRGKGSACPGHLAPATAAPGPASGANRSLETSSLTSPNMSSATSPSLQPAAESPQSSDTSTSQIASSYTTLILVLVFSIF

SEQ ID NO: 58142 - protein, 83 aa, Brassica napus
  misc_feature (17)..(17): Xaa can be any naturally occurring amino acid
  misc_feature (50)..(50): Xaa can be any naturally occurring amino acid
  misc_feature (71)..(71): Xaa can be any naturally occurring amino acid
LILISKEMVQRQAAWRXVGLAISAGISTPGMCASLAYFDTYRRARLPRIXQAQRDLFGAHTYERTDRPGAXHTEWTKLARKGN

SEQ ID NO: 58143 - protein, 346 aa, Thermus thermophilus
MKVAVLPGDGIGPEVTEAALKVLRALDEAEGLGLAYEVFPFGGAAIDAFGEPFPEPTRKGVEEAEAVLLGSVGGPKWDGLPRKIRPETGLLSLRKSQDLFANLRPAKVFPGLERLSPLKEEIARGVDVLIVRELTGGIYFGEPRGMSEAEAWNTERYSKPEVERVARVAFELARKRRKHVVSVDKANVLEVGEFWRKTVEEVGRGYPDVALEHQYVDAMAMHLVRSPARFDVVVTGNIFGDILSDLASVLPGSLGLLPSASLGRGTPVFEPVHGSAPDIAGKGIANPTAAILSAAMMLEHAFGLVELARKVEDAVAKALLETPPPDLGGSAGTEAFTATVTATVGI

SEQ ID NO: 58144 - protein, 343 aa, Physcomitrella patens subsp. patens
MADAVRPVSAFLTVSSRSPFFSCQPVVARPSSRSFAPRIFAARLRIMAESDPVLDWIKGDGGATKILRSAPVGGGCISTATRYDTDAGSFFVKTNWDTGPAMFEAEAAGLNAMHATGTIRVPKPLKVGPLSAYSRGSFIIMEYIEMGSSRGNQAELGRQLAEMHKTSSSEKGFGFDVDNTIGSTPQKNPWTDDWITFFRDHRLGFQLQLIKDQYGDNDLYVKGQRLMERLPTLMKDLDNVRPCLLHGDLWSGNVATDAKGSPVVLDPACYYGHNEAEFGMSWCAGFGPSFYDAYFKVMPKQPGFEQRTELYKLYHYLNHYNLFGSGYRGSCTSIINSYLAVAR

SEQ ID NO: 58145 - protein, 344 aa, Thermus thermophilus
MKVAVLPGDGIGPEVTEAALKVLRALDEAEGLGLAYEVFPFGGAAIDAFGEPFPEPTRKGVEEAEAVLLGSVGGPKWDGLPRKIRPETGLLSLRKSQDLFANLRPAKVFPGLERLSPLKEEIARGVDVLIVRELTGGIYFGEPRGMSEAEAWNTERYSKPEVERVARVAFELARKRRKHVVSVDKANVLEVGEFWRKTVEEVGRGYPDVALEHQYVDAMAMHLVRSPARFDVVVTGNIFGDILSDLASVLPGSLGLLPSASLGRGTPVFEPVHGSAPDIAGKGIANPTAAILSAAMMLEHAFGLVELARKVEDAVAKALLETPPPDLGGSAGTEAFTATVGMGI

SEQ ID NO: 58146 - protein, 429 aa, Arabidopsis thaliana
MIGAVNSVEAVITSIQGLSGSPEDLSALHDLLRGAQDSLRAEPGVNFSTLDQLDASKHSLGYLYFLEVLTCGPVSKEKAAYEIPIIARFINSCDAGQIRLASYKFVSLCKILKDHVIALGDPLRGVGPLLNAVQKLQVSSKRLTALHPEFLQLCLQAKSYKSGFSILSDDIVEIDQPRDFFLYSYYGGMICIGLKRFQKALELLYNVVTAPMHQVNAIALEAYKKYILVSLIHNGQFTNTLPKCASTAAQRSFKNYTGPYIELGNCYNDGKIGELEALVVARNAEFEEDKNLGLVKQAVSSLYKRNILRLTQKYLTLSLQDIANMVQLGNAKEAEMHVLQMIQDGQIHALINQKDGMVRFLEDPEQYKSSEMIEIMDSVIQRTIGLSKNLLAMDESLSCDPLYLGKVGRERQRYDFGDDFDTVPQKFSM

SEQ ID NO: 58147 - protein, 266 aa, Physcomitrella patens subsp. patens
MADPEQANVAAEHKLEKEMAAWRRNSQWKVDSPAIEVKVPKEAFCELRSQFKIGLPPHAVWNILIDPGNKRVFKNIKEVTSRKVLEDDGHRQLVEVDQAAIWRFLWFSGTLSVCVLVDQDRRSHLMKYRLARQGFMKQFEGSWKVDPLYVDAQGSPSSENEADRVASIVSLEQVVRPAVVPPPPFKSYVRGITTRTTEMLLQDLQAEGKRLRELSVDSSGVDLETSSSAFQDEESMDANSDQLKKLTGSRRKPRKSKWRLKEDSCP

SEQ ID NO: 58148 - protein, 452 aa, Zea mays
  misc_feature (176)..(176): Xaa can be any naturally occurring amino acid
GKVLEVLRNWPHRNIQVICVTDGERILGLGDLGSQGMGIPVGKLALYTALGGVRPSACLPITIDVGTNNEKLLNDEFYIGLRQKRATGEEYHELMEEFMAAVKQIYGEKVLIQINLLFIPKCNTVKFGQFEDFANHNAFNLLAKYSKSHLVFNDDIQGTASVVLAGLLAALKVVGXTLAEHTYLFLGAGEAGTGIAELIALEISKQTSAPIEECRKKIWLVDSKGLIVDSRKNSVQSFKKPWAHEHEPLTTLYDAVQSIKPTVLIGTSGVGRTFTKEVVEAMASFNERPIIFSLSNPTSHSECTAEEAYNWTQGRVIFASGSPFDPVEYDGKSNNAYIFPGFGLGLVISGAIRVHEDMLLAASEALAAQATQENFDKGSIFPPFTNIRKISARIAAAVAAKAYELVQTPFHTLAFTTPSLPSAGLATRLPPPRDLVKYAQSCMYTPVYRNYR

SEQ ID NO: 58149 - protein, 194 aa, Alkaliphilus metalliredigens QYMF
MALVPVVVEQTSRGERSYDIFSRLLKERIIFLGDEINDVTASLLVAQLLFLEAEDPDKDIQIYINSPGGSITAGMAIYDTMNYIKPDVSTICVGMAASMGAFLLAAGAKGKRFALPNAEVMIHQPLGGTRGQAEDIRIHAERIVKLRDTLNKILVERTGQPLERVQKDTDRDFFMEAKEAKEYGIIDEVISSRK

SEQ ID NO: 58150 - protein, 218 aa, Nocardia farcinica IFM 10152
MPGRQRRDGGNGPAGQNSNGPEGRDNRRGGGDRRGGGDRRDNAAEKNQLERVVAINRVSKVVKGGRRFSFTALVIVGDGNGLVGVGYGKAKEVPAAIQKGVEEARKGFFRVPMIGSTITHPVQGEAAAGVVMLRPASPGTGVIAGGAARAVLECAGIHDILAKSLGSDNAINVVHATVAALKQLQRPEEVAARRGLPLEDVAPAGMLRARAQAAGGAR

SEQ ID NO: 58151 - protein, 113 aa, Arabidopsis thaliana
MPEQYPHLIFNNFTTQMGQRVGNILKHIFPAPKLDAKRIVTFSNQSDYISFRNHVYDKGEGGPKSIELKEIGPRFELRLYQVKLGTVEQNEAEIEWVIRPYMNTSKKRKFIGE

SEQ ID NO: 58152 - protein, 485 aa, Fremontodendron californicum x Fremontodendron mexicanum
  misc_feature (10)..(10): Xaa can be any naturally occurring amino acid
  misc_feature (485)..(485): Xaa can be any naturally occurring amino acid
SGISTLEKEXLGRISQIIGPVLDVAFPPGKMPNIYNALVVKGRDTAGQQINVTCEVQQLLGNNRVRAVAMSATDGLMRGMEVIDTGAPLSVPVGGATLGRIFNVLGEPVDNLGPVDTRTTSPIHKPAPAFIQLDTKLSIFETGIKVVDLLAPYRRGGKIGLFGGAGVGKTVLIMELINNIAKAHGGVSVFGGVGERTREGNDLYMEMKESGVINEQNLAESKVALVYGQMNEPPGARMRVGLTALTMAEYFRDVNEQDVLLFIDNIFRFVQAGSEVSALLGRMPSAVGYQPTLSTEMGTLQERITSTKEGSIISIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFKLILSGELDGLPEQAFYLVGNIDEATAKATNLEMEX

SEQ ID NO: 58153 - protein, 487 aa, Keraudrenia hermanniifolia
  misc_feature (1)..(1): Xaa can be any naturally occurring amino acid
  misc_feature (9)..(9): Xaa can be any naturally occurring amino acid
  misc_feature (481)..(483): Xaa can be any naturally occurring amino acid
  misc_feature (487)..(487): Xaa can be any naturally occurring amino acid
XGVSTLEKXNLGRISQIIGPVLDVAFPPGKMPNIYNALVVKSRDTVGQQINVTCEVQQLLGNNRVRAVAMSATDGLMRGMEVIDTGAPLSVPVGGATLGRIFNVLGEPIDNLGPVDTRTTSPIHKPAPAFIQLDTKLSIFETGIKVVDLLAPYRRGGKIGLFGGAGVGKTVLIMELINNIAKAHGGVSVFGGVGERTREGNDLYMEMKESGVINEQNLAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFKLILSGELDGLPEQAFYLVGNIDEATAKATNXXXESKX

SEQ ID NO: 58154 - protein, 482 aa, Pterospermum celebicum
  misc_feature (6)..(6): Xaa can be any naturally occurring amino acid
  misc_feature (482)..(482): Xaa can be any naturally occurring amino acid
TLEKQXLGRISQIIGPVLDVAFPPGKMPNIYNALVVKGRDTVGQQINVTCEVQQLLGNNRVRAVAMSATDGLMRGMEVIDTGAPLSVPVGGATLGRIFNVLGEPVDNLGPVDTRTTSPIHKPAPAFIQLDTKLSIFETGIKVVDLLAPYRRGGKIGLFGGAGVGKTVLIMELINNIAKAHGGVSVFGGVGERTREGNDLYMEMKESGVINEQNLAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFKLILSGELDGLPEQAFYLVGNIDEATAKATNLEMESX

SEQ ID NO: 58155 - protein, 398 aa, Wolbachia endosymbiont of Drosophila melanogaster
MNIPSIENCDLHNKTVLLRVDFNVPIKDGEIRDVTRILRALPTIQYLVNASAKIIIISHFGRPKARDNNLSLKNVIDTLSQLLNKKVKFIDDCFGEKVQRAVSVMDAGDIILLENLRFYKEEEQSDSNFAKQLASLADIYVNDAFSCSHRAHASISRITEFLPSYAGFCLQDELKYLEKAVSFKAKPITAIVGGAKISTKIKVLMKLTEKVNYLVLGGAIANNFLSFSKVNIGKSFFQNGVDDLLHNILETANKNNCKIVVPEDVLVAVNSDYSTSISRRTESILDGDIILDIGPQTLSTISSIIASSKTLLWNGPIGVFEHSAFASGTIGVMKIVSDLTHKGKLTSIIGGGDSLSAISAAGLADKDFTYVSTGGGAFLDWLSGDEMPGVAALQKRLD

SEQ ID NO: 58156 - protein, 387 aa, Physcomitrella patens subsp. patens
MSQVSSSGIKWSFCGTSLERKAAAASKATNVAFAVRAAGYDEELVKTAKTIASPGRGILAIDESNATCGKRLASVGLENNEVNRQAYRQLLCTTPGLGEYISGAIMFEETLYQSTSDGRKMVDCLVEGGIIPGIKVDKGLVPLAGSNDESWCQGLDGLASRTAAYYKQGARFAKWRTVVSIPNGPSELAVTEAAWGLARYAAICQDTGLVPIVEPEVLLDGSHGIDTTLEVAERVWSKVFYFLAENNVLFEGILLKPSMVTPGAECPERATPEQVAEYTLKMLRRRVPPAVPGIMFLSGGQSEVEATLNLNAMNQSPNPWHVSFSYARALQNSVLKTWKGQPENLEAAQKALLVRAKANSLAQLGKYSAEGEAKEAKEGMFVKGYTY

SEQ ID NO: 58157 - protein, 482 aa, Saccharomyces cerevisiae YJM789
MSAFVRVVPRISRSSVLTRSLRLQLRCYASYPEHTIIGMPALSPTMTQGNLAAWTKKEGDQLSPGEVIAEIETDKAQMDFEFQEDGYLAKILVPEGTKDIPVNKPIAVYVEDKADVPAFKDFKLEDSGSDAKTSTKAQPAEPQAEKKQEAPAEETKTSAPEAKKSDVAAPQGRIFASPLAKTIALEKGISLKDVHGTGPRGRITKADIESYLEKSSKQSSQTSGAAAATPAAATSSTTAGSAPSPSSTASYEDVPISTMRSIIGERLLQSTQGIPSYIVSSKISVSKLLKLRQSLNATANDKYKLSINDLLVKAITVAAKRVPDANAYWLPNENVIRKFKNVDVSVAVATPTGLLTPIVKNCEAKGLSQISNEIKELVKRARINKLAPEEFQGGTICISNMGMNNAVNMFTSIINPPQSTILAIATVERVAVEDAAAENGFSFDNQVTITGTFDHRTIDGAKGAEFMKELKTVIENPLEMLL

SEQ ID NO: 58158 - protein, 464 aa, Glycine max
MSASTVSITAANPGTRRRPVIATEKKTATSLELLANDVAVSPAVATSGDGATGRDLSHHSIRGEALLDRAPRDLTPAKKVAGAGPNSASGPPRRTRKPAAKSEKPRWLTLVSIFGKNLVLLVVLAGLVQLIRRMSLKSGDAAAGGFAGFSEFEGRISDVEGLLKKTAKMIQVQVDVVDKKIEDEVRGLRKELNEKIEEKGVILESGLKKLEAKNEELEKYLSELKGENWLSKEEFEKFVEEVRSVKGSGYEGGGLDEIREFARGVIEKEIEKHAADGLGRVDYALASGGGTVVKHSEVFDLGRGNWFLKSARNGVNPNAEKMLKPSFGEPGQCFPLKDTRGFVQIRLRTAIIPEAVTLEHVAKSVAYDRSSAPKDCRVSGWLQEHNADSAIDTEKMHLLSEFTYDLEKSNAQTFNVLNSAASGVINMVRLDFTSNHGSPSHTCIYRFRVHGHEPDSVSMMALES

SEQ ID NO: 58159 - protein, 851 aa, Oryza sativa
MALLQFGGTLAPKLGEKPQLLPRSPALTRVIYADPRFLVSKSGSGGRLKHLVSPTASLQSRTSSRLFNHAPSPRFRHRRSSRFIVRADADFYSTLGVSRNASKSEIKSAYRKLARSYHPDVNKDPGAEQKFKDISNAYEVLSDDEKRSIYDKYGEAGLKGAGMGTGDYSNPFDLFESLFEGFGGMGGMGGRAARNRPMQGDDEAYNLVLNFKEAVFGVEKEIEITRLEGCNTCDGTGAKPGTKPTTCKTCGGQGQVVSSTRTPLGIFQQVSTCNTCGGTGEFSTPCNTCGGDGRVRKTKRISLKVPAGVDSGSRLRVRSEGNAGRRGGPPGDLYVFIDVLSDPVLKRDGTNILYTCKVSYIDAILGTTVKVPTVDGMVDLKIPSGTQPGTTLVMSKKGVPLLGKSNARGDQLKHQTILIVIEIDIVQNIGRQAAAAVAGGVGEKARWWWLCRRRGVAATGWAVVHGRISGWLMAVATLFAGDGPGGGGLHEGRRMMILDNFETSGRRRRQRGSRALHDLRLPNPSRLLARRPRLPSPRLPLAPISILLAEVAPASSCSRRIRILIHPIRPRPRISSPRPPLAPIPILRAEVAPGVLLLPPHRRSPEIGEKLSDIDGRLDYPLLNKELVLDVKRLWQDPAIQETYLRGSILQLPDCAQYFMENLDRLAEAGYVPTKEDVLYARVRTNGVVQIQFSPVGENKRGGEVYRLYDVGGQRNERRKWIHLFEGVNAVIFCAAISEYDQMLFEDETKNRMMETKELFDWVLKQRCFEVPLSVCEWFKDYQPIAPGKQEVEHAYEFVKKKFEELYFQSSKPDRVDRVFKIYRTTALDQKLVKKTFKLIDESMRRSREGT

SEQ ID NO: 58160 - protein, 397 aa, Zea mays
  misc_feature (168)..(168): Xaa can be any naturally occurring amino acid
  misc_feature (235)..(235): Xaa can be any naturally occurring amino acid
RLYPSTSAPSFPSPHAPRERSFRIPHRIGRVPLTEKIGLGGASVLSVVRSDAKEGTTTGVSAKDRTNTILALASPNSKPEDFNSPGHIFPLKYREGGVLKRAGHTEASVDLAMLAGLPPVAVLCEIVVDDDGFMVLLPKLQQFAKRENLKIISIADLIRYTKPRDGLXETVEASPAEVHTGPSPRRSTTRLLSALHHLSLMQGDVGDGQEILVRVHSECLTGDIFGSARCDYGNXLALAMTMIEKTGRGVVVYLRGHEGRGIGLGHKLQAYNLQDDGRDTVEANLELGLPADSREYGIGAQILRHLGARTMRLMTNNPAKYTGLKGYGLSVLGRVPLLTPITTENRRYMETKRLKMGHVYGSRSSNHANGSGLAGAGEREEQDQNDSAGVQERTPEA

SEQ ID NO: 58161 - protein, 785 aa, Oryza sativa Japonica Group
MTTLPTAILLLLLLLALPPPSAVVALTADGLALLALKAAVTDDPLSVLSSWSESDPDPCRWPGVTCSNVTAAGGEPRRRVVGVALAGKNLSGYIPSELGSLLFLRRLNLHDNRLAGGVPAALSNASSLHSLFLYGNRLTGALPAALCDIPRLQNLDVSRNALSGGLPGDLRNCRSLQRLILAGNSFSGEVPAGIWAEMASLQQLDISSNGFNGSIPADLGELPRLAGTLNLSHNRFSGVVPPELGRLPATVTLDLRFNNLSGAIPQTGSLASQGPTSFLNNPGLCGFPLQVPCRAVPPPTQSPPAPTTTTTTTTPSSASAAAAAASEHHQPIRTSLIALISIADAAGVALVGVILVYVYWKVKDRKKQGRSSTVAAGDENESRHGLCRCIWGHRGVDSDTDTDDSSASENGGGGGKYGEGELVAIDRGFRVELDELLRSSAYVLGKGGKGIVYKVVVGNGATPVAVRRLGGGGGGGERCKEFAAEARAVGRARHPNVVRLRAYYWSADEKLVVTDFVGNGNLAAAMRGRPGQTPLSWSTRLKIARGAARGLAYLHECSPRRFVHGEVKPSNILLDADFTPRVADFGLARLLAVAGCADDVVDAPPAAPSSGGLLGGAIPYAAKPASSVAADHRGGGYRAPEARTAGARPAQKWDVFSFGVVLMELLTGRGPGDHASPSTSASFSAPSSSSAATTDRSGSGEHGHGAGVGGAVVPEVVRWVRRGFEEEARPVSEMVDPALLRDAPPLPKKEVVAAFHLALACTELDADLRPRMKAVADTLDKIASS

SEQ ID NO: 58162 - protein, 589 aa, Physcomitrella patens subsp. patens
MGGCCSKSSVVEQRPQAPHRTEANGKEKEAAYQNKGRDLPVKVGGDPPEKKERDSPEHKGRDLVENTQGSPPEKKARETPDKQVGATKRPIPERKQSRISAANLKDNQSHSQPLGKRTNFGYERDFKEKYSLGKLLGHGQFGYTYVATEKATGNKVAAKCIEKKQMKLPISVEDVKREVKILRTLSGHENVVQFFAAFEDDDLVYIVMELCEGGELLDRILAKKDTRYSEKDAAKIVRQMLNVAARCHLNGVVHRDMKPENFLFKSSKDDSPLKATDFGLSDYIKPGKRFRDVVGSAYYVAPEVLNRKSGPESDVWSIGVITYILLCGRRPFWDKTEAGIFNEVLKKKPDFREKPWPSITASAQDFVKKLLRKDPHMRLTAAQALSHPWVKEGGDASDMPLDISVLSNMREFVKYSRLKQLALRALASTLESDEIRDLRDQFDAMDVDRNGTITLEEIKHALQKDRPWAVKESRVLEILQAMDSNADGMIDFDEFVAATLHVHQLEQANSAKWQQRSKAAFSKFDVDGDGFITAEELKIATGLKGSVGTLLEEADSDKDGRISLSEFQKLLHQASFGSRTNTDHNRQRT

SEQ ID NO: 58163 - protein, 541 aa, Deinococcus radiodurans R1
MSRLTDLPAWQALEDHYYELQGTHLRELFAADPERGEKMNAEGAGLYLDYSKHRVTDETLRLLRELAQATGVEARRDAMFRGEKINVTEGRAVLHTALRAPRDAVIEVDGKNVVPEVHEVLDRMATFADAVRSGEWLGYTGKPIKNIVNIGIGGSDLGPVMAYEALKHYAQRDLTVRFVSNVDGTDLTEKTRDLDPEVTLFIVSSKTFTTQETMTNARSARKWLLGSLKDDAAVTRHFVAVSTNAEEVQKFGIDTANMFGFWDWVGGRYSMDSAIGLSLMVAVGPEHFREMLAGFHDMDEHFRTAPAEQNLPMLMGLLGVWYGDFFGAESLAVLPYDQYLASFPAYLQQLDMESNGKHVTLGGEPVDYQTGPIVWGQAGTNGQHAFYQLIHQGTKLIPCDFIGFCQTLNPLPPHHDLLMANVFAQTEALAFGKTLEQVLADGVAPEVAPHRVFEGNRPTSTILADRLTPRTLGALIALYEHKVFVQGAVWDINSFDQWGVELGKVLAKKIDGELQSEGEPELQHDSSTNALIRRYRARRQG

SEQ ID NO: 58164 - protein, 1045 aa, Shewanella sp. MR-7
MSYQVLARKWRPATFEQMVGQSHVLHALTNALTQQRLHHAYLFTGTRGVGKTSLARLFAKGLNCEKGVTASPCGVCGSCVEIAQGRFVDLIEVDAASRTKVDDTRELLDNVQYRPTRGRFKVYLIDEVHMLSRSSFNALLKTLEEPPEHVKFLLATTDPQKLPVTVLSRCLQFNLKSLTQQEIGTQLQHILTQEQLPFEHEALTLLAKAANGSMRDALSLTDQAIAFGGGTVMLNQVQSMLGSIDEQHVLRLLKALTDADIGVLMQSCAQVLAYGADAQEVLRSLLELLHQITLTQFAPAAAQQSLYSAQIQAFAEQLAPEQVQLYYQILLTGRKDLPHAPDPKSGLEMALLRAVAFVPEKPVKRWQVEDAAKVSLPAQQPMSATSVSNMPAAEQVKQVEQTVNQAVAEKKTPLTAERDSQALPQAAISESIAESNESSASQAEAAEQAVSEDALVCEDALDEESTLNAALIAEQQVILSQAQSQGFGASTEVISRTEAVLISESSPELSSVSTPASNLYAEHNQAAMVDSESSGQKPSPAVLTEPVALSHDDIEDDTQASVNQSADALAPDEYSAEDFGQYDYAAAPLDAYQDDYSQFIAEEQGGFSGMEDSSLMSDSAQSIDHTDVVHESAADPKSQSFADNSASTTPPVSTATVSLEDDDILSAVLAARDSLLSDLDALSTKEDDGKKPAAEVKLKTPSQNVHTAPATKASASTPSETKTASGEAENDFELPFDDDFEVESHFEAQAGVINASLPAHVAPAPHPQFDPNDRPPWEEAPVDTLADVEPVATSYQGSETARAPQVSQTPQPIIAPQEPELATGIAHSASIPTLPTDTGAANTKTANSEETRVEQAIAPHPQRDTAAQPVTQTQTPPQSSEETQQSAPSTALTLAQSITGHPLDLHWYKLMASLEIGGRVRQLAVNSICQLQANPLPLLLKPDQKHLSAPVAIEQLEQALTAALGNPRQVEVVIGIDPTRETPLELRKRFHQELLQQARQSLMMDDNVQWLINRFGAELDQDTLVYPPELLNQRSGLIPALPEPE

SEQ ID NO: 58165 - protein, 224 aa, Haemophilus ducreyi 35000HP
MAQQPFLIAPSILSADLARLGDDVNQVLTAGADIIHFDVMDNHFVPNLTFGPMICQALRNYGITAEIDVHLMVKPVERIIPDFAKAGANYITFHPEATDHIDRTLQLIHQYGCKAGLVFNPATPLHYLDYVIDKIDMILLMGVNPGFGGQTFIPSTLTKLREVRQRIDASGKSIRLEIDGGVKIDNIAEIAAAGADTFVAGSAIFDQQNYKSVIDQMRAELSKI

SEQ ID NO: 58166 - protein, 183 aa, Shewanella sp. MR-7
MAMNTETLSLIKQSIKTIPNYPKEGILFRDVTSLLENAVAYKATIDLLVEQYRNKGFTKIVGTEARGFLFGAPLALELGIGFVPVRKPGKLPRATISQSYELEYGHDSLEIHTDAITANDKVLVVDDLLATGGTIEATVKLIRQLGGEVQDAAFVISLPDLGGEARLTALGLELVKLCEFEGE

SEQ ID NO: 58167 - protein, 208 aa, Alkaliphilus metalliredigens QYMF
MKIKTSDIVMSAVAPKQYPEEGLPEIALAGRSNVGKSSLINTILNRKKLARVSSSPGKTRTLNFYLINKEFHLVDLPGYGYARVSKGEKSSWGKMLETYLSNRPNLYEVVLLIDIRHEPSEQDQQMYQWIRHYGYGTIVVATKSDKIARSQHQKHFKMIRDTLGMSPEDRLIPISSLKKLGIEQLWGALEDIFVENELPITIEKEAPK

SEQ ID NO: 58168 - protein, 370 aa, Arabidopsis thaliana
MQKQSTTMLSDLPKDVAEEVLSKFPVTSLRRVRFTCKKLNTLSKDMSFTRKHIDKEEAKKKQSKEFHVVMMLDFRVSLFSLNLLNPNPIERLGQLVSLDGGAQVDISNIFHCEGFLLCTTKDISRVVVWNPCVGQTIWIKPRNSFNKWDRYALGYDVMKNHKVLRFVDDGEYGRRHLLCEFEIYSFESDSWEVLDVNPDWEIDFVHRGLSIDGNSYWFARDKVVPYGGQDPSYFLLCFDFTTERFRPPLPLPFQPYFGDTVALSSVGDNQIAVLCQRSSSPYTLKIWISSKVEPNAVSWNKLFLKVDMKPLTGNSFSYSGGSFFVDEEKKMAVVLDKNIGGGFDPTRNIAYIIGKEGYFKKVDLGESRHL

SEQ ID NO: 58169 - protein, 668 aa, Cryptococcus neoformans var. neoformans B-3501A
MFRGRSYMPGRRAFAVTTTTTLAVGSAYLYFRPQPVRLEDASSVYDVKRPANLSWKPPTRDQMLSHLATSGIYVNRTQESGPEIGEIKGEKKEEEDDDVFDLLIVGGGATGAGTALDAVSRGLKVACVERDDFSSGTSSKSTKLVHGGVRYLQKAIFELDYEQWKLVKEALRERRIFLDTAPHLSHMLPILLPIYTWWQLPYYYAGCKLYDVLAGKENMESAYWVGKGKALEAFPTLKKEGLVGGVVYYDGQHNDSRMNISIMMTAVQHGAVVANYTEVTELHKKADPSRNGQERIYAATVKDNLTGKTMKVRCRGVINATGPFSDGIRQLDEPSVQNIVAPSAGVHISLPNYFGSKTMGLLDPATSDGRVIFFLPWQGVIIAGTTDSPTSLSQNPIPDEKEIQWILDEVDHYLSPDVKARREDILAAWSGIRPLVKDPNSKNTESLVRNHIINTSKGGLMTIAGGKWTTYRAMAEETVDAAVKEFDLKPNGPTRTHHLKLIGGHAWSKVMYIKLLQEYGLETEVAKHLSESYGDRAWTVASFANPTGESWPKHGVRFYRRYPYIEAECRYACRCEYAQTAVDFLARRIRLSFLDIHATVVALPRVIDIMSDELGWDAKRRAEELESTIKFLQSMGLGSKSDRDYAHELSERRGERRQIPIERSAGGA

SEQ ID NO: 58170 - protein, 263 aa, Zea mays
MPSIAPPSSSVAALTRQPVQFFKGCSVSKETKGPVRSFFTANSKSTKVKSAGLKVASSFKNDGGYPAGGVSWKDDTLLPKSTTIRGQDHSVADPVLPMDSMITPEILSANVERVIDMFADDDTDTELDLDSPTEGFTSIAEAIEDIQQGKLVIVVDDESRENEGDLIMAASLVTPEAMAFIVRHGTGIVCVSMKEDDLERLSLPLMVTTKENEEKLCTAFTVTVDAKEGTTTGVSAQDRAKTVMTLASPDSKPEDLNRPGHIF

SEQ ID NO: 58171 - protein, 798 aa, Cryptococcus neoformans var. neoformans B-3501A
MFRGRSYMPGRRALVFTTATTVAVGSAYYALRPTPLHLDSQHVPLTKRRPGPLWAPPSREQMLEHLRTSGIYIHRTEEGGPEPGAVLRKDEAESEGDDVFDLLIVGGGATGAGTALDAASRGLKVACVEREDFSSGTSSKSTKLVHGGVRYLQKAIFELDYEQWKLVKEALRERRIFLETAPHLSHMLPILLPIYTWWQLPYYYAGCKLYDFLAGKENMESAYWMGKGKALEAFPMLKKDGLVGGVVYYDGQHNDSRMNISLVMTAVQHGAVVANYVEVTELHKKPDPSRGGQERICAATLKDRRTGETWKVRTRGVINATGPFSDGLRKLDEPTTQDIVAPSAGVHITLPNYYGPKTMGLLDPATSDGRVIFFLPWQGNVIAGTTDSPTKVSQNPIPDEKEIQWILDEVRNYLSPDVKVRRGDILSAWSGIRPLVKDPNSKNTESLVRNHMINTSKGGLLTIAGGKWTTYRAMAEETVDVAVKEFNLKPNGPSQTNHIKLVGGHAWSKTMYIKLIQQFGLETEVANHLSESYGDRAWTVASMAKPTGESWPFHGVRLSKLYPYIEAECRYACRCEYAQTAVDFIARRTRLSFLNVQATVETLPRVLEIMGEELGWDMKRKEQEFDDAMEFLKSMGLPQHTKLKLSDVEKSHGHIGPLGLAQKEEVALYQRAQFTPDEVTHLRTQFERFDFDHDQRITRADLIHAMTGMGYDASVELADSILREVDFGRKGEIDFQDYLDIAAGLKELQLENAFTHLTQLDSSRKEAGARDIGDHAHESSERREKRRKIPVERSGGGA

SEQ ID NO: 58172 - protein, 370 aa, Cryptococcus neoformans var. neoformans B-3501A
MPSATVIRYAIQGARKPTPNVIIPFKPTNIAKSRQLPPPHLLTLADLSPEQISSLIANAAALKFVSKNVHTTAIPKRLDRRTVALIFNKRSTRTRVASETSVEALGGHPMFLGKDDIQLGVNETLEDTAKVVGSMTDGIMARVAGHEEIETLARYSPVPVINALSDLYHPTQILADLLTLCEIYAPVPPPTEIVSGQAYSSILSYYQSALNPTKILQGKKVAWVGDTNNITNELLVTLPRFGMHFSVAAPKGYDKFDERVWSRLAESKTESLVTLTNSPAEALRDADVVVTDTWISMGQETEKAARLEAFKGYQITNKMVSEAGAKEDWKFMHCLPRKKEEVDDEVFYGPRSVVFPEAENRKWTIMAVFE

SEQ ID NO: 58173 - protein, 506 aa, Zea mays
  misc_feature (230)..(230): Xaa can be any naturally occurring amino acid
MEKERKQGFFAALKEEVVRGLSPARTRGKSPAPRSASPARMLIPRRRKAPAAPPPPPPPPEKVLQQYLGEQLVARSGSLLRPGGEALAPLIEGPDAERLAAGDPDEEDSGHREGFGHWVRGHLTRAPSMAAAGGPDGSFRRSDLRLLLGVMGAPLAPIPSKPAEPLPLLSIKGTTIESSSAQYILHQYTAASGGYKLLQSVRNAYAMGKVRMVASEFETATRVVKNRGPXSGRGAAAVEQGGFVLWQMARDMWYVELAVGGSKVHAGSNGRLVWRHTPWLGAHAAKGPVRPLRRVLQGLDPLTTAGLFAEARCVGEKKVNGEECFILKLAADPRTLKLRSEGPAEIIRHVLFGYFSQRTGLMVHIEDSHLTRIQPHAGGDAVYWETTTSSALEDYRAVEGVMVAHSGRSAVTLFRFGEAAMSHTKTRMEEAWSIEEVAFNVPGLSADCFIPPADIQSGPVGEACELPSSQSRAKAVAVHPSRVAAVDRATAAAACRGRKTTWRVEV

SEQ ID NO: 58174 - protein, 216 aa, Methanothermobacter thermautotrophicus str. Delta H
MIMNFNMEEWEPRTQLGRLVKEGVITSIDEIFEEGHPIMELEIIDALLPDLEEEVIDVNLVQRMHKSGRKVNFRVIVAVGNKDGYVGLGQGKAREVGPAIRKAVDDAKFNIIKVRRGCGDWGCVCGREHTVPFKVSGKSGSVRVTLIPAPGGVGLAIGDVGKTIMRLAGIDDVWSHTRGQTQTTVNFARATFDALKQLSKVKASEKDLKNLGVCST

SEQ ID NO: 58175 - protein, 327 aa, Brucella suis 1330
MGLLVDGKWHDVWYDTGSTQGRFERSKAQFRNWVTQDGSAGPTGEGGFKAEPGRYHLYVSYACRWAHRTLIFRALKKLEKIISVSVVDFLMAEEGWTFYGTTGSTGDALYGAKRLYEIYTRADPAYSGRVTVPVLWDKQRETIVSNESAEIIRMLNHAFNEFGDATLDFYPAALRNQIDTLNDFIYPNINNGVYRAGFATTQEAYEEAFQQVFAALDALEQKLSQQRYLAGSSLTEADWRLFTTLVRFDPVYVGHFKCNHRRLADYPNLWNYTRDLYQTPGVAETVNMEHIKGHYYRSHKTINPTGIVPAGPEIEYTAAHDRGRFTG

SEQ ID NO: 58176 - protein, 346 aa, Legionella pneumophila str. Paris
MNTAPKQYGFYMPAEWYPHERCWMAWPCHHETWSKIGLDKAKMAYARVAKAIAQFEPVTLLVNPGDEDSATNLCKGHNIEIISLPINDSWTRDTGATFLINNEKQLAGVDWIHNAWGGNYADCSLDNLIASHLIKCTEAQYFHAPLVMEGGSFHVDGEGTILTSKECLLNSNRNPHLSQQEIEQYLINYLGAERIIWLNMGLIGDETDGHIDEIATFIAPGKVLCLITKDKEDPNYHRLQENFEILKSSKDARGRTFEVYTVEQPPATYLNGERLTLSYINFYMANQGIVMPAFGYESFDRLAYQLFVQIFPGYQITQIDALDVFSGGGGIHCITQQQPKSYKLGE

SEQ ID NO: 58177 - protein, 454 aa, Wolbachia endosymbiont of Drosophila melanogaster
MPIEILMPALSPTMSKAGGKIVKWHKKEQDKVEVGDVIAEIETDKAIMEFESIDEGVLAKILVTEGTSGVPVNQPIALMLEEGEDESALNNYTSTSINSAVKKEVTKSAVDNQKSEHQDLNGKPISHSSVSFQRVTLESNPSMSSQCLTLGSRKEEWIPVSATQMTEGYAEGRTKISPLAKKIAQNEGVNVQQLKGTGPYGRIIKADVLEFLGSGIHTESPEKDTIVEVSNMRQVIAQRLTESKQNVPHFYLTVDCQVDKLISLKNEINSADENNKVTINDLIIKAAAFSMKKFPDINSSWIDNKILRYSNIDISIAVALEDGLITPIVKNADKKGILSISKEVKDLVSRARSGKLKPEEFQGGGFTISNLGMFGIKAFSAIINPPQSCIMAVGASKKQPIVMNEKIEIAEIMTVTLSVDHRAVDGALGAKFLNAFKHYIENPLVMLIETAVIY

SEQ ID NO: 58178 - protein, 297 aa, Mycobacterium smegmatis str. MC2 155
MHEYLRAAELRGRRAALRGMVSRQIPALAAVPATRFAMAVATVDGAEACIGEASTAFSIQSLSKLFALCALLRHEPDVWTDVGWVPTDAGYGSVADLERNHWRPRNPFVNSGALVVTDRLMTHAGDAVGATIEVLQAGDPDAPVRSDPAVALSESEADHRNSAIAHVLAEHGRLVNDIDRVLPQYFAQCAIAASVRTIARAALFLADRTGERTVLDDDSVRRVNAVLLTSGMYGAAGDIAYRIGLPAKSGIGGGVLAVMPGHGTVCVWSPPLDDDGNSAGGVAAIEEFARLAGWSVF

SEQ ID NO: 58179 - protein, 464 aa, Fagus grandifolia
  misc_feature (464)..(464): Xaa can be any naturally occurring amino acid
VSALEKKNLGRIAQIIGPVLDVAFPPGKMPNIYNALVVKGRDTAGQQMNVTCEVQQLLGNNRVRAVAMSATDGLTRGMGVIDTGAPLSVPVGGATLGRIFNVLGEPVDNLGPVDTRTTSPIHRSAPAFIQLDTKLSIFETGIKVVDLLAPYRRGGKIGLFGGAGVGKTVLIMELINNIAKAHGGVSVFGGVGERTREGNDLYMEMKESGVINEQNIAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLASKGIYPAVDPLDSTSTMLQPRIVGEEHYETAQRVKQTLQRYKELQDIIAILGLDELSEEDRLTVARARKIERFLSQPFFVAEVFTGSPGKYVGLVETIRGFQLILSGELDGLPEQAFX

SEQ ID NO: 58180 - protein, 350 aa, Citrus unshiu
MADNHNPTSGAGSKDLSASMDGGSGAYDRLVVCFGEMLIDFVPTVGGVSLAEAPAFKKLLCAPANVAVGISRLGGSSAFVGKLGDDEFGYMLANILKENNVDTSGVRYDSTARTALAFVTLRADGEREFLFFRHPSADMLLCESELDKNLIKQGSIFHYGSISLIAEPCRSTQLAAMNLAKESGSILSYDPNLRLPLWPSEEAAREGIMSIWDQADIIKVSDDEITFLTGGDDHNDDHVVLEKLFHPNLKLLIVTEGSKGCRYYTKEFKGRVPGVKTKAVDTTGAGDSFVSGILNCLAADQNLIKDENRLREALLFANACGALTVTERGAIPALPTKEAALKLLHTVAAL

SEQ ID NO: 58181 - protein, 181 aa, Halobacterium sp. NRC-1
MTVEIANIVGSGDLGVELDVEPLEADLSTPYSEYDPSNYHGLYVRLEENGPLITVYRSGKYIITGCASMESLHETNEEFLGMLADLGVTEEDTQTGFTVENVVCTAMLDELVSLNALAIGLGLEVTEYEPEQFPGLVYRPEEIGAVLLVFANGKMVITGAKDTETAESAYEYFQSKVQELV

SEQ ID NO: 58182 - protein, 502 aa, Xylella fastidiosa 9a5c
MHNGFDALQLHANRLRGVTIPDLLAAELKRPEQYARQVGPLYFNFARQKYDCVALEALFALARNHNVAGAFQRMFCGEQVNVTEGRAVLHTALRGDLSGTSVAVAAYTAAAKVRERMYALIAGLDASEVTDIISVGIGGSDLGPRLVVDALRPISQGRFRVHFVSNVDGAAMRRTLDMLDPSRTAGILISKTFGTQETLLNGRILYDWLGGSERLYAVSANPERAAHAFDIVPTQVLPIWDWVGGRYSLWSAVGFPIALAIGSQRFEELLAGAAEFDAYALRVPLEENVAVLHGLTAVWNRNFLGCATYAVMAYDQRLALLPAYLQQLVMESLGKRVKCDGTPVDRDTVPVWWGGVGTDVQHSFFQALHQGTNIVPADFIGTIRNDDPYTENHFALNANLLAQIEVLANGQLSDDPHRVYPGGNPSTLILLDALTPQALGGLIAMYEHSVYVQSVIWGINAFDQFGVELGKHLAVQLLPALKGESVEVVDPVTRAVLVRLRG

SEQ ID NO: 58183 - protein, 275 aa, Pseudoalteromonas tunicata D2
MSLTVVITGASKGVGAACAKIYAAQGANLVLVARGLSALEQLAHDLKQQYPNSQILTLGADIAKLDDCQTIISAAVKRFGKINVLINNAGLHHRGEFSAQSADQMAAMVDVNLRAPIYLCALALPHMPKPTTADHQNAIVMVGSLAGRAPLQGAATYSATKAGLRAFTYALHDELIQKNINVAVVSPGPIDTAFIMEEIDVVEDIVYSQPMSTPEQVAENVLTLSKSIRTEIAMPWFSGKLTTLGYLLPSFRRATRGLLYKIGKKNKQKYRNRID

SEQ ID NO: 58184 - protein, 382 aa, Vibrio sp. Ex25
MTVEIKPGQTHIKSKAMVAWAAGEPLKMEEVDVQLPKAGEVLVRIVATGVCHTDAFTLSGDDPEGIFPSILGHEGGGIVEMVGEGVTSVEVGDHVIPLYTAECGECKFCKSGKTNLCQAVRETQGKGLMPDGTSRFSINGETIFHYMGCSTFSEYTVLPEISLAKVNKDAPLEEVCLLGCGVTTGMGAVMNTAKVEKGDTVAIFGLGGIGLSAIIGARMVGASRIIGIDINESKFDLAKQLGATDVINPQKFDKPIQEVIVEMTDGGVDYSFECIGNVNVMRQALECCHKGWGESVIIGVAGAGQEISTRPFQLVTGRVWRGSAFGGVKGRSELPEIVNRYMAGEFGLQEFITHTMGLADVNKAFDLMHEGKSIRTVIHMDQ

SEQ ID NO: 58185 - protein, 356 aa, Physcomitrella patens subsp. patens
MVRADLVNLADLDIALNRVHSKLPNSAEAASAEPPGPVEEWEINPREITLKHMIARGTFGTVHKGVYNGQDVAVKLLEWGEENTMKKSEVQYYRNQFRQEVAVWHKLDHPNVTKFIGASMGNSDLRIPSAVDGDDGFHHVPNNACCVVVEFLAGGTLKDFLIRHRRRKLSYKVVVELALDVARGLAYLHSQKIAHRDVKTENMLLDKQRRVKIADFGVARVEASNPKDMTGDTGTPGYMAPEILDGKPYNKKCDVYSFGICLWEVYCCDMPYLNLSFADMTSAVVHQNLRPEMPKCCPSGLADIMKRCWDANPEKRPAMADVVKMLEALDTSRGGGMIPADAQPHGCLCFGRYKGP

SEQ ID NO: 58186 - protein, 305 aa, Medicago sativa
PYGSGVWSKKEWVLPEIDDDDIVSAFEGNSNLFWAERFGKQFLGMSDLWVKHCGISHTGSFKDLGMTVLVSQVNRLRKMNRPVVGVGCASTGDTSAALSAYCASAGIPSIVFLPANRISIAQLVQPIANGAFVLSIDTDFDGCMQLIREVTAELPIHLANSLNSLRLEGQKTAAIEILQQFDWQVPDWVIVPGGNLGNIYAFYKGFHICRELGLVDRIPRLVCAQAANANPLYLYFKSGWKEFKAVRAQTTFASAIQIGDPVSIDRAVHALKNCNGIVEEATEEELMDAMAQADSTGMFTCPHTG

SEQ ID NO: 58187 - protein, 283 aa, Aspergillus nidulans FGSC A4
MPALQSSKLAFIGGGNMASAIIGGLLSQGINKQNITVSEPWEVNRNKIADLGVKTTTSNVVAGGEADLVIIAVKPQVTKAVCEELADAWSKRETLPVVVSIAAGITLGSLQQWLKTSDGRTTHLVRVMPNTPALVGEGASGLFASADVTAEEKELVNALLGSVSKATEWVDKEELIDVVTGLSGSGPAYFFAMVEHLIASATALGLPAEQATRLAAQTCLGAGKMLTESSDSPTQLRKNVTSPNGTTHAALETFNAQHFDQVVDKAVKAATSRAAELGNTLGK

SEQ ID NO: 58188 - protein, 391 aa, Rhizopus stolonifer
MVSFISITQGVSLCLLVSSMMMGSSAVPVSGKTGASSDAVSTSGNFTLPPIISSRCAPPSGKGSSSDLQSEPYFVKKNTEWYTAHGGDLAAIGKRDDNQVGGMTLDLPENAPPIASSYSLDSVSDSSVVAATAAQVQELTKYAGVAATAYCRSVVPGNKWDCKQCLKWVPDGKIITTFTSILSDTNGYVLRSDKQKTIYLVFRGTNSFRSAITDIVFNFSNYKPVSGAKVHTGFLSSYEQVVNDYFPVIQAQLTANPSYQVIVTGHSLGGAQALLAGMDLYQREKRLSPKNLSIFTIGGPRVENPTFAYYVESTGIPFHRTVHKRDIVPHVPPQAMGFLHPGVESWIKSGDSNVQICNSQIETKACSNSIVPFTSIADHLSYFGINEGSCL

SEQ ID NO: 58189 - protein, 141 aa, Cicer arietinum
RDIISGPFEKLIRGSKIRELSGPEYSRKVMENCVAHLKSIGTYGDEEVEAMQKFAEAFKNVNFPPGASVFYRQSPDGVLGLSFSKDASIPEKEDAVIENKAVSSAVLETMIGEHAVSPDLKRCLAARLPALFDQGTFSIGN

SEQ ID NO: 58190 - protein, 197 aa, Saccharomyces cerevisiae YJM789; identical to SEQ ID NO: 1163

SEQ ID NO: 58191 - protein, 77 aa, Haemophilus ducreyi 35000HP
MSIEERVKKIIVDQLGVKAEDVKPEASFIEDLGADSLDTVELVMALEEEFDIEIPDEEAEKITTVQSAIDYVAKANA

SEQ ID NO: 58192 - protein, 580 aa, Aspergillus nidulans FGSC A4
MHAIYGSLALLLGLAVSSRASTVRHDHSFQPDHILRVTADIYNEACSERYSVLVNGSSPGPELRLREGEVSWIRVYNDMTDANTTIHWHGLTAFTAPFSDGSPAASQWPIPPGHFFDYEVKPEPGSAGSYFYHSHVDFQSVTAKGPLIVDSSEPAPYHYDEERTVMISDYFSEPDDEIVDGLVSTNFTWSGETEAILVNGQSRPATNATGACKLAAISVEAGKTYRLRFIGATALSFVSLAIESHHMHIIEADGHYTKPLETDFLQIGSGQRYSVLLTAKGEDELKALDRRQFYLQITTLERPAVLTSFAVLDYTSDAAPDLTTVPSPPPLPVATTVQGWLDYELEPAHPNEDFPTLDEVTRRIVIDVHQNVSDRTIWLQNGYDWVESFPKSPYLVDIYQDRLDLDASYHRALTRGNGFDNITRTFPARVGEVLEIVWQNRGTVENGGVDAHPFHAHGRHFYDIGGGDGLYNATANEIRLRGTHPIQRDTSVLYRYRSKTSQLVPSGWRAWRIRVTNPGVWMYHCHVLQHMIMGMQTVFTFGDREDILAKTGQVDDGYLTYGGSAYGNGTWDPMVQDFDV

SEQ ID NO: 58193 - protein, 96 aa, Magnetospirillum magnetotacticum MS-1
VDDIVDSGGTLVNAAEALLNAGAKDVSAYITHGVLSGGAVSRIAASRMKELVITDSILPTQAVKLARNIRVISIAPLLGEAIGRTATESSVSSLFT

SEQ ID NO: 58194 - protein, 158 aa, Prochlorococcus marinus str. NATL1A
MATIEGTFEKSSSLKVAIVIARFNDLITNKLLSGCLDCLSRHGIDVSESSNQIDVAWVPGSFELPIISQELARTGKYEVLITLGAVIRGDTPHFDVVVSEASKGIATVSRETGVPIIFGVLTTDTMQQALERAGIKNNLGWSYALQALEMGSLMKAVT

SEQ ID NO: 58195 - protein, 262 aa, Glycine max
MSQEQLKKPQGEQDPIKYGDVFKVSDELAFKPIAPRDAALMQATENQALGQTQKGGPASVMQSAATENLRAGVVGRQDISDVARNEGVSVTETKVGCHRVITEFVGRHVVGQFVEPDVPMNTPGTALERDAITIGEALEASAIAGASDKPVDESDAAAIQAAEMRATGKNETEPGGLGARAQSAATRNTRTVSHSHKTTLSDVLTDAKEKLPADKAVTREDAEGVIGAELRNKLDMRTTPGGVAASMAAAATLNQNRQVTDA

SEQ ID NO: 58196 - protein, 120 aa, Arabidopsis thaliana
MFKKALELSTLCNIEVCVIYYGRDGELFKTWPEDESKVRDMAERFTKLNERERRKKRTNLSLFLRKKILDDNKLSGKVLEMKDSLERGLRVLQDKLLLLQPENQTKSLTRSVSSLDYVFV

SEQ ID NO: 58197 - protein, 118 aa, Glycine max
RADNRHPNNEGAGLFFNQSKPKSEQPTPPEIPGFFFGWTVDGFPLGHGSVVGQPMGRAPGNSSICACLGQTDHFCRSDFEVGFFGRGAPWVLFGSNVEGLDIVLGTFANHCLPYFGRI

SEQ ID NO: 58198 - protein, 392 aa, uncultured bacterium pCosFS1
MSVTDSDLEFDQRHIWHPYTSMSHPLPCYPVEAASGVELQLADGRRLIDGMSSWWAAIHGYNHPQLNLAATQQLEKMSHVMFGGITHPAANELCRKVVAMTPEALQCVFLADSGSVAVEVSLKMALQYWQARGERRQRILTLRHGYHGDTFGAMSVCDPDNSMHSLYQGYLAPHLFATAPQCGFDQAWDENDIAPFAALLEQHAGEVAAVILEPVVQGAGGMRIYHPTYLERVRELCDRYQVLLIADEIATGFGRTGKLFACEHAEVVPDILCLGKALTGGYMTLSATLTTRHVAETISNGAAGCFMHGPTFMGNPLACAVANASLSLLAENRWQQQVAAIETQLKQQLLPLKMQPKVADVRVLGAIGVVEMREPVDMAQLQRGFVERGVWI

SEQ ID NO: 58199 - protein, 205 aa, Arabidopsis thaliana
MGKAVIVATNMLESMIVHPTPTRAEVSDIAIAVREGADAVMLSGETAHGKFPLKAAGVMHTVALRTEATITSGEMPPNLGQAFKNHMSEMFAYHATMMSNTLGTSTVVFTRTGFMAILLSHYRPSGTIYAFTNEKKIQQRLALYQGVCPIYMEFTDDAEETFANALATLLKQGMVKKGEEIAIVQSGTQPIWRSQSTHNIQVRKV

SEQ ID NO: 58200 - protein, 139 aa, Wolbachia endosymbiont of Drosophila melanogaster
MAIERTLSILKPDAVKNNITGNINSYIEQSGLKITAQKMMLLTKKQAELFYEIHKDRPFFGELVEFMTSGSVVVQVLVGENAVSKYRQIMGATDPKQADKGTIRGDFADDISENRVHGSDSLENARKEIAFFFAECELV

SEQ ID NO: 58201 - protein, 335 aa, Wolbachia endosymbiont of Drosophila melanogaster
MLDETTKNLLIVEVNKLLPENSENKLISAMRYILLAPAKHIRSFLVVASSRVFNAEAKKVISVAAAIEFVHAYSLIHDDLPCMDNSDTRRSQLSCHKKFDEATAVLAGDALLTLAFEVLSSLNEKRCEIIKVLSQAIGIRGMVGGQALDINSEHIDFSPQPSVIQVADTGIQKALPTSISCKKPCDSGAEHEMDSSVSYLHDTLSTLKLQHSYDCMYDAGMTSGQADKIKEIHLMKTAKLFAASCEIGAIIGGATDKQRKALYNYGINLGLIFQAKDDIEDYEQDKTNNLMSVLGKSEVEDYIDGLFKQGLDNLSALSGDTNYLYDLLNQVKKDG

SEQ ID NO: 58202 - protein, 710 aa, Arabidopsis thaliana
MATIAVNLPIHEHPLFPSARCIIGECDGCHVNGFMYGGYFCNEPYCYIWFHKECAEAPVEISHSSHPQHPLLLTNDSRDGPCDLCGQKLLPPCYSCSTCEFKVDLTCGMKPSPPAIEHPLCHHHPVVFLKIREEKVPCELCKESIDGPSYSCLECDVYFHVNCVHLSEEVNHPCHSIHPLKLITSESLTDDAEKSCLLCGNIPAENMLYHCSVCNFTSCLGCTKNPPLLVIEHMKTHKHPLTLLPRRISCICDVCGKKCQFTAYVCLQCDFVTARKCIDRPRVININRHDHRIYLTHHLGTGYSECGVCHKNVSQYKGAYSCSVCPNYAVHSTCAVRTDVWDGVELEGTTEITEDISPFKVVGDNLICHFSHEEHQLKLHKEDVIHDERRRCEACIHPVQFGSIYVCEEEECCFVLHEKCANLPMKKRLVFGTRPYTLMKETTEITHCELCGILSDGFAYSSHEWSDVDVHCGSLNEPLVHDGHIHPLYFAKKEEHTCDGCQKSIEDYMLRCKACDFDLCLYCATLPEKIWHRNDGHPLTLCCGEKEEASGKYWCDICEKELDPSIWFYTCYDCGVTLHAQCVLGDFSRLVLGQIYSFGEKEIEFEAVPNNINTRPFCIQCNSRCKVSVILKILKDSEDGSDDGSDDVSDDVSDDPSNDVSDDTSDDDSDVVSDVVSDDASNDDSDDTSDDHNGYICSRSCLSSYLGEEI

SEQ ID NO: 58203 - protein, 535 aa, Burkholderia sp. 383
MPIIESKLNPRSEDFRANAAALEAVVADLRAKIEQLAQGGGQAARDKHLSRGKLLPRDRIAQLLDPGAPFLEFSQLAANGMYNDDAPGAGVITGIGRIAGRECVIVCNDATVKGGTYYPVTVKKHVRAQEIAAENRLPCVYLVDSGGANLPNQDDVFPDRDHFGRIFFNQATMSAAGIAQIAVVMGSCTAGGAYVPAMSDESIIVKEQGTIFLGGPPLVKAATGEEVSAEDLGGGDVHTRLSGVADHLAQNDAHALSIARNIVDHLAPKIASPVALREPKPPRFDAKSLYGVIPVDTRKPFDVREVIARIVDDSEFDEFKARYGTTLVTGFAHIWGHPVGIVANNGILFSESAVKGAHFIELCCQRKIPLVFLQNITGFMVGRKYENEGIARHGAKMVTAVSNAKVPKFTVIIGGSFGAGNYGMCGRAFGPRFLWMWPNARISVMGGEQAASVLATVRRDGIEAKGGSWSAEEEDAFKQPIRDQYERQGHPYYASARLWDDGVIDPAQTRDVLGLGLAASMNAPIEDTRFGVFRM

SEQ ID NO: 58204 - protein, 238 aa, Triticum aestivum
MAPSQEVAAATKEPSTNGNGTQAAAAPKTKTPALNERILSSITRRSVAAHPWHDLEIGPDAPTIFNCVIEIPKGSKVKYELDKKTGLIKVDRVLYSSVVYPHNYGFIPRTLCDDSDPIDVLVIMQEPVVPGCFLRAKAIGLMPMIDQGEADDKIIAVCADDPEYRHFNDIKELPPHRLAEIRRFFEDCESLMPLIRSDKKNENKEVAVNDFLPSEDAYEAIQHSMDLYATYICEGLRR

SEQ ID NO: 58205 - protein, 299 aa, Zea mays
MAEHLASIFGTEKDRVNCPFYFKIGACRHGDRCSRLHNRPTISPTLVLANMYQRPDMITPGVDAQGQPIDPEKMQEHFEDFYEDIYEELGKFGEIENLNVCDNLADHMIGNVYVQFREEEQAAAAYNALQGRFYSGRPIIVEYSPVTDFREATCRQFEENSCNRGGYCNFMHVKQIGRDLRRKLYGRSASRRYHGRSRSRSPPPQRRGHRDRDDYRGGGGGGRGRGSRYDRYDDGAGRGGRHDRYDDGAGRGGRHDRYDDGGRRRHGSPPRRARSPVRESSEERRAKIEQWNREREGKQ

SEQ ID NO: 58206 - protein, 588 aa, Prochlorococcus marinus str. NATL1A
MALLVQKFGGTSLGSIERIKAVAQRIKSSKEKGADLVVVVSAMGHQTDELTRLASEITVDPPHREMDMLLSTGEQVSISLLTMALNELGTPAISLTGTQAGIITESAHGRARILEIRTERIKNLLDQGQTIVIAGFQGTTLGIGGIAEITTLGRGGSDTSAVALAASLEAATCEIYTDVPGVLTTDPRIVKNAKLMKSISCDEMLELASLGAAVLHPRAVEIARNFGVTLVVKSSWDNLDGTTLTSNKKPDFSQGGIEHQSPVDGLELLENQAVVALSNIPDRPGIAAELFESLSEGGVNVDLIIQATHQIDSNDITFTIAENELHNALTQCKKLVNTIGGDISFQKDLTKLSIYGAGIMGRPGIASSLFQILSDSGINIRLIATSEVKVSCVIDAELGKKALRNVSEVFKLTDKQITVNPTIENNNEPEVRGIALDKDQIQISVKNVPDKPGTASSICSTLAEKNISLDTIVQSERKHKDKTKDISFTLKKNDRSDAKYALKELIENWKGAKLEEGESIVRISAVGSGMPFTKGTAGKIFRALANQKINIEMIATSEIRTTCIISEKYGEKALNEIHSCFKLGKNKS

SEQ ID NO: 58207 - protein, 231 aa, Zea mays
MAGGGSDEVKLLGMWASPFVLCVQLALSLKGVGYEYVEEDLKSKSELLLKSNPVLQKVPVLIHDGKPVCESSVILQYIDEAFAGVGPSLLPEEPHGRAVARFWAAYIDGTLVKASSQASMAKTEEEKAEGKKQVTAAVETLEGALRDCSNGKPFFGGDTAGYVDVMLGGLLAWVHAGDKMKGVKTFDPATTPLLAAWADNFGSLDAVEAVMPDVGKLVEFGMAMHARAAAA

SEQ ID NO: 58208 - protein, 445 aa, Physcomitrella patens subsp. patens
GVAGGTASGKTTVCDMIIQQLHDHRVVLVNQDSFYRGLTAEEKAKVGEYNFDHPDAFDTEQLLECLENLKANLPINIPEYDFKRHQRCTDKFRKVNASDVIIVEGILIFHDARVREYMNMKIFVDTDADVRLARRIRRDTLERGRDVNGYGKFVKPAFDDFVLPTKKYADVILPRGGDNHVAIDLIVQHIRTKLGQHDLRKIYPNVFVIQSTFQVRGMHTLIRDQETQKHDFVFYADRLIRLVVEHGLGHLPFTEKQVITPTGSIYVGVDFCKQLCGVSIIRSGESMENALRACCKGIKIGKILIHREGDNGQQLIYEKLPRDIADRHVLLMDPILGTGNSAIQAILLLLQKGVPESHIIFLNLISAPEGIHAVCKKFPLLKIVTTEIDAGLNDEFRVVPGMGEFGDRYFGTDDDGPERMYRVPIETKPSQAQCTPLKSLSNGKC

SEQ ID NO: 58209 - protein, 423 aa, Yarrowia lipolytica CLIB122
MSPTAEQIAWLFVSQYFKRLHSDPSELHHFYDVDAKLLHGKEQDDTAAISGTESIQERISQLHTKGCKTLISCLDAMEGPNKSILIQIIGQMSSTDDGVPQKFVQSVVLESKSGTNYSIYSDVFRFLKDDDEEVAKEDVKEEPKEDVKEEPKKEVEAKKEPKKEEPKKEETKKEEPKKEEALKKEEPKKDEPKKEAPVAAPVATPATPVAASSSSAASAAPETKEEPKKETAAAAPPAAATSAPAEPTKPSGPISWAARARSSDKPAPAGSATPAETPSPVAAAAVAKKEPSSSPTVAAATTSSASSAAGNRKGTFHSAYIKGVDGNTDLAVVEAALKKIGNGISHFEVTKSRNSVFVDFNDAQTLRKALELRELKVGDLTIIIDERKRRKPGSGSGTSNGGGSGSGSSGNRDSNKRQGTKRR

SEQ ID NO: 58210 - protein, 317 aa, Kluyveromyces lactis NRRL Y-1140
MSVDIRNRTIEFQKRCAIISKKNKANNASVASNNSIPNKSEFQKKASEIAHEIANTAVQLGKLSQLAKRKPLLNDNPVEIMELTFLIKRRIYTIENEIMELNKLQIGTKQHKQNVMTLLNTKMKNISGNFKDVLETRQKLELENQDRLERLTHVGGSDNKDSTNNTSSLVPAGASSNIIGHGYNNVNPFISNLIDDETNNTSSSANNGLTLPANGNLLLLEEQQDQRYLQERSNAIETIESTIQEVGNLFQQLAHMVQEQGETIQRIDDNVGDIEMNIHGAQRELLKYFDNISNNRWMAVKIFAIIFVFFLLWVLVN

SEQ ID NO: 58211 - protein, 541 aa, Magnaporthe grisea 70-15
MAHSTVSLALAAVGIFTLYLISKVILKTWQNATEARRLGCKPPASFPSWCPFGLDIVRKLIISRRQMRTPEWLREQLAKTSTPANPNNLTCSFQIVHTSGILTADEVNVHAMLSKQFDDFEVGQTRREIARPLVGESIFTTDGHAWKMLRGLVRPSFARHQVGDLELDEKHFKNMMACLETGSDGWTGNIDLQTLMFRYSLDSSTEFLCGASVGSQLKELQLQNGKVTDDEDEIDFASALDRAMEGLATRGQFFKCGPYIWPRGFEKACRDCHAFIDKYVARRQNKTLAAAEKQPPAESPPAAKEKYIFLDALAESFPDPVELRHQILGVLFAGRDTTASLISWVFYNLARDPARCHKLRRAVLEHFGGPREEEEEDPGRAVTFESLKECRYLQHVINETARLCPVVPVNSRRARRNTTLPRGGGPDGQSKVFVKEGTLVYFAPYIMGRRKELWGEDAERFVPERWEGKRHGWEFIPFSGGPRICPGQQSALTKTAYVIVRLLQRFDRIESWDPEVDVKHDATATMCSGTGVKVRLHADGF

SEQ ID NO: 58212 - protein, 484 aa, Campylobacter lari RM2100
MQGFISQVLGPVVDVEFKDYLPQINEAIVVNYELEGKECKLVLEVAAHLGDNKVRTIAMDMTDGLVRGLTAVATGNPISVPVGEKVLGRIFNVTGDLIDEGEEINFDKHWSIHRDPPPFEEQSTKSEIFETGIKVVDLLAPYAKGGKVGLFGGAGVGKTVIIMELIHNVAFKHSGYSVFAGVGERTREGNDLYNEMKESNVLDKVALCYGQMNEPPGARNRIALTGLTMAEYFRDEMGLDVLMFIDNIFRFSQSGSEMSALLGRIPSAVGYQPTLASEMGKFQERITSTKKGSITSVQAVYVPADDLTDPAPATVFAHLDATTVLNRSIAEKGIYPAVDPLDSTSRMLDPQIIGEEHYKVARGVQSVLQKYKDLQDIIAILGMDELSEEDKLIVERARKIEKFLSQPFFVAEVFTGSPGKYISLEDTIAGFKGILEGKYDDLPENAFYMVGNIDEAIAKAETLKEVSRKDVCLDNCKVDKAKKG

SEQ ID NO: 58213 - protein, 344 aa, Physcomitrella patens subsp. patens
MGKLQKGRVADLSRTLQKVTTSLNETFALLNEPAPAESVKGDWSEIQKSADLVFKHSTTIGLLWTQGPKVDEAAQAMKTFAESLQGLILLCHGHTVGAGPTLSLTIRNAVKVVLDAGLSLLTRAVSFSVKGSSREEREGAIPALVGCVWESCNALKRMPSTNRAAIGRSLAQVATSVKDVLREIGEMREGKPVDQADDCGCGHSHDDSSIESLEFNDDLSPEEMEVVDATKGVVTSVLDFVKQLLYVAADRQQGDDESATAYLENILSHCKSLGVEADEFGASLYPPQEINQLRDRITKSSALIESIKEEVKATKGTVPEGLELASVAVKDAQAQLTQCLGGLS

SEQ ID NO: 58214 - protein, 139 aa, Physcomitrella patens subsp. patens
SATSARFGDVYVASVPLRAPKLAQEIFEAVKDLEMFSEFQHFMTIVKPVGNGDLPCTVLDFQPQNPEDPMTVLSVLIGNSIPGVILERTLSRLPNQRCWWVGEMKPGLSLEDAVKFSRGYSSELSLGINDCRHHTLGII

SEQ ID NO: 58215 - protein, 430 aa, Blastopirellula marina DSM 3645
MRNVISLVLGGGRGTRLYPLTKYRSKPAVPLAGKYRLIDIPLSNCINSDLNRIYVLTQFLSVSLHRHIRQTYRFDNFRGGFVELLAAQQTGNESTDWYQGTADAVRKNLKYIQQYGTDYVLILAGDQLYRMDYRKMLETHIKSGADVTIAGIPVTREDAGSLGIMRLDDSGRVVGFVEKPQTEEDLNLVRMAPDKLEALGVKSQGRDCLASMGIYLFNRDTLVDVLEKTDYEDFGREIFPAAIRSRHVQLHAFDDYWEDIGTIRAFYEANLSLANPNPPFSFSDEDEPIYSRARFLPPTLMSEVTIKRSQIADGCRIGAGCVIDNSVVGLRSLIGENVTIKDSVLMGSDYFETEGELADHRSCKRPPLGIGSGSVIQGAIIDKNCNIGKNVRIVNDHGIEDKEYDVGVTVVEGIPCVEKGAQIPDGWTLT

SEQ ID NO: 58216 - protein, 185 aa, Blastopirellula marina DSM 3645
MTHSWHDVSPGHRMPTEFCAVIEIPTGCSLKYELDKQTGLLRMDRILYSAVHYPANYGFIPQTLADDDDPLDVLVLCQEPVYPLTLIEARVVGLMTMIDSGKLDHKIIAVAVNDPEYSSYREAVDLPSHRRNMLRRFFQDYKQLEGKTVEVDEMQPTEMAIPVIEEALQRYSEQRRRGFDVKPSS

SEQ ID NO: 58217 - protein, 144 aa, Zea mays
MYQAIPYSAGQPWPRPAPTIGPDVAEEEGLLAASQQQASTPAEAAARVEEEEVRRAVAECPVLVVGVRGCCLSHVVKRLLQGLGVNPAVHEVAGAEADLAAAGVAALPAVFVGGRLLGGLDRLMAAHISGDLVPILKDAGALWL

SEQ ID NO: 58218 - protein, 265 aa, Blastopirellula marina DSM 3645
MLDGRRNLRLVDTDRDAMRIAGKFNAQLMDFIRPHVQAGITTGEIDRLIHEYTLDHGHVPACLGYHGFPKSSCTSVNEVICHGIPGSYELKDGDIVNVDITSIVDGWHGDQSETILIGEVSDEARSVTQCAFDAMHAAIAAITPECCVAIIGRAVVAEAKKHGYGVVEEYVGHALGRRFHQEPSIPHVPTRATHNVFLMPGVCFTIEPMINLGTHETVLDRRDGWTVRTKDNKLSAQFEHTILMTETGPEILTLTQNGPQIGHQF

SEQ ID NO: 58219 - protein, 416 aa, Methanothermobacter thermautotrophicus str. Delta H [sequence omitted]

SEQ ID NO: 58220 - protein, 295 aa, Haemophilus influenzae Rd KW20
MGHFSEELQQVQTRINRFLEAQFEGIESHNAPLLEAMKYALLLGGKRVRPFLVYATGQMLGAEKQTLDYAAAAIEAIHAYSLIHDDLPAMDDDNLRRGHPTCHIQFDEATAILAGDALQSFAFEILTKTPNISTEQKLALIQILAQGAGVQGMCLGQSLDLISEHKQISLSELELIHRNKTGALLIAALKLGFICSPHFTDKRLEQSLTQYAEAIGLAFQVQDDILDIEGDSAEIGKQVGADLDLDKSTYPKLLGLSGAKQKAQDLYQSALSELEKIPFDTTVRALAEFIITRKS

SEQ ID NO: 58221 - protein, 186 aa, Halobacterium sp. NRC-1
MSTLTDTIQIENVVASTDLSQELALEQLATDLPGAEYNPGDFPGVIYRLDDPKSATLIFDSGKAVCTGAQSVDDVHDAISIVVEDLRDLGIDIPPSPPVHVQNIVCSGSLDQDLNLNAIAIGLGLEDVEYEPEQFPGLVYRLNDPDVVVLLFGSGKLVITGGSNPDDAHHALEIIHERLTDLGLLE

SEQ ID NO: 58222 - protein, 625 aa, Haemophilus influenzae Rd KW20
MTNNMNNYPLLSLINSPEDLRLLNKDQLPQLCQELRAYLLESVSQTSGHLASGLGTVELTVALHYVYKTPFDQLIWDVGHQAYPHKILTGRREQMSTIRQKDGIHPFPWREESEFDVLSVGHSSTSISAGLGIAVAAERENAGRKTVCVIGDGAITAGMAFEALNHAGALHTDMLVILNDNEMSISENVGALNNHLARIFSGSLYSTLRDGSKKILDKVPPIKNFMKKTEEHMKGVMFSPESTLFEELGFNYIGPVDGHNIDELVATLTNMRNLKGPQFLHIKTKKGKGYAPAEKDPIGFHGVPKFDPISGELPKNNSKPTYSKIFGDWLCEMAEKDAKIIGITPAMREGSGMVEFSQRFPKQYFDVAIAEQHAVTFATGLAIGGYKPVVAIYSTFLQRAYDQLIHDVAIQNLPVLFAIDRAGIVGADGATHQGAFDISFMRCIPNMIIMTPSDENECRQMLYTGYQCGKPAAVRYPRGNAVGVKLTPLEMLPIGKSRLIRKGQKIAILNFGTLLPSALELSEKLNATVVDMRFVKPIDIEMINVLAQTHDYLVTLEENAIQGGAGSAVAEVLNSSGKSTALLQLGLPDYFIPQATQQEALADLGLDTKGIEEKILNFIAKQGNL

SEQ ID NO: 58223 - protein, 377 aa, Candida albicans SC5314
MSADGEFTRTQIFGTVFEITNRYTELNPVGMGAFGLVCSAVDRLTGQNVAVKKVMKPFSTSVLAKRTYRELKLLKHLKHENLITLDDIFISPLEDIYFVNELQGTDLHRLLNSRPLEKQFIQYFTYQIMRGLKYIHSAGVIHRDLKPSNILINENCDLKICDFGLARLQDPQMTGYVSTRYYRAPEIMLTWQKYDTEVDLWSVGCILAEMIEGKPLFPGKDHVHQFSIITELLGSPPADVIDTICSENTLRFVQSLPHRDPIPFSERFASCTHVEPEAIDLLAKLLVFDPKKRISAVEGLTHPYMEAYHDPTDEPVCESKFDWSFNDADLPVDTWRVMMYSEILDFHQTVGVANETEGSEQPDSQVEQNNLDSANGA

SEQ ID NO: 58224 - protein, 325 aa, Methanothermobacter thermautotrophicus str. Delta H
MMEVMDILRKYSEMADERIRESISDITPETLLRASEHLITAGGKKIRPSLALLSSEAVGGDPGDAAGVAAAIELIHTFSLIHDDIMDDDEIRRGEPAVHVLWGEPMAILAGDVLFSKAFEAVIRNGDSEMVKEALAVVVDSCVKICEGQALDMGFEERLDVTEEEYMEMIYKKTAALIAAATKAGAIMGGGSPQEIAALEDYGRCIGLAFQIHDDYLDVVSDEESLGKPVGSDIAEGKMTLMVVKALERASEKDRERLISILGSGDEKLVAEAIEIFERYGATEYAHAVALDHVRMAKERLEVLEESDAREALAMIADFVLEREH

SEQ ID NO: 58225 - protein, 260 aa, Pseudoalteromonas tunicata D2
MDKQMNQHHLLDQVVAIAKAAGEAAMIIYQKDFNIEYKGDDSPVTDADLAAHAVIVKGLKALTPHLPILSEESADISWEERRTWEEYWLVDPIDGTKEFIKKNGEFTVNIALIKQGKPVLGVVDAPALNETYFAEASLGAFKQDSQGIHSLKVTKKANKGLIRVVGSRSHPSPDLAAYLEQFEAVDMVPKGSSLKLCLVAEGKADIYPRLGLTSEWDTGAGHAVAEIAGASITQIDGSPLTYNQKAQYLNPYFIVSALLD

SEQ ID NO: 58226 - protein, 614 aa, Xylella fastidiosa 9a5c
MLSGVLMSNPSSTPLLFADLGLSDAVMQAVTKIGYETPSPIQAATIPALLAGRDVLGQAQTGTGKTAAFALPLLTRTVLNQVKPQVLVLAPTRELAIQVAEAFQRYAASISGFRVLPVYGGQSYGQQLAALKRGVHVIVGTPGRVIDHLERGTLDLSELKTLVLDEADEMLRMGFIEDVEEVLRKLPASRQVALFSATMPPQIRRIAQTYLQDPIEVTIATKTTTAANIRQRYWWVSGLHKLDALTRILEVETFDAMIIFVRTKAATEELAEKLQARGLTAAAINGDMQQAQRERTIHQLKDGKLDILVATDVAARGLDVERISHVLNYDIPYDVESYVHRIGRTGRAGRSGEAILFVTPREKGMLRQIERATHQPIEAMQLPSVDAVNDTRVAKFFGRISNALVVGAEIDFYRKLLQRFESEHNVPAIEIAAALARLLQGDSPFLLSVPTRAQRERSEPPSEHVKRSSSFKQTERPNHTEHPKRPQRNAPARNTPEFGMESYRIEVGRIHGVKPANIVGAIANEAGLESRYIGRIDIRDDHSVLDLPAEMPHEILQHLKKVWVSGQQLQMRRIDTTETTATAREFKSKPGGAGKFPPKPHHNKSTKPKPPYSG

SEQ ID NO: 58227 - protein, 812 aa, Oryza sativa Japonica Group
VFIGLLLLSLHAPPYSAAVDDTLAAGQVLAVGEKLVSRNGKFALGFFQPSAIAISKSSNYTNALGWYLAIWFNKIPVFTTVWVANRERPITVPRLNSTWLKMSGDGNLYILDHATNSIIWSTDHVVNTTTETGMNTSATLLNSGNLVIRNPSGVVSWQSFDNPTDVVLPGAKFGWNKATGLNRLGISKKSLIDPGLGSYSVELDTTGARGLILKHRNPSMEYWSSDRALIIPVLKSLFEMDPRTRGLITPAYVDNSEEEYYIYTMSDESSSVFVSLDVNGQIKMYVWSRANQSWQSIYAQPVDPCTPSATCGPFTICNGNSTQTCDCMESFSVKSLWDWELDDRTGGCIRDTPLHCVSDKNMTSSTDMFQPIGLVTLPYDPQIMQDATTQGECAQACLSDCSCTAYSYQNSRCSVWHGKLLNVNKNDGIYINADNVLHLRLAATDFQDLSKNKRKTNVELVVGASIVSFVLALIMILLMIRGNKFKCCGAPFHDNEGRGGIIAFRYTDLAHATKNFSEKLGAGGFGSVFKGVLTNMATIAVKKLDGAHQGEKQFRAEVSSIGIIQHINLVKLIGYCCEGDKRLLVYEHMLNGSLDVHLFQSHAAVLNWITMHQIAIGVARGLSYLHESCRECIIHCDIKPENILLDISYFPKLADFGMATFVGRDFSRVLTTFRGTVGYLAPEWISGVAITPKVDVYSFGMVLFEIISGRRNSPEVHTSGNYDATYFPVRAINKLHEGDMSSLVDPRLHGDYNLDEVVRVCKVACWCIQDDEFDRPTMREVVRVLEGLQELDMPPMPRLLATLTNFSAVASM

SEQ ID NO: 58228 - protein, 193 aa, Chromobacterium violaceum ATCC 12472
MISKYNRPMENLSNLDYSSYLKGWIRTVPNWPQQGVMFRDITPLLQNPKTFRMLIDIYVHRYMMEKVDLVAGLDARGFIIGSVLAYELNVGFVPIRKKGKLPFTTVEEEYELEYGNAAVEMHTDACKPGDRVILIDDLVATGGTMMAGYKLLKRMGADVLEAAAIIELPELGGGQLVRDGGLDLFTVCSYEGH

SEQ ID NO: 58229 - protein, 698 aa, Erythrobacter sp. NAP1
MGLLAIVYGIVTSRQVLGASAGNAKMQEIAGAIQEGAQAYLNRQYTTIGIVGIVAAALVGFFLGIVPAVGFVVGAVLSGVAGYIGMNISVRSNVRTAAAAETGLQEGLTIAFRAGAITGMLVAGLALLAIAVFFAVLVGPMGLDANSRVVIDGLVGLAFGASLISIFARLGGGIFTKAADVGADLVGKVEASIPEDDPRNPATIADNVGDNVGDCAGMAADLFETYVVTVGATMVLTALLFASQLGENLLTLMTLPLLIGGACIVTSIIGTYFVRLGNGTNVMGAMYKGFIVTAVLAIPLIYLVTQYALSTFGSDMTTVLGTGPGGVDFNGMDLFYCSLIGLALTGIIIWITEYYTGTNFRPVRSIAKASETGHGTNVIQGLAISLESTALPTIVIIAAIIGAYQLAGLIGLAYGATAMLALAGMVVALDAYGPVTDNAGGIAEMAGLDESVREKTDLLDAVGNTTKAVTKGYAIGSAGLAALVLFAAYTADLREFFPEANVDFGLENPYVIVGLLLGALLPYLFGAMGMTAVGRAAGDVVKDVREQFAADPGIMEGTSRPNYARTVDLVTKAAIKEMIIPSLLPVLAPIVVYFVILGLAGQDNAFAALGALLLGVIVGGLFVALSMTAGGGAWDNAKKYIEDGNHGGKGSEAHKAAVTGDTVGDPYKDTAGPAVNPMIKITNIVALLLLAALAGGAH

SEQ ID NO: 58230 - protein, 559 aa, Penicillium chrysogenum
MSPFITTHVWKDDGSTTPIVSNPNVPIYGDGEMSDNSEIENAAGQLKEIHEFRQGLHQRHIQMIALAGTVGTGIFLSSGRAIVEAGPLGAFLAYTIIGATVASVVYGVGEMGALVPLNGGVIRYAEIFCDPALAFANGWNQIYSYCVSIPSEIVAAAVIIEFWITVNNAIWITVLGLLMLSTAFVFVRVYGELEFGFSILKIMLIIGVNLMALVITCGGAPNKSSIGFAYWKAPYGPFVQYLGVGGPLGRFLGFWKTFDNALFAYSGIENFTLAAAETRNPRHSIPMAARRIFVRILLFYVITIFMIGLIVSSADKRLLGSSGTASQSPFVIAARHAGIKVVPSIINAVVLTSAWSSGNSNILGGSRILYGMATQGHAPAVFTRINRFGIPWVAVALYGVFMSLGYMSLSSSASTVFTWLQNLVSISTLVNLMCICIVYLRFYYGCKKQGIDRFKELPWAAPFQPYITWISLFIYVVLFFTGGFTTFMRGHWSTATFVSTYFNLPFIVIVYFAYKFWAKTKIIPLAEIPIRPFIESWHKNPEPEPKPKRGLSKLNILWS

SEQ ID NO: 58231 - protein, 565 aa, Prochlorococcus marinus str. NATL1A
MITTYEPLHHKYRPTSFDELVGQDPIKSTLKQALISDRIAPAYIFSGPRGTGKTSSARIFAKSLNCLKSEKATTTPCGQCELCKGISSGNALDVIEIDAASNTGVENIRELIERSRFAPAKARWKVYVIDECHMLSTAAFNALLKTLEEPPRQVVFILATTDPQRVLPTILSRCMRFDFRRIALHDLESHLIKIAKKEEIQINEEAISLIAKHSQGGLRDAESLLDQVSLLPPPITQLNIINLIGAIPEEELIILAKSLITKDPNSILNICNSLINKGKEPIAILQGIASILRDLVVTKVTNKPTNLCNISREHSESLNDLATSSNLDQILNLQAKLKGSESNIRNSNQPNLWLEIHLLGMLTDEVSKENNKIEQSLVKTKISDNSESKNTNNTSNRIVPNTEKEQIKTTAFLDETKTSPTLNLDDIWKKVIAMLELPSTKMLLSQQAKLINLNSDSAEIAISEKWINMIQSRKNLIEDAFYKARGSSTKVVLIQQKDNLSNHKKVEDNLQKIEQKNQIKIDREPNKNTIKEEKIESKNNLKVNSIDQKAKQFADFFNGEIVNLE

SEQ ID NO: 58232 - protein, 684 aa, Physcomitrella patens subsp. patens
MPPKRSKVEIIKQNSDFLRHPLKEELETEAPNVNEDAVQLIKFHGSYQQDNRELRGPGHKAYQFMLRTKNPSGIVPNRLYLVMDELADKYGIGTLRLTTRQTFQLHGVLKTDLKTVMSSIIKNLGSTLGACGDVNRNVLAPAAPYKSKEYVHAQELASKLAMLLAPQAGAYYDIWVDGEKITQDEPEDVTIARNDNSYGTNFDNSPEPIYGVQFLPRKFKIAVTVPGDNSVDVLTNDIGIVVISDEHGDVQGYNIYVGGGMGRTHRNEQTFPRLADELGYVSKDDILYVVKAIVATQRDYGRRDDRRMSRMKYVVEEWGIHKFKTVVEQYFGKHIQPFKELPPFQFQSYLGWHEQGDGNVFFGLHVENGRIKGEAKKALREVIEKFKLDVHITPNQNLILCNVRPSWKARITRALANVGLLAPKFVDPLNITAMACPALPLCPLAIAEAERGAPDILKRVRAMMDKVGLKASESLVVRITGCPNGCARPYMAELGLVGDGPNSYQIWLGGASNQTRLAETFMDRVKLDKLESVLEPVFYMWKSERHEKEGFGDFVYRQVLLCCLVLAGRSSMCEFVKPGDIVHYSKMDNFHFDEKKIASAVQLLVEEALIVGFSPFESFMQQGFGACKTYIENYTGPRKPVRRGGLFLDADVHSSLAKLAADEGLTVSKFASKVLAEHLEKAQH

SEQ ID NO: 58233 - protein, 497 aa, Chlamydomonas reinhardtii
MGCSSSKDEVELAQQVLGAKKAADTKAVRRLSALGLEDGEVWITRQTTDIRKVFKFGQQINKGQFGVIHVVTDAAGNKYACKQISKRKLTGPNSIRDIRREIEIMHHLRGHPSVITFHGVYEDVSDVYMVMELCTGGDLFEKIEKMSTVTERAAAALFRELVECVAYCHTLGVMHRDLKPENFLVTDRTGDARIKLSDFGLSTFFREGQADFADVLGSAYYMAPEVLERSYGKSCDVWSLGVILHVLLSGAPPFAGATDAEIIKAVRSRDVDLSAKPWPAISRHARHLVSRMLEKDPEQRIQLDQVLTHPWLRLDGTAPVRAVPTGVRDRVRQFRTLNLLKREARRVMAASLPPEEVAGLKNLFEELDANADGLVSLEDLVAGLARRGEALAGEEAAALLRSMDLNGDGFIDYREFVAATYTLSKLQQSDVLLKTFRHFDLDGDGYISKEELAAALAQLPAAASSAASARESVTGLLAEADLDKDGRLNYREFCTML

SEQ ID NO: 58234 - protein, 421 aa, Chlamydomonas reinhardtii
MLKTAKALGLAGQVAAKAMGGAAGATGGMGLVAANAQNMAGMASAASEATPKSLGYTMPGEFEPHVGCWMGWPYSPYLWRENAKPAQQQYAAIAKAISEFEPVWMFADPSSIQSARNHFRGVSGVTVVEMPIEDGWLRDWGPTCVVRDDPKTGKREVAGVHWDYDCYGAPGKKKLGLPAMMPEWQKDHAAGRAILDWAGLKAFECPLHLEGGSIHSDGQGTLVVTEECLLHPSRNPHLGKEGIERMLKEYLGLEKIIWLWKGMMGDDHVVNGHVDNMATFSEPGTILLSWCDDPNDPQHEVSARNLEILENTEDALGRRIKVIKLPAPTPGMFRSFKEANGMHPDHAKKGYVPRVAGERLAASYINHYIANGGISKSDELALEILSKAYPGRKVVGVHSRDVLLNAGNVHCITQQHVAPRG

SEQ ID NO: 58235 - protein, 644 aa, Mesorhizobium loti MAFF303099
MSEAVDAKQAPLDVITIGRASVDLYGQQIGSRLEDITSFAKSVGGCPANISVGTARLGLRSALLTRVGDEQMGRFIREQLRREGVNTDGLKTDKERLTALVLLSVESEGVSPMIFYRSDCADMALAPEDIDEAFIASARSIVVTGTHFSRPNSDAAQRKAIRIMKAKGGKVVFDIDYRPNLWGLAGHAEGFERYVKSDRVSAQLKTVLPDCDLIVGTEEEIMIASGADDCLSALKTIRALSAATIVLKRGAMGCIVYDGPISDDLEDGIVGKGFPIEIYNVLGAGDAFMSGFLRGWLGGEDHATAATWANACGAFAVSRLLCAPEYPTFEELQFFLKNGSKYRALRKDEAINHIHWATTRRRDIPSLMALACDHRVQLEDVAAKAGADPARIRDFKVLAVKAAAKVAAGRDGYGMLIDEKHGREAMFEFARHPFAWLGRPVELPGSRPLRFEFSQDIGSQLVEWPVDHCIKCLCFYHPDDPAALKEEQQQKLRALFEAARKVGRELLVEIIAGKHGKLDNTTIPRALEELYALGIKPDWWKLEPQASAGAWTRIEAVILKHDPWCRGIVLLGLEAPQDELEAAFAATAKAPIVKGFAVGRTIFVHAAEEWLAGRMSDDEAVADMASRFEQLTEAWLAARGRKAA

SEQ ID NO: 58236 - protein, 608 aa, Medicago sativa
MQKDQLKKDVKEVKFFTDYGDANRYKILEVVGKGSYGVVCAAIDTHTGGKVAIKKIHDVFEHISDAIRILREVKLLRLLRHPDIVEIKRIMLPPSKREFKDIYVVFELMESDLHQVIKANDDLTREHQQFFLYQMLRALKFMHTANVYHRDLKPKNILANANCKLKVCDFGLARVAFNDTPTTTFWTDYVATRWYRAPELCGSFFAKYTPAIDIWSIGCIFAEVLTGKPLFPGKSIVHQLDLITDLLGTPPPEIISGVRNEKARKYLMEMRKKLPVPFERKFPNADPLALRLLQRLLAFDPKDRPTAQEALADPFFKGLAKIEREPSSQPISRMEFDFERRRVSKDDIKELIYREILEYHPQLLKDYISGTEGTNFMYPSAIDQFRKQFAYLEENNGKCGPVIPPERKHVSLPRSTVLSSTIPPSTQPSFAPYANRQITQEAFSIPRAAESNSLSQSKGLRPPPRAPAAKSGRVTGPVLYDNGRSTKDNYDARIFYQNAIPQAISPHCFQRVANAHQTSTKTTPETYKDNSQGKHQLSPKKCNVPARPAFDLNTNPYHQQSKNDLLNDPVTVIDAKLLKAQSQFGAAGAAAVAVAAHRHSAGFQYGLT

SEQ ID NO: 58237 - protein, 118 aa, Zea mays
PVTSVFMVLPLPNIPFFWVLFRAYSHWRALQGSERLELLVSDCSDKWKVLEEKINSVKDGKPSENARNSPWKLRPSEKLDRFFEGRNLDEGLDCDTILSICQEYDLDKIDVFKYRDFL

SEQ ID NO: 58238 - protein, 79 aa, Glycine max
  misc_feature (72)..(72): Xaa can be any naturally occurring amino acid
MATAMIAWAAVTTADRADPRMHAPFTGLKSMAGFTTRKTNHDISSIATNAVRVLCMHEWTPVLMKKYETLYXLPDLDDP

SEQ ID NO: 58239 - protein, 174 aa, Glycine max
MAKEEEQQQQQQHPPYAYTLILNIFSKRRTWACLFLVVYGTLLASSWNLLKSTLSWYNLQVESSTTSAWPALYASVLLGTVFGVLSMVAAMVVMVPAVVVTWITIVVLLAFFGKPKRTLVVEGRKITKEIFGFVMRTLLKEGNFVAAVCAVLGYFALVRRNGTQGGGVAVVGES

SEQ ID NO: 58240 - protein, 166 aa, Haemophilus ducreyi 35000HP
MSNIEKQAGELQEKLIAVNRVSKTVKGGRIMSFTALTVVGDGNGRVGFGYGKAREVPAAIQKAMEKARRNMINVALNEGTLQHPVKGSHTGSRVFMQPASEGTGIIAGGAMRAVLEVAGVHNVLSKAYGSTNPINVVRATIDALANMKSPEMVAAKRGKTVEEIWG

SEQ ID NO: 58241 - protein, 553 aa, Methanothermobacter thermautotrophicus str. Delta H
MVPVEDLVYRYALLNAVKHRGRANPGAVMGAVMSNEPELRKMAPQVKEAVEAAVERVNSLSPEEQQQEMERLGLEITERKQKKRKGLRELAGVKGEVVLRFAPNPSGPLHIGHARAAILNHEYARKYDGRLILRIEDTDPRRVDPEAYDMIPADLEWLGVEWDETVIQSDRMETYYEYTEKLIERGGAYVCTCRPEEFRELKNRGEACHCRSLGFRENLQRWREMFEMKEGSAVVRVKTDLNHPNPAIRDWVSMRIVEAEHPRTGTRYRVYPMMNFSVAVDDHLLGVTHVLRGKDHLANREKQEYLYRHLGWEPPEFIHYGRLKMDDVALSTSGAREGILRGEYSGWDDPRLGTLRAIARRGIRPEAIRKLMVEIGVKIADSTMSWKKIYGLNRSILEEEARRYFFAADPVKLEVVGLPGPVRVERPLHPDHPEIGNRVLELRGEVYLPGDDLGEGPLRLIDAVNVIYSGGELRYHSEGIEEARELGASMIHWVPAESALEAEVIMPDASRVRGVIEADASELEVDDVVQLERFGFARLDSAGPGMVFYYAHK

SEQ ID NO: 58242 - protein, 410 aa, Methanothermobacter thermautotrophicus str. Delta H
MVTVNENYLLLKSSYIFSEINRRVEEFQRKNPDADIIRMGIGDVTRPLPEAVVEAFHRAVDEMAEEETFRGYGPEQGYPFLREAIAENDYASRGVDITADEIFISDGAKCDTGNIQEIFGLDNVVAVTDPVYPVYVESNVMAGRAGPADDDGRYSGLVYLPCTEENSFIPSLPEERVDLIYLCYPNNPTGTTLTEKQLAEWVDYARDSGSLILFDAAYEAYIQEDGIPHSIYEVEGAREVAIEFRSFSKNAGFTGTRCAFTVVPEELEVPDSSGRMHSVRELWNRRQTTKFNGVSYPVQRAAEAVYTPEGQREIRESIDYYMENARIIRESLERAGLRYYGGVNAPYIWIRTPEGMDSWQFFDTLLNDAEVVGTPGSGFGPSGEGYFRLTAFNSFRNTVKAMERISELSF

SEQ ID NO: 58243 - protein, 629 aa, Alteromonadales bacterium TW-7
MLEIALIYLAAAIVAVPIAKRVGLGSVLGYLIAGILIGPYALGVVGDQTDVMHFAEFGVVMMLFLVGLELQPSRLWKLRHSILGLGGLQVVLTAAVIFAFCFWFFTMPWQTALAIGLMLALSSTAIVLQSLEEKGWLKREAGQNAFSVLLFQDIAIIPILALLPLLAFAPPSSSKEISHSIIANWPVWQQVAVSVGVIAAIIAGGKYVSAPLFRYIAKTHMREIFTIFALFLVVAIALVMQSIGLSPALGTFLAGVVLAESEFRHELEADIEPFKGLLLGLFFITVGASINFELLASEFSTVIALVALLIVVKACILYALAITFNISKKQRLLFALALAQGGEFAFVLLSVTTTLAILTPEQTSLVTLVVAVSMLVAPLLLMMYEQLEKRSHTSAPEFDKPEQISTAKHVIIAGYGRFGQIMGRLLHAQGYEITVLDHSPSQIELLRRFGNTVFYGDAARQELLEAAGAHTAQMLVVAIDDPDKTIEIIELAHKNYPQLKIVARAIDRRHAYKLLNLKVDAFNRETVDSAINLAVEALELLGNNKQDAERAGKLFREHDRAAVVQLAELWGDDASYGVAVRQRMEDLKQVLQQDRQAQSDLNTCDSGDCEDGLTELADKPKKPDDAHLE

SEQ ID NO: 58244 - protein, 414 aa, Zea mays
MNELCDLEVHINGHHTLHLHQSVMCAFSGRLRTLVKQEKKKKGGGRKEAVSINLAGGFPGGADGFELVARFCYNDGRVLLCPSNLPLLHCAAVSLEMTEEVCACNLLAQAEAFVNGLYYWTWADVLAAVRSCEPFAAAADASGLLDRLISALFSKITGATPGPGPGTPNRSSSSCSSSPDTAGLRRSSSSANKTPESMRPCAGREWWFDDMTSLSPPTVEKMMRVLGCYGVENKNLILTRFLLHYLRAATRRPPALEREGAALAGLADTAVHGVALVGGTAFSCRGLFWVLRIVSAVGLSRECRHKLERLMGLMLDQATLDDLLVSGDDGGGVYDVNLVMRLVRVFVASEEEADAPSERMRKVGRLVDKYLGEISPDQGLKVSKFLAVAESLPDSARDCYDGVYRALDIYLEVK

SEQ ID NO: 58245 - protein, 338 aa, Streptococcus pyogenes MGAS10394
MKAVVVNQASTGVEVVEHDLPNVGHGEALVKVEYCGVCHTDLHVAHGDFGQVPGRILGHEGIGIVEEIGEGVTSLKVGDRVSIAWFFEGCGHCEYCTTGRETLCRSVKNAGYSVDGGMSEYAVVTADYAVKVPEGLDPAQASSITCAGVTTYKAIKEAGAAPGQWIVIFGAGGLGNLAVQYAKKVFNAHVVAVDINNDKLELAKEVGADILVNGKEIEDVPGYIQEKIGGAHGVVVTAVSKVAFNQAIDSVRAGGTVVAVGLPSEYMELSIVKTVLDGIKVVGSLVGTRKDLEEAFAFGAEGLVAPVVEKVPVDTAPEVFDEMERGLIQGRKVLDFIS

SEQ ID NO: 58246 - protein, 762 aa, Arabidopsis thaliana
  misc_feature (654)..(654): Xaa can be any naturally occurring amino acid
MTITSNISVQNDNLVVQGKTILTKIPDNIILTPVTGNGFVSGSFIGATFEQSKSLHVFPIGVLEGLRFMCCFRFKLWWMTQRMGSCGKDIPLETQFMLLESKDEVEGNGDDAPTVYTVFLPLLEGQFRAVLQGNEKNEIEICFESGDKAVETSQGTHLVYVHAGTNPFEVIRQSVKAVERHMQTFHHREKKKLPSFLDWFGWCTWDAFYTDVTAEGVDEGLKSLSEGGTPPKFLIIDDGWQQIENKEKDENCVVQEGAQFATRLVGIKENAKFQKSDQKDTQVSGLKSVVDNAKQRHNVKQVYAWHALAGYWGGVKPAASGMEHYDSALAYPVQSPGVLGNQPDIVMDSLAVHGLGLVNPKKVFNFYNELHSYLASCGIDGVKVDVQNIIETLGAGLGGRVSLTRSYQQALEASIARNFTDNGCISCMCHNTDGLYSAKQTAIVRASDDFYPRDPASHTIHIASVAYNSLFLGEFMQPDWDMFHSLHPTAEYHAAARAVGGCAIYVSDKPGNHNFDLLRKLVLPDGSVLRAKLPGRPTRDCLFADPARDGISLLKIWNMNKFTGIVGVFNCQGAGWCKETKKNQIHDTSPGTLTGSIRADDADLISQVAGEDWSGDSIVYAYRSGEVVRLPKGASIPLTLKVLEYELFHISPLXGLVDMFNSSGAIESIDINHVTDKNPEFFDGEISSASPALSDNRSPTALVSVSVRGCGRFGAYSSQRPLKCAVESTETDFTYDAEVGLVTLNLPVTREEMFRWHVEILV

SEQ ID NO: 58247 - protein, 482 aa, Xylella fastidiosa 9a5c
MLPTSHTPCMESAPPMNDILPVILSGGSGTRLWPLSREAYPKQFLPLVGHHSMLQATWLRAAPVTTHSPIVVANEEHRFIAAEQLQHLGVYPSAILLEPTGRNTAPAIAVAALEATRTGNDPLLLVLPSDHVIRDEAAFQTAVHVAAEAAAQGKLVTFGITPNTPEIGYGYIKATGNDTIRPVERFIEKPDLATAQSYLASGDYFWNSGMFLFRASRYLAELSTFQPAIAEACQRAWSAAKRDTDFIRLDKEAFENSPADSIDYAVMEHTADAVAVPLDAGWNDVGSWSALHEVSKQDNDGNAHQGDVIQIDCRNTYAYGSRLIAMVGLENVVVVETDDALLVGHRDSIQTVKEIVGKIKANGRPEATWHRKVYRPWGAYDSIDTGQRFQVKRITVKPGGTLSLQMHHHRAEHWIIVSGTAEVTRGSEILLLTENQSTYIPLGVTHRLRNPGKLPLELIEVQSGSYLGEDDIVRFEDTYGRT

SEQ ID NO: 58248 - protein, 248 aa, Candida albicans SC5314
MPKLVLVRHGQSEWNEKNLFTGWVDVRLSETGQKEAKRAGELLKEAGINVDVLHTSKLSRAIQTANIALDAADQLYVPVKRSWRLNERHYGALQGKDKAQTLEAYGQEKFQIWRRSFDVPPPKIDPKDEYSQVGDRRYADVDPAVVPLTESLALVIDRLLPYWQDEIAGDLLAGKVVLIAAHGNSLRALVKHLDNISDEDIAGLNIPTGIPLVYELDENLKPTKPSYYLDPEAAAAGAAAVAAQGQKK

SEQ ID NO: 58249 - protein, 473 aa, Bacillus cereus ATCC 10987
MQQQTNEKLHRTMKSRHLFMIALGGVIGTGFFLGSGYTINQAGPGGAILSYLVGGFIMYLTMLCLGELTVAMPVSGSFQKYATKFIGPGTGFMIGWLYWLGWAVTVGLELTSIGLMMKRWFPNADVWVWCLVFGVILYASNAISAKSYAELEFWFSSIKVITILAFVVLGGSALLGFISYDGKEAAPLFSNFVSEGGLFPNGLAAVLLTMITVNFSFQGTELIGIAAGESEEPEKTIPRAIRNTVWRIMLFFILTMTILVGLISWKEAGVIESPFVVVFDKIGIPYAADIMNFVIITALLSVANSGLYAATRILWSLANEGMAPKSFQKVNKRGIPITALVVTIAVAALSLLTSFLAEDTVYMYLLSIAGLSAVSSWIIIALSQLRFRSQYIKGGGKLEDLKYKTPLYPIVPILALITNSIVVISLAFIPEQRMALYCGIPFIIFCYIYYYINKKRQKPMKVETTNETNHQTR

SEQ ID NO: 58250 - protein, 336 aa, Chromobacterium violaceum ATCC 12472
MAFNLRNRNFLKMLDFTPREIRYLLDLSRDLKRAKYSGTEQQHLKGKNVALIFEKTSTRTRCAFEVACFDQGANVSYIGPSGSQIGHKESMKDTARVLGRMYDAIEYRGYSQDMVEHELAAYAGVPVYNGLTDEYHPTQMLADVLTMWEHSDKPISQISYTYLGDARNNMGNSLLVIGSKLGMDVRIGAPKHLWPTDELVAECREIAKRTGARITLTEDPKEAVKGTDFIHTDVWVSMGEPAEVWAERIRLLKPYQVNSALMAASGNPQVKFMHCLPAFHNSETKVGKEISAQYPELANGIEVTEDVFESEACIAFEQAENRMHTIKAILVSTLGD

SEQ ID NO: 58251 - protein, 142 aa, Glycine max
  misc_feature (84)..(84): Xaa can be any naturally occurring amino acid
  misc_feature (106)..(106): Xaa can be any naturally occurring amino acid
  misc_feature (118)..(118): Xaa can be any naturally occurring amino acid
MQNHRLKQQQQALMQQALLQQQSLYHPGLLAPPQIEPIPSGNLPPGFDPSTCRSVFVRNIHTKETDPLLQEVFAGTGPVEACKXLVRKDKSYYGFIHYYDRGTAAXDILALHGTPLFXQPHTGIWPYEKGAKEDTPRHYTIY

SEQ ID NO: 58252 - protein, 437 aa, Mucor circinelloides
MSSPVPSFDSLDKIYDPAAVPKQDQRYKKLIAEFEKVHGRKAEFVVRSPGRVNLIGEHIDYCGFGVLPMAIERDVIIVGATTDDDTKVRIANINPKYPAREFDYEGKEKVVTIDSSELEWSNYFKCGYKGMLEKFQLDKPKGLFLIVDGTVPAGGGLSSSAAFVCASALAVVTANKLTISKTELTEIAIVAERNVGVNSGGMDQSASVLSEKDFALHVEFVPKLHTAAVPLPVTTPKLAFIIANTLVTADKFVTAPRNYNLRVVETHMAALFLAKKLNLPAVDTLKEVYDLYYKDSSLNEVERFTDLLKKAEEFYPKDNTNNNGYTLEEVSQMLDIPVKELQDKYMTRFPVQTDYYRLVHRTKHVLSEASRVIEFHKACETGKGDSTLKVLGDLMNLSQESCNKLFMCSCPEIDQVCEVARKNGSLGSRLTGAGWGG

SEQ ID NO: 58253 - protein, 148 aa, Cicer arietinum
MSNFKSKYHDELIANAAYIGTPGKGILAADESTGTIGKRLASINVENVETNRRALRELLFTAPNVLQYLSGVILFEETLYQSTAAGKPFVDVLNEAGVLPGIKVDKGTVELAGTDGETTTQGLDGLGARCAKYYEAGARFAKWRAVLK

SEQ ID NO: 58254 - protein, 351 aa, Oryza sativa Japonica Group
MVSPVVHRHAAGGGSGGDDDDQACMYALELLGGSVVSMTLKAAIELGLVDELLAAAGAAVTAEELAARLRLPAAVAAAAAVDRMLRLLASYGVVRCATEAGPDGKARRSYAAAPVCKWLAAGSSSGEGSMAPLGLLNLDKVFMENWYYLKEAVSEGGTAFDKAYGTSLFQYLGQDGNEPSNTLFNQAMASHSVVITNKLLQFFRGFDAGAGVDVLVDVGGGVGATLRMITARHPHLRGVNYDLPHVIAQAPPWILHLWGDEECVKILKNCYKALPAKGKVILVEYVLPASPEATLAAQEAFRLDVMMLNRLAGGKERTQQEFTDLAVDAGFSGDCKPTYIFTNVWALEFTK

SEQ ID NO: 58255 - protein, 534 aa, Cryptococcus neoformans var. neoformans
MPSGIPTRRVRLVDENAPPPPGAVVTRTRSRALASTTSTATNVKPTTTSIPMMKRQRSTISSENKIVDKSDVRRNALGEVRNGKGGEKEKESGKGKVVAIERKPLATTQAKAQRVTRSASAQPVMGVKDGDKKRKAVITSKIPSRSRSTGAEPAQVEVKPTIKTEEEPVRKRRKTSSPVVEVGEDGPTVDGKELLLSSGSKNATAFRSPKIKAKDDGWTDLDAEDEGDPTMVSEYVVEAFKYMMDIQGQTMPDPEYMDNQAELQWKMRQILMDWIIEVHSKFRLLPETLFIATNLVDRFLSKRVISLVKFQLVGLTALFIASKYEEVCCPGVEHFLHMSDGGYTVEELLKAERYMLSTLQFDMSYPNPLNFIRRISKADGYDIQSRTVAKYLVEISCVDHRLLGYTPSMLAAASMWLARLCLERGEWNANLVHYSTYSEDEIRPCAQVMLDRILDPDFDESTSFYKKYASKKHMKASVYVREWATQLWPASADGSAVERGTELELLKMFLEDEEEENNKGSKRRMKAVDEEEEY

SEQ ID NO: 58256 - protein, 151 aa, Campylobacter lari RM2100
MQINLLSIQKNNNDEFSKIDEHYTKLIKKFCSFNEICVFNNKINQAQNTNSIEAKKSYTNALNPYKKGFCIALDEKGKEFTSVEFAKLLQDKNEITFFIGGAYGFEQEFIAQMHTSIALSKMTLVHKFAKTMLLEQIYRAFCINTNHPYHK

SEQ ID NO: 58257 - protein, 352 aa, Deinococcus radiodurans R1
MPKVITLPGDGIGPEVTAAAVQVLREVAPDVTVEEHAIGGGAYDAHGEPFPTSTRDALKEADAVLLGTVGGAHDSAWNQLPRHLRPESGLLALRKALGCYANLRPVRVQPGLEHLSPLKAELARGVDILIVRELLGGIYFDQDRKIEGDTAYNTMRYTTSEVERVAKVAFWAAEQRKGRVTSVDKANVLEVSELWRRDVQALRDRDYRSIHLNHEYVDSVAMLIVADPSRYDVILTENLFGDILSDLAAVIPGSLGLMPSASLGDGAGLFEPIHGSAPDIAGQGVANPAAAIMSVGMLLRHGLERSEAANQVDRAVALALREQPTRDLGGSADTQTFTRAVLKALGSSPSVG

SEQ ID NO: 58258 - protein, 579 aa, Shewanella sp. MR-7
MRLAGTFRPLILAIAMALPLLSSPTLHAEEPSIFSQMATAQPVWAKHGMVASQEALASRTGIEILKQGGNAVDAAVAVAFSLAVTLPRAGNIGGGGFMLVHLAKENKTIAIDYREMAPSKAKKDIFLDENGDAVTKLSREHGLAVGVPGTVMGMSLALEKYGTMTMAQVTAPAIKMAQEGISVTPDLAVSLAGLKRRMSQWPSTAAIFYKADGSDYQVDDILKQPELAHSLQLIAEKGTKGFYEGETAEKLVKAVQDAGGIMTLADLQHYKAVEREPVRGQYRGYDVVSMPPPSSGGVHIIEMLNVLQQFPIDQFGHNTAQTIHVMAETMKHAYADRSEYLGDPDFYKVPVKQLTNKDYAQKIASQIALNKTTPSTEIKPGNLAPYESDQTTHFSVVDKWGNAVSNTYTLNFSYGSGLVAKGTGILLNNEMDDFSAKPGTPNGYGLVGGDANAVEGNKRPLSSMSPTIVMKDGKPFLVTGSPGGSRIITTTLQIIMNVIDHGLNIAEASNAARVHHQWLPDELRVESSLNRDTISLLEAKGHKVKVQSAMGSTQSIMVTDQGIFGASDPRHSGSEAVGY

SEQ ID NO: 58259 - protein, 353 aa, Haemophilus influenzae Rd KW20
MKLSKTFLFITALCCATPTLAIQNSTSSSGEQKMAMENTQNIREIYLAGGCFWGMEAYMERIHGVKDAISGYANGNTEKTSYQMIGLTDHAETVKVTYDANQISLDKLLKYYFKVIDPTSVNKQGNDRGRQYRTGIYYQDGADKAVIGQALAQLQTKYKKPVQIEVQPLKNYIVAEEYHQDYLKKNPNGYCHIDITKADEPVIDEKDYPKPSDAELKAKLTPLQYSVTQNKHTERSFSNEYWDNFQPGIYVDITTGEPVFSSNDKFESGCGWPSFTKPIIKDVVHYETDNSFNMQRTEVLSRAGNAHLGHVFDDGPKDKGGLRYCINSASIKFIPLAEMEKAGYGYLIQSIKK

SEQ ID NO: 58260 - protein, 436 aa, Vibrio sp. QY102
MRISIFGLGYVGAVCAGCLSARGHEVVGVDISSTKIDLINNGKSPIVEPGLEELLQKGISTGKLRGTTDFAEAIRATDLSMICVGTPSKKNGDLELDYIESVCREIGYVLRDKATRHTIVVRSTVLPGTVANVVIPILEDCSGKKAGVDFGVAVNPEFLRESTAIKDYDLPPMTVIGEFDKASGDVLQSLYEELDAPIIRKDIAVAEMIKYTCNVWHAAKVTFANEIGNIAKAVGVDGREVMDVVCQDHKLNLSKYYMKPGFAFGGSCLPKDVRALNYRAGSLDVEAPLIGSLMRSNAAQVQKAFDIIASQDSRKVALLGLSFKAGTDDLRESPQVELAEMLIGKGFDLSIYDRNVEYARVHGANEEYIESKIPHVSSLLNSDLEDVVAKADIIVLGNSDERFAKLAEQAPSGKRVIDLVGFMPHASNGVAEGICW

SEQ ID NO: 58261 - protein, 287 aa, Streptomyces neyagawaensis
MNAIQKVAVVGCGVMGSGIAHVCALAGVDVVVAGSSPASLARGRARLTGSLDRALGKGRITDRDHENALARVSYTSDLAELADRQLVIESISEDEQAKRDLFARLDQVLQDPETILASNTSSLSVLRLARATADGGRVFGVHFFNPVPALPLVELVPTLLTREKTAVRAEEFVTDILGKRVIRSPDRAGFTVNALLIPYLLAAVRMVEAGHASAETVDDAMTLGCSHPMGPLRLADLIGLDVVTSIAEALHEEFREPQYAPPPLLRRLVEAGMLGRKTGRGLYDYAP

SEQ ID NO: 58262 - protein, 305 aa, Chromobacterium violaceum ATCC 12472
MRTLLIIGAGDVARRALPLLLRHWRVLALCRTEASAARWRALGAVPLIGDLDDSGSLERLAGLADAALLTAPPPAHGRTDPRMRKLLYALAKADSIPQQLIYISTSGVYGDAGGGLLDEAAAIRPRNERAQRRADAEAQLRRFACRRRCALTILRAPGIYADERLPLSRFASGAPLIIDAEDSWSNHIHADDLAQLCVAALRRRRGIRVYNACDDRPMPVGQWYAALGETLGLSMPPRLPRAEVKARVAPSQWSFLAESRRLDNSRMRRELDVRLRWPSVLDYLAALRRDEGRRSAILASYAEIR

SEQ ID NO: 58263 - protein, 304 aa, Clostridium sticklandii
MIYENIMQTIGKTPIVKLKNLTDENMAELYVKLEFFNPGGSVKDRAALNMIENMEKEGKLKLGDIIVEPTSGNTGIGIAMVGSAKGYKVILCMPETMSIERRKILKAYGAELVLTEGAKGMKGAIAKAEEMAQEDGYIILRQFDNSYNVDAHYKNTAKEIISDLPDLDALVVGVGTGGTLTGVAKAFKESSINAEIVAVEPVDSAVLSGNAPGPHKLQGIGAGFVPSILDTEYISKIEQIQTQEAFNASRLMASKEGILLGISGGAALEAAIRTAKRLGKGKKVCLLLPDNGERYLSTALYGDE

SEQ ID NO: 58264 - protein, 483 aa, Bacillus cereus ATCC 10987
MFQTIKNDWFSNVKGDVLSGIVVALALIPEAIAFSVIAGVDPTVGLYAAFCIAVTISFVGGRTGMISAATGAMALLMVTLVKDHGLQYLFATTILTGIVQIIFGVFKLSSFMKFVPKSVMSGFLNSLGILVFTAQLPHFKNATWQMYALVALGLAIIYVFPRITTAVPSTLISIIIVTSIALMSGLQLKTVGDMGSLPKELPFFSMPDVPFTLETLGIILPYAVMLAIIGLLESLLTASVLDDMTHTESNKHKEARGQGIANIVAGFFGGMAGCAMIGQSVINIKSGGRGRLSTFVAGGFLIILLFVLGDYVVHIPMAALVAVMIMVSIGTFDWNSVTTIHKVPKGNAFVMIVTVVVVLITHNLALGVIIGTVISAVLFAFNMAKIHVKHLYIENKKIYEIHGQLFFASTADLINNFSFEEDVKEIELNFSHAHIWDDSAVASIDKVIMKYEQSGVKVSIMGLNERSAKLVTNLATYNKRIAS

SEQ ID NO: 58265 - protein, 191 aa, Clostridium sticklandii
MREVLSLREKQKLTFMEKIKETIEVAREKDPAAKGAINILVNTPGIHAIMFHRVAHSLYNRKHFFIARLISQISRFLTGIEIHPGAQIGRRFFIDHGMGVVIGETAEIGDDVMLFHQVTLGGTGKDKGKRHPTVENNVIISAGVKVLGPIVIGENSKIGANAVVLHDIPKNATAVGIPAKVVRLNGEKVEH

SEQ ID NO: 58266 - protein, 880 aa, Clostridium difficile 630
MGDLTMETKYVYSFGEGSKDMKSLLGGKGANLAEMTKIGLPVPPGFTITTEACNDYYVNNESIRAEIIKEIEEHLATLEKDLNKTLGCNKNPLLVSVRSGAVFSMPGMMDTILNLGLNDNSVVGLAEATQNERFAYDSYRRFIQMFSDVAMEVPKYKFENVLDRVKEAKGYTVDTELTTDDLKEIVKEFKAIYKKEIKNDFPQDPKEQLMLAIEAVFRSWNNPRAIVYRKLNDIAHNLGTAVNIQSMVFGNMGETSGTGVAFTRNPATGENKLFGEFLMNAQGEDVVAGIRTPQNISTLADVMPAVFDEFVKITHILEGHYKDMQDIEFTIENERLYILQTRNGKRTAAAAINVAVDLVEAGIIDEKEAIMRIEPNQLDQLLHPKFEDKALKEAKVIAKGLPASPGAASGKVYFNADDVVKANEKGEKVVLVRLETSPEDIEGMVKAEGILTARGGMTSHAAVVARGMGKCCVAGCGEIKVDEFNKEIRALDDVVIKEGEYISIDGSTGNVYLGDVKKTEVSLTGNFEKLMNWVDKHKCMMVRTNADNPRDARAAIEFGAEGIGLCRTEHMFFDEARLPAVREMILSNTVEQREKALEKILPMQREDFVELFKVMDGKPVNIRLLDPPLHEFLPHDDETIEELSKSMGIKVSDIKKRIVDLDEFNPMLGHRGCRLAITYPEICVMQSKAIIQGAIEAIKAGVKVSPEIMVPLVGEVNELKIIRKMIVETVDAIIKEEGIEVPYTVGTMIEIPRACLTADEIAQEADFFSFGTNDLTQMVFGYSRDDAGKFLGQYVDEEILEKDPFQVLDQNGVGKLVKMGAKLGREVKPELKLGICGEHGGEPSSVEFCYSVGLNYVSCSPFRVPIARLAAAQASIKNPR

SEQ ID NO: 58267 - protein, 148 aa, Brassica napus
  misc_feature (79)..(79): Xaa can be any naturally occurring amino acid
  misc_feature (134)..(134): Xaa can be any naturally occurring amino acid
MAKTNGVIPTIDLGEVSDKILNQQIREASERWGCFRVINHGVPLCLMSDMKKTVMDLFERPYEVKVRNTDVLLGSGYRXPNEINPYYEALGLYDMASSQAVNTFCDQLEASADQREIMVKYAKAIDGLAKDLAXRLAESYGLAETNFF

SEQ ID NO: 58268 - protein, 317 aa, Burkholderia xenovorans LB400
MEPELKALIEQLSQAGRRPFWQCTVDDARNAPTLVKRLFPDAPSVERTQDIRISSTRGHAFPARLYVPRDRPCGLIVYLHGGGWVVGSVDDYHPLTATITARSGFAVLSVDYRLAPEHAFPIPLEDARAALEWASSGSAAVAIGADVNCLIVMGDSAGANLATVAARLHNEKNIDRRVDGQVLVYPVTGHDFKTASYDEFAEGNLLTRNDMQWFWDHYCPERAARANPLASPLEAEDLSMSPPALVMTAGRDPLRDEGEAYGARLRKAGVDVAVVRCDGLVHGFLAMIHQVPGAARAFDRIVDYITRLGEAVPEARR

SEQ ID NO: 58269 - protein, 386 aa, Brassica napus
MALNKIRTKMNEPRHPSVFQKVHGQTSLISTLSSTVQPRNHSVSGAYVNGGLQSLLQPTNHDTSLIPRGALPVLAQAPTEKSSTGFLIDFLMGGVSAAVSKTAAAPIERVKLLIQNQDEMLRAGRLSEPYKGITDCFTRTVKDEGVLALWRGNTANVLRYFPTQALNFAFKDYFKRLFNFKKDKDGYWKWFAGNLASGGAAGASSLLFVYSLDYARTRLANDAKAAKKGGQRQFNGIVDVYKKTVASDGVVGLYRGFNISCVGIIVYRGLYFGLYDSLKPVVLVDGLEDNFLASFLLGWGITIGAGLASYPIDTVRRRMMMTSGEAVKYTSSLQAFNQIVKKEGAKSLFKGAGANILRAVAGAGVLAGYDKLQLLVFGKKYGSGSG

SEQ ID NO: 58270 - protein, 486 aa, Glycine max
MHLELETWTILVAIVCILVFVLKEIVMGGKSSKGSGRRYDFGASSSSRDNNYGGYHPQSPYPSYQTPQHPRASAPFYDYAQPKRKLDKKYSRIADNYRSLDEVTAALANAGLESSNLIVGIDFTKSNEWTGKRSFNRKSLHDIRSGQNPYEQAISIIGKTLSAFDEDNLIPCFGFGDASTHDQDVFSFYSEERFCNGFEEVLTRYRQIIPSLKLAGPTSFAPIIEMAMTIVEQSGGQYHVLLIIADGQVTRSVDTQNGNLSPQEQNTIDAIVKASEYPLSIVLVGVGDGPWEMMREFDDNIPSRAFDNFQFVNFTEIMTRNVDSTRKETDFALSALMEIPSQYKATLELGILGSRRGHSPDRVALPPPLYSRTSSSISTKSTRSNSFQQRTPTHTSYDSSVHTETSSSSLYDNKVCPICLTNAKDMAFGCGHQGLQKDVQSWSGSFHRWFLVHKNCICNFQAKLVFPVTLRKSSLQKELAFPVVYM

SEQ ID NO: 58271 - protein, 465 aa, Clostridium paradoxum
MPDKNVGKVVQIIGPVLDIKFSSDNLPNLLNAIEIYHEGRKIVAEVAQHIGDDTVRCIAMSSTDGLVRGIDAIDTGNAISVPVGRKTLGRIFNVLGDPVDNKPEVEDAPKLPIHRPAPSFEDQETATEILETGIKVVDLIAPYAKGGKIGLFGGAGVGKTVLIMELINNIAKEHGGLSVFSGVGERTREGNDLYHEMIDSGVIDKTTLVYGQMNEPPGARMRVALTGLTMAEYFRDQEGQDVLLFIDNIFRFTQAGSEVSALLGRMPSAVGYQPTLATEMGALQERITSTKKGSITSVQAVYVPADDLTDPAPATTFAHLDATTVLSRQIAALGIYPAVDPLDSTSRILDPNIVGREHYEVARGVQSVLQRYKELQDIIAILGMDELSDEDKLIVARARKIQRFLSQPFSVAEQFTGMAGKYVPLKETIRGFREILEGKHDDLPESAFLYVGTIDEAVEKAKKGE

SEQ ID NO: 58272 - protein, 550 aa, Oryza sativa
  misc_feature (524)..(524): Xaa can be any naturally occurring amino acid
MQAWFSGTGPSASSASSSSSPPQPSLLAEWNSYAAARSAEEEEDGGGGGFGIDIEAAVRSANDRVSGTFGVVSKGVLGLPGSFKSTTSSVPSSKSLVYFGLFLASGIFLVFIAFTIFLPVMRLPFTMGFVGSMAATIYVSMVLHSYILSVFFSCLQNLTGILGGMARLPYPGTGDGVFAAHGYLRFGLGIWYILSLSLSAYELIKTAKYIATPGKGILAADESTGTIGKRLASINVENVEPNRQALRELLFTTPGAFQYLSGVILFEETLYQSTAAGTPFVDVLKAGGVVPGIKVDKGTVDIAGTNGETTTQGLDSLGARCAKYYEAGARFAKWRAVLKIGAAGEPSELAVKQNAEGLARYALICQENGLVPIVEPEILTDGAHDIKTCAAVTERVLAAVYKSLNDHKVLLEGTLLKPNMVTPGSDSPKVGAEVIGEYTVAALRRTVPPAVPGIVFLSGGQSEEEASQNLNAMNKLEVLKPWTLTFSFGRALQQSTIKKWGGKKENVAAAQAAFLARCKANSEXATLGKYGGAAGDAATSESLYVKGYTY

SEQ ID NO: 58273 - protein, 736 aa, Arabidopsis thaliana
MESEGVSLPLIHKHVMMPSHDQRKGDCCGRSEFTSGGYYCEICDFFVHRKCVDESSEYIKHTSHSVHTLKLQCKPHHICNLCGKSIKDLFYRCEICDFDVDLYCAKYPPPEVIDISETHHHKLTLFKKRTLVDCGASKCGEVMYGFPYKCHECNLAFHVDCVWNSPDTKNLLEVNHSHHPLHPLKLHIGQPPDYSDGKCRLCAQKIKEKLFYHCSACNFSLDMDCLLNPPPQSILDLKAHAHQLIFRPRLDSFTCNACGLNGDRSPYICVQCDFMIHQECFSLPRLININRHDHRVARTSVLGVVNSVCGVCHQKVDWTWGGYSCQRCPQYVIHSKCATRNDVWNGKELEGVPEEIEDIKPYVVIYGNIIQHFSHKEHYLRFHVNGFFRDGNKRCSACTYPIGLQSFYECIDCDFMLHQNCAEFPRKKWHMLHNDRLTLVTSVAEFFWCIACRRMSNGFKYQCGYGVLDVLCCSVSEPFVHPSHPDHPLYYIRQVKYRQCYGCNGRTYNVLTCIESCCGFVLCFCCATLPQVVMHRVDDHPLSLCYGEKASGKYWCDICEKELNPSTWFYTSKDHRASLHTKCVLGDFAGLMPRSTIKYGSRSYEVVLNNSVSRPFCRVCESHCMYPISLKMLGTSDPYICSLNCQKRLNSLDNLTKKLEALYVLKTTKKESDDDDRTQLQALLLAEETAKKEPDYADRMQLVCMYCKYCCYASTNKVLTLKRHIYGGFEDQRLEP

SEQ ID NO: 58274 - protein, 320 aa, Alteromonadales bacterium TW-7
MSSLNNIPPVGFGLWKVAQEDCAQTVYQAIKAGYRHLDCAADYGNEEQVGDGIAQAINDGLCTREELWITSKLWNTFHAPEHVELAIDKTLSDLRLDYLDLYLIHFPIAQTFVPIETRYPPEWFVDPDAQNPHMELAKVPLHLTWQAMEEQVHNNKAKRIGVCNYSSALLHDLMTYATVKPAMLQIESHPYLTQERLIRLAKQYDIPVTAFSPLGALSYLELEMADQTESVLEQSVVKAAAQNHGKTPAQVVLRWGVQRGTAIIPKTSKLERMTENLSLFDFELNEQEMADISALNINRRFNDPGHFCEAAFNRFHPIYD

SEQ ID NO: 58275 - protein, 263 aa, Pseudomonas fluorescens PfO-1
MAFVQLADGELHYSLESPVDAPVLVLSNSLGTDLHMWDVQMPAFTEHFRVLRFDTRGHGQSLVTPGPYSIEQLGRDVLALLDALHIERAHFCGLSMGGLIGQWLGINAGQRLNKLIVCNTAAKIGDPSVWNPRIETVLRDGPAAMVALRDASIARWFTPDFSAANPAAAKQITDMLAATNPEGYAANCAAVRDADFREQLSSIKAPLLVIAGTEDAVTPPSGGHFIQEHVRGAEYAEFYAAHLSNVQAGDAFSDRVLTFLLAD

SEQ ID NO: 58276 - protein, 496 aa, Bifidobacterium longum DJO10A
MSEQFDLVIIGAGPGGYSTALRAAELGMKVALVERDATVGGTCLNRGCIPSKALITATHTIDTVHRAAELGVNASVNGIDFGTLRDYRLRVVKTMVGGLAGLLAHRGITVFRANAAFHADETAPATSNHIVHLVPSPDQSDILTYHKADVPEPSGPTMDLTATNIVIATGAKPRPLPGNPFAGALIDSTQALEVNEFPSSAVIIGAGAIALEFASMWNAAGSKVTLLIRKDRVLSAWDRRAGTTLTRELKRHGVNIITRASVTHVDTGANLGATVHYTREGQDGEQSVWGEIALVAIGRDPITDPAWGVTIDDHGHVATDAYGRTDKPGVWAVGDVTAGHALAHRAFEQGIVIAETIAGLNPKPVDEATVPQIVFSFPEAASVGLTVEQAQAREDLIEIKETNYPMLANARMLMSGTAGSLTIVSGCDAANPDTPRVLGVHMVSQMASDIIAEAEQLVGNHVPLADAARLVHPHPTFSETLGEALLKADGRPLHTR

SEQ ID NO: 58277 - protein, 400 aa, Nostoc punctiforme PCC 73102
MSKKSLASLSSADISGKRALVRVDFNVPVDDQGKITDDTRIRAALPTIQDLTQKGAKVILASHFGRPKGVDDKLRLTPVAKRLSELLGQEVIKTDDSIGDEVAAKVAALQNGQVLLLENVRFYPEEEKNDAEFAKKLAANADFYVNDAFGTAHRAHASTEGVTKFLSPSVAGYLVEKELQYLQNAIENPQRPLAAIIGGSKVSSKIGVIETLLEKCDKLIIGGGMIFTFYKARGLSVGKSLVEEDKLELAKSLEAKAKERGVALLLPTDVVLADNFAPDANSQTVSIENIPDGWMGLDIGPDSVKFFQEALADTKTVIWNGPMGVFEFDKFAAGTEAIAHTLAEIGKTGTTTIIGGGDSVAAVEKVGLADQMSHISTGGGASLELLEGKVLPGIAALDDA

SEQ ID NO: 58278 - protein, 653 aa, Zea mays
  misc_feature (435)..(435): Xaa can be any naturally occurring amino acid
MGGSADANGAGSVRVPVPPARPFLDTFRGNLKETFFPDDPFRGVVRERGAGRRTVAALRYFFPFLEWAPAYALSTFKSDLIAGITIASLAIPQGISYAKLANLPPVLGLYSSFVPPLVYALMGSSKDLAVGTVAVASLLISSMLGSEVSPTENPVLYLHLAFTATFFAGVFQASLGLLRLGFIVDLLSHATIVGFMAGAATVVCLQQLKGMLGLVHFTTSTDVVSVMESVFSQTHQWRWESVLLGCGFLFFLLVTRFISKRRPKLFWISAAAPLTSVVLGSVLVYLTHAENHGIEVIGYLKKGLNPPSVTSLQFSPPYMMLALKTGIITGVIALAEGIAVGRSFAMFKNYHIDGNKEMIAIGTMNVLGSLTSCYLTTGPFSRSAVNYNAGCRTAMSNVVMSLAVMVTLLFLTPLFHYTPLVVLSAIIVSAMLGLXDFGAALHLWRVDKVDFCVCAGAYLGVVFGSVEVGLVVAVAVSLLRVLLFVARPRTTVLGNIPGTMVYRRMDQYAAAQTVPGVLVLRVDAPVYFANASYLRERISRWIDDEEERTKSQGEMGVRYVVLDMGAIGSIDTSGTSMLDELNKSLDRRGMQIVLANPGSEIMKKLDSSKVLEQIGHEWVFPTVGEAVASCDYVLHSHKPGMAKDSAAAHESMV

SEQ ID NO: 58279 - protein, 361 aa, Sinorhizobium meliloti
MKALVENLKATARETDATDIRAAFAADPNRFSRFSTAFDDLLFDYSKCAVNDRIIDGLEALAKAAKVEEKRDAMFRGDIINITEERAVLHTALRNRSNRPVLVDGKDVMPDVNAVLEAMGKFADDIRSGALKGATGKKITDVVNIGIGGSDLGPVMATLALAPFHDGPRLHFVSNVDGAHIADTLTLLDPETSLFIVASKTFTTIETMTNAATARAFIAGKLGEAAVGHHFAAVSTALDKVGAFGIDAARVFGFWDWVGGRYSIWSAIGLPLMIAIGKENFGRFLDGGHAIDEHFRSAPLRQNIPMLLGLIGFYNRNVLGYPSRAILPYDQRLTRFPAYLQQLDMESNGKGVTLDSQPVEF

SEQ ID NO: 58280 - protein, 669 aa, Arabidopsis thaliana
MERSVDLPIHKHPLYHSSRFINGRCRGCKQTSPIYSGYRCNDSDCNHVWYHKECGESLPEINHPSHLEHPLCLIDYRGSGTCAFCGAFLFGPTYHCWICAFNIDIACARKQLPPLAAIENPKCHNHSLVLLEKQVKKDHCGVCKKTVFGMYPYVCLECDVYFHVECINISREVHHSSHTNHTLELFGSESLPDSAQKTCLLCDDVSDHLIYHCSVCNFSICVYCAINPPPLAIEHLKTHEHTLTLLPRQVKFICNACGMKGDGCPYFCLGCGYLIHRKCIDLPRVININRHDHRISLTHHLGLQYSECGVCRQSVNGYYGGYSCSLCPNYVVHPQCAMKDDVWDGIELEGTPEDSEQDTAPFEVVDDNTIKHFSHEKHNLMLNKNGIITQHDEITRCQACVLPLSSDPSYSCGQCDYVLHETCANLPRKKRHVFNNKPFTLHTGGKDSSRNWFECDACRTISNGFRYVSGDWILDVHCGSMSEPLLHDGHSHPLYYYRRQGKSCRSCHNKVVKPRVLCCDTCDFDLDFYCANLPKTVKHCYDEHPLSLCHGEDDVIKDNKYWCDICETETDPKKWFYTCYDCGVTLHVKCVLGDFSRLMPGRNINVDGREYEVVPNSKSSRPFCDQCHSRCKDRFILKAWNNCNVVNCNLCVDVYICSRKCRQPFHLRH

SEQ ID NO: 58281 - protein, 375 aa, Chromobacterium violaceum ATCC 12472
MSNLPAILVLADGTLFKGSAIGAAGHTVGEVVFNTAITGYQEILTDPSYTRQIVTLTYPHIGNVGANSEDTESRAVFASGLIIRDLPLLHSNFRAEDSLSDYLKKHNVVAIADIDTRKLTRILREKGAQAGCIMAGDIDEAKALELARGFGSMAGQDLAKVVSCQKPYAWTEKQWKLGAGYQVQASTRFHVVAYDFGVKHNILRMLAERGCQLTIVPAQTPAADVLALNPHGVFLSNGPGDPEPCGYAIAAIRDILETKLPVFGICLGHQLLGLATGAATSKMKFGHHGANHPVQDLDTGRVMITSQNHGFQVDETSLPANVRVTHRSLFDGTVQGIALTDRPAFSFQGHPEASPGPEDVAYLFDRFIAAMAERQ

SEQ ID NO: 58282 - protein, 139 aa, Physcomitrella patens subsp. patens
MASAGGAETQVQKSEEEWRAILSPEQFRILRQKGTEYPGTGEYNKNKAEGVYNCAGCGTPLYKSTTKFDSGCGWPAFFEGLPGAINETTDADGRRVEITCAACGGHLGHVFRGEGFPTPTDARHCVNSVSLKFTPANKS

SEQ ID NO: 58283 - protein, 140 aa, Brassica napus
  misc_feature (11)..(12): Xaa can be any naturally occurring amino acid
  misc_feature (28)..(28): Xaa can be any naturally occurring amino acid
  misc_feature (32)..(32): Xaa can be any naturally occurring amino acid
  misc_feature (35)..(35): Xaa can be any naturally occurring amino acid
  misc_feature (39)..(39): Xaa can be any naturally occurring amino acid
  misc_feature (46)..(47): Xaa can be any naturally occurring amino acid
  misc_feature (52)..(52): Xaa can be any naturally occurring amino acid
  misc_feature (54)..(54): Xaa can be any naturally occurring amino acid
  misc_feature (58)..(60): Xaa can be any naturally occurring amino acid
  misc_feature (64)..(64): Xaa can be any naturally occurring amino acid
  misc_feature (72)..(72): Xaa can be any naturally occurring amino acid
  misc_feature (75)..(75): Xaa can be any naturally occurring amino acid
  misc_feature (78)..(78): Xaa can be any naturally occurring amino acid
  misc_feature (81)..(82): Xaa can be any naturally occurring amino acid
  misc_feature (85)..(85): Xaa can be any naturally occurring amino acid
  misc_feature (87)..(87): Xaa can be any naturally occurring amino acid
  misc_feature (90)..(91): Xaa can be any naturally occurring amino acid
  misc_feature (93)..(93): Xaa can be any naturally occurring amino acid
  misc_feature (97)..(98): Xaa can be any naturally occurring amino acid
  misc_feature (102)..(102): Xaa can be any naturally occurring amino acid
  misc_feature (105)..(105): Xaa can be any naturally occurring amino acid
  misc_feature (107)..(109): Xaa can be any naturally occurring amino acid
  misc_feature (111)..(111): Xaa can be any naturally occurring amino acid
  misc_feature (113)..(113): Xaa can be any naturally occurring amino acid
MASSMLSSAAXXTSPAQGTMVAPFTGLXSSAXFPXTRKXNNDITFXXSNGRXVXCMKXXXPVGXKKIENLSXLSXLTXMNXXKGXDXPFXXKXVSCXXIQMXHGXFXXXGXGXTPPILIGVLKGNFLGRADGGQKGKTKF

SEQ ID NO: 58284 - protein, 496 aa, Burkholderia xenovorans LB400
MGHMNETPALPAWLDGSPKLLLIDGQPTPARSGRTFETINPTTGKALAQIAEADEKDIDLAVAAARRALDGPWGRFKPFDRQAVLLKLADLVETHFDELALLDTLDMGGPIRSTGAKRTRAIGLLRFYAGLATSIHGSTIDNSQAGEVISYTVKEPVGVVAAINPWNGPLGLAIWKIAPALAAGCTVVLKPAEQAPLSPLRFGELCLEAGIPQGVVNVVTGFAGAGAALAAHPGVDKVAFTGSTEVGQHIIRASAGNIKRVSLELGGKSPNIVFADANLDAAVPGAAMAVFANSGQICSAGTRLFVQRSIHEEFVERLSSFAKTLRVGNPLDPDTQLGPLVSEAQLKRVTSYLDKGREEGARAVAGGTRLQNDELKNGYFVEPTVFDGVKDDMAIAREEIFGPVISVLPFDTAEEAVQRGNDTEYGLGSGVWTRDIGNAHRVARGLRAGSVWVNCYQVMDPAVPFGGYKMSGYGRESGVEHMEEFLQTKAIWIKTD

SEQ ID NO: 58285 - protein, 7510 aa, Streptomyces aizunensis
MGEVPMADQDKILGYLKRVTADLHQTRQRLREVEAQEPEPIAIVGMSCRFPGGIESPEGLWDLVAGGRDAITDFPTDRGWDIESLYDADPDQQGTSYTREGGFLDGVGKFDASFFGISPRETLGMDPQQRLLLETSWEAFERAGIDAATLRGSKAGVFIGTNGQDYPELLREVPKGVEGYLLTGNAASVVSGRISYTFGLEGPAVTVDTACSASLVALHLAVQALRNDECSLALAGGVTVMSSPRAFVQFSRQRGLAPDGRCKPFADGADGTGWGEGVGMLLVERLSDARRNGHPVLALVRGSAINQDGASNGLTAPNGPSQQRVIRQALTNAGLTPAQVDVVEAHGTGTTLGDPIEAQALLATYGQNRPEGRPLWLGSVKSNIGHTQAAAGVAGIIKMVLAMQHGVLPESLHIDQPSGNVDWAAGDVKLLTEAVPWPQTGQPRRAGVSSFGVSGTNAHTVIEQAPPADDAPETGADTAPTAEAPEAASADASEAGTPTGATGPVPVLVSGQSDAALRAQAERLAAHLRAHPGLGADTGTLTDLGFSLATSRSSLDRRAVLFGDRDSLLADLSALAEGEQPAGPVLGAVGEGKTAFLFTGQGSQRLGMGRELYATHPGFARALDEVRAELDQHLERPLFDVLFAAEGTPEADLLDETAYTQSALFAVEVALFRQLEQWGVGADFLIGHSIGELAAAHVSGVFTLADAAKLVAARGRLMQALPADGAMIAVEATEDEVAPLLTGRVSIAAVNGPRSVVVSGDEDAATALAETLRARGRRTKRLTVSHAFHSPLMDGMLDAFREVAESVAYAPPVIPIVSNLTGASVTAEEICAADYWVRHVREAVRFLDGVRKLSAQGVTTFVEVGPGGVLTALAQECVTGQDAVFVPVLRGDRPEAAAFATAVAQAHVHGVAVDWSAVFAGRGATRIDLPTYAFQRELYWPEQPTAWAGDVTAAGIGAADHPLLGAAIALADGDGHLFTGRLSLATHPWLADHTVMDTVLLPGTAFVELALQAGDHTGCDLLDELTLEAPLVLPPHGGVQIQLAVGAPDAEGRRSLTLHSRPEDAADDTWGEGAWTRHATGFLATAAQGAREPLADLTSWPPKNATKVDVEGLYAYLTESGFAYGPVFQGLTGAWQRGDEVFAEVRLPEQAHAEAALFGLHPALLDAALHAVGIGSLLEDTEHGRLPFSWSGVSLRAVGARALRVRLAPAGNDTVSVTLADETGAPVAAVDALLLRPVSPDQVHAARTAFHDSLFRVEWTGTPLPAATTVAAGQWALLGEPRTEFTAALPTAATHADLAALGAALDAGGPVPRAVIVPFSASGAPSATPVDAALPTAVADALHRTLELAQAWLADDRFAGSRLVFVTRDAVATTAGSDVADLAHAPLWGLLRSAQSEHPDRFVLLDLDGREDSLRALPAALATAEPQLALRAGKALVPRLARVAAAPGQEAPALDPDGTALVTGATGTLGGLVARHLVAAHGVRHLLLTSRRGEAAAGAAELAAGLRELGAEVTIAACDAADRDALAALIGSVPAEHPLTAVVHTAGVLDDGVLEALTPERIDAVLPAKVDAAVHLHELTRELDLAAFVLFSAAAGTLGGPGQANYAAANTFLDALAHRRRAEGLPATALAWGLWAERSGMTGDLADADLERISRAGVAALSSAEGLALLDTARAVGDPTAVPMHLDLASLRHADASMVPALLRGLVRAPARRSVESPGAAPAGGLAERLLPLTAAERDRLLLDTVRVQVAAVLGYPGPEAVDPGRAFKELGFDSLTAVELRNRLGSATGVRLPATLVFDYPTPNALSAFLRTELLGDAADSAPVAAVTARDDEPIAIVGMSCRYPGGVTTPEELWQLVAGSVDAISPFPTDRGWNLDALYDADPGRAGTSYTREGGFLHDAADFDPDVFGINPREALAMDPHQRLLLETSWEAFEQAGIAPSSMRGSRTGVFAGVMYHDYLTRLPAVPEGLEGYLGTGTAGSVASGRISYTFGLEGPAVTVDTACSSSLVALHLAAQALRNGECDMALAGGVTVMSTPDTFIDFSRQRGLSGNGRCKSFSADADGTGWAEGAGMILVERLSDARRNGHQVLAVVRGTAVNQDGASNGLTAPNGPSQQRVIRQALANAGLTTAEVDVVEAHGTGTTLGDPIEAQALLATYGQDRPAGQPLRLGSIKSNIGHTQAAAGAAGIIKMILAMRHGVMPPSLHIGEPSPHIDWTAGAVSLLTEAAEWPDAGRPRRAGISSFGVSGTNAHVIIEQPPVEEPATATETGSGTGLPAGTPLPFALSGRTPAALRAQAARLIGHLAPRPEAAPADVALSLATTRTALDRRAAVIAHDRTELLAGLTALAEGHDSARLVQHTAADGRTAILFTGQGSQRPGMGRELYETYPAFAEALDAVCAELDPHLEQPLKEVLFTADGDLLNRTGRTQPALFALETALYRLVESWGVRPDFVAGHSIGEITAAHVAGVLSLPDAATLVAARGRLMQELPEGGAMIALTATEDEVLPLLAGHEDRIGIAAVNSASSVVISGEEGLALEIAAEFERRGRRTKRLTVSHAFHSPLMDGMLDAFREVAESLTYRAPAIPVVTLLTGTVAGDELRTAEHWVSHVREAVRFLDGIRTLDAEHVTTYLELGPQGVLSGLGRDCLTDPADPADTAVFVPALRRDRGEAEALTAAIAAAHTRGVPLDWSAYFAGTGARRVELPTYAFQRERFWLEAPAGYIGDVESAGMGAAHHPLLGAAVALADGEGFLFTGRLSLDTHPWLADHAVMGNVLLPGTAFVELAIRAGDQAGCDLLEELTLEAPLILAPQAAARLQIVVGAPDGSGRRTLDVYSSDPDAPADEPWTRHAGGILATGAQAPAFDLTAWPPPGAEAVGVDGLYEHLGRGGFAYGPVFQGLRAAWLLGDDVYAEVALPDDRQAEAARFGLHPALLDAALHATFVQPSPDGDQQGRLPFSWRDVSLHAVGASALRVRLTPDGRDTLSLQLADTTGAPVAAVGHLTLRPVSADQLGSARSAHHESLFRIDWATVPLPSDAPAATDEWAVIAADGGTDGGTDGGTDGGIPAALPGRVHTGLDALGAAVDAGAPVPAHVLVHHTPAATTADAVHAATHEALRLVRAWLADDRFAASRLVFVTRGAIATQSDWDLTDLTHAPVWGLVRTAQSENPDRFVLADLDADPASTDALAAALATGEPQLAVRRGTVHAPRLARVPAATPLTPPPGESAWRMDIEDKGTLDHLTLVPSPESAAPLEPGQVRVAVRAAGLNFRDVLNALGMYPGDPGLMGSEGAGIVVETGPGVTGLAPGDRVMGMLPGSFGPLAVVDRRMIAPMPEGWTFAEAASVPIVFMTAYYALHDLAGLQGGESLLVHAAAGGVGMAAVQLARHWGADVYATASPAKWDTLRGLGLGDDRIASSRTLDFEETFRTATGGRGVDVVLDSLAREFVDASLRLLPRGGRFVEMGKTDVRSPQDVADAHPGVSYQAFDLTEAGLDRIQEMLTELLTLFRSGALRPVPVSAWDLRQAPEAFRYLSQARHVGKIVLTLPGEWNSQGTVLITGGTGTLGAVVARHAVTTRGARRLLLTSRRGEAAAGAAELAAELRELGAEVTIAACDAADRDALAALIESIPSEHPLTAVIHTAGVLDDGVVDSLTPERLSTVLRPKVDAAWNLHELTRHLDLADFVLFSSAAGTFGGAGQANYAAANVFLDALARHRHAHGLAATSLAWGLWAEASGMTGELDTADKDRMTRSGVLGLSSEEGVALLDTARLTGDALLVPMHLDLAPLRRTDASMVPALLRGLVRAPARRAVGATAAGAGTPLVERLVRLPENERDPLLLDLVRQQVAAVLGHATPDAVEPTRAFKDLGFDSLTAVEFRNRLGATAGIRLPATLVFDYPTPTVLAGYLKDELLGSEAAAALPKLAATAVEGDDPIAIVAMSCRFPGDVRTPEDLWELLAEGRDGISDLPDDRGWDTEALYDPDPDSPGTSYAREGGFFYDAHHFDPAFFGINPREALAMDPQQRLLLETSWEAFERAGIDPTGLRGKQVGVFVGQMHNDYVSRLNTVPEGVEGYLGTGGSSSIASGRVSYTFDFEGPAVTVDTACSSSLVALHLAAQALRNGECTLALAGGVTIITTPDVFTEFSRQRGLASDGRCKPFAEAADGTAWGEGVGMLLVERLSDARRNGHQVLAVVRGTAVNQDGASNGLTAPNGPSQQRVIRQALANAGLTAAEVDAVEAHGTGTRLGDPIEAQALLATYGQDRPEGSPLWLGSIKSNFGHTQAAAGVAGIIKMVQAMHHGVLPKTLHVDAPSPHVDWSAGAVSLLTEQMAWPETGRPRRAGVSSFGMSGTNAHAIIELAPDAATPSAARPEPAPAALPWNLSARTPDALRAQGERLLSHLETHCETHPETVLADIGHSLTTGRALFEHRATVVAGDRDGFRAGLAALAEGRTAAGLIQGSSSTGGRTAFLFTGQGSQRLGMGRELYEAYPVFARALDEVCARLELPLPLKDVLFGTDTGLLNETAYTQPALFAVEVALFRLVESWGLKPDFLAGHSIGEIAAAHVAGVLSLEDACALVSARGRLMGALPGGGVMIAVQASEGEVLPLLTDRVSIAAINGPQSVVIAGDEADAVAIVESFSDRKSKRLTVSHAFHSPHMDGMLDDFRAVAEGLSYGAPRIPVVSNLTGALVSDEMGSADFWVRHVREAVRFLDGIRALEAAGVTTYIELGPDGILSAMAQECITGEGAAFAPVLRAGRDEAETVLSALAAAHVRGVPVDWQAFYAPAGAQRVPLPTYAFQRSVYWLDAGRAQGDIASAGLGATDHPLLSAAVELPDSDGFLFTGRLSLATHPWLADHAVLGSVLLPGTAFVELALRAGDQVGCDLIDELTLEAPLVLPPHGGVQLRLAVAAADATGRRTLAFHSRSEDADAGTPWTRHASGVLAVGAERTPQSLTEWPPTGAESVPVDGLYEGLAESGFGYGPVFQGLRAAWRRDGEYYAEVALPEGTEDEAGRFGLHPALLDAALHALGLGSTDTEGGEGRLPFSWSGVHLHAVGASALRVRLTTSRSGEVALTIADAAGEPVATVAGLALRAVSREQLSTARDLTRDALFRVDWTALPAGGAVGSLDDWMLLGAGSQVYADLAGLGVAVAEGGGIPAALVVPVSEPDAESAAGGVAGTVHAAVERALSLVQEWLSDERFADARLVFLTRGAVAARAGDTVPGLVQAAVWGLVRSAQSENPGRFALIDVDGDGDGDGEVDGDVLSAALATGEPELAVREGALLVPRLARAAVVEGAGRELDVDGTVLVTGASGTLGGLFARHLVVERGVRRLLLVSRRGEAAEGAAELGAELTELGADVRWAACDVADRDALEAVLAGIPAEYPLSGVVHTAGVLDDGVVSSLTPERLSAVLRPKVDAAWNLHELTRGLDLSLFVLFSSAAGVFGGAGQANYAAANVFLDALAQHRRAQGLAATSLAWGLWAGVGGMGGELTESDRERINRGGITALEPETGLALFDAAQRTTDALLVPLPLDLAALRVQAGSGMLPDLLRGLVRVPVRRAAGQGSAAGGGSVLRTRLAAMPADERDAALLDLVRAEVAAVLGHASTDEVPADRAFKELGFDSLTSVELRNRLGATTGERLSATLVFDYPTPHALAEFLRTEVLGLDEPTDTATTAPTHLGTSLDDDPIAIVGMSCRYPGGVETPEDLWRLVVGGGDAISEFPQGRGWDLESLYDPDPDGKGTSYTRSGGFLHDAGRFDPAFFGISPREAVAMDPQQRLLLETSWEAFERAGIDPASMRGSRTGVFAGIMYHDYATRITSVPDGVEGYLGTGNSGSIASGRVSYAFGLEGPAVTVDTACSSSLVALHWAIQALRNGECTMALAGGVTVMSTPGTFTEFSRQRGLAADGRIKSFAAAADGTSWAEGAGMLLVERLSEARAKGHPVLAIVRGSAINQDGASNGLTAPNGPSQQRVIRQALAGARLTSDQIDVVEAHGTGTTLGDPIEAQALLATYGREREADQPLWLGSIKSNMGHTQAAAGVAGIIKMIMAIRHGVLPKTLHVDEPTPHVDWEAGAVSLLTESVPWPETGRPRRAGVSSFGISGTNAHTIIEQAPEEFVPVRVTESQTPGAGSRVLPFVLSAKSAGALRGQAVRLKAHVEASPEVSGAGAVDVAYSLATRRAVFDHRAVVVAGDREELLRSLAAVESEGAAAGVTRGAVGGGKLAFLFTGQGSQRLGMGRELYETYPVFARALDAACARLELPLKDALFGTDAGLLGETAYTQPALFAVEVALFRLLESWGVRPDFLAGHSIGEIAAAHVAGVLSLDDACALVEARGRLMQALPTGGVMIAVQASEAEVLPLLTDRVSIAAINGPQSVVIAGDEADAVAIVESFSGRKSKRLTVSHAFHSPHMDGMLAGFRKVAESLSYEAPRIPVVSNLTGALVTDEMGSADFWVRHVREAVRFLDGIRTLEAAGVATYVELGPDGVLSAMAQDCVTGEGAAFAPALRKGRPETETITTALALAHAHGTSVDWETYFAGTGAQGVELPTYAFQRDWYWLNSAVVQAGPGDASGFGLGATDHPLLDATIELPDSDGFLFTSRLSLDTQPWLADHAVLGSVLLPGTAFVEIAVRAGDQVGCDVLEELTLEAPLVVPERGGVQLRLTVAAADESGRRGLSLYSRDEDAPADEPWTRHASGVLATGAAAPDFDLAAWPPAGAEPVDIDGLYEGLAAAGFDYGPAFQGLRTAWLHGDAVYAEVSLDEESAESAEWFGLHPALLDATLHAAGLGGLVESTGQGRLPFAWSNVSLHAAGASAVRVRLAPAGRDAVSLQLADAAGAPVASVESLVLRAVSPDQIGAARGGRHESLFEIDWAALPLAPVSAAEQRPWALLADDGSGHAGLEAVGVRHEAHTGLAALADTGRAIPEVVCVPLAAANSQDLAGAGAVHAAVERALGLVQEWLSDERFADARLVFLTRGAVSAVPGEDVTDLVHAPVWGLVRSAQSENPGRFVLADTDGTDASYRALTAALASGEPEFTVRGGAVRVPRLTRSTAVAVEAVPELGSDGTVLVTGASGTLGGLFARHLVVERGVRRLLLVSRRGGAAEGAAELGAELTELGADVRWAACDVADRDALESVLAGIPAEYPLSGVVHTAGVLDDGVVSSLTPERLSAVLRPKVDAAWNLHELTRGLDLSFFLLFSSAAGVFGGAGQANYAAANVFLDALAQHRRAQGLAATSLAWGLWAEPGGMAGALDADDVSRLGRGGVSGLSAQEGVALFDAASASEQALFVPVKLDLAALRAQAGSGMLPPLLSGLVRTPTRRAAGTGGTGDTGTDGGTALRERLAGLAPAARDEALLELVCTYVAAVLGFAGPEAVDPARSFSEVGFDSLTAVELRNRLGAATGVRLPATLVFDYPTPDALVEYLRDELWQDGAAAVPPLLAELDRLEKTLVASVPDDDGRTRITERLQALLAAWSEAGESTDTADADVAEALETATDDDLFDFIGKEFGIS

SEQ ID NO: 58286 - protein, 510 aa, Oryza sativa Japonica Group
MESMLVAGAGAAAVAAVGGLVAAAALADKLVAAPPPRKNRANPPPAVPGLPIIGNLHQLKEKKPHQTFAKWSETYGPIYTIKTGASPVVVLNSTEVAKEAMIDKFSSISTRKLPKAMSVLTRESMVAISDYGDYQKMAKRNIMIGMLGFNAQKQFRGTRERMISNVLSTLHKLVSLDPHSPLNFRDVYINELFSLSLIQSLGEDVSSVYVEEFGREIPKDEIFDVLVHEMMMCAVEADWRDYFPYLSWLPNKSFDTIVSTTEFRRDAIMNALIKKQKERIARGEARASYIDFLLEAERSAQLTDDQLMLLLSESILAAADTVLVTTEWTMYEIAKNPDKQELLYQEIREACGGEAVTEDDLPRLPYLNAVFHETLRLHSPVPVLPPRFVHDDTTLAGYDIAAGTQMMINVYACHMDEKVWESPGEWSPERFLGEGFEVADRYKTMAFGAGRRTCAGSLQAMNIACVAVARLVQELEWRLREGDGDKEDTMQFTALKLDPLHVHLKPRGRM

SEQ ID NO: 58287 - protein, 317 aa, Mycobacterium tuberculosis H37Rv
MAKDLVATVPDLSGKLAIITGANSGLGFGLARRLSAAGADVIMAIRNRAKGEAAVEEIRTAVPDAKLTIKALDLSSLASVAALGEQLMADGRPIDLLINNAGVMTPPERVTTADGFELQFGSNHLGHFALTAHLLPLLRAAQRARVVSLSSLAARRGRIHFDDLQFERSYAPMTAYGQSKLAVLMFARELDRRSRAAGWGIISNAAHPGLTKTNLQIAGPSHGRDKPALMERLYKTSWRFAPFLWQEIEEGILPALYAAATPQADGGAFYGPRGRYEVAGGGVREAKVPAAARNDADSKRLWEVSEQLTGVSYPKSR

SEQ ID NO: 58288 - protein, 152 aa, Solanum chacoense
MTTPGEKAQEIQPQTHKMQKSQLYFNPLKALFFLLLFSHAQMRFCSGVSVLDLKSVKDSNFNLMGKRGCSEKLQECSEMVGEEDLMDSESNRRVLLMQKKYISYGTLKRDLVPCNTPGASYYNCKAPGAANNYNRGCEIITRCARDVSDIKS

SEQ ID NO: 58289 - protein, 468 aa, Escherichia coli O157:H7 EDL933
MIREPPEHILNRLPSSASALACSAHALNLIEKRTLDHEEMKALNREVIEYFKEHVNPGFLEYRKSVTAGGDYGAVEWQAGGLNTLVDTQGQEFIDCLGGFGIFNVGHRNPVVVSAVQNQLAKQPLHSQELLDPLRAMLAKTLAALTPGKLKYSFFCNSGTESVEAALKLAKAYQSPRGKFTFIATSGAFHGKSLGALSATAKSTFRKPFMPLLPGFRHVPFGNIEAMRTALNECKKTGDDVAAVILEPIQGEGGVILPPPGYLTAVRKLCDEFGALMILDEVQTGMGRTGKMFACEHENVQPDILCLAKALGGGVMPIGATIATEEVFSVLFDNPFLHTTTFGGNPLACAAALATINVLLEQNLPAQAEQKGDMLLDGFRQLAREYPDLVQEARGKGMLMAIEFVDNEIGYNFASEMFRQRVLVAGTLNNAKTIRIEPPLTLTIEQCELVIKAARKALAAMRVSVEEA

SEQ ID NO: 58290 - protein, 348 aa, Kluyveromyces lactis NRRL Y-1140
MSIPETQKGVIFYENGGELQYKDIPVPKPKANELLINVKYSGVCHTDLHAWKGDWPLPTKLPLVGGHEGAGVVVAMGENVKGWNIGDFAGIKWLNGSCMSCEYCELSNESNCPDADLSGYTHDGSFQQYATADAVQAARIPKGTDLAEVAPILCAGVTVYKALKSADLKAGDWVAISGACGGLGSLAIQYAKAMGYRVLGIDTGAEKAKLFKELGGEYFVDYAVSKDLIKEIVDATNGGAHGVINVSVSEFAIEQSTNYVRSNGTVVLVGLPRDAKCKSDVFTQVVKSVSIVGSYVGNRADTREALDFFARGLVHAPIKIVGLSELADVYDKMVKGEIVGRYVVDTSK

SEQ ID NO: 58291 - protein, 91 aa, Zea mays
IGFINKIYHPNVDEMSGSVCLDVINQTWSPMFAALMMRDRPAYEQKVKEYCEKYAKPGDAGVTPEEQSSDEELSEDEDDSGDEEIMGKPDP

SEQ ID NO: 58292 - protein, 160 aa, Oryza sativa Indica Group
MSGKDHKKATALEEKLELLRAVTKSSAANETSILVDASKYIKELKDKVSQEPEQLGSTSSSMPMPRVSVSSVELEKKRGFRINVSMEKSQPELLTSVLEAFEELGLDVLDADVSCADDTAFRLEALGSSQSEAAERSVDEQMVRHAVLQAIKKCMDGSSI

SEQ ID NO: 58293 - protein, 141 aa, Triticum aestivum
  misc_feature (99)..(99): Xaa can be any naturally occurring amino acid
YGAGARSASSSCSSVRGGRPGGFRDFGRTDGNVILAGFSTELGGPAWDLEEDDAVKLVATHPASGIVSLTAGQKVPVRGDADRKDRGLNCLAAELDLDXIPHGGRVLVLNNANLSLVKKVGVEADLVRIYAHSMRAQGFLQ

SEQ ID NO: 58294 - protein, 255 aa, Brucella suis 1330
MSYESPFHLNDAVAIVTGAAAGIGRAIAGTFAKAGASVVVTDLKSEGAEAVAAAIRQAGGKAIGLECNVTDEQHREAVIKAALDQFGKITVLVNNAGGGGPKPFDMPMSDFEWAFKLNLFSLFRLSQLAAPHMQKAGGGAILNISSMAGENTNVRMASYGSSKAAVNHLTRNIAFDVGPMGIRVNAIAPGAIKTDALATVLTPEIERAMLKHTPLGRLGEAQDIANAALFLCSPAAAWISGQVLTVSGGGVQELD

SEQ ID NO: 58295 - protein, 531 aa, Vitis vinifera
MAAPRIFSLLSASSTAASLRSFGRYSRWGRGSSRFSTAEEPITPPVQIDYTQLLINGRFVDAASGKTFPTLDPRTGDVIAHVAEGEAEDINRAVSAARKAFDEGPWPKMTPYERSCILFRFADLLEKHCSEIAALESWDNGKPYEQAANVEIPMVIRVFRYYAGWADKIHGLTVPADGLHHVQTLHEPIGVAGQIIPWNFPLLLYGWKVGPALACGNTIVLKTAEQTPLSALYASKLLYEAGLPPGVLNVVSGFGPTAGAALSSHMDVDKLAFTGSTGTGKIVLGLAAKSNLKPVTLELGGKSPFIVCEDADVDKAVELSHTALFYNQGQSCCSGSRTFVHESIYDEFIEKAKARALKRVVGDPFKKGVEQGPQIDSQQFNKILGYIKSGIEAGATLEAGGEKFSSKGYYIQPTVFSNVHDNMLIAKEEIFGPVQSILKFKDLDEVIRRANATHYGLAAGIFTQNLDTANTLTRALRVGTVWINCFFVFDAAIPFGGRKMSGHGREKGIYGLSNYMQVKAVVTPLKNPAWL

SEQ ID NO: 58296 - protein, 435 aa, Alteromonadales bacterium TW-7
MTSATSPSTFNELGLIPELQARLTDLEYSQPTPIQAKAIPSVLAGSDLIAGANTGSGKTATFALPMLQKLFLEQGAKKTASKGNFVTGLILVPTRELATQVADSVKSYSANFNGAIKTVAVFGGVSVNTQMQALRGGADIIVATPGRLLDLISSNAIKLDKVTTLVLDEADRMLSLGFTEELAELLALMPAKKQTMLFSATFPEQVTQLTQKLLTNPVEIQVQSKDESTLVQRVFTVNKGEKTTVLAHLIKEHKWRQALIFVNAKKDCEHLAGKLEKRGINAQVFHGDKGQSERTRVIEKFKAGEIEVLIATDIAARGLDIAKLPVVINFNLPRSPADYMHRIGRSGRAGEVGLALSLIDYEDFHHFKIIEKKNKLRLEREEVTGFAVNQANLDAADALKNDKPMAKPEGTGKKKKKNKVNPEDDAWSGWRNRSK

SEQ ID NO: 58297 - protein, 535 aa, Shewanella sp. MR-7
MTQLSSRINARSDEFKAKSDDMAALVADLKTKLAKIELGGGPVALERHLARGKLLPRQRVEKLLDAGSPFLELSQFAAFDVYDEEVPAAGIIAGIGRVSGVECMIIANDATVKGGTYYPITVKKHLRAQEIASRCHLPCIYLVDSGGANLPRQDEVFPDRDHFGRIFYNQAQMSAKGIPQIAVVMGLCTAGGAYVPAMADESIIVKEQGTIFLAGPPLVKAATGEEVSAEELGGADVHTKISGVADHLAQNDEHALELARRAVLRLNHQKQINSLLSPVKPPKFNISELYGIVGTDLKKPFDVKEVIARIVDDSDFDEFKANYGATLVCGFARIHGYPVGIVANNGILFSESAQKGAHFIELCCQRKIPLLFLQNITGFMVGKKYEHEGIAKHGAKMVTAVSCANVPKFTVIIGGSYGAGNYGMCGRAFEPTMMWMWPNARISVMGGEQAAGVLATVRRDGLARKGEEWSAEDEKAFKAPIIAQYDKEGHPYHASARLWDDGIIDPAQTRDVVGLALSAALNAPIEDTRFGVFRM

SEQ ID NO: 58298 - protein, 542 aa, Vitis vinifera
MRNNWVGLFLILVVFGGFSSVSASPPVASEYKLQNPYVSFAFTHLSASNVWFCFNFQLCLHFHILLFAEIVSGIVSNVVSALVKWLWSLKSTTNTAISSRSKMNFEDGYTVETVFDGSKLGIEPYSLEVSTSGELLVLDSENSNIYKISSPLSRYSRPKLVAGSPDGYSGHVDGKLREARMNHPKGLTMDERGNIYIADTMNMAIRKISDAGVTTIAGGKWGRGGGHVDGPSEDAKFSNDFDVVYIGSSCSLLVIDRGNQAIREIQLHYEDCAYQYNGSFHLGIAVLVAAGFFGYMLALLQRRVAAMFSSQYDSSTPMKKGMPPESYQRPLKSVRAPLIPTEDEYEKADEGFFGSLGRLFLNTGSTLAEIFGGLFSGSRKKPPHQQIQQQYGQPNVHSNGWPMQESYVIPDEDEPPSIESRAPTPKKTYPFMTPEMEKTHHFRQSRTFYSNGWDGNYQQLQQKQIQQKQQYQQHHQKHYSSNPQTYYEQSCETKNEIVFGAVQEQDGRREAMVIKAVDYGDPVYNHHNIRPRLNYMGYSHAY

SEQ ID NO: 58299 - protein, 459 aa, Pseudomonas putida GB-1
MNPTLQTTLLIIGGGPGGYVAAIRAGQLGIPTVLVEGQALGGTCLNIGCIPSKALIHVAEQFHQASRFTEPSPLGISVASPRLDIGQSVAWKDGIVDRLTSGVAALLKKHGVKVVHGWAKVLDGKQVEVDGQRIQCEHLLLATGSSSVELPMLPLGGPVISSTEALAPKALPQHLVVVGGGYIGLELGIAYRKLGAQVSVVEARERILPTYDSELTAPVAESLKKLGIALHLGHSVEGYENGCLLANDGKGGQLRLEADQVLVAVGRRPRTQGFNLECLALKMNGAAIAIDERCQTSMHNVWAIGDVAGEPMLAHRAMAQGEMVAEIIAGKARRFEPAAIAAVCFTDPEVVVVGKTPEQASQQGLDCIVAQFPFAANGRAMSLEAKSGFVRVVARRDNHLILGWQAVGVAVSELSTAFAQSLEMGACLEDVAGTIHAHPTLGEAVQEAALRALGHALHI

SEQ ID NO: 58300 - protein, 423 aa, Pseudomonas putida GB-1
MGTHVIKMPDIGEGIAQVELVEWFVKVGDIIAEDQVVADVMTDKATVEIPSPVSGKVLALGGQPGEVMAVGSELIRIEVEGSGNHVDTPQAKPVDTPSAPVAAKPEPQKEMKPAAYQAPAQHEAAPIVPRQPGDKPLASPAVRKRALDAGIELRYVHGSGPAGRILHEDLDAFMSKPQRAAGQAPSGYAKRSDSEQVPVIGLRRKIAQRMQDAKRRVAHFSYVEEIDVTALEALRQQLNSKHGDSRGKLTLLPLLVRALVVALRDFPQINATYDDEAQIITRHGAVHVGIATQGDNGLMVPVLRHAEAGSLWANAGEISRLANAARNNKASRDELSGSTITLTSLGALGGIVSTPVVNTPEVAIVGVNRMVERPVVIDGQIVVRKMMNLSSSFDHRVVDGMDAALFIQAVRGLLEQPACLFVE

SEQ ID NO: 58301 - protein, 328 aa, Streptomyces aizunensis
MANKPILFYVLEGIADAGVTDVGIIVGDTADEIRAAVGDGSRFGISVTYIPQHQPLGLAHAVRIARDWLGEDDFVMYLGDNFLLGGISEQLEEFRTRRPAAQIMLTRVPDPSAFGVVTLDEAGRVTGLEEKPKFPKSDLALVGVYFFTAAVHDAVDAIQPSARGELEITEALQWLLDKGLGIASSTVNGYWKDTGNATDMLEVNRTVLDRLTPYCDGSVDGESELVGRVVVEDGAVITRSRIVGPAIIGRGTRVEGSYIGPFTSVGADCVVVDSEIEYSIVLAGAAIDGVGRIEASMIGRQAQVTPAPRTPQAHRLILGDHSKVQIRS

SEQ ID NO: 58302 - protein, 515 aa, Haemophilus somnus 2336
MVKNMISNLTEQPSGAEYLKAILSSKIYELAQVTPLQPMLKLSERLSNTVLVKREDRQLVHSFKLRGAYAMIAGLSQPQKNAGVITASAGNHAQGVALSAKNLGLNALIVMPQNTPRIKVDAVRGYGGEVLLYGANFDEAKAKAIELSESKSMTFIPPFDHPAVIAGQGSLAMELLQQNSHIDRIFVPVGGGGLAAGVAVLIKQLMPDIKVIAVESKDSACLHAALKVGQPVDLERVGLFADGVAVKRIGNETFRVCQQYIDDVVLVDSDEVCAAMKDMFENVRAIAEPSGAVSLAGLKKYVKEHNIQGETLVNILSGANLNFHTLRYVSERCEIGEKHEAIFAVTIPEEKGSFLRFCHLLGDRPVTEFNYRYADKEQACIFVGVRISSEKEKLEIIQQLEQNDYKVMDLSDDEIAKTHIRYMIGGRTTSNSKERLYSFEFPEQKGALLKFLMMLGTHWNISLFHYRAYGADYGNVLAGFQLDEHDEIRFNGHLEELAYTYQDVTDSPAYKYFLA

SEQ ID NO: 58303 - protein, 231 aa, Picea sitchensis
MEDQVEVSAIEVLPVDALAHCFLSLSSFKDLAQVSIVCRKWREAVKQSLARRDKLSFAGWKMDDNSLARLVQGAFGLKELDISRGCWGCRITDDGLYKISLAKCCINLTSVSMWGITGITDNGVIQLVSRARSLQHLNIGGTFITDDSLFIIASHCPQLKVLILWGCRHVTERGLFALIRGCPKLESINVWGMRVSLECYVGLLTIKPHLLIKPGGVHLHAGRVPQWPIVQ

SEQ ID NO: 58304 - protein, 224 aa, Oryza sativa Japonica Group
MDVSAALSSDYSSGTPSPVAADADDGSSAYMTVSSAPPKRRAGRTKFKETRHPVFKGVRRRNPGRWVCEVREPHGKQRIWLGTFETAEMAARAHDVAALALRGRAACLNFADSPRRLRVPPIGASHDDIRRAAAEAAEAFRPPPDESNAATEVAAAASGATNSNAEQFASHPYYEVMDDGLDLGMQGYLDMAQGMLIDPPPMAGDPAVGSGEDDNDGEVQLWSY

SEQ ID NO: 58305 - protein, 307 aa, Bacillus cereus G9241
MEKVLFFGDPGIDDSFAIMYGLLHPEIEIVGIVTGYGNVEHIHAAHNAAYILQLANRQDIPVISGATKPLTEEITTYYPEIHGAEGLGPIHVPEKVLSIPIYNFGSIAAILIKYGKDLTIVDVGRSTSLAIAFNLWNDLMLNVKGIYFMGGVFLEVGNVTPLAEANVYGDPIASKIVFQQAKNLFIFPLNVTNKAVLTPNVISYIQANSKNPFHTIMKPMYDYYLSAYQKLNPSIEGPLLHDVVAISGLVNPSFFEFAHRTVNVDTYGDTKGQTFADFRPSSISKGARIALEIDEQKFIQDFIKIML

SEQ ID NO: 58306 - protein, 701 aa, Zea mays
MVAALPAQNSPVVQLAEGYSVNHMVSPQRAEESTLRGYSNLSTLETRQQKVIQPADVQSIAGNENPKREDGLDGACAQKRFFLKASFTKSECSKLLSPIRWILKREYLTSCIEAGKFVDEEPFEWFGTGFNDGRTISFDAPRKWRNIRQQMGHGAFYGMQIVAYGQFILPTLDTVKRAVKAGNGAVLATSPPYTRNSSATAHGIPCVSADYLVEYVCKPGQPLDRHVLFETNCVASMSLEKLTKKQLEMATAEKSEPSEDDDPEDLSCSACGRRDRGDVMLICGDEAGGGIGMHIDCCDPPLDAVPDDDWMCPRGSRELKGAEPNQGRAQDECARRRLRRRTRHSVPTVPRNRWNPTSPTAVSSLCFPEPESEKSPFDMDTEPLLPAHLLHSLPEHSEVFHFSPPPSPSCPSPASSYKDRIIFGAHPPPPQPPPPPPLPPSHSHRAHRRRSSVDGLYDFDLPSCSSSPPSPPSDPEDPSSAAAAGASSLFEFIANAASARTNLHRSRTAPAMAPLSAVTLAAAAAAGDQAPAPPERPSIVLHTFLFLLAYLALGEHLLITALKNPTSARKHRHNYIFDVKKGRMRIRMKVALALGVVAVCVGVGAAVLRRVESLGWLDAVYLAVMSVTTVGYGDQAFRTLAGRLFASAWLLVSTLAVARAFLYLAEMRIDKRHRAMANWVLSRDMTVSEFLAADIDNNGYV

SEQ ID NO: 58307 - protein, 228 aa, Haemophilus somnus 2336
MTPYLIAPSILSANLARLGEDVENVLKSGADVIHFDVMDNHYVPNLTFGPAICKALRDYGIKAPIDVHLMVKPVDRIIPDFAKAGADYITFHPEASEHIDRSLQLIRDCGCKAGLVFNPATPLSYLDYVLDKIDVILLMSVNPGFGGQAFIPSTLEKLKQARKIIDESGLDIRLEVDGGVKVNNIAEIAQAGADMFVAGSAIFDQPDYKKVIDEMRQQLSTIREKETK

SEQ ID NO: 58308 - protein, 214 aa, Zea mays
MSEEDKAAASAEQPKRAPKLNERILSSLSRRSVAAHPWHDLEIGPDAPAVFNVVVEITKGSKVKYELDKKTGLIKVDRVLYSSVVYPHNYGFVPRTLCEDNDPMDVLVLMQEPVVPGSFLRARAIGLMPMIDQGEKDDKIIAVCADDPEYRHYNDISELSPHRLQEIKRFFEDYKKNENKEVAVDAFLPATTAREAIQYSMDLYAQYILQSLRQ

SEQ ID NO: 58309 - protein, 371 aa, Campylobacter lari RM2100
MLDISLIMLSAGESSRFNAPVKKQFLRLGEQPLWLYATKNLSSFYPFKQIVVTSGNISYMKKFAPEYKFVQGGATRAQSLLNALSMVESEYVLVSDVARVLISKNLFNNIIENHDKADCITPVLKVSDTTIYAQEAIDRDKIKLIQTPQLSRTSMLKKALEQSSNFTDDSTAIQAIGGKIWYVQGDELAKKITFKEDLKSLNLPKPSWDIFNGNGFDVHEFGEQRALLLGGVKVHENMGLKAHSDGDVLAHALIDALLGAAGLGDIGELFPDNDMQYKNADSMLLLQNAYTLVQNYGFELVNADITIIAQTPKMKEFKEAIAFNIAKTLKTTPNKINIKATTTEHLGFVGRKEGIAVLTSVNLKYFDWMKL

SEQ ID NO: 58310 - protein, 242 aa, Triticum aestivum
  misc_feature (219)..(219): Xaa can be any naturally occurring amino acid
ALTAMARAKAPRRKPPQAVSRRLLGFCGLSFAAALYVGIDYLRYLSPTWHNRLQPVLWAALALAAAARAPFYRHWDVELRAVLPFLGSIVFMLSAFLIEMISVRFVSVLMGLQWHGSAAPLPDTGQWVLLALNEKLPGSVVGLLRAHVITLHHYLMLFMMLGFSLLFDCIKAPGLGIPPRYMSTMAIGRVLPGGTFGWYNSFHLQKPGGRSGRYQLPGXPHPWAQKILVPNGSESKCISAGP

SEQ ID NO: 58311 - protein, 367 aa, Campylobacter lari RM2100
MKEKIEERLKQVIYPGFKKDIVSFGFVKKIESNDQKAHVVVEIVSANAQIAQELRLNIANALKDLNLELNLEIIQPKIPEEKSNSRSGKNIAPQIKNFLMISSGKGGVGKSTTTLNLAISLAKMGKRVGLLDADIYGPNIPRMLGESKSKPEIVGQKIRPILSHGVYMMSMGVLIEEGKGLMWRGSMIMKAIEQLLADVLWPELDVLLLDMPPGTGDAQITLAQSVPVSAGVCVSTPQVVSLDDSKRALDMFEKLHIPVAGIIENMSGFLCPDNGKEYDIFGKGTTEEMAKAYKCEVLAQIPIEMSVREGGDSGKPVSFYMPESVSSKRYLQAAEKIWEFIEKVNQEGKVDNSAIQPVMNGKSACSQ

SEQ ID NO: 58312 - protein, 427 aa, Ipomoea batatas
LGGGAGTRLYPLTKKRAKPAVPLGANYRLIDIPVSNCLNSNVSKIYVITQFNSAYLNRHLSRAYASNMGGYKNEGFVEVLAAQQSPENLWSQGTADAVRQYLWLFEEHNVLVLEFLVLAGDHLYRMDYERFIQAHRETDADITVAALPMDEKRATAFGLMKIDEEGRIIEFAEKPKREQLKAMKVDTTILGLDDQRAKELPFIASMGIYVISKNVMLNLLREKFPGANDFGSEVIPGATSIGMRVQAYLFDGYWEDIGTIEAFYNANLGITKKPVPDFSFYDRSAPISTTPRYLPPSKMLDADVTDSVIGEGCVIKNCKIHHSVVGLRSCISEGAIIEDSLLMGADYYETDADRRLLAAKGSVPIGIGRNSHIKRAIIHNIARIGNDVKIINNDNVQEAARETEGYFIKSGIVTIIKDALIPSGTII

SEQ ID NO: 58313 - protein, 222 aa, Zea mays
MDWAYYGSGYSTPASGGGGGDEDAYMTVSSAPPKRRAGRTKFKETRHPVYKGVRSRNPGRWVCEVREPHGRQRIWLGTFETAEMAARAHDVAALALRGRAACLNFADSPRRLRVPAQGAGHDEIRRAAVEAAELFRPQPGERNVGGSEAAAEAAAAAPCAMGSGDLGGGEFPYYPVDDGLEFEMRGYLDMAQGMLIDPPQPAAGQSAWIEDEYECEVSLWSY

SEQ ID NO: 58314 - protein, 424 aa, Synechocystis sp. PCC 6803
MWLIRRRPGKGAQPWIRLQGLNFFPLRPNGPIPATLQYIIMPIAAAKPALLVLADGTPYPGWSFGADGTTVGEVVFNTGMTGYQEVMTDPSYCGQIVTFTYPELGNTGVNAEDEESIHPHVKGVVARNITRRPSNWRSTQSLPDYLVEHKIIGIYGIDTRALTRKLRSIGAMNGGISTEILEPEALLHHIQAAPSMAGLNLVKEVTTHEVYEWTDSTNDHWQFGPVAEQQGQPPLTVVALDFGVKRNILRRLASYGCRVIVVPASTSAAEILQYNPDGIFLSNGPGDPSAVEEGIVTTKELLAAKKPMFGICMGHQVLGLSLGAETFKLKFGHRGLNQPCGLEQQVEITSQNHGFAVTEGSLAEEVEITHFNLNDKTVAGLRHKELPFFSVQYHPEASPGPHDADYLFEKFVKLMRQQKAEVAG

SEQ ID NO: 58315 - protein, 446 aa, Zea mays
MAATIQSVKARQIFDSRGNPTVEVDVFCSDGTFARAAVPSGASTGVYEALELRDGGSDYLGKGVSKAVNNVNSVIGPALIGKDPTAQTEIDNFMVQQLDGTKNEWGWCKQKLGANAILAVSLAVCKAGASIKRIPLYQHIANLAGNKQLVLPVPAFNVINGGSHAGNKLAMQEFMILPTGAASFKEAMKMGVEVYHHLKSVIKKKYGQDATNVGDEGGFAPNIQENKEGLELLKTAIEKAGYTGKVVIGMDVAASEFYSDKDQTYDLNFKEENNDGSQKISGDSLKNVYKSFVSEYPIVSIEDPFDQDDWVHYAKMTEEIGEQVQIVGDDLLVTNPTRVAKAIKEKSCNALLLKVNQIGSVTESIEAVKMSKRAGWGVMTSHRSGETEDTFIADLAVGLSTGQIKTGAPCRSERLAKYNQLLRIEEELGAIAVYAGAKFRAPVEPY

SEQ ID NO: 58316 - protein, 188 aa, Treponema pallidum subsp. pallidum str. Nichols
MESLIGKRVIDFKLPAYVGGKFTEVSNASIKGSWAVFMFYPADFTFVCPTELADLARVYPSFVEIGCKVYSVSTDSEYVHKAWADATDTIKNLPYEMISDKAGKLAGFFGVLLPDTWHALRGTFVVDPEGLVKAFEVHDMGIGRDADELLRKVQSAQFVAKHGDQVCPARWKPGAKTLKPGIDLIGKI

SEQ ID NO: 58317 - protein, 612 aa, Pseudoalteromonas tunicata D2
MTAIYIAGIALCSVLAQWLAWAVKIPAILFLLVTGLLLGPVFNVLDPDALFGDLLFPLISLSVAVILFEGSLTLHFRELKGIGKVVRNLCSIGMVVTCVILGLSSYWLLGLDWRVAAVIGAVLVVTGPTVTAPLLNAMRPTKEVDRILRWEGIVIDPIGALFAVLVFEAVMLAGKTGVLSHTLIALITTVGVGLSIGILAGWLTAFLIRREWLPYELHKFGVLALVLISFTVSNFISHESGLLAVTVFGIYLANQDDLELDSILEFKEDLSQILISTLFILLAARLKLSDLMLLGPSVVVFLLIVLFVARPACIAVSTHNSTLPWRARAILMWIAPRGIVAAAVGSVFALSMAKAGIADAQKIVPLIFTVIIVTVVLQSLTAIPIAKLLKMRQPKPSTVLIIGANHLARAIAKGLQDQKIEVHLSDPAWENCKMARMDGLTCYYGNPQSEHAERYLPMSNLKSVLALSPNRHHNALGVQYFSHMLGEKNVYSLKSSDAHAKANKDSATFLSRQILFGDSASYARLSSMVAKGGKVSSTKLADAFTWQDYLEVNKDAVPLFIFKLTDEEFIHLTPFTVGLDRTPSSGDMIIAMQPPKMSVLKEPNSNMGAVES

SEQ ID NO: 58318 - protein, 468 aa, Shigella flexneri 2a str. 301
MSKQQIGVVGMAVMGRNLALNIESRGYTVSIFNRSREKTEEVIAENPGKKLAPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLSNEELAQTFTEWNNGELSSYLIDITKDIFTKKDEDGNYLVDVILDEAANKGTGKWTSQSALDLGEPLSLITESVFARYISSLKDQRVAASKVLSGPQAQSAGDKAEFIEKVRSALYLGKIVSYAQGFSQLRAASEEYNWDLNYGEIAKIFRAGCIIRAQFLQKITDAYAENPQIANLLLAPYFKQIADDYQQALRDVVAYAVQNGIPVPTFAAAVAYYDSYRAAVLPANLIQAQRDYFGAHTYKRIDKEGVFHTEWLD

SEQ ID NO: 58319 - protein, 399 aa, Treponema pallidum subsp. pallidum str. Nichols
MRRGGACVQKKEYLPLTSRQPGVCLLSEILVRALEARSFFLVVVTVPAGEVAYAESQVACDSRLSAFPSRTRPVILYVPGAHTRSASVRAGLDAMATHAPDVVLVHDGARPFVSVALIHSVLEATCRYGAAVPVIEATDTPKGVAADGSIETHLIRSRVRLAQTPQGFCYASLCAAHHRAATDGEQYTDDSELYARYGGTVHVCAGERSNVKITYPEDLEQRASEPALTRGISVLPCTEEGALRVGLGTDMHALCAGRPLILAGIHIPSKKGAQGHSDADVLAHASIDALLGAAGLGDIGTFFPSCDGRWKDAHSCALLRHTWQLVRAACWRLVNLDAVVCLEQPALHPFREAMRASLAQALDTHVTRVFVKAKTAERLGPVGSGAAVTAQVVVLLKKI

SEQ ID NO: 58320 - protein, 288 aa, Tuber borchii
MSSTGNGSGHHGDSEVKTDIITLTRFLTEEQHRLGPHATGDFTLLCHALQFSFKSIAYYIRRATLINLIGLAGSSNMTGDDQKKLDVIGNEIFVNTMRGCGKVKVLVSEEEEEAIIFPGHGKYAVVCDPIDGSSNLDAGVSVGTIFGIFKLDDGAEGKAEDMLKPGTELVASGFTMYGASANLVLTMKGGQVNGFTLDTALGEFILTHPDMRIPKSKGIYSVNEGNSLYWTEPCKAYFESIKYPKEPGAKPYSARYIGSMGRRCLQGPSVTEGSSPTPLTRRVLKASL

SEQ ID NO: 58321 - protein, 181 aa, Brassica napus
MAYSMLSSAAVVTSPAQATMVAPFTGLKSSAAFPVTRKANNDITSIASNGGRVSCMKVWPPVGKKKFETLSYLPDLTEVELGKEVDYLLRNKWIPCVEFELEHGFVYREHGSTPGYYDGRYWTMWKLPLFGCTDSAQVLKEVQECKTEYPNAFIRIIGFDNNRQVQCISFIAYKPPSFTGA

SEQ ID NO: 58322 - protein, 517 aa, Triticum aestivum
MASFAALPLAALLVLAVSWAWEHLVWRPYAIARRHRAQGIHGPPYRFLKGSNEEVRRMKAETADVVLDVRDHNYLPRVAPHFLKWRAQYGEPFLFWFGAKPRICVFDYELVRQILSSKSGHFPKNDAHPNVLELLGKGLVLVNGVDWVRHRRVINPAFAMDKIKAMTETMVSCAQRTFSVFEDQACKNTNREILVEFDKAVQGLTADIISHTAFGSSYKLGMEAFHAQKELQSIAISSLLNVQIPGFSYLPTKRNRRKWMLEKKLRSTLMRVINSRLASKGSGYGNDLLGLMFEGCTTTVQGGKQEQLSLSMEEILHECKTFFFAGYETTSLLLTWTVFLLSVYPEWQERLREEVLREVGKGNPTGDNLGKLKEMMMVLHEALRLYGPALFMQRKTITDMVVGAITIPKDHAVVIGAPFMHRDKKVWGEDADQFNPMRFANGVARAAKVPHALLAFSIGPRACIGQNFAMLEAKSVMVTVLQKFSFALSPSYVHAPADFLTLQPKFGLPVVMKLLDI

SEQ ID NO: 58323 - protein, 518 aa, Streptomyces aizunensis
MTTTVIGKVAELYAVREEAVRGPSDRATEAQHAKGKLTARERIGLLLDEGSFREVEQLRRHRASGFGLEAKRPYTDGVITGWGTIEGRTVFVYAHDFRIFGGALGEAHATKIHKIMDMAIAAGAPLVSLNDGAGARIQEGVSALAGYGGIFQRNTKASGVIPQISVMLGPCAGGAAYSPALTDFVFMVRETSQMFITGPDVVKAVTGEEITQNGLGGADVHAGTSGVAHFAYDDEETCIAEVRYLLSMLPSNNRENPPAVQAGDPADRRCDALLNLVPVDGNRPYDMLKVIEEIVDDGDYVEIHEGWSRNIICALARLDGQVVAIVANQPQFLAGVLDIGASEKAARFVQMCDAFNIPIVTLLDVPGFLPGVDQEHGGIIRHGAKLLYAYCNATVPRISLILRKAYGGAYIVMDSQSIGADLTYAWPTNEIAVMGAEGAANVIFRRQIAESGDPEAMRARMVKEYKAELMHPYYAAERGLVDDVIDPAETREVLIASLAMLRTKHADLPPRKHGNPPQ

SEQ ID NO: 58324 - protein, 284 aa, Yarrowia lipolytica CLIB122
MTKESVHNLPTVSTSQPAEPVDAIPPTAYVPPDEAYTRSRPMGLGENMRNLFIACIGEFVGTFMFLLFAYLIATVANYDKTVAGPNAAKIIMISFGFGFSLLVNVFIFFRVSGGQFNPCVTLALTLVGAVPPVRALCLAITQLLAGMAAAGVADALTPGPVTFINTLGDGVSRTRGMWIEMFCTAQLCLTVLFLAVEKHRATFMAPFPIGMSLFIGHLVAVFPTGAGINPARSLGPCIVGKSFPHYHWIYWVGPILGSIFSVGLYHTLKFLDYETSNPGQDNQD

SEQ ID NO: 58325 - protein, 177 aa, Avena sativa
NRRFPLPSARFYAAEVLLALEYLHMMGVVYRDLKPENVLIRADGHIMLTDFDLSLQSPPRFVAEPLSARSSSFVGTHEYVAPEVASGGAHGAAVDWWAYGVFLYELLHGRTPFAGATNEETLRNIVRAPLAFPLAAARDLIARLLVKDPAARVGSLRGAADLKAHPFFRGLNFALLR

SEQ ID NO: 58326 - protein, 276 aa, Picea sitchensis
MMTRVPSMNPDAFLMAGSLNNVSKDRRLMAAGASRMEKLLGFAPQNLNSNSAASDAGDLNELKEEDVWGIWPDAGSNPAQYETKKEENFQFRHKTDSGNGGGGIGGGVEPGRSLQSGSSRRWKENGGLSIAFEECNRSRLSPLTRSSAIFSVTPANRISVRMIPSADQNGNTSGNSSNMMMMHHQSAPVNVPDWSKILGVGMDRLKENNPNLLFSAAADEDEDGGDMLPPHEYLAREQARSQMTTTSVFEGVGRTLKGRDMSRVRNAVWRQTGFLG

SEQ ID NO: 58327 - protein, 326 aa, Oryza sativa Japonica Group
MAALHHQAAAAPVTTTTDGGELRAMDLYEKLEKVGEGTYGKVYKAREKATGRIVALKKTRLPEDDEGVPPTALREVSLLRMLSQDSHVVRLLDLKQGQNKEGQTILYLVFEYMDTDLKKFIRAHRQNLQKIPVPTVKILMYQLCKGVAFCHGRGVLHRDLKPHNLLMDRKTMALKIADLGLSRSFTVPLKKYTHEILTLWYRAPEVLLGAAHYSTPVDIWSVGCIFAELATNQPLFAGDSEVQQLLHIFKLLGTPNEQVWPGVSKLPNWHEYPQWNPSKVSDLVHGLDADALDLLEKMLQYEPSKRISAKKAMEHPYFNDVNKELY

SEQ ID NO: 58328 - protein, 76 aa, Haemophilus somnus 2336
MSIEERVKKIIVEQLGVKEDDVKPEASFIEDLGADSLDTVELVMALEEEFDIEIPDEEAEKITTVQSAIDYVQNNQ

SEQ ID NO: 58329 - protein, 392 aa, Synechococcus sp. WH 7803
MSRPLSLSSRAEALQPSLTLAISARAKALQKEGRDICSLSAGEPDFDTPDFIVEASVEALRNGMTRYGPAAGDPHLRELIANKITSENGIPTSAAEVLVTNGGKQAIYNLFQVLLNPGDEVLIPAPYWLSYPEIARLAGARPVAVPSSAADGFRLDLNALDAAITPASRVLVINSPGNPTGRVLSRDELLSIAELMRRHPRLVVMSDEIYEYLLEDGVTHHSFASLAPDLQDRCFMVNGFAKGWAMTGWRLGYLSGPESVIKAASALQSQSTSNVCSFAQQGAVAALTGPRDCVQTMAESYNRRRSFLVSGLQAMDGITLVPPQGAFYAFPQLPDGCGDSMNFCRRALEEEGLAIVPGAAFGDDRCIRLSCAVSRETITDGLHRLNRLLKAG

SEQ ID NO: 58330 - protein, 464 aa, Streptomyces avermitilis MA-4680
MKGIVTVMRTPRALLAATATTAALAVVVAVPTPAVSAQVPTGGAYFVQSAVTGLNAADNAGAVEQHNPKGNEDHQQWNLRTSGSAYLLESTDTAGSCLGRSGDQARTVVCTSADAAWEITPAGTDQYTLKAPGTDRHLTVGAKPSGSNYPAQLAIGSAGSLASWYLTPVTPSVNPMPSPDQRTLDQVTFLTAHNAYANGVDGGFAPPFVNLVPNQTRGINQQLTDGVRGFMMDIHQTSDGAILCHNSCTLVSKPVALWVDIQRMVDFLKQHPDQVVTVFLEDYVDPGVLRSELARVSGLSDVLYRPDRTGVRQSGWPRMADLIAANHRLLIFTDHSRSSDESAGLTRDSFGVMYQREWTVENYWSMGSGLGSSDWSCYSRWYGADTNIPLTYTESAFRPLFVMNHFRDAAIASTATTDNTKLADRAQRFCRPAARKKPNFLAVDRYDLGNPTSAVDTLNTYTYP

SEQ ID NO: 58331 - protein, 407 aa, Campylobacter lari RM2100
MLNNTLFFKTQDFKKITAYANRMNDELESGDIGYYHLVDTSFDLIEESKEFIATKTHIENIVLVGMGGSSCGVKALKELLFDQVEEKKLFIIDNTSSHTFTQTMQKINPQKTLFIIASKSGTTIEVISLFKLIIAHFDFKNENLHENFVFITDLNSKLHKLGEELNIKCFFIPQNVGGRFSVLSAIGIVPLSFCGYDTKALLEGAKACYVDFFEKKCDQILQKAYHYCTHKSAHINVLFSYGDAFKGFNEWYIQLIAESLGKKQGFKRIGLTPIALIGARDQHSFLQLIMDGPKDKTVTFLKIKDSQKSPSIPNISFNHLQNCDFTNEVNLHDLLNAQCDATMHALIAENLSVDVIELEKLDAYHCGYLMYYYELFTSACGIMLGINTYDQPGVEVGKLILKNMLSK

SEQ ID NO: 58332 - protein, 523 aa, Yarrowia lipolytica CLIB122
MIILYVLAVAVSFLIFKRVTYTMRSRELAKKWHCEEPHNLNEFPLNLPLFFLIINASRRHELLDTLLGLFRSFAPTKTVKQVLLGSFTIIPTNDPENIKAVLATQFKDFCLGQRHGQLAPVLGDGIFTLDGQGWQHSRAMLRPQFARDQVSDVEMIERHVQMMLLRIPNNKKFDIQELFFNLTLDTATEFLFGQTVGSQTVEMPNEDKSTVSDMPKDMRKSFQEDFNVAQHHGGIRTRFQMFYWLWRPTELFSSSKRVHAFVDHYVEKALANSDEEKSDDKYIFLRELAREVKDPRVLRDQALNILLAGRDTTAGVLSWIVYELARHPEVWKKLRAEIHQDFGDGSDLSQITFEGLKRCEYLRFVINETLRLYPSVPLNVRYASRDTTLPRGGGPDESKPILVRKGDTIVYNVFSMHRTEEFWGKDCDEFRPERWAEKGSRGWEYLPFNGGPRICLGQQYALTETSYVITRICQLFTNIENADTAVEPPQKLHALTLCHLNGVFVKMTRDEAAFAETEKLINA

SEQ ID NO: 58333 - protein, 193 aa, Haemophilus somnus 2336
MSVIPMVVEQTSRGERSYDIYSRLLKERVIFLTGEVEDRMANLIVAQLLFLEAEDPAKDINIYINSPGGSVTAGMAIYDTMQFIKPNVRTLCIGQACSMGAFLLAGGTAGKRAALPHARVMIHQPLGGFRGQASDIQIHAQEILKIKQTLNERLAFHTGQSIEQIEQDTDRDNFMSAEQAKLYGLVDDVLIKR

SEQ ID NO: 58334 - protein, 498 aa, Aspergillus nidulans FGSC A4
MAKREHQDQTGDSRPSKKSKGTKDTKKNTEVSPPYFQSPALDNVPQTEIDKFLSDHSIKITDASADKPSLRPIISFSFLPPSNKDLYAPLDGFASPTAIQSATWPLLFAGRDVIGIAETGSGKTLAFGLPCLKKVLDLKTKQKSCRPLAVVISPTRELAMQIYDQLVKFAEKVDIQVACIFGGVKKDEQREALKSAAVVVATPGRLKDLQNDGSLDLGRVKYLVLDEADRMLDKGFEQDIKDIISPMPVSKRQTVMFTATWPPIVRNLASTFMTSPVTVTIGGDPSADPRANSRIKQVVEVVKPHEKEQRLVQILNRHQRGTPDKVLAFCLYKKEAMRVERLLRTKGFKVAGIHGDLSQQERFRSLEAFKSGAATVLVATDVAARGLDIPHVKLVVNVTFPLTVEDYVHRIGRTGRAGADGHAITLFTETDKAQSGALINVLKAANQEVPEALLKFGSTVKKKQHDAYGAFFKDVEPGKAATKIPTDLRSVFALVQDD

SEQ ID NO: 58335 - protein, 274 aa, Campylobacter lari RM2100
MLQTCIFPAAGYGTRFLPATKTLPKEMLPILTKPLIHYGVDEALEAGMETMGFVTGRGKRALEDYFDISYELEHQIAGTKKEYLLSEIRTLIDRCTFTFTRQNEMKGLGDAVLKAKPLVQDEAFGVILADDLCVNEDGVNVLAQMVKIYEKYRCSVIAVMEVEADQVSNYGVIAGNAVEEDLIMVNSMVEKPDPKDAPSNLAIIGRYILTPDIFGILENTKAGKNGEIQLTDALLSQATNNMVLAYKFKGKRFDCGSVEGFVEATNYFYEKSKC

SEQ ID NO: 58336 - protein, 524 aa, Burkholderia xenovorans LB400
MCGEVRIARTFEREFMMNAVTQASNAHVSTVKLLIDGEFVDSATTEWRDVVNPATQEVLARVPFTTVAEVDAAVRSAHAAFATWKNTAIGARLRIMLKFQALIREHMPRIAKTLTAEQGKTLPDAEGDIFRGLEVVEHACSIGTLQQGGFAENVAGGVDTYTLQQPIGVCAGITPFNFPAMIPLWMFPMAIVCGNTFVLKPSEQDPLSTMQLVELALEAGIPKGVLNVVHGGKEVVDAICSHPLVRAISFVGSTTVGTHVYRLGSEHGKRVQSMMGAKNHAVVLPDANREQTINALVGAGFGAAGQRCMATSVVVLVGASKDWVPELVEKAKTLKVNAGHEPRTDVGPVVSRAAKTRVLGLIESGVKQGATLALDGRDVKVPGYEDGNFVGPTIFTDVTTDMDIYTQEIFGPVLVVLAAATLDEAIAIVNANPFGNGVGLFTQSGAAARKFQSEIDIGQVGINIPIPVPVPYFSFTGSRGSKLGDLGPYGKQVVQFYTQTKTVTARWFDDATVNDGVNTTISLR

SEQ ID NO: 58337 - protein, 495 aa, Coccidioides immitis RS
MTDFKEKALDFCSFVNASPTPFHAVASARTRLVDAGFKEIKEKDAWSSVCKPGGKYYLTRNGSTIIAFAVGRKWKPGNSIAMLGAHTDSPCLRVKPVSKKRAEGFIQIGVETYGGGLWHTWFDRDLGIAGRVMARNNDGSISARLLRIDRPILRIPTLAIHFERQETFSFNKETQLFPIAGLVEAELSRVGGDHASTEPSKSEDKTDDAPTAPLKVITERHHPYLIELMASELALKPDDIVDFEILLYDTQKACLGGLLDEFIFSARLDNLNMSYCATMGFIESLSNSSALDNETSIRLVALFDHEEIGSKTAQGADSNALPAILRRLAVLPSSGKEDTSTAYEQSLSTSFLLSADMSHSVNPNYAFKYEPDHKPEMNKGPVIKINANARYATNSPGIVLVQEAARLAKSGSDTANTVGVPLQLFVVRNDSLCGSTIGPMLSAALGTRTVDLGNAQLSMHSIRETGGTKDVGYAVRLFKSFFENFSQLSQRIFVD

SEQ ID NO: 58338 - protein, 339 aa, unidentified eubacterium SCB49
MKILVTGGLGYIGSHTVVALQNSGYDVVVVDNLSNSSIDVLDRIESISGTRPQYQELELRDKSAVTSFFEKHKDINGIIHFAASKAVGESLENPLLYYENNLNTLVYLLQECEKHKLANFIFSSSCTVYGEPDSLPITEAAPVKNATSPYGNTKQIAEEILVDLCRVSETLNSIALRYFNPIGAHKSAEIGELPKGAPQNLVPFITQTAAGIREQLSVFGDDYDTEDGSCIRDYIHVVDLANAHVVALERLLNKKNKSNYEVFNIGTGRGSSVLEVVHAFEKVTDQKLNYKIVDRRPGDVVSVYADTNKANNELGWKSEKTMEDALESAWEWEKKVRGI

SEQ ID NO: 58339 - protein, 579 aa, Haemophilus somnus 2336
MLKKWFLTKNIFLAVRPFSALQDSFKIGYGKSHLIKDIIAGLTVGVIAIPLSMALAIASGVPPQHGLYTAIVAGIVIALSGGSRFNISGPTAAFVVILYPVTQQFGLSGLLMATLLSGIILILMAFFRLGRLIEYIPLSVTLGFTCGIGIVIATLQIKDFLGLNVATMPVHYLGKLQAIFTALPTINWADAAVGTVTLILLTKWHKFRLPIPGHLPAVIIGTLLSIALIHFGFDVATIGSSFSYSLSDGSTGYGIPNVIPEIILPWNFPNADGEVINWDFNTLQALLPAAFSMAVLGAIESLLCAVILDNMTSTKHHSNNELLAQGLGNIVAPFLGGITATAAIARSAANVKSGAVSPISSVIHALLVLFSLLFFAKALSYLPLASMSALLLVVAWNMANVGQIVQLIRRSGLNEIAVLLTCLTLTVIFDMVIAITVGVLLASLLFIRTIAEMTRSFEIAHPEDLCDTVVFRISGPLFFAAADNLFADLHEKTTHTGKEIKHIVLQCDAVTVLDAGGIHALTRFIQHMLPSQELHMCNMQFQPLRTIVKSKTVKEIHKIHFSTNLDVVYRKIRDLTKTE

SEQ ID NO: 58340 - protein, 524 aa, Campylobacter lari RM2100
MVEVKNLTMRFANQLLFEDVNLKLNRGERYGLIGANGAGKSTFLKILSGQIESSSGEICIDPNLKIAVLGQDQFAFENYTIKDAVMCANKRLYDALKEKEKLYMSEEFTDEINDRLSELEIITAEEDPNYDCELRCEKILSSLNIKDFNALMSTLQSADKFKVLLAQVLFLGADVLFLDEPTNNLDLEAISWLENELLRHEGTLVVISHDRHFLNKVCTRILDVDFKQIRDFAGNYDDWYMASTLLAKQAELKRDKTLKEREELENFIRRFSANASKAKQATSRAKALEKLELEEIKTSSRRDPSIVFRTNREIGNEVLELKGISKAYDKTLFENLELKLEKGDKIALIGANGAGKSTLAKIIASKLEPDNGHIHLGATIEMGYFSQDTTNLINENLKLYEWLMSEKFKDLDEIRKCLGRMLFSGSDQEKMASSLSGGEKHRLMLSKLMLERGNFLLLDEPDNHLDLESIIALGEALYNFKGCVICISHDRELISAFANRIWFLEDGKLTDFKGSYDEFLGGLE

SEQ ID NO: 58341 - protein, 286 aa, Caulobacter crescentus CB15
MRLFVFGLGYVGAAFADALQDRGWDIAASARDPGQAQALRDKGITPADPADRDAMIAALAGVNAILITAPPGPDGCPALESIVPALAQAQAYPDWIGYLSTTGVYGDFEGRWVFETSPLKAQSVEGARRVGAERDWRQVGRGMGLTVTTFRLPGIYGPGRSALDRLRAGEGRRIVKPGQVFSRIHVDDIVSGLLASLDHPRAGGVYNLVDDEPAPPQDVMEHAARLLGVPVPPDLPFNELGTSPATRRFYAENKRVSNARAKAELGWRPKHPTYREGLAAILKAGG

SEQ ID NO: 58342 - protein, 496 aa, Oryza sativa
  misc_feature (104)..(104): Xaa can be any naturally occurring amino acid
  misc_feature (112)..(112): Xaa can be any naturally occurring amino acid
MPGAAGYSGSVKLKYVKLGYQYLVNHFLTLLLVPVMAATALELARMGPGELLSLWRSLQLDLVHILCSVFLVVFVGTVYFMSRPRPVYLVDYSCYKPPPSCRVXPFATFMEXHTRLITDDEKSVRFQTRILERSGLGEETCLPPANHYIPPNPSMEASRAEAQLVIFSAIDDLVRRTGLKPKDIDILVVNCSLFSPTPSLSAMIINKYKLRSNIRSFNLSGMGCSAGLISLDLARDMLQVHPNSNALVVSTEIITPNFYWGTRRDMMLPNCLFRMGAAAILLSNRRREARRAKYRLMHVVRTHKGADDRAYRCVYEEEDEQGHSGISLSKELMAIAGDALKSNITTIGPLVLPMSEQLLFFFRLVGRKLINKKWKPYIPDFKLAFEHFCIHAGGRAVIDELQKNLDLSAQHVEASRMTLHRFGNTSSSSLWYELAYIEAKGRMRRGDRVWQIGFGSGFKCNSAVWKCLRTVKTPADGPWDDCIHRYPVDIPEVVKL

SEQ ID NO: 58343 - protein, 47 aa, Triticum aestivum
  misc_feature (10)..(10): Xaa can be any naturally occurring amino acid
YKVEEDSTPXGIFARGSYSARLKFVDDDGKVYLDMRYSFDIRKVWPN

SEQ ID NO: 58344 - protein, 308 aa, Caulobacter crescentus CB15
MVRITVLGECMVELSPEAGDGGAPLYRMGFAGDTFNTAIYMARLGDQVAYCTALGQGDPFSEGVLAAMRREGMDTQLVRQVENRLPGLYAIVLDEHGERKFHYWRERAPIRDLFSAHTADQLIEAAKASDLVYLSGVTLAVIGDIGRARLRDILAYVHSHGVAVALDFNYRPALWPSAEAARAALDGVVPACRYISLSSEDSRPLYGREAEDLAAEWAAAGAEVVARDESHAVNVHTPEGRTATPAPARVKAVDTTGAGDSFNAAYLSSRLAGAAIPDAVARAHALAGIVVSHRGAIVPPEIGLAPLG

SEQ ID NO: 58345 - protein, 596 aa, Kluyveromyces lactis NRRL Y-1140
MTKKECSDNEEEEEDIDIVNHQDIFISPSKVRYQSPKKLKSFDFLSPSKTVRPKSPKRSLTLESVSIETEYKDEESRKHSSTDTATPRRRQRKTTKRVKLEEDDAIDYVSDTNELIHNDDEYEDLKIKIDSNESSPNKSPRRKLTFNAEPSPQRKTTRNTVQRNKIIDDDLAYDDIQQYKHLKLNLNPNFKPTKLPKSDNNDQTSDEQSQIYFFDGFEGFIDQTKILKTDKRSKNSMSSAPSISRDEYNILSQLSNDIFHRSSTKAVQKIHETLFQQFTFELLQGFTLLFYGIGSKKKFLESFAFNFLSMKIALLQNPDIQKDDPCIPVFVMNGYTTLSKNIFLDIFKILVEGETIDDQGQSNYWDNRIDLQMDRLSKYFKKRPPTVKMILLIHNLDGPSFRREHFQTRMSILAQIKQICVVASVDHIQAPFLWDHFRAQSFNFVYHDITNFEPYIVETVQTDNAIDFSKDSGTLFNANGAKYVLESLTDNSKRMYKILLQLLMGQINAKNESKPRAKSSSLNKITPGIEFSELFKTCTEQFVVSSEMGLRTILSEFIDHKMAVNTKNKMGKEIINVKYSYGDMEKMITEIDSMLQ

SEQ ID NO: 58346 - protein, 128 aa, Oryza sativa Japonica Group
MGMIYPVPLDSSWFSECKGQLALVHCECKSVLLRMESSKTQSQGSASVPKNPAMSSCRKKKSDDVTFLEDLKDHIDEFIHASMDEHKHCFKNTIQKMFGMSKVVAERSAEAKEAEVESALPLQTSVSQ

SEQ ID NO: 58347 - protein, 837 aa, Solanum lycopersicum
MEMSTRRSNYTLLSQVADDNYLPPPPKYSVTGGGGGGGGVAPYYESHSGEKGKGKTGDNRGFDWDLSDHRSNMMQASNRIGAAAFPGSIGLQRQSSGSSFGESSISGEYYMPSLSNAEASFGYLNDGGGGAEVRMKPLEANLFGGSSSKSWAQQTEESYQLQLALALRLSSEATCADDPNFLDHVPDESASRASASAASAETLSHRFWVNGCLSYFDKVPDGFYLIHGMDPYVWIVCSDLQENARVPSIESMRAVDPSVVPSVEVILIDRRTDPSLKELQNRIHSLSPTCGTTKEVVDQLAQLVCSHMGGATSAGEDELVPLWKECSYELKDCLGSTVLPIGSLSVGLCRHRALLFKVLADAIGLPCRIAKGCKYCNRADASSCLVRFGPDREYLVDLIGSPGCLCEPDSSLNGPSSISISSPLRFPRFREVEPTTDFRSLAKQYFSDCQSLNLVFEESSAGAAVDGDAGQTDRNNIERNSAVTGPSNRDEVSRLPVPAIRDMAPVKYVRPVLHGDTQLSDPRDIGNDMRFLERGSQLVPSKISRDIALEIEDFDIPWEDLVLKERIGAGSFGTVHRADWNGSDVAVKILMEQDFHAERFKEFLREVAIMKRLRHPNIVLFMGAVTQRPNLSIVTEYLSRGSLYRLLHKPGAREVLDERRRLSMAYDVAKGMNYLHKRNPPIVHRDLKSPNLLVDKKYTVKVCDFGLSRLKANTFLSSKSAAGTPEWMAPEVLRDEPSNEKSDVYSFGVILWELATLQQPWSNLNPAQVVAAVGFKGKRLDIPRDLTPQVASIIEACWAKEPWKRPSFAAIMDMLRPLIKPPVTPPQPGRTDTQLIA

SEQ ID NO: 58348 - protein, 116 aa, Lithachne humilis
VAEPVEARSSSFVGTHEYVAPEEARGGGHGAAVDWWAYGVFLYELLYGRTPFVGANNEATLLNIVRRPLEFPDASARDLIARLLDKDPRTRLGSQRGAADVKPTPFFKGLNFALLR

SEQ ID NO: 58349 - protein, 198 aa, Oryza ridleyi
GQTPVFPRIFGHEAGGIVESVGDGVTDLAPGDHVLPVFTGECKECPHCKSAESNMCDLLRINTDRGVMIGDGKSRFSINGKPIYHFVGTSTFSEYTVMHVGCVAKINPEAPLDKVCVLSCGISTGLGATINVAKPPKGSTVAIFGLGAVGLAAAEGARIAGASRIIGVDLNPNRFEEARKFGCTEFVNPKDHDKPVQQ

SEQ ID NO: 58350 - protein, 285 aa, Triticum aestivum
  misc_feature (168)..(168): Xaa can be any naturally occurring amino acid
RVVPRVRVIEVWDYVNGMLKKDLQYQGDESFMMHEDAVLCVDFSRDSEMLASGSQDGKIKVWCIRTGQCLRRLERSHAKGVTSVTFSRDGTQILSTSFDTTARIHGLKSGKMLKEFRGHDSYVNYAIFSTDGTRVITASSDCTVKVWDVKTADCLQSFKPPPPLRGGXDASVNSVHLFPKNSDHIVVCNKTSSIYIMTLQGQVVKSFSSGKREGGDFVAASVSPKGEWIYCVGEDMNMYCFSQQSGKLEHLMKAHDKDVIGITHHPHRNLVATYAEDCMMKIWKP

SEQ ID NO: 58351 - protein, 198 aa, Oryza longiglumis
GQTPVFPRIFGHEAGGIVESVGEGVTDLAPGDHVLPVFTGECKECPHCKSAESNMCDLLRINTDRGVMIGDGKSRFSINGKPIYHFVGTSTFSEYTVMHVGCVAKINPEAPLDKVCVLSCGISTGLGATINVAKPPKGSTVAIFGLGAVGLAAAEGARIAGASRIIGVDLNPNRFEEARKFGCTEFVNPKDHDKPVQQ

SEQ ID NO: 58352 - protein, 108 aa, Panicum miliaceum
SCSFVGTHEYVAPEVARAAPHGAAVDWWALGVFLYELLHGRTPFAGADNESTLRNIARRPLAFPDAAARDLIAGLLAKDPARRLGSRRGAADVKAHPFFRGLNFALLR

SEQ ID NO: 58353 - protein, 292 aa, Shigella flexneri 2a str. 301
MKTRKGIILAGGSGTRLYPVTMAVSKQLLPIYDKPMIYYPLSTLMLAGIRDILIISTPQDTPRFQQLLGDGSQWGLNLQYKVQPSPDGLAQAFIIGEEFIGGDDCALVLGDNIFYGHDLPKLMDTAVNRESGATVFAYHVNDPERYGVVEFDDNGTAISLEEKPQEPKSNYAVTGLYFYDNDVVEMAKNLKPSARGELEITDINRIYMDQGRLSVAMMGRGYAWLDTGTHQSLIEASNFIATIEERQGLKVSCPEEIAHRKGFIDAEQVKVLAEPLKKNAYGQYLLKMIKGY

SEQ ID NO: 58354 - protein, 299 aa, Pseudoalteromonas tunicata D2
MSAKHPIIAITGSSGAGTTTTTNAIKHIFRSLNIEAAFVEGDSFHRYTRPEMDKKIREAQQESRHISYFGSEANDFGALEELFSTYGATGTGKTRRYLHTFDEAVPYNQLPGTFTPWRPLEENTDILFYEGLHGGAVDENHDVAKHVDLLIGMVPIINLEWIQKMIRDTTERGHSREAVMGSIVRSMDDYINHITPQFSRTHINFQRVPTVDTSNPFSAKDIPSLDESFVVIRFRGIEDVNFPYYLQMIDGSFMSRRNTMVVPGGKMGLAMELLLRPLIEDIINKKRGLASLSPSSLPI

SEQ ID NO: 58355 - protein, 443 aa, Vitis vinifera
MSFPLIISSVGIVVCLGTTLFATDFVEIKNVSEIEPSLKRQLLISTILMTAGIAVVSFFALPSEFTLFNFGSTKTVKNWHLFFCVSIGLWAGLVIGYITEYYTSNAYSPVQDVADSCRTGAATNVIFGLALGYKSVIIPIFAIAIAIYVSFSMAAMYGIAVAALGMLSTIATGLAIDAYGPISDNAGGIAEMAGMSHKIRQRTDALDAAGNTTAAIGKGFAIGSAALVSLALFGAFVSRAGIETVDVLTPKVFIGLIVGAMLPYWFSAMTMKSVGSAALKMVEEVRRQFNTIPGLMEGRAKPDYATCVKISTDASLREMIPPGALVMLTPLIAGTLFGVETLAGVLAGSLVSGVQVAISASNTGGAWDNAKKYIEAGASEHARSLGPKGSDPHKAAVIGDTIGDPLKDTSGPSLNILIKLMAVESLVFAPFFAAHGGLLFKLL

SEQ ID NO: 58356 - protein, 368 aa, Saccharomyces cerevisiae
MKIKILVDEYNTQKEQAKKVRKATSLYFRIHPSIMASKTLRVLFLGPKGTYSHQAALQQFQSTSDVEYLPAASIPQCFNQLENDTSIDYSVVPLENSTNGQVVFSYDLLRDRMIKKALSLPAPADTNRITPDIEVIAEQYVPITHCLISPIQLPNGIASLGNFEEVIIHSHPQVWGQVECYLRSMAEKFPQVTFIRLDCSSTSESVNQCIRSSTADCDNILHLAIASETAAQLHKAYIIEHSINDKLGNTTRFLVLKRRENAGDNEVEDTGLLRVNLLTFTTRQDDPGSLVDVLNILKIHSLNMCSINSRPFHLDEHDRNWRYLFFIEYYTEKNTPKNKEKFYEDISDKSKQWCLWGTFPRNERYYHK

SEQ ID NO: 58357 - protein, 118 aa, Pennisetum glaucum
TLVANPVNARSCSFVGTHEYEAPEVARGGPHGAAVDWWAYGVFLYELLHGRTPFAGADNDPTLRNIARRPLAFPDAAARDLIARLLAKDPAHRLGSRRGAADVKAHPFFKGLNFALLR

SEQ ID NO: 58358 - protein, 168 aa, Zea mays
  misc_feature (95)..(95): Xaa can be any naturally occurring amino acid
GATQTANCHLLPQPLCPSPCHQGPRSPERDLAATQAMESPFRADLLRGKAALVTGGGSGIGFEIAAQFARHGAHVALMGRRREVLDKAVAALRLXDLQAVGFDGDVRKQEDAARVIAATVEHFGKLDILVNGAAGNFLASPEDLKPKGFRTVLDIDTGGTYTMGYKAL

SEQ ID NO: 58359 - protein, 114 aa, Setaria italica
NPVKARSCSLVGTQEYVAPEVARGGPHGAAVDWWAYGVFLYELLHGRTPFAGADNESTLRNIARRPLRFPDAAARDLIARLLDKDPAHRLGSRRGAADVKAHPFFKGLNFALLR

SEQ ID NO: 58360 - protein, 107 aa, Setaria viridis
CSLVGTHEYVAPEVARGGPHGAAVDWWAYGVFLYELLHGRTPFAGADNESTLRNIARRPLAFPDAAARDLIARLLDKDPAHRLGSRRGAADVKAHPFFKGLNFALLR

SEQ ID NO: 58361 - protein, 250 aa, Wigglesworthia glossinidia endosymbiont of Glossina brevipalpis
MKIKEKMTDFGFSYVKKSKKNSMIEDIFNNVSYKYDLMNDIMSFGVHRIWKNILVYCNSTNPDQKILDLASGTGDITKRLSKLINKKGFIVSLDINRKMLKICRKKIRNSGTIRNIFYIQANSEYLPFKKNIFDSVIVSFGFRNFTEKKKQLSSIFNVLKPGGKLLILEFSKPLFEFLKKIYDIYSFYCIPKMGNIISGNYYSYKYLVESIKIHPSQKKLNKILSESEFCNSEYINISGGIVAIHRCYKF

SEQ ID NO: 58362 - protein, 389 aa, Chlamydomonas reinhardtii
MADPGAQPVPAPQSAEEPVTGGLQESVEVTASGKLDSYNREYNQFLVCGSLFECPAKYLPIKPIGKGAYGVVCSAKNLDNQEKVAIKKIANAFDNVIDAKRTLREIKLLRHLQHENIVQIKDIIPPTNRDAFKDLYVVYELMDTDLHQIIRSPQALSNDHSQYFLYQLLRGLKYIHSANILHRDLKPSNLLVNANCDLKICDFGLARTSTSNEKEFMTEYVVTRWYRAPELLLSCSGYTTAIDVWSVGCIFAELLGRKPLFPGKDYVHQLSLITKVIGSPSEEELGFITSEKAKRYIRSLPRSERVDFGQLWPHVTKTALDLIDKMLVFDPTKRITVEQALEHPYLASLHDVSDEPVCPTPFTFDFDSEHLTPDVVREVILQDMAELHT

SEQ ID NO: 58363 - protein, 237 aa, Coccidioides immitis RS
MNSSRLFSLAARHVFRSPVRSYSSASNFIPPRGWTPTPFVTETLGGAWHTYDIFSRLLKERIVCLNGEVDETVSASIVAQLLFLEADNPEKQISLYINSPGGSVTAGLAIYDTMTYIQSPVSTICIGQAASMGSLLLCGGEPGKRFCLPHSSVMVHQPSGGYFGQATDIAIHAKEILRVRKQLNEIYRRHLTKDMSLEEIEKLMERDYFMGAKEALDMGIVDGIMDRRMKPKEEGPS

SEQ ID NO: 58364 - protein, 463 aa, Methanocaldococcus jannaschii DSM 2661
MFIDGKWINREDMDVINPYSLEVIKKIPALSREEAKEAIDTAEKYKEVMKNLPITKRYNILMNIAKQIKEKKEELAKILAIDAGKPIKQARVEVERSIGTFKLAAFYVKEHRDEVIPSDDRLIFTRREPVGIVGAITPFNFPLNLSAHKIAPAIATGNVIVHHPSSKAPLVCIELAKIIENALKKYNVPLGVYNLLTGAGEVVGDEIVVNEKVNMISFTGSSKVGELITKKAGFKKIALELGGVNPNIVLKDADLNKAVNALIKGSFIYAGQVCISVGMILVDESIADKFIEMFVNKAKVLNVGNPLDEKTDVGPLISVEHAEWVEKVVEKAIDEGGKLLLGGKRDKALFYPTILEVDRDNILCKTETFAPVIPIIRTNEEEMIDIANSTEYGLHSAIFTNDINKSLKFAENLEFGGVVINDSSLFRQDNMPFGGVKKSGLGREGVKYAMEEMSNIKTIIISK

SEQ ID NO: 58365 - protein, 441 aa, Streptomyces avermitilis MA-4680
MNDRTPEQPADTVARLRATFRTGRTKPVEWRTDQLDRLREMLTTHGADLAAALHADLGKSSTEAYRTEIDFTVREIDHTLSHLGTWLRPESAPVPPHLGDDATAWTQYDPLGVVLVIAPWNYPAQLLLTPMIGALAAGNAVVVKPSELAPATSAVLARLLPQYLDTDAVAVVEGGIPETTALLAERFDHIFYTGNGVVGRIVMRAAAEHLTPVTLELGGKSPVFVDRDADLAVVADRLARGKFLNAGQTCVAPDYVLTDPETGRALETELARAVSSLYGPEPETSGEYGRIVNERHFDRLSGLLDSGRVVTGGGSDRTAKYIAPTVLADVDPESPVMREEIFGPILPIVTVPGLDEAIDFINDRDKPLALYVFTASGTTRQRIAAETSSGGLGYGLPLAHLTVSDLPFGGVGESGMGNYHGRYSIETFSHRKAVLEKPLSV

SEQ ID NO: 58366 - protein, 322 aa, Acidobacteria bacterium Ellin345
MALYLVTGAAGFIGRSIAQQLLAGGAAVRGIDNFSTGKRGNLVGLEGMEFIEGDITDPAAVGRACDGVEVVFHEAALASVPRSVADPLATNHANVTGTLQLLQAAHRAGVRRVIYAGSSSAYGDTPTLPKNEEMLANPISPYAVSKLTGEYYLRSMYAVHGMETVTIRYFNVFGPYQDPGSQYSGVLAKFIPQMLRGETPTIHGDGEQSRDFTYIENVVKANIALANAPAERVAGEVFNVATGTRISLNETVALLREMTGYTGAVHHGPERKGDVKHSLADISKAKRAFGFEPTVMFPAGLHRTVEWYRKALAEDAVETARK

SEQ ID NO: 58367 - protein, 488 aa, Mycobacterium avium 104
MTKNSDHRCYDELFIGGQWRKPANPQQLDVISPHSEQPIGHAQAAGPEDVDAAVAAARRAFDHGPWPRMSHAERMAKVEQLATIYAAHMDEMADLITDEMGSPRSFSRMGQGAAAATLIHLTLAAARDFPWTERRQGVLGEVHLHRAPVGVVGAIVPWNVPQFLIMPKLIPALIAGCTVIVKPAPETPLDALWLAEMIEQLELPPGVVSVLPGGTDVGEALVRHPGVDKVAFTGSSAVGRRIAALCGERLKRVSLELGGKSAAIILDDADIDKTVAGLKSAGLMNNGQACVAQTRILVSDRKHDEVVDALAAMMAELNVGDPADESTDIGPLVAQRQQRRVQEYIKSGRSEGARMVLGGEDSPAGRGWYVRPTLFADATNDMRIAREEIFGPVLTVLRYRDEDDAIRIANETDYGLAGSVWTADVAHGLEVAAAVRTGTYGINMYTLDIGAPFGGFKQSGIGREFGPEGLHEYVELQTLVCKGQLPPL

SEQ ID NO: 58368 - protein, 665 aa, Ipomoea nil
MGEFGKEAAIVRKNKKGTVASKSQISASPTMESHLHEGEAHLVSTPVSYPTQVVRCTACWGNDGCQTVRSRTKLMKTLIERGKPQEVHSITKGLTEEGHRPTLVTYTTVLAALTLQKRFKSIPLLLKKVEQNGLRPDSIFFNPMINAFCESGNVKEAMKIFRKMREKGCKPTASTFNALIKGFGIIGKPEESSKLLEIMSREENIKPDDRTYNILVQAWCNKNNIEKAWGVVHRMVGAGLKPDVVTYNTIARAYARGKETSRAAELISQMQNNKVAPNVRTCGIVVDGYSKEGNMADALKFIYKMQGFGVHPNLFIFNSLLKGFLDITDTKGVDETLTLMQEFGVKPDVVTYSTIMNAWSSAGLMEKCEEMFQDMIKSGIEPDNHAFSILAKGYVRAGEPKKAEALLEAMATHGAHPNVVMFTTIISGWCSAAKMEDALRVYDRMCRMDVQPNLNTFETLIWGYGEANEPWKAEELLQIMEEMGVLPRKNTVQLVADAWRAIGFINEAKRILNDDQSSVLIPRTDEKPVEEDLQRVYQEKTNGSYKTLPDNDKRPTLNAKMVENREDNVHRGDHHEQIMKGSFSSLPEMTGSTITNQNGSSTFTLRSQTTPKSSRTATKSMNMAAKAILISNNCGFKPNPLMVIQRPLHVQIGIHRYINSCRLVA

SEQ ID NO: 58369 - protein, 752 aa, Zea mays
MAGQERRTIDLEEGWAFMQKGITKLKNILEGKPEPQFSSEDYMMLYTTIYNMCTQKPPQDYSQQLYDKYRESFEEYIASMVLPSLREKHDEFMLRELVQRWSNHKVMVRWLSRFFYYLDRYFISRRSLTPLKEVGLTCFRELIYQEIKGQVKDAVIALIDKEREGEQIDRALLKNVLDIFVEIGLGQMECYENDFEDFLLKDTTEYYSVKAQSWILEDSCPDYMIKAEECLKREKERVGHYLHISSEQKLLEKVQNELLAQYATPLLEKEHSGCSALLRDDKVEDLSRMYRLFSKISRGLEPISNMFKTHVTSEGTALVKQAEDSASNKKPEKKDMVGMQEQVFVWKIIELHDKYVAYVTECFQGHTLFHKALKEAFEVFCNKGVSGPEFPGRPTRPVPSCWLLFCDNILKKGCSEKLSDEAIEDALEKVVRMLAYISDKDLFAEFYRKKLARRLLFDKSANDEHERSILTKLKQQCGGQFTSKMEGMVTDLTVARDHQTKFEEFVAGHPELNPGIDLAVTVLTTGFWPSYKTFDINLPAEMVKCVEVFKEFYQTRTKHRKLTWIYSLGTCNINAKFDAKPIELIVTTYQAALLLLFNGSERLSYSEIATQLNLSDDDVVRLLHSLSCAKYKILNKEPASRSISPNDVFEFNSKFTDRMRRIKIPLPPVDEKKKVVEDVDKDRRYAIDASIVRIMKSRKVMGHQQLVAECVEQLSRMFKPDFKAIKKRIEDLITRDYLERDKDNANTYKYLA

SEQ ID NO: 58370 - protein, 256 aa, Streptococcus pyogenes MGAS10394
MKIGIIGVGKMASAIIKGLKQTPHELIISGSSLERSKEIAEQLTLPYAMSHQDLIDQVDLVILGIKPQLFETVLKPLHFKQPIISMAAGISLQRLATFVGQDLPMLRIMPNMNAQILQSSTALTGNALVSQELQARVRDLTDSFGSTFDISEKDFDTFTALAGSSPAYIYLFIEALAKAGVKNGMPKAKALEIVTQTVLASASNLKTSSQSPHDFIDAICSPGGTTIAGLMELERLGLTTTVSSAIDKTIDKAKSL

SEQ ID NO: 58371 - protein, 198 aa, Coccidioides immitis RS
MGLYYPAGGTLVALTVVGAYMLFNGEGEAFNVGQFLEAVSPYAWANIGIGLCVGLSVVGAAWGIFITGSSIIGGGVKAPRIRTKNLISIIFCEVVAIYGVIMSIVFSSKVFYVPGETLYSGDNYYTGYALFWGGLTVGMCNLICGVAVGINGSSAALADASDPSLFVKILVIEIFSSILGLFGLIVGLLIQGKAKDFS

SEQ ID NO: 58372 - protein, 323 aa, Aspergillus nidulans FGSC A4
MENYQKIEKIGEGTYGVVYKARELTHPNRIVALKKIRLEAEDEGVPSTAIREISLLKEMNDPNIVRLLNIVHADGHKLYLVFEFLDLDLKKYMEALPVSEGGRGRALPDGSTLSRNLGLGDAMVKKFMAQLIEGIRFCHSHRVLHRDLKPQNLLIDRDGNLKLADFGLARAFGVPLRTYTHEVVTLWYRSPEILLGGRQYSTGVDMWSCGAIFAEMCTRKPLFPGDSEIDEIFKIFRILGTPDETIWPGVTSFPDFKPTFPKWKREDIQNVVPGLEEDGLDLLEALLEYDPARRISAKQACMHPYFQHGSSYYSGRARRNGFH

SEQ ID NO: 58373 - protein, 793 aa, Solanum lycopersicum
MEVPVRRSNYAILQQQPPYDEFNSDEKSKSRGDKGLYWDLIDRRKGTTPFQASIVLPTQSSEGSFAESSISGVSFGYMNAYSDVGGSLSKSWAQQTEESYQLQLTLALRISTEATCADDPNLLDYVPDESVSHASASSASVEAMSHRFWVNGSLSYFDKVPDGFYFIQGMDPYIWTVCSDLQESGRIPSIESLMAVDPSVVPSVEVILIDRQSDPRLKELQNRIHSMYRSCNTTKEVVDQLAKLVCNHMGGAASVGEGDFIPIWKECCNDLKDCLGCFVFPIGSLSVGLCRHRTLLFKVLADIIDLPCRIARGCKYCKESDAFSCLVRFGLDREYLVDLIRDPGCLYEPNSLLNGPSSISIPSPLRLPRFGQVEPAMDFTSFAKQYFSDCLSLNLAFDDSSAGTAVDGDAGQTDRSSMDKSSAVPSSSNRDEVSRLPLPSINAWNKGCDKGSQLPAKYHPPNMSISMSQEKDLIHLKNVPPIRYVDAHLIAISEARTDTINDQRYFEGVGRLAPAKPSRGLVLDVEDLDIPWNDLVLKERIGAGSFGTVHRADWNGSDVAVKILMEQDFHAERYKEFLQEVAIMKRLRHPNIVLFMGAVTEPPNLSIVTEYLSRGSLYRLLHKPGAREVLDEKRRLCMAYDVAKGMNYLHKRKPPVVHRDLKSPNLLVDTKYTVKVCDFGLSRLKANTFLSSKSAAGTPEWMAPEVLRDEPSNEKSDIYSFGVILWELATLQQPWSNLNPPQVVAAVGFKGMRLEIPRDLNHPVTTIIEACWVNEPWKRPSFSTIMDMLKPLI

SEQ ID NO: 58374 - protein, 474 aa, Dechloromonas aromatica RCB
MSKQFDVLVIGGGPGGYIAAIRASQLGFLAACAESNPYADPKGEPRLGGTCLNVGCIPSKALLHTSHLFEEANHSFEAQGIKVGKATIDVPVMKARKDGVVNQLTSGIKMLLKKNKVSFLAGHGSFVGKEGDYWKVKVGAEEVLTKQVIVATGSKARHLPNLPVDQKIVMDNEGALNQESVPKKLAIIGAGVIGLEMGSVWRRVGSEVTVLEAMPDFLAAADVDVAKEALKLFSKQGLNIQMGVKIGDIKATKKSVSIAYTDKDGKEQKLDADRLIVSIGRVPNTDGLNGEAVGLKLDARGFVEVDGHCKTNLPGIWAIGDVVRGPMLAHKAHEEGVMVAELMAGQAGHCNFDTIPWVIYTSPEIAWVGKTEQQLKAEGVEYKAGKVPFLANGRALGMGDPSGFVKMLACKKTDRILGVHIIGANASEIIAEAVVAMEFGGASEDLARICHAHPTLSETVHEAALACDKRTLNF

SEQ ID NO: 58375 - protein, 407 aa, Dechloromonas aromatica RCB
MSIIEVQVPQLSESVAEGTLASWKKKIGEAVARDEILIDIETDKVVLEVPSPAAGVLVEIIKADGETVVSGELIARIDTEAKAGVAAPAAEAPKAAAAAAPAPAAAAPAGTASPSARKILDEKGVAAADVAGSGRGGRVTKEDAVAAAPKSGPVAAPAAAKVSLPTPPVTVALGDRTEQRVPMTRLRARIAERLLQSQQTNAILTTFNEVNMGPMMALRKQYGEKFEKTHGVRLGFMGFFVKAACAALQKFPVLNASVDGNDIVYHGYIDIGIAVGSPRGLVVPIIRNADQMSIAEIEKKIAEFGAKAKDGKLTIEELTGGTFSISNGGIFGSMMSTPIINPPQSAILGIHATKDRAMVENGQVVVRPMNYLAMSYDHRIIDGREAVLGLVTMKEALEDPSRLLLGV

SEQ ID NO: 58376 - protein, 1199 aa, Oryza sativa Indica Group
MVGAEMLVAAAVSQVARKINGIVGVAQGEVKLCCNFSDDLEGIKDTLVYLETLLKNAENNSFGSDRANLRHWLGQIKSLAYDIEDIVDGYYSSKEQFDGGSYAQKGSLFCSLSNPMLLKGSMVYKMKSKREMLQQRQQLPNQYHFLSHINSAVNFEEKQTTSYRNTDIAIVGRDADLDNLMDILMENSAEELSIISIVGPVGFGKTSLAQFVFNNTGTEVFSFRIWVHVSMGNINLEKIGRDIVSQTTEKIEGNMQLQSIKNAVQRVLNKYSCLIILDSLWGKDEEVNELKQMLLTGRHTESKIIVTTHSNKVAKLISTVPLYKLAALSEDDCLKIFSQRAMTGPGDPLFREYGEEIVRRCEGTPLVANFLGSVVNAQRQRREIWQAAKDEEMWKIEEDYPQDKISPLFPSFKIIYYNMPHELRLCFNDAERSGASEEMLHMHNLAHDLARSVAGEDILVILDAENERNARYCDYRYAQVSASSLESIDRKAWPSKARSLIFKNSGADFEHVSEVLSVNKYLRVLDLSGCCVQDIPSPIFQLKQLRYLDVSSLSITALPLQISSFHKLQMLDLSETELTELPPFISNLKGLNYLNLQGCQKLQRLNSLHLLHDLHYLNLSCCPEVTSFPESLENLTKLRFLNLSGCSKLSALPIRFLESFASLCSLVDLNLSGFEFQMLPDFFGNIYSLQYLNLSKCLKLEVLPQSFGQLAYLKSLNLSYCSDLKLLESFECLTSLRFLNLSNCSRLEYLPSCFDKLNNLESLNLSQCLGLKALPESLQNLKNLQLDVSGCQDCIVQSFSLSTRSSQSCQRSEKAEQVRSRNSEISEITYEEPAEIELLRNNPSKDLASISHLNEDRIEEPEVVTESSATRGMVQQIPGNQLSSPSSHLSSFASSSAPFASSSWDTSTSEHPVPNEEAAALTVPRSNEKCDNTPMPVKDGLISEDDAPVHFGRFLKKNGFGGGSEAEMLPMQMQGTCTTVAPEVRLDKQLQAWKNNPIWSDEPPEIKVTVPQGSLCNLNLKFKAGLPPDAVYNIIIDPENKRVFKNIKVKFKQGRTGFMKKFEGCWKIEPLFVDKEACHPLDPCTLEKYDSCTNGTGRVGSSITLDQLIEPAMVPPPPFSWYLRGITTRTTEMLVNDLIAETARLRGLANNAIDKQYVEGKCDTSRDHLTEECNDIKERWRQRRKTGRHGNSLRLTAQG

SEQ ID NO: 58377 - protein, 214 aa, Taiwanofungus camphoratus
MVAIVQKPAPGFKAMAVVDGQFQDISLSDYFGQWVVLFFYPLDFTFVCPTEILAFNDALPQFKELSTTVLSVSTDSHYAHLAWATQDRKQGGLGPNLKLPMIADKNTQISRDYGVLIEEEGVALRGLFLIDPKGTLRQITINDLPVGRSVDETIRLIKAFQFTDEHGEVCPANWTEGGKTIKADPKGSLEYFSTAGANGHTDAKGTTKKRARVD

SEQ ID NO: 58378 - protein, 478 aa, Shigella flexneri 2a str. 301
MAQSKLYPVVMAGGSGSRLWPLSRVLYPKQFLCLKGDLTMLQTTICRLNGVECESPVVICNEQHRFIVAEQLRQLNKLTENIILEPAGRNTAPAIALAALAAKRHSPESDPLMLVLAADHVIADEDAFRAAVRNAMPYAEAGKLVTFGIVPDLPETGYGYIRRGEVSVGEQDTVAFEVAQFVEKPNLETAQAYVASGEYYWNSGMFLFRAGRYLEELKKYRPDILDACEKAMSAVDPDLDFIRVDEEAFLACPEESVDYAVMEPTADAVVVPMDAGWSDVGSWSSLWEISAHTAEGNVCHGDVINHKTENSYVYAESGLVTTVGVKDLVVVQTKDAVLIADRNAVQDVKKVVEQIKADGRHEHRVHREVYRPWGKYDSIDAGDRYQVKRITVKPGEGLSVQMHHHRAEHWVVVAGTAKVTIDGDIKLLGENESIYIPLGATHCLENPGKIPLDLIEVRSGSYLEEDDVVRFADRYGRV

SEQ ID NO: 58379 - protein, 198 aa, Oryza granulata
GQTPMFPRIFGHEAGGIVESVGEGVTDLSPGDHVLPVFTGECKECPHCKSAESNMCDLLRINTDRGVMIGDGKSRFSINGKPIYHFVGTSTFSEYTVMHVGCVAKINPKAPLDKVCVLSCGISTGLGATINVARPPKGSTVAIFGLGAVGLAAAEGARIAGASRIIGVDLNANRFEEARKFGCTEFVNPKDHDKPVQQ

SEQ ID NO: 58380 - protein, 249 aa, Treponema pallidum subsp. pallidum str. Nichols
MRGYFIAGNWKMHKTCAEAVALAQELVRELRGGPHTYMIAPSFTALDAVGKVLRGSNVLLGAQDVSSEEWGAHTGEVSVLQLEDLGVQVVIVGHSERRHGRGENDKLINQKVRRVLESGLRVILCVGERLQEYEAGCTNEVVGTQVRAGMADVCGSLMHNVTVAYEPVWAIGTGKTATPAQANAVHAHIRSVVREMYGAAIAEALCIQYGGSMKAENARALLAEEHIDGGLIGGASLEAASFVPIARSV

SEQ ID NO: 58381 - protein, 419 aa, Treponema pallidum subsp. pallidum str. Nichols
MMLRTCKDVTMRGERVVVRVDFNVPMRDGMVQDDTRVTAAVPTLRYIIEQGPRHVVLISHLGDPTRDADKAEGNAKKDGCPFDRHAFINGKHRLKPVADCLAKKLGVPVHFAPSCVGQREFIEGLPDGSVVLLENVRFHPEETSGDAKVQEQFARELAQYGDIFVNDAFGTAHREHASTVVLPRLMRRRVAGLLIEREVRYLEPMVCNPKVPMVAVVGGAKVSSKIAVLESLLRTSTALIIGGGMAYTFLKAQGVGVGTSLVEDDFIDTARMLLQKAQSGGVSVVLPVDHVCASTFCADAQPVAVDDVHIPMHLMGMDVGPRTLEQYRAHLKGVSSVLWNGPVGVFEFDAFAHGTRVLAQLIAEATDAGATSVVGGGDSIAAVSKFGLASRMSHVSTGGGASLKLFEGKVLPGISCLET

SEQ ID NO: 58382 - protein, 444 aa, Spinacia oleracea
NSQTCLDPEASRSVLGIILGGGAGTRLYPLTKKRAKPAVPLGANYRLIDIPVSNCLNSNISKIYVLTQFNSASLNRHLSRAYASNLGGYKNEGFVEVLAAQQSPENPDWFQGTADAVRQYLWLFEEHNVMEFLILAGDHLYRMDYERFIQAHRETDADITVAALPMDEKRATAFGLMKIDEEGRIIEFAEKPKGEQLQAMKVDTTILGLDDERAKEMPYIASMGIYVISKDVMLNLLRDKFPGANDFGSEVIPGATSIGLTVQAYLYDGYWEDIGTIEAFYNANLGITKKPVPDFSFYDRSSPIYTQPRYLPPSKMLDADITDSVIGEGCVIKNCKIHHSVIGLRSCISEGAIIEDTLLMGADYYETDADRKLLAAKGSVVLGIGQNSHIKRAIIDKNARIGDNVKIINSDNVQEAARETDGYFIKSGIVTVIKDALIPSGTVI

SEQ ID NO: 58383 - protein, 406 aa, Oceanicola granulosus HTCC2516
MYDIDKIRADFPILSRQVNGKPLTYLDNGASAQKPQAVIDAVTRGYAEEYANVHRGLHYLSNLSTERYEAVRATVARFLHAPTEDEIVLNTGTTMGINLVAYGWAMPRLEAGDEIILSVMEHHANIVPWHFLRERQGVKLVWVDVDETGALDPDKLLAAVTERTKLIAVTHMSNVLGTRVDVKAICAGARARGVPVLVDGSQGAVHGPVDVADIGCDFYAITGHKLYGPSGSGAIYIRRERMDEMRPFLGGGDMIREVSKEQVLYNDPPMKFEAGTPGIVATIGLGAALEYLMEIGMERIAAHEADLRDYVQERFAGLNWLTVQGTAPGKGAIFSFTLEGAAHAHDISTVLDKKGVAVRAGHHCAGPLMDHLGVSATCRASFGMYNTRAEVDRLIEALELCHELFA

SEQ ID NO: 58384 - protein, 201 aa, Brassica napus
MNKAWMGLEIAPEGSMKNKIHGLGLKLLARVKPSEIFLKSISKEVTSVQVSYPPSLDPRLVRRRLRHIAMSGTILHKKYLIGSVTLLPLTTAFTVLPLPNIPFFWVLFRTYSHWRALQGSEKLLKLLSNHSNPQTDTADESNNNKLEQEAQSPTCVLLPSEELYKLLGEASEEGLDEETIVEICKLFHLNKIDVLKYRNLV

SEQ ID NO: 58385 - protein, 474 aa, Streptococcus pneumoniae R6
MTRYQNLVNGKWKSSEQEITIYSPINQEELGTVPAMTQTEADEAMQAARAALPAWRALSAIERAAYLHKTAAILERDKEKIGTILAKEVAKGIKAAIGEVVRTADLIRYAAEEGLRITGQAMEGGGFEAASKNKLAVVRREPVGIVLAIAPFNYPVNLSASKIAPALIAGNVVMLKPPTQGSISGLLLAKAFEEAGIPAGVFNTITGRGSEIGDYIIEHKEVNFINFTGSTPIGERIGRLAGMRPIMLELGGKDAALVLEDADLEHAAKQIVAGAFSYSGQRCTAIKRVIVLESVADKLATLLQEEVSKLTVGDPFDNADITPVIDNASADFIWGLIEDAQEKEAQALTPIKREGNLLWPVLFDQVTKDMKVAWEEPFGPVLPIIRVASVEEAIAFANESEFGLQSSVFTNDFKKAFEIAEKLEVGTVHINNKTQRGPDNFPFLGVKGSGAGVQGIKYSIEAMTNVKSIVFDVK

SEQ ID NO: 58386 - protein, 252 aa, Burkholderia xenovorans LB400
MRLEGKVAIITGAATGIGNAIARAYVAEGAKVVIADLKGAEAAASELGAGIALGIYANVADPDSTRQMAAAAVERFGKIDVLVNNAGIFTGLSGVPMEGITVEDWDKLYAVNVKGPWLCTSAVSAAMREGGGGKIINIASVIAHVGVPFMLHYVSSKGAVAAMTRAMAREFAATKAGITVNAISPGYTHSANAVANTQQHEQFEGVAAQMRTIGRPQVPEDIAGAALWLASDEASYVNGQNIIVDGGIFMSL

SEQ ID NO: 58387 - protein, 494 aa, Burkholderia xenovorans LB400
MNANPKHVADPTRLRNQNLIGGQWKAALSGQSIAVENPANEEIIAQVPRGQQEDIDEAVKVARATFESAAWRKIRPIDRGRILENIARKVEEHAEELSWLESLDTGKAISFARVIDLPSTVDVFRYMGGWCSKLGGTTPPISFDGKEYHAYTRREPVGVVGAITPWNYPLALGSWKIASALAAGCTMVLKPTELTPLSTLRLAELCLEAGLPEGALNVVNGYGHEAGEALARHPDIDKITFTGSTVVGKKIVEYALGNMKRVTLELGGKSPSIVFDDADLDQVGLGAALAVFFNSGQICFAASRLFVQASVYDRVVEAVAAVASQFKVGNGQDTDTMLGPLVSRKQQERVLGYVQSGIEQGASLIYGGQKIGDKGYFLQPTVFADADQSMKIAQEEIFGPVVSIIRFKDEVEAIRLANDTTYGLAANIWTRDIKKAHRVAHRLQAGSVWINCHGVIDPAAPFGGFKQSGWGREVSEEGLAAYTEIKTVCALLDD

SEQ ID NO: 58388 - protein, 198 aa, Rhynchoryza subulata
GQTPMFPRIFGHEAGGIVESVGEGVTDLAPGDHVLPVFTGECKECPHCKSAESNMCDLLRINTDRGVMIGDGKSRFSINGKPIYHFVGTSTFSEYTVMHIGCVAKINPEAPLDKVCVLSCGISTGLGATINVAKPPKGSTVAIFGLGAVGLAAAEGARIAGASRIIGVDLNPNRFEEARKFGCTEFVNPKDHDKPVQQ

SEQ ID NO: 58389 - protein, 380 aa, Streptococcus pneumoniae R6
MKNEMLALILAGGQGTRLGKLTQSIAKPAVQFGGRYRIIDFALSNCANSGIHNVGVVTQYQPLALNNHIGNGSSWGLDGINSGVSILQPYSASEGNRWFEGTSHAIYQNIDYIDNVNPEYVLILSGDHIYKMDYDDMLQSHKDNNASLTVAVLDVPLKEASRFGIMNTDANNRIVEFEEKPAQPKSTKASMGIYIFDWQRLRNMLVAAEKSKVGMSDFGKNVIPNYLESGESVYAYEFSGYWKDVGTIESLWEANMEYISPENALDSRNRQWKIYSRNLISPPNFLGANAHVEDSLVVDGCFVDGTVKHSILSRGAQVREGAEVLDSVIMSGAIIGQGAKIKRAIIGEGAIISDGVEIDGTDEVQVVGYNEVVGVATDED

SEQ ID NO: 58390 - protein, 379 aa, Streptococcus pneumoniae R6
MKIDKYSAILGNTVGFHNMSTLTDHRPVASLPFGGKYRLIDFPLSSLANAGVRSVFGIFQQDNISSVFDHIRSGREWGLSTLLSHYYLGIYNTRVESSTVGKEYYQQLLTYLKRSGSNQTVALNCDVLINIDLNQVFHLHSTTKEPITVVYKKLAKKDISEVNAILDVDETDHVLSHKLFDSKSTAETFNMSTDIFVVDTPWLIEHLEEEAKKEHPEKLRYVLRDLAVKEGAFAYEYTGYLANIHSVKSYYQANIDMLESQKFYSLFSPNQKIYTKVKNEEPTYYANTSKVSTSQFASGSIIEGQVANSVLSRNIHVHKDSLVKDSLLFPRVVIGEGAQVEYAILDKGVEVEPGVVIRGTAEHPVVVKKGAKVTEDIHS

SEQ ID NO: 58391 - protein, 674 aa, Zea mays
  misc_feature (193)..(193): Xaa can be any naturally occurring amino acid
  misc_feature (222)..(222): Xaa can be any naturally occurring amino acid
MKAATDRRGREVLDRANGGRRRAGMARGEGSRAGMAMAGSDLPSLEQPRGDGERERTFHDGGRERRAGAGIVGSEFPSLEQPRGDNDGEVGPSMMAAERALVSDVEGRHHRHVCPHFSCGGLSNISYPFRRQGDPSGCGVQSYELVCTDTDATIRIGSGTYKVLSINSTYSYFWVIDADLDIQSSCPLPRWDXMLVGSISTYIFGGLSSSISISILLLFILXSGRWAIFVNCSQPIENIDTDKYHIYEPVSCLSNSSFIYLLVTHYWDADNWDVTAGVLEPSCGYLAMTPLGGPGMQVPWNTSYPDVVKFMRSGFALGFPVWYGDNIRECLANNMRFILMPLAVFVFLAYKYWKTRITIDAVEKFLRMHHMLVPMRYAYTNIIAITGHFRDKLGQGGYGTVYKGVLQPGEVHVAVKMLGNSNCNGEEFISEVATIGKIHHVNVVRLIGFCSEENIRALIYEFMPRGSLDKYIFSSEKTFSWDKLNEIALGIARGLNYLHHGCDMQIVHFDIKPHNILLDSNFVPKVADFGLAKLFPRDDSFVPLSAMRGTIGYIAPEMVSRSFGVISSKSDVYSFGMLLLEMTGGRRNADPHAGSSSQAYYPSLVYRQLSQGDANRISEGVDMHELEKKLCIIGLWCIQMKPQDRPTMSEVIEMLEAGVDGIQMPPRPYFCDEE

SEQ ID NO: 58392 - protein, 393 aa, Coccidioides immitis RS
MAANFFSNKARAAAAANATASKSKSTADEADKSKLQPWVEKYRPKTLDDVAAQDHTVTVLQRTLQASNLPHMLFYGPPGTGKTSTILALAKSLFGPKLYRSRILELNASDERGINIVREKIKDFARIQLSHPPAHDSEYRKQYPCPPFKIIILDEADSMTQDAQSALRRTMERFSRITRFCLVCNYVTRIIDPLASRCSKFRFKSLDGSAAGTRLEEIAKTEKLRLDNGVVDALIRCSEGDLRRAITYMQSAARLVGSGLSGKSGKDESGDEVMTDADQSGVITVQTVEEIAGVVPDKVVNRLIDAMQPKKGGSVYEGVARVVTDIVADGWSAGQMLSQMYQAIVFNESIPDIQKNDIVLVFSEYDKRLIDGADEQLSILDLALRISAILGRS

SEQ ID NO: 58393 - protein, 131 aa, Candida glabrata CBS 138
MSGGKGGKVGSAAKASQTRSAKAGLTFPVGRVHRLLRRGNYAQRIGSGAPVYLTAVLEYLAAEILELAGNAARDNKKSRIIPRHLQLAIRNDDELNKLLGNVTIAQGGVLPNIHQNLLPKKSAKPSASQEL

SEQ ID NO: 58394 - protein, 1295 aa, Oryza sativa Indica Group
MALRSPNSMLWLALLVWAALLCGSCHGRFVVEKNSLKVTSPSDMKGTYECAIGNFGVPQYGGTMVGVVAYPKANKKACKSFDDFDISYKAKPGSLPTFLLVDRGDCFFTKKAWNAQNAGAAAILVADDKTEPLITMDTPEESGNTDYLENITIPSALITKSFGDKLKKAIDNGDMVNVNLDWRESLPHPDERVEYEFWTNSNDECGPKCDSQIEFVKSFKGAAQVLEKKGYTQFTPHYITWYCPDSFILSKQCKSQCINHGRYCAPDPEQDFSKGYDGKDVVVQNLRQVCVYKVAKEHGKPWLWWDYVTDFAIRCPMKEKKYTKECADGVIKSLGLDHKAIDECIGDPDADKENPVLKAEQDAQIGKGSRGDVTILPTLVINNRQYRGKLDKGAVLKAICAGFRETTEPAVCLSEDIQTNECLENNGGCWQDKAANISACKDTFRGRVCECPVVKGVKFVGDGYTHCEASGSGRCEINNGGCWKDSRHGRTYSACTNDGCKCPDGFKGDGVHKCEDIDECKERTACQCKECKCKNTWGSYECGCSGGLLYMKEHDTCISKNAATEVGWNFLWVIFFGLVVAGIAGYAVYKYRIRFCLVLAEKEKSGIPNINWLRDRLFRSIRRRRRRGALAPLAPTLTTAIAMPSCFTLDSASDDGRSTAQGQGWPAGVGGFLSSFFSAGAARADGGKPSPDWDAHGLAASALPVPLSRLDGKKRYKVSDLTFLNRRTRAAAAAAAAAEAPLFDALRPGGVYTRAQLRDELDALATSGMFDHVTLQTKPKPDGTLGLTVSYAETEWPAVEHLKCINVGGPMARPDGDELELDDDMTARERMEHLRRQEREYQQLVRRAKPCVLPEKLQRELQGMVKRQRKVSSGLLKRMAGRIERWYHDEGFHCAQVVSYHGNLDAGEVVCEVVEGDITKVEYQFLDKLGNVVDGNTSIPLIDRELPQQLRPGHIYNNGAGKQALKNIDSLGLFSTIEVQPRPDETNQGGVIVAIKLKEHDPKSAQVITDWSIVPGSQGRPTLASIQPGGTVSFEHRNICGLKRSLIGSVTSSNLLNPEDDLSFKLEYAHPYLDGIDNLSRNRTFKISCFNSRKLSPIFVAGPNMYEAPPIWVDRIGFKANITESFTKQSKFTYGLVVEEITTRDENNNICTHGSRQLPSGALSMIGPPTTLSGTGVDRMAFLQANITRDNTEFVNGATIGDRCIFQMDQGLGIGSKNPFFNRHQLTVTKFINLNKQEKGSRKPPPAVLALHGRYAGCVGDLPSYDAFALGGPHSVRGYGMGELGASRNLLENFS

SEQ ID NO: 58395 - protein, 1847 aa, Methanocaldococcus jannaschii DSM 2661
MVIIMEKPWVEKYRPKTLDDIVGQDEIVKRLKKYVEKKSMPHLLFSGPPGVGKCLTGDTKVIVNGEIREIGEVIEEISNGKFGVTLTNNLKVLGIDEDGKIREFDVQYVYKDKTNTLIKIKTKMGRELKVTTYHPLLINHKNGEIKWEKAENLKVGDKLATPRYILFNESDYNEELAEWLGYFIGDGHADKESNKITFTNGDEKLRKRFAELTEKLFKDAKIKERIHKDRTPDIYVNSKEAVEFIDKLGLRGKKADKVRIPKEIMRSDALRAFLRAYFDCDGGIEKHSIVLSTASKEMAEDLVYALLRFGIIAKLREKVNKNNNKVYYHIVISNSSNLRTFLDNIGFSQERKLKKLLEIIKDENPNLDVITIDKEKIRYIRDRLKVKLTRDIEKDNWSYNKCRKITQELLKEIYYRLEELKEIEKALEENILIDWDEVAERRKEIAEKTGIRSDRILEYIRGKRKPSLKNYIKIANTLGKNIEKIIDAMRIFAKKYSSYAEIGKMLNMWNSSIKIYLESNTQEIEKLEEIRKTELKLVKEILNDEKLIDSIGYVLFLASNEIYWDEIVEIEQLNGEFTIYDLHVPRYHNFIGGNLPTILHNTTAALCLARDLFGENWRDNFLELNASVSKDTPILVKIDGKVKRTTFEELDKIYFETNDENEMYKKVDNLEVLTVDENFRVRWRKVSTIIRHKVDKILRIKFEGGYIELTGNHSIMMLDENGLVAKKASDIKVGDCFLSFVANIEGEKDRLDLKEFEPKDITSRVKIINDFDIDEDTAWMLGLYVAEGAVGFKGKTSGQVIYTLGSHEHDLINKLNDIVDKKGFSKYENFTGSGFDRKRLSAKQIRILNTQLARFVEENFYDGNGRRARNKRIPDIIFELKENLRVEFLKGLADGDSSGNWREVVRISSKSDNLLIDTVWLARISGIESSIFENEARLIWKGGMKWKKSNLLPAEPIIKMIKKLENKINGNWRYILRHQLYEGKKRVSKDKIKQILEMVNVEKLSDKEKEVYDLLKKLSKTELYALVVKEIEIIDYNDFVYDVSVPNNEMFFAGNVPILLHNSDERGIDVIRTKVKDFARTKPIGDVPFKIIFLDESDALTADAQNALRRTMEKYSDVCRFILSCLTGDAKITLPDEREIKIEDFIKMFEERKLKHVLNRNGEDLVLAGVKFNSKIVNHKVYRLVLESGREIEATGDHKFLTRDGWKEVYELKEDDEVLVYPALEGVGFEVDERRIIGLNEFYEFLTNYEIKLGYKPLGKAKSYKELITRDKEKILSRVLELSDKYSKSEIRRKIEEEFGIKISLTTIKNLINGKIDGFALKYVRKIKELGWDEITYDDEKAGIFARLLGFIIGDGHLSKSKEGRILITATINELEGIKKDLEKLGIKASNIIEKDIEHKLDGREIKGKTSFIYINNKAFYLLLNFWGVEIGNKTINGYNIPKWIKYGNKFVKREFLRGLFGADGTKPYIKKYNINGIKLGIRVENISKDKTLEFFEEVKKMLEEFEVESYIKVSKIDNKNLTELIVKANNKNYLKYLSRISYAYEKDNFARLVGEYLRIKEAYKDIILKEIAENALKEADGEKSLRELARKYNVPVDFIINQLKGKDIGLPRNFMTFEEFLKEKVVDGKYVSERIIKKECIGYRDVYDITCHKDPSFIANGFVSHNCNYPSKIIPPIQSRCAVFRFSPLKKEDIAKKLKEIAEKEGLNLTESGLEAIIYVSEGDMRKAINVLQTAAALSDVIDDEIVYKVSSRARPEEVKKMMELALDGKFMEARDLLYKLMVEWGMSGEDILNQMFREINSLDIDERKKVELADAIGETDFRIVEGANERIQLSALLAKMALMGR

SEQ ID NO: 58396 - protein, 181 aa, Acidobacteria bacterium Ellin345
MLHVFVVHVENKPGVLTRVASLFRRRAFNIDSLTVGRTEKADVSRMTIVVDTDKDGARRLEAHLYKLVNVLLVEDITGTPSINRDLAMIKVSCTQDTRPQILALVEVFRARVVDLAMDSIIMEITGNEEKIDRLVEVLQPYGVMEMVRTGIVAMRRGVTTPINKEANATQVYEDTGVSYSV

SEQ ID NO: 58397 - protein, 177 aa, unidentified eubacterium SCB49
MKMSAIANKTFDVLIEIPKGSRNKYEYDFDLQKIRFDRMLYSSMMYPGDYGFIPETLALDGDPLDVLVMGTEPTFPMCVMEVKPIGVFHMSDEKGQDEKIICVPVTDPIWNSYNDISDLNPHRVKEITHFFQVYKDLENKKVDIGAWGDAKEAYEIWNACIERYENSEHKAKGDFKI

SEQ ID NO: 58398 - protein, 145 aa, Glycine max
MAVSTTFSGAKLEALLLKCSSSSSSPPPSRSSFTTFPGQNRRTLIQRGVIRCDAQPSDASSVAPNNATALSALEQLKTSAADRYTKERSSIIAIGLSVHTAPVEMREKLAIPEAEWPRAIAELCSLNHIEEAAVLSTCNRMEIYV

SEQ ID NO: 58399 - protein, 322 aa, Oryza sativa Japonica Group
MASSIAMSLRSLAATDAFLPKPSPSSAPFLLLLSPSTPRLRLHLHLRSTRRLPLAPLAASDSFESASSSSAAALDFAEPGAAEESDVPEESDQEEEGYAPEAEEEAEADEEVEEEAVEASAEVAEEAEDVEEVGEYVEPPEEAKVYVGNLPYDIDSERLAQLFEQAGIVEVSEVIYNRETDRSRGFGFVTMSTVEEAEKAVEMFHRYDVDGRLLTVNKAAPRGARVERPPRQFGPSFRIYVGNLPWQVDDSRLVQLFSEHGKVVDARVVYDRETGRSRGFGFVTMATQEELDDAIAALDGQSLDGRALRVNVAEERPPRRGF

SEQ ID NO: 58400 - protein, 742 aa, Aspergillus nidulans FGSC A4
MYHDHPVRSVQDLIGFSGLISHAIRHPLDFHYSVGPTLSELSGGLLSSSFEPERDLPGLSGKVIFVTGGNTGLGKETVLQLARHRPERIYLAARTAIKATNAIASIQEALPCRADIRHIPLDLASFASIRAAAKQFQAECERLDILILNAGVMGHPPSLTEEGYEIHLGTNHIGHFLLTKLLLPTLRETVSRSESPDVRVITLSSLAANTAPSYDSITSTPALLSLGWASRYGASKAANVLFAAELARRHPEILSVSVHPGAVVTDLYQQTKKAGLFYEAGVGLMMKFFRSIRTGALTQIWAAAAPREQLINGGYYVPIAVKGVSRYHQYLPDLSLPRFQVMRNQDAHEYAEAFKKGRNPPWLHALYTHWKDLAQEPFKGVTTDGNVRPNLFTLQDEQVPIDTIVSATKHLFSLLSPDQQQTLSYHIDSPEWRTWSNPEFLLSHKGLRLDEVNPEIRDAILAVLQATLSPEGYDKAIKAMRINHFLGELVESPRVMNEYSYNFVLFGNPSTTRPWGWSFYGHHLCLNIFLYKSQIVASPWFTGAEPNLIDSGPYSGTRILHVEETLGLKLMQSLPPHIQRKAQTYALMKDPAMPPGRWNRDDQRHVCGAYRDNRIVPNEGVPVTLFTEDQKATLYEILNQYLLYLPTYARALRIAHIKQYESETYFSWIGGYGDHDPFYFRIQSPVILVEFDHHSGVFLNNEEPKKFHIHTLLRTPNGGDYGFALRPLVPPIEDANGKEISW

SEQ ID NO: 58401 - protein, 543 aa, Listeria monocytogenes str. 4b F2365
MKKVWLNSVKDYTWARFRKDLLAGIIVGIIALPLAMSFAIASGVSPEYGIYSSFVAGIIVSIFGGSKFQIAGPTGAFIPVLLGIVLTYGYQDLLVAGMMAGVLLCLMGIFKIGTLIKFIPRPVTIGFTAGIAVTIFMGQVGNFLGLTGMEKHESFVANMNEIWLHLDSWNFYSVFISCICMLVLFIFPKILPRIPAPLIGLVITTAIAMLFFPDALPTIGSAYGDIPSTFPPFEFPDMTFANMSKLIGPAFVIAMLGGIESLLSAVVADGMTNTKHNSNRELIGQGIANIVTPMFGGIPATGAIARTATNINNGATSRVSGVIHGIFVLLTLLVLAPVAVNIPIAAMAPILMLVAWNMSERKTFQHIIKLKSGDTLVLIITFLLTVFASLTVAVEVGLLLAVVLFAKQMGSSMQIEEIEPEGAEIAPHLHEKISIFTIRGPLFFGAAQIFQQNIIKAIHVKPKYLILRMGKVPIIDATAEGYFHQIEKEFSKQGGQILITGLTDKAKESLKGSGLYDRIGEEHFFSHTEDAIHYAENALNKGD

SEQ ID NO: 58402 - protein, 230 aa, Glycine max
MATSLSVSRLLSSSAISVAKPLLSPTSAFTAPISFSRSLAPNLSLKSHTRRTSISAARSFSATTVSASISVGDKLPDSTLSYLDPATNDVKTVTVSSLTAGKKTILFAVPGAFTPTCSQKHVPGFVSKAGELRSKGVDVIACVSVNDAFVMEAWRKDLGISDEVMLLSDGNGEFTGKLGVELDLRDKPVGLGVRSRRYAILAEDGVVKVLNLEEGGAFTNSSAEDMLKAL

SEQ ID NO: 58403 - protein, 1527 aa, Coccidioides immitis RS
MGVNTAAEAAARVAYLSSDLVLSVQPSLQGDSEFSQQLKQLSAKNVQGIVSHEVPEVRAVRQNEDPLLSAFHPLQNGKYVSVTTSSSILLSSIPHLYRLAQYPIVLHVSLEPAAFPDFSVISSIRQCGFSFLHSETPQEAQDIALTAHALAIKSGKGVIHFFDSSNASGDVPIAEEDPELVTEILDLNSARALHQSNGTSQTIYANSGRIATVEEQGLAAAQSQAVATSELPALSKDLSSTEASSIASSQGDSISGSAVPSSAATTVEAPTRRPVDASDIFQIAAHIWDSLAARTGRTYHAIEYVGPENAKNALFIFGSTRIFVDILSDPSSKGDFPGIGIITARLYRPWVGSQISRTIPTSVERIAVLEQVRKTTKWGPSFLDLLSSLARQGGGNSPLLVGYRLGYVEPSTVRQALRGIFQNLTASSPIQNLDVGTQKEPSEVASKLQLEQPANENAYVKILNQLFDGRLHVANQLGSQHAGISATVSTSPEYGFGSLIARMERRERFVGEVQEAVKSNEFATDIPRNWLSKWALNAAEPKKINQIAPDVIARLLVDGSSLSRELLASKQFFFAESQWLIGSDAWAYDLGNSGVHHVLASGANVNMLIIDSQPYSERVAADPTRRKKDIGLYAMNYGNAYVASVAVYSSYTQVLQAITEADQFKGPSVVVAYLPYNKEDDSPLTVLQETKKAVDLGYWPLYRWNPNNAEKGEPNFALDSERIKRELEEFLRRDNQLTQIMKRNPRFSAALSESYGSEVRALQKRAAKDAYDKLLEGLFGAPLTILFASDNGNAENLAKRLGNRGKARGLKTAVMAMDDYPIEDLPTEENIVFISSTAGQGELPQNGRNFWETVKNSADLDLSSVHYSVFGLGDSHYWPRKEDKIYYNKPGKDLDSRLSFLGAKKLADIGLGDDQDPDGYQTSYQEWEPRLWQALGVDKVEGLPEEPPPLTNEDIKIQSNYLRGTIAEGLRDTSTGAISASDQQLTKFHGTYMQDDRDVRDERKAQGLEPAYSFMIRCRLPGGVATPQQWLQMDAISSAYGNETMKLTTRQTFQFHGVVKGKLRPAMQAINKALMTTIAACGDVNRNVMCSSLPELSTYHREVHQVSKKISDHLLPATTAYHEIWLKDENDKKIQVAGDAIVDHEPLYGPTYLPRKFKITIAIPPHNDTDVYAHDIGLIAIKGADGHLEGFNILAGGGMGMSHNNKKTYPRTGSMLGYVPANQAHIVCEKIMLVQRDHGDRKNRKHARLKYTIDDMGVDVFKDKVEEILPNGLRFAPPRPFKFDSNVDTFGWQKDEKGLNHFTFFIENGRVEDTADFQMRTGLRELAELGKGEFRLTGNQHLILSNVEDADLPAIKQLMAKYKLDNTAFSGLRLSSSACVAFPTCGLAMAESERYLPVLITKLESTLEENGLGRDSIVMRMTGCPNGCARPWLAEVAFVGKAYGAYNMYLGGGYHGQRLNKLYRASIKEEEILDIMKGLLKRYALERNVDGALPERFGDWCVRAGVIKETTEGKNFHEGVAEDEGEE

SEQ ID NO: 58404 - protein, 618 aa, Zea mays
  misc_feature (95)..(95): Xaa can be any naturally occurring amino acid
VQKSRRGTARGIPRDGTTKPKIAPTRTAPHRISLPFHSSPPPLPFPSRRRHGQRRPLPSAHTGGPQGRHPLALLSSRAHSLPPSPPSPPPPPPPXTSPTASDLTAFPPNPNGIFASDRPIDVDAATEAELRENGFRSTRRTKLVCTVGPATSRPDQLEALAVGGMNVARLNMCHGDREWHRAAIRAVRSLNEEKGFAVAVMMDTEGSEIHMGDLGGASSVKAEDGEVWTFSVRSFELPLPERTINVNYDGFAEDVRVGDELLVDGGMARFEVIEKIGPDVKCRCTDPGLLLPRANLTFWRDGSIVRERNAMLPTISSKDWLDIDFGIAEGVDFIAVSFVKSAEVIRHLKSYIAARSRGSDMAVIAKIESIDSLKNLEEIIRASDGAMVARGDMGAQVPLEQVPSIQQKIVQLCRQLNKPVIVASQLLESMIEYPTPTRAEVADVSEAVRQRADALMLSGESAMGRYPDKALSVLRSVSLRIEKWWREEKRHEALELRSVSSSFSDKISEEICNSAAKMANGLGVDAVFVFTKTGHMASLLSRCRPDCPVFAFTTSTSVRRRLNLQWGLIPFRLAFSDDMESNLNRTFSLLKARGMIQSGDLVIALSDMLQSIQVMNVP

SEQ ID NO: 58405 - protein, 498 aa, Gloeobacter violaceus PCC 7421
MSTPIHCLNYIDGQWQPAQSGETLEDLNPADRREVVATFPRSGAADVEAAVTAARKAYRGWRLVSAPARAEIVFRIGEILRGRKEALAQLMSREMGKTIVEARGDVQEAIDCAFYYAGEGRRLFGQTTPSEMDNKFAMSVRSPVGVCSLITPWNFPVAIPCWKALPALVCGNTVILKPAEDTPACATALIDVFREAGLPAGVANLVHGTGEETGRALVAHPGVDLVSFTGSSVVGAEVASVCGRTHKRVCLEMGGKNAQIVMEDADLELALKGALWGAFGTTGQRCTATSRLILHRDIKQVFTEKLIEQARQLRLGPGIDPNTEVGPLINESQLSRVHEYIEIARQEGLKILLGGEPVRSEELVHGHFFEPTILDEVPPASRLAREEVFGPVVVLMTVDSFEQAVELLNDTPYGLSSSVYTRDVNRAFRAIRDIEAGITYINGPTTGAEVHLPFGGVKQTGNGHREAGAAVLDVFSEWKTVYVDFSGQLQRAQIDNRS

SEQ ID NO: 58406 - protein, 439 aa, Gloeobacter violaceus PCC 7421
MLSLPTKEASLPRVPRLVGPLPGPRAQALIARDEAVTSPSYTRGYPLVAARGEGCMLEDVDGNVFLDLTAGIAVTATGHAHPVVVRAIQEQAANLLHMSGTDFYYEPMAELAEALCERAPFPTAAGRPRARVFFSNSGAESNEGALKLARYYTGRQQVVAFLGAFHGRTYGAMSLTGSRAVQRQGFGPLVPGISHIPYGTHASLDYLEDKLFPAVLPPEEIAAIVVESIQGEGGYIVPEDGFHERIRQICTRHGILMVVDEVQAGMGRTGKLFAIEHWGVQPDIVTLAKGIASGLPLGAILSRPEIMTWPAGSHATTFGGNPVACAAANATLKLLEAGLIENAERMGRVLQAGLGQLADRFSFVSASRGKGLMVAVDLFDAAGNLDRERRDQIVDLAFYRGLLLLGCGKAAIRFCPPLVIDADQVRVALDILRQIFEEQ

SEQ ID NO: 58407 - protein, 286 aa, Gloeobacter violaceus PCC 7421
MNALAAQQLWAKLWAKYQARVAYARTYQRMIEQAGGTLANDHIAFRSLRLILDGQDFGLGYLERFLLPLGYEAAGEYVFPTQSLYARHYRHPEQDALDLPKLFVSELVVDDLPQPAAGIIRASVAGAKLVERADTPEALEAVFDRPWQPPLRSAVEAVNAASQYGAWVLLHGYAVNHFTGYINRQNTAAYPDIESTARGLAALGVPMKSEIEGSWGSGLRQTATKAVSEPATVREDATGKPVQIPWTYAYYEIAERGPIEVAPGRMERFEGFLGPQAKNLFEMTRK

SEQ ID NO: 58408 - protein, 470 aa, Arabidopsis thaliana
MTPPPNSISSRNVAVIGAGAAGLVAARELRREGHTVTIFERQKQVGGLWVCTPNVEPDLLSIDPDRTVVHSSVYQSLRTNLPRECMGYSDFPFVTRPDDESRDPRRYPDHREVMRYLQDFAKEFKIEEMIRFETEVFRVEPTAENSCKWRVQFRSSSGVSGEDIFDAVVICNGHFTEPRLAHIPGIESWPGKQIHSHNYRVSDPFKGQVVIVIGYQSSGSDISRDIAILAKEVHIAAKSDAYAKESSIYSNLHFHPTIDRVYEDGSVVFQDGKLIFADAIVHCTGYKYCFPFLETKGYVNVEDNRVGPLYKHVFPPALAPGLSFIGLPSMALQFFMFEIQSRWVASVLSGRVKLPSEEQMMEDVIAFYAKLKSLGIPKRFTHFLTDPQWTPMFEKLKPHEAVLISQSEYFNWIAEQCGCSSIERWREEQYNIAIKKDDDNFRDEWDDDDQIIQEAYRDFAKFKPSKVWST

SEQ ID NO: 58409 - protein, 451 aa, Pseudomonas putida GB-1
MHLERTSFGKRLGTYAEAIELPAQPVVEGRLLRMVGLTLEAEGLRAAVGSRCLVINDDSYHPVQVEAEVMGFSGPKVFLMPVGSIVGIAPGARVVPLDDGGRLPMGMSMLGRVLDGAGRALDGKGGMKAEDWVPMDGPVINPLNRDPISKPLDVGIRSINGLLTVGRGQRLGLFAGTGVGKSVLLGMMTRFTEAEIIVVGLIGERGREVKEFIEHILGEEGLKRSVVVASPADDAPLMRLRAAMYCTRIAEYFRDKGKNVLLLMDSLTRFAQAQREIALAIGEPPATRGYPPSVFAKLPKLVERAGNGEPGGGSITAFYTVLSEGDDQQDPIADSARGVLDGHFVLSRRLAEEGHYPAIDIEASISRVMPQVVDADHLRQAQKFKQLWSRLSQSRDLISVGAYVAGGDPETDLAIALQSKLVEFLRQGLRENVGMAQSREQLGAIFTPPAG

SEQ ID NO: 58410 - protein, 419 aa, Oryza sativa
MENMRSENFNQGVSMEGVKHAPEMANTNRRALRDIKNIIGAPHQHMAVSKRGLLDKPAAKNQSGHRPMTRKFAATLANQPSSAPLAPIGSERQKRTADSAFHGPADMECTKITSDDLPLPMMSEMDEVMGSELKEIEMEDIEEAAPDIDSCDANNSLAVVEYVDEIYSFYRRSEGLSCVSPNYMLSQNDINEKMRGILIDWLIEVHYKLELLDETLFLTVNIIDRFLARENVVRKKLQLVGVTAMLLACKYEEVSVPVVEDLILICDRAYTRTDILEMERMIVNTLQFDMSVPTPYCFMRRFLKAAQSDKKLELMSFFIIELSLVEYEMLKFQPSMLAAAAIYTAQCTINGFKSWNKCCELHTKYSEEQLMECSKMMVELHQKAGHGKLTGVHRKYSTFRYGCAAKSEPAVFLLKSVAL

SEQ ID NO: 58411 - protein, 65 aa, Arabidopsis thaliana
  misc_feature (13)..(13): Xaa can be any naturally occurring amino acid
  misc_feature (31)..(31): Xaa can be any naturally occurring amino acid
  misc_feature (34)..(35): Xaa can be any naturally occurring amino acid
  misc_feature (39)..(39): Xaa can be any naturally occurring amino acid
  misc_feature (47)..(48): Xaa can be any naturally occurring amino acid
  misc_feature (57)..(57): Xaa can be any naturally occurring amino acid
MASSMLSSATMVXSPAQATMVAPLNGLKSSXAFXXTGKXNNGITSIXXNGGRVKCMXVWTTIGKK

SEQ ID NO: 58412 - protein, 437 aa, Clostridium difficile 630
MHTQLQKTIGLSAALSTVVGMVIGSGVFFKPQAIYTTTNGAPGLGIIAWLLGGFITITAGLTATEISAAIPKTGGMMIYIEEIYGEKLGFLTGWMQTVLFFPGTSAALGVIFAQQASELLGMSPNNMANVLPIAIGVILFLALLNIIGSSLGGKVQTVATIGKMIPLILIIVFGFIKGQSSEVLNPFVGDGVNASNALGQVLIATLFAYDGWINVGAISGEMKSPEKDLPRAIVGGLSLVMAVYIIINIAYLWVVPASELATVTSPATLVATRLFGNIGGKVITVGILISVFGTLNGYLLTGSRIPYTLAEMGTLPASKTLLKVNSGGSPVNSILLITVLACVYALSGQFNLLTDLTIFSIWVFYVLTFIGVMRLRRQKPDLHRPYKVPLYPIIPIIAILGGLFVIINQILTSTVISLGGIFITLLGLPVYYYMKKR

SEQ ID NO: 58413 - protein, 434 aa, Streptococcus pneumoniae R6
MSIITDVYAREVLDSRGNPTLEVEVYTESGAFGRGMVPSGASTGEHEAVELRDGDKSRYGGLGTQKAVDNVNNIIAEAIIGYDVRDQQAIDRAMIALDGTPNKGKLGANAILGVSIAVARAAADYLEIPLYSYLGGFNTKVLPTPMMNIINGGSHSDAPIAFQEFMILPVGAPTFKEALRYGAEIFHALKKILKSRGLETAVGDEGGFAPRFEGTEDGVETILAAIEAAGYVPGKDVFLGFDCASSEFYDKERKVYDYTKFEGEGAAVRTSAEQIDYLEELVNKYPIITIEDGMDENDWDGWKALTERLGKKVQLVGDDFFVTNTDYLARGIQEGAANSILIKVNQIGTLTETFEAIEMAKEAGYTAVVSHRSGETEDSTIADIAVATNAGQIKTGSLSRTDRIAKYNQLLRIEDQLGEVAEYRGLKSFYNLKK

SEQ ID NO: 58414 - protein, 256 aa, Burkholderia xenovorans LB400
MKKKQTSLEGQVAVVSGGAHGIGLGIVERLLQLGAKVVASDIDRDGLAVSRERLAKSFGTSIAVQAADLSKERGAQALHRAVAKRFGPAQILVNCAGGGVIRPFLEHTPETLKATIDRNLWTVIWCSRVFLPDMIGAKYGRIVNIGADSVRNGLPAHAGYNAAKGGMHGLTTGLAREFALNGITVNTVAPCAVNTEVWAKVKKSNPRLAQAFVDVIPMGRVGEIEEVASMVGYLALPEAAFVTGQVISVNGGSAML

SEQ ID NO: 58415 - protein, 833 aa, Acidobacteria bacterium Ellin345
MSMWHASVRRLSKSVLFINRSFISLAIFLGVLAFSSTAAFGQSEAGGEAALKLPDLSSVSFMGVDGHKLLLIGLVFCALGLAFGLAIYMTLKNLPVHRSMLEISELIYETCKTYLTTQGKFILILWAFIAVVIAMYFGWLAPVPNKPIAVTLPVILAFSLVGIAGSYGVAWFGIRVNTFANSRTAFAGLRGKPYSIYEIPLRAGMSIGMMLISVELLIMLCILLFVPADYAGPCFIGFAIGESLGAAALRIAGGIFTKIADIGSDLMKIVFKIKEDDARNPGVIADCTGDNAGDSVGPSADGFETYGVTGVALITFILLGVHDPKVQVQLLVWIFVMRIMMLVSSAGAYFLNTVIAKGRFGNADEMNFETPLTSLVWITSIVSIILTYIVSKMMIPDLSGDTTLWWKLATIISCGTLAGAVIPEFVKVFTSVDSKHVQEVVTSSKEGGASLNILSGLVAGNFSAYWLGLTMVVLMGVGYYVSAWGAAEGHGLGALMLAPAVFAFGLVAFGFLGMGPVTIAVDSYGPVTDNAQSVYELSLIENVPNIEAELKKDFNINVNFERAKHLLEANDGAGNTFKATAKPVLIGTAVVGATTMIFSIIMALTNGLTTDVGKLSLLHAPFVLGLITGGAMIFWFAGASIQAVSTGAYRAVEFIKANIKLEGIEKASVADSKKVVAICTQYAQKGMFNIFLAVFFGTLAFAFFEPFFFIGYLISIAIFGLYEAIFMANAGGAWDNAKKVVEVELKAKGTPLHDATVVGDTVGDPFKDTSSVAMNPVIKFTTLFGLLAVELAVSLEKNGGPLGRILALAFFIVSAFFVWRSFYGMRIGSLKNE

SEQ ID NO: 58416 - protein, 337 aa, Salmonella typhimurium
FFLFDDIRFGASISGSHVAIDDIEGAWNSSTKYEGGNKGHRPGVKGGYFPVPPVDSAQDIRSEMCLVMEQMGLVVEAHHHEVATAGQNEVRTRFNTMTKKADEIQIYKYVVHNVAHRFGKTATFMPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEPMDKNLYDLPPEEAKEIPQVAGSLEEALNALDLDREFLKAGGVFTDEAIDAYIALRREEDDRVRMTPHPVEFELYYSV

SEQ ID NO: 58417 - protein, 497 aa, Yarrowia lipolytica
MTVTEQEFLASYPQKVAPGGPTGYPGNLTAEQEQKLGELKMILLTKGYEDRTDDATLLRFLRARKFDVPLAQEMWENCEKWRKEFGTNTILEDFWYKEKKEVAKLYPQYYHKTDKDGRPVYVENVGKVNIHEMYKITTQERMLRNLVWEYESFVRHRLPACSRVVGHLIETSCTILDLKGVSLSSASQVYGFLKDASNIGQNYYPERMGKFYLINAPFGFSTVFSVIKRFLDPVTVSKIHVYGSNYKEKLLAQVPAYNLPIKFGGQSSSKIGVELSDDGPWRDPQFVGPEAWPPWLVSDPPVPPPSSPTPPPTPSPLLPPRSVLTTRPLTQRPTVTELLLPLPELELLLLAVLLLLLELLLPSRLLLPRLLLPRRQGSRSRCCQDRHCPCPHRQDCCTSDQLFPPEMLAMMEQNEKKAEKAAEAKTKGGAAPQANAFTDEQLAQLNSLPQQVATGGVSQPLPDSHVTQGVPTVAKIAELPPVPMRMPIFPIKTKKHT

SEQ ID NO: 58418 - protein, 608 aa, Zea mays
  misc_feature (557)..(557): Xaa can be any naturally occurring amino acid
ARGRAFFPLSFGKAAPRPSSATSSAHSNTLRKPQNPSNPKPSASTAADDDGAAMIGPPRPPPAPAGEEDDEDGGGIMIGPPRPPPPSACGEGDDGDGMIGPPRPPPADDDEDDDEEEMEDDGEGGFNRIPLSNEIVLRGHNKVVSALAVDHTGSRVLSGSYDYTVRMYDFQGMNSKLQSFRQLEPFEGHQVRSLSWSPTSDRFLCVTGSAQAKIYDRDGLTLGEFVKGDMYIRDLKNTKGHISGLTGGEWNPKSKETILTSSEDGSMRLWDVSDFTSQTLVIKPKLVRPMRIPVTSCAWDHEGKRIVGGIGDGSIQVWTIKAGWGSRPDIHVEKTHTEDITGVKFSTDGQSLLSRSMDSTLKIWDLRRMKTPLKVFEDLPNHYAETNAAFSSDEQLIFTGTSIEKDGDNGGLLCFFDRKKLELVSRVGISAHYSVIRCLWHPRINQVFATVGDKKEGGTHILYDPSISQRGALVCVGRAPRKKSVDDFEVQPVIHNPHALPLFRDQPSRKRQREKILKDPLKSHKPEAPVNGPSFGGRVGTTKGSLLTQYLLKEGGXIKETWMDEDPREAILKYADAAEKDPKFIAPAYSQTQPKPVFAESDSDNEEK

SEQ ID NO: 58419 - protein, 401 aa, Oryza sativa Japonica Group
METSPALRPAHIPRSTAVRPPCATPFSRAHWHATCAAIRRVPRVNGDSNSSIKPALADHAAPPLDLDLLPVSNLPRPLTITDLSPAPMHGSQLRVAYQGVPGAYSEAAAAKAYPSCDAIPCDQFEVAFQAVELWIADRAVLPVENSLGGSIHRNYDLLLRHRLHIVGEVQLPVHHCLLALPGVRRDLLTRVISHPQALAQCELTLNAMGLNVAREAFDDTAAAAEHVAAAGLRDTAAIASSRAAELYGLQVLADGIQDDAGNVTRFVMLAREPIIPRTDRPFKTSIVFAHDREGTSVLFKVLSAFAFRDISLTKIESRPHRHRPIRLVDDANVGTAKHFEYMFYIDFQASMAEVRAQNALSEIQEFTSFLRVLGSYPMDMTPWEYSSSSSPSPAPGGDTSR

SEQ ID NO: 58420 - protein, 163 aa, Schizosaccharomyces pombe
EVCVDSITSLSFDKTDMTKPNLSSYKTFFETNFIENTKNFYAKESSEYLASHSITDYLKKAEIRLAEEEELVRLYLHESTLKPLLEATEDVLIAQHEEVLHNDFARMLDQNCSEDIIRMYRLMSRTPNGLQPLRQTFEEFVKRSGFAAVAKIVPQVGGEADVD

SEQ ID NO: 58421 - protein, 320 aa, Candida glabrata CBS 138
MAKGEDKIQKSAAQKVSKFGSFTAGGLAACIAVTVTNPIEVVKIRMQLQGELMAANQRIYTNPFQAMGVVFRNEGIRGLQKGLVAAYIYQIALNGSRLGFYEPIRAVMNKTFYPDQESHKVQSVGINVFAGAASGIIGAVMGSPLFLVKTRLQSYSNAIKIGEQTHYTGVWNGLKTIYMTEGVKGLFRGIDAAILRTGAGSSVQLPIYNTAKNFLLRNDIMEDGPSLHLTASTISGLGVAVVMNPWDVILTRIYNQKGDLYKGPIDCLVKTVKIEGITALYKGFEAQVFRIGPHTILCLTFLEQTMKLVHAFESKVLGHN

SEQ ID NO: 58422 - protein, 284 aa, Triticum aestivum
MAAAALTLLLLVLLPAGRALATAAGDAHPGYAGAEADTCEPAPGGAPPYGGGAAGRRHGPALEEYGGGHIVDITHAYRPSMPAFAPGATVGPLVRLKASMEDGSEYNLSELRMECHMGTHVDAPGHMNQAHFAAGLDVDTLDLDVLNGPALLVDVPRHTNITAESMKSLNIPKGVRRVLFRTLNTDRGLMWKAAGDMSYVGFTEDGAQWLVDNTDIKLVGIDYISVAAFDHLISAHVAFFKNADIILVEALKLDNVKTGLYMLHCLPLRLVGSEGSPIRCILIK

SEQ ID NO: 58423 - protein, 502 aa, Aspergillus nidulans FGSC A4
MSSSPVPLLKAPVPGNRGSSNSPRPPKLTLGIPPSATSRPVAGNGVPIMSDAPQPQRPSGRPAPPQLRLATPMGSTQDVPPQRNVRPMPPPLATTGLNDANGHSRSGSSTHLDGKGSGPASASSSNYSNLSFAMGGLRQPHGGTPDPSSAISSVYSDREGGVQMERDNSVNGLIPDLDKLSLEKGRALDVEDLDDQGWLAASEQKKIVELGSLGEGAGGAVTRCKLKEGKTVFALKIITTDPNPDVKKQIIRELNFNKDCASEHICRYYGAFMDKSTGTISIAMEFCEGGSLDSIYKEVKKLGGRTGEKVLGKVAEGVLNGLTYLHGRKIIHRDIKPSNILLCRNGQVKLCDFGVSGEFGTKGDANTFIGTSYYMAPERITGQSYTITSDVWSLGVTLLEVAQHRFPFPADGTEMQPRAGLIDLLTYIVRQPIPKLKDEPENGIKWSSNFKYFIECCNSLEKEPPRRATPWRMLEHPWVLDMKNKKVNMANFVKQSFDSTVL

SEQ ID NO: 58424 - protein, 565 aa, Oryza sativa Japonica Group
MGGGAAAGNSRGISHRGLRGESNDGGGQRRRCRQGREARRHRRPPLPICCRRPEEKRIEERKEAPPTPATSSPFLSRRIGSKRWPPGKQLGMAGHLLPFARGHVHLRELEDLEQRHEPLAPEPVADTVGVVLVGEEELQGGREAALSRHPPLAVAVRRMMETLPAPRPTQIPRSTAIRPPCATPFSRAHWQTTCAAILATTTTTNAKAYGAPRVNGDSIKPALSDHAAPPLDLDLLPVSNLPRPLTITDLSPAPMHGSQLRVAYQGVPGAYSEAAAAKAYPSCDAIPCDQFEVAFQAVELWIADRAVLPVENSLGGSIHRNYDLLLRHRLHIVGEVQLPVHHCLLALPGVRRDLLTRVISHPQALAQCELTLNAMGLNVAREAFDDTAAAAEHVAAAGLRDTAAIASSRAAELYGLQVLADGIQDDAGNVTRFVMLAREPIIPRTDRPFKTSIVFAHDREGTSVLFKVLSAFAFRDISLTKIESRPHRHRPIRLVDDANVGTAKHFEYMFYIDFQASMAEVRAQNALSEIQEFTSFLRVLGSYPMDMTPWEYSSSGQTAGDTSSS

SEQ ID NO: 58425 - protein, 476 aa, Mycobacterium tuberculosis H37Rv
MPTTSMSLRELMLRRRPVSGAPVASGASGNLKRSFGTFQLTMFGVGATIGTGIFFVLAQAVPEAGPGVIVSFIIAGIAAGLAAICYAELASAVPISGSAYSYAYTTLGEAVAMVVAACLLLEYGVATAAVAVGWSGYVNKLLSNLFGFQMPHVLSAAPWDTHPGWVNLPAVILIGLCALLLIRGASESARVNAIMVLIKLGVLGMFMIIAFSAYSADHLKDFVPFGVAGIGSAAGTIFFSYIGLDAVSTAGDEVKDPQKTMPRALIAALVVVTGVYVLVALAALGTQPWQDFAEQETAGLAIILDNVTHGEWASTILAAGAVVSIFTVTLVTMYGQTRILFAMGRDGLLPARFAKVNPRTMTPVHNTVIVAIFASTLAAFIPLDSLADMVSIGTLTAFSVVAVGVIVLRVREPDLPRGFKVPGYPVTPVLSVLACGYILASLHWYTWLAFSGWVAVAVIFYLMWGRHHSALNEEVP

SEQ ID NO: 58426 - protein, 175 aa, Glycine max
MKQFAVQNVVVPSHDEISVVCPKPRRLGLFNFPVNDPTVRPFRWHLSYHVEPCDSNSSGSNPLDNLLTKDGDFDVEQSWPVVTSSPPFFCGSPPSRAANPLIQDARFGDENFSPLSPPSWVVVPAAASGLPPSPSSSARKGGCVRANFGNNPAVRIEGFDCLDRDRRNCSIPALA

SEQ ID NO: 58427 - protein, 695 aa, Zea mays
MSRRRAQEEEEDDEDVVESVERVFEGREVPGWREQVTARALAVSALLGAMFSVIVMKLNLTTGIIPSLNVSAGLLGFFLLTSWTKLLAKAGLTGVRPFTRQENTVVQTCVVACSGIAFSGGFGSYMFAMSERISEQSGETWDAHNIKNPGLGWMIGFLFIVSFLGLFSVVPLRKIMIIDYKLIYPSGTATAHLINSFHTPQGAKLAKRQVKTLGKFFAGSFTWGFFQWFYTAGEGCGFMSFPTLGLEAYRQKFFFDFSATYVGVGMICPYLVNASVLLGGVVSWGIMWPLIEQKKGDWYPADLKPSSLRGIVGYRVFVSIALILGDGLYNFLKVMTRTVTALVVQVRRMMSEPTLPISGGGGEGGGIPLPAPEETFDDRRRTELFLKDQIPNTLALGAYLVIAVVSIATVPHIFHQLRWYHVAASYVVAPVLAFCNAYGCGLTDWSLATTYGKLAIFTVGAWAAATDDSGGGGGGIIAGLAACGVMIGIVSTASDLTQDFKTGYMTLASPRSMFVSQVIGTAMGCVVAPSVFWLFYNAFRDIGMPGSEYPSPNALVYRNMAILGVQGLGSLPRHCLDLCIAFFAAAIAINLARDLAGARAAAYIPLPMAMAIPFYLGPYFGIDMCIGSLVRLVWDRLDPARAKAFAPPVASGLICGDGIWTLPQSVLALAGVKPPICMKFLSRSTNVKVDAFLRS

SEQ ID NO: 58428 - protein, 496 aa, Avicennia marina
MPTRQLFIDGEWREPVQRKRIPIINPANEQTIGDIPAATAEEMDIAVEAARKAFFRNSGKDWSSTTGAHRAKYLRAIAAKIKDRKVELVELEAIDSGKPLEEASLDMDNVIGCFEYFAGIAERLDSEQRTPVSLPMETFKCHLLKEPIGVVGLISPWNYPLLMAIWKVAPALASGCTAILKPSELASVTCLELAEVCMEVGLPPGVLNILTGLGPEAGAPLVTHPHVAKISFTGSDTTGVKIMTAAAQLVKPVTLELGGKSPIVVFEDVDLDTAAEWTLFGCFWTNGQICSATSRLLVHESIATTFLEKLVKWCEKIKISDPLEEGCRLGPIVSRRQYEKVMKYISTAKEEGATILCGGARPEHLEKGYFVQPTIITDVKTSMQIWIEEVFGPVLCVKTFATEDEAVELANDTHYGLAAAVISKDLDRCERMAKAFQVGAVWVNCSQPCFYQAPWGGKKRSGFGRELGERGLDIYLNVKQVTRYVSSEPWGWYKSP

SEQ ID NO: 58429 - protein, 213 aa, Shigella flexneri 2a str. 301
MTDQSHQCVIIGIAGASASGKSLIASTLYRELREQVGDEHIGVIPEDCYYKDQSHLSMEERVKTNYDHPSAMDHSLLLEHLQALKRGSAIDLPVYSYVEHTRMKETVTVEPKKVIILEGILLLTDARLRDELNFSIFVDTPLDICLMRRIKRDVNERGRSMDSVMAQYQKTVRPMFLQFIEPSKQYADIIVPRGGKNRIAIDILKAKISQFFE

SEQ ID NO: 58430 - protein, 424 aa, Oceanicola granulosus HTCC2516
MSTIIDIHAREILDSRGNPTIEVDVTLEDGTMGRAAVPSGASTGAYEAVEKRDGDKGRYKGKGVLEAVAAVNGEIAETILGADATDQVEIDLAMIELDGTDNKARLGANAILGVSLATAKAAAIYSGQPLFRYVGGTSARMLPVPMMNIINGGEHADNPIDIQEFMIMPVAATSIAEAVRFGSEVFHTLKKELSDAGLSTGLGDEGGFAPNLGSTREALDFILKSIEKAGFTPGDDIHLALDCAATEYFKNGVYDMVGEGKKLSPEENVAYLEALVKDYPIISIEDGCSEDDWDGWVALNAALGERCQLVGDDLFVTNPKRLKMGIEKRAANSMLVKVNQIGSLTETLQAVEMAHRAGMTNVMSHRSGETEDATIADLAVATNCGQIKTGSLARSDRLAKYNQLIRIEEMLGSAAEYAGRSILR

SEQ ID NO: 58431 - protein, 567 aa, Streptococcus pneumoniae R6
MALEVIMPKAGVDMTEGQIVQWNKKVGEFVKEGEILLEIMTDKVSMELEAEEDGYLIAILKGDGETVPVTEVIGYLGEERENIPTAGAASPEASPVPVASTSNDDGKSDDAFDIVVIGGGPAGYVAAIKAAQFGGKVALVEKSELGGTCLNRGCIPTKTYLHNAEIIENIGHAANRGIVIENPNFTVDMEKLLETKSKVVNTLVGGVAGLLRSYGVTVHKGIGTITKDKNVLVNGSELLETKKIILAGGSKVSKINVPGMESPLVMTSDDILEMNEVPESLVIIGGGVVGIELGQAFMTFGSKVTVIEMMDRIVPAMDVEVSKNLRLILERKGMTILTGTKLQEIIEENGQLRIKVEGKDDIIASKALLSIGRMPDLEGIGEVEFELDRGCIKVNEYMETSVPGIYAPGDINGTKMLAHAAFRMGEVSAENALKGNHAVAKLNLTPAAIYTLPEVAAVGLTEEQAREKYDVAIGKFNFAANGRAIASDAAQGFVKVIADKKYGEILGVHIIGPAAAELINEASSIIEMEITVEEMLKTIHGHPTYSEVMYEAFADVLGMAIHSPKKK

SEQ ID NO: 58432 - protein, 532 aa, Oryza sativa Japonica Group
MAAIGNMNLFDLFFVLQLLLSGVCVLVICYRYQRLKSMKKCSLGVVQWPIVGVLPAIVANMHRLLDGVTFLLATSQLNFQCRFWLAGFRFFVTCDPDNVRHIFTSNFDNYPKGDVFADMFDVLGGGIFNTDGERWRRQRNKAQMLMTTPRFRAFVARSSLDKVEKGLLPFLAHVADARKTCDLQDVFTRWSLDATCHLVFGVDPGCLDIGLPEVPFARAMDDVLRTIFLRHTMPVSFWKTMRWLGIGHEKRNAAARRTVESFVASAIAKHRADDESKSRQGGGGGGDKQSVADLLSSFLCDDEIAGSADADVYIRDMAMNLLVAGRDTTSSALSWFFYLLSTNPRVEQKLLQELAPIASRKPQLQQGRLFPGNGGMVTFDASEVRNLLYLHAALCEAMRLYPPVPLEHKAAVADDVLPSGHEVMAGDKVLVFYYSMGRMKRVWGKDCREFRPERWITEDGKLRYVPSNKFVAFNSGPRTCLGKEMALVQMKVTAAAMAWNFAVEVVPGHVVEPRLSVILHMKNGLLEYIGFI

SEQ ID NO: 58433 - protein, 235 aa, Clostridium difficile 630
MENNFTTRTSFLVGDDGIKKLNNSNIIVFGVGGVGSFTVEALARAGVGNITIVDFDDVDITNINRQIPALHSTVGRYKVDVMEERILDINPNINIKKIRSLYNKDTSDEILTERYDYVVDAIDMVSSKIHLIETCEKKGLKIISSMGMGNKLDPTKIVVTDIHKTSTCPLAKVMRKELRDRGIKKLKVVYSTEQPIELKKKVMNGRKVTPGSVSFVPSVGGLIIASVIVNELLGQ

SEQ ID NO: 58434 - protein, 131 aa, Trichodesmium erythraeum IMS101
MKSFISRLLALVLVCAIGLMGCSNPSTLSGNYSEDTLSLINSLKTAIELPENTEAKSEAQAIARQAINDYASRYRRDNSVSSLPSFTTMRTALDSLAGHYSSYPNRPVPDKLKKRLAQEFKQVELALKRGV

SEQ ID NO: 58435 - protein, 111 aa, Synechococcus sp. WH 7803
MERPWGWYEDLLSGPGYKLKRLLVRQGCRLSLQRHRHRSENWTVVAGSGQLLCDGHAVDAKAGSTFHIPRGSIHRAVGGPGDLLIIEVQHGSTLEESDIERLEDDFGRVIN

SEQ ID NO: 58436 - protein, 374 aa, Pseudomonas putida
MAKRDYYEVLGVERGANEGDLKKAYRRLAMKYHPDRNPGDKESEEQFKEANEAYEVLSDASKRAAYDQYGHAGVDPSMGGGGAGFGGANFSDIFGDVFSDFFGGGRGGSRGGAQRGSDLRYTLELNLEEAVRGTTVSIRVPTLFNCNPCDGCGANKGSTPSTCPTCGGIGQVRMQQGFFSVQQTCPRCHGQGKIITDPCGACHGEGRVEEYKTLSVKVPAGVDTGDRIRLSGEGEAGTHGGPTGDLYVVINVREHEIFQRDGKHLYCEVPISYTDAALGGELEVPTLDGRVKLKIPEGTQTGKQFRLRGKGVAPVRGGGAGDLLCRVAVETPVNLSRRQRELLEELRDSLEGDSSHSPKANGWFDGVKRFFGDL

SEQ ID NO: 58437 - protein, 172 aa, Triticum aestivum
  misc_feature (53)..(53): Xaa can be any naturally occurring amino acid
  misc_feature (151)..(151): Xaa can be any naturally occurring amino acid
LHVLITGSTKGIGYALARKFLEAGDNVIICSRSAQKVESVVGDLKKEYGEQHXGTVCDVRDGKDVKALVEFARDKLKHIDLWINNAGSNAYTYKPLVETSDEALMEIITTNTLGLMICCREAINMMRNQPRGGHIFNLDGAGSDGRPTPRXELQMNEVNNVMVHNLSALGHA

SEQ ID NO: 58438 - protein, 449 aa, Listeria monocytogenes str. 4b F2365
MEKHYDYIAIGGGSGGIASINRAAMHGAKCALIEPKFLGGTCVNVGCVPKKVMWYGAQIKEAMDLYADAYGYQVDASFNFQKLVENREAYIERIRGSYKNGLDNNKVEWIKGYAEFVDEKTLRVNGELVTADHILIATGGEPALPSIPGAEFGITSDGFFALKELPKKVAVVGAGYIAVELAGVLQQLGSETHLFVRKHAPLRNFDPLLTDTLTEIIEQSDMMLHKHAVPQKVEKNPDGSLTLSLEDGRTETVDTLIWAIGRKPVIQGLQIEKAGVKLLESGHIAVDKFQNTNVAGIYAVGDVTGHYELTPVAIAAGRRLSERLFNNKKDAHLNYENIPTVVFSHPAIGTVGLTEPEAIEKYGKENIKVYTSSFTSMYTAITDHREPCRMKLICEGKTERVIGLHGIGYGVDEMIQGFAVAINMGATKADFDNTVAIHPTGSEEFVTMK

SEQ ID NO: 58439 - protein, 239 aa, Picea sitchensis
MAAATSSMTLLSCKVPSTPICYSFMKPSFRPSIIALKSPSRVLKGSSFLVPGPKPFTINPIKPTFVRSSTTLHTVRATISVGDKLPEATLSYFDKEGEIQTIKVSELTKGKKVVLLAVPGAFTPTCSQKHLPGFVEKADELKAKGVDTIACVSVNDAFVMRAWGENLNVGDKVLLLADGIQEFTKALGVTLDLSDKPVGLGVRSRRYALLAEDGVVKVLNLEEGGAFTVSSAEDILKAL

SEQ ID NO: 58440 - protein, 266 aa, unidentified eubacterium SCB49
MKIAIIGAGNLGQSIANGLLQDTLVVSLYITKRNVSEISALKKHENVVVTSDNIEAVKNSELLIFAVQPAHFEGVLNEIKPYITDRHTVISTITGYSIAKIEAQLSVKQAIIRAMPNTAIAVGKSMTCICSNVSAEKRVDVAQKIFNSLGHSLLIPESQMQAATVVCASGIAFWMRLIRATTQAAIQLGFDAKEAQQLAMFTSEGAANLLIQSGKHPEEEIDRVTTPKGCTIEGLNEMEHKGLSSSLIQGMVASFNKINTIKTDQL

SEQ ID NO: 58441 - protein, 357 aa, unidentified eubacterium SCB49
MAIFHKLKIKDIYKETDDTSVITFDIPSEILSEFKFRQGQHLTLKADIDGKDTRRSYSLCSGPEEGEWKVAVKKIIGGAFSTFVNETLQTGDTLEVMAPSGNFGVACQPSEAKNYLFFAAGSGITPVLSMVKAHLAAEPQSTCKLFYVNKTAKSIIFKEALEQLRNKYFGRFEIYYFLTKERRDIALFNGRFDDEKMAVLTKNFIDIPDTNDVFLCGPEAMVNYVSEYLVTAGLPKENVHFELFVTGLTEEDIARAERLAKQNVEGTEVTIVDGGKEFSFVMTKEYDNILDAALGAGADLPFACKGGVCSTCKCEVKDGDVEMKINYALSDKEVSQNLVLSCQAVPTTDKVIVDFDV

SEQ ID NO: 58442 - protein, 292 aa, Mycobacterium avium 104
MVVIGQIGRDLVLRTDRPPTAGESATVLRREELLGGKGANQAVGLAQLGVPVTLIGVVGDDQAGTSILQQAQRDGIDVSKVARRGTTALLVDVVAAPPERMLLEDVPDSSLVRVADLDRSSSLFDTADTVSIQLQQPAATALEAAQRARQRGLRVVADGVPAPQVRADLLATLDVLRADATEASIIAGTEITTVEQAFELADHLLSGGPELVALAVPDVGDLLTWRGGSELFEFADVEVVDPTGAGDAFVAGLVAALREGAAPREAGRRAAAAAGATVQRLGGRPDLTGLRA

SEQ ID NO: 58443 - protein, 488 aa, Listeria monocytogenes str. 4b F2365
MSIKETALPKVQTKLFINGKWTDGDNKETKDIVNPANGEVIAKIAQAGPNETKKAIKAAKEAFPDWAKMELADRVKLLHKIADLMEEKADTLAKIMTLEQGKPLKESKGEVLTGAENFRFAAEEARRLYGETIPAPNNHAFIVKKQPIGVVAAITPWNFPGGMVTRKLAPALATGNTIVLKPSGDTPLSALAIFEIFEEAGLPKGVANIVMGSSKEIGETLTDSDDVRKLTFTGSTKVGQTLFKQSAETLKKISLELGGHAPFIVFDDANLDAAVNDLVAAKFRNNGQVCVSPNRIFVAKEIKEKFTKALVAKVEQLKVGNGLDDVNVGPLIREDAIDKIDKQLKNATDKGAKVLTGGGRLTGSDYDKGNFYKPTVLDNVTREMDIFYEETFGPVIPLITFETEDEAIEMANDSEFGLASYFYTKDLARVEKVGAALEYGMVGANEIAISNPETPFGGVKHSGFGRENGHYGMEEYIQVKFINLKYRD

SEQ ID NO: 58444 - protein, 178 aa, Aspergillus fumigatus
FHQTPSAMSQVFFDVEYAPVGTAETKVGRIVFNLFDKDVPKTAKNFRELCKRPAGEGYRESTFHRIIPNFMIQGGDFTRGNGTGGRSIYGDKFADENFSRKHDKKGILSMANAGPNTNGSQFFITTAVTSWLDGKHVVFGEVADEKSYSVVKEIEALGSSSGSVRSNTRPKIVNCGEL

SEQ ID NO: 58445 - protein, 328 aa, Escherichia coli O157:H7 EDL933
MPLHNLTRFPRLEFIGAPTPLEYLPRFSDYLGREIFIKRDDVTPMAMGGNKLRKLEFLAADALREGADTLITAGAIQSNHVRQTAAVAAKLGLHCVALLENPIGTTAENYLTNGNRLLLDLFNTQIEMCDALTDPNAQLEELATRVEAQGFRPYVIPVGGSNALGALGYVESALEIAQQCEGAVNISSVVVASGSAGTHAGLAVGLEHLMPESELIGVTVSRSVADQLPKVVNLQQAIAKELELTASVEILLWDDYFAPGYGVPNDEGMEAVKLLARLEGILLDPVYTGKAMAGLIDGISQKRFKDEGPILFIHTGGAPALFAYHPHV

SEQ ID NO: 58446 - protein, 914 aa, Magnaporthe grisea
MDGHSNFTQPSDTSHASHTIPSSSSSQRRRLTKKPPPSTSARHHHSSLSIDSRVDAQSLVGKRSSTSLRRAPSAPPARTPTSTHASNSSSPRNPSSSTRLNNHSPIIPAASEFAASSLSPSARDRDSDPARNDHGHQLQNNNNYYYSAFTNAHHHNQYSAASHRRSNSYGHPHGPQSSNSLTFNHSEDFIGAPFDGSAILNRIEATKASPTLGSGAFPHISNPIPVGAAAPAQYSRGSPALEQSFTFPSAAMREKSQQVRGMEAQLPTSKRYSDETKEPKPGVLRKKSGFSGFMSGLVGTPKKPLISAPENPVHVTHVGYDSATGQFTGLPKEWQRLISESGITEKERRENPETLVNVIKFYKETTEKPAEDQVLEKFHDARPGLPSAPSAGSMISPGLAPHHYNPMSPMISPPASPRFPQVGHEGNFENPRSPPPVPKNKDVTLMPSRPAPRPPVSLPTRTAPHAPYAAKDSGIDMPPQHDDLTPTTYQPPKESQPILPEEHRSRSNSRVNGNTAYPASQQSPAVQAAYQQQLMQQQQEQALAQAQASMSGSMSRAPSKRQPQAQQPTPPQSQHQYSRPTDANGAQQTQRPQQPQIGPVPQSRPRHRSRQSNGLDVVAALKRICSEGDPREIYRSFTKIGQGASGGVYTGHERGSNRLVAIKQMNLEQQPKKDLIINEILVMKDSSHPNIVNFIDSYLCGGELWVVMEFMEGGSLTDVVTFNIMTEGQIASVCRETLLGLQHLHSKGVIHRDIKSDNILLSMEGNIKLTDFGFCATINEAQNKRTTMVGTPYWMAPEVVTRKEYGRKVDIWSLGIMAIEMIEGEPPYLTESPLRALWLIATNGTPQIKDEGNMSPVFRDFLYFALKVDPDKRASAHDLLRHEFMNLCVDLSHLSPLVRAAREARAQEKARKGQ

SEQ ID NO: 58447 - protein, 395 aa, Nicotiana paniculata
MASASLLKTSPAIGKTDFIKGQALRQPSVSVRCHPAPPSGLTVRASSYADELVKTAKTVASPGRGILAMDESNATCGKRLASIGLENTEANRQAYRTLLVSAPGLGQYISGAILFEETLYQSTVDGKKIVDVLHEQNIVPGIKVDKGLVPLAGSNDESWCQGLDGLASRSAAYYQQGARFAKWRTVVSIPNGPSALAVKEAAWGLARYAAISQDNGLVPIVEPEILLDGEHNIDRTFEVAQKVWAEVFFYLAENNVMFEGILLKPSMVTPGAECKERATPDQVADYTLKLLQRRIPPAVPGIMFLSGGQSEVEATLNLNAMNQSPNPWHVSFSYARALQNTCLKTWGGRPENVQAAQEALLIRANANSLAQLGKYTGEGESEEAKKGMFVKGYVY

SEQ ID NO: 58448 - protein, 421 aa, Ehrlichia canis str. Jake
MSNITINKILARQILDSRGYPTIEAEVILSNNTKAKACVPSGASVGKFEAVELRDNDKNYYNGYGVTKAVNIINSEIAPQIIGMNTLNQEKIDNTLIKIDGTDNKSRIGANSTLAVSLAIAKAAASTLNIPLYQYIGGINAKVLPTPLINVINGGMHADNNLDFQEFMIIPNGANKFEDAMRMSAEVFFKLKQILKSKQYNTSVGDEGGFAPNIKTNNEVFEIIIDAIEKSGYKMYKDFSLGLDVAASTFYKDQKYKFADYEFNTQELVEYYKNITSQYPIISLEDPIAEEDTNGWKLITQELGNKIQIVGDDLFVTNCKLIQNGIQNNLANAVLIKPNQIGTLTETFNAIRLAQKNNYNTIISHRSGETEDTTISHIAVAANCGQIKTGSLSRSERLAKYNELLYIEKQLDISAIYYGAL

SEQ ID NO: 58449 - protein, 398 aa, Nicotiana paniculata
MASASLLKSSPTVLDKSEFVKGQSLRQTSVSVVRCHPTNAPSLTVRAASPYADELVKTAKTVASPGRGILAMDESNATCGKRLASIGLENTEANRQAYRTLLVTAPGLGQYISGAILFEETLYQSTVDGRKIVDVLVEQNIVPGIKVDKGLVPLAGSNDESWCQGLDGLASRTAAYYQQGARFAKWRTVVSIPNGPSALAVKEAAWGLARYAAISQDSGLVPIVEPEILLDGEHGIDRTFEVAQKVWAEVFFYLAENNVMFEGILLKPSMVTPGAECKDRATPQQVADYTLSLLQRRIPPAVPGIMFLSGGQSEVEATLNLNAMNQAPNPWHVSFSYARALQNTCLKTWGGQPENVKAAQDALLTRAKANSLAQLGKYTGEGESDEAKQGMFVKGYVY

SEQ ID NO: 58450 - protein, 202 aa, Glycine max
TTQTNAFLSEIRGKHLNYSKFWNANPSAEKQVKLSSKAGMPWLYTPAVLAGLASFWVFPHQGLRFTILQSAVTLHYFKRVFEVLFIHKYSGGMTLESAIPITLSYFLSAVTMVYSQHLTKGFPEPPINLFYPGIVLFLVGIIGNFYHHYLLSKLRGKGEKEYKIPKGTTMYLVGRSYSTRKWYLSKFEDFPKHVKAVIPFVF

SEQ ID NO: 58451 - protein, 530 aa, Zea mays
MGNRASRHHRQAAEQQPATPTLPKPQPQIQPPPPPPPTQTQQYQQAPPQSQQKPKPAADVGAVGRVLGRPMEDVRATYTFGRELGRGQFGVTYLVTHSETGQRFACKSIATRKLVHRDDIEDVRREVQIMHHLTGHRNIVELRGAYEDRHSVNLVMELCEGGELFDRIIAKGHYTERAAASLCREIVAVVHSCHSMGVFHRDLKPENFLFLNNKEDSPLKATDFGLSVFFKHGETFKDLVGSAYYVAPEVLKRKYGAEADIWSAGVILYILLSGVPPFWAENEDGIFDAVLRGHIDFSSDPWPSISNGAKDLVKKMLRQDPKERLTAAEILNHPWIREDGEAPDKPLDITVIGRMKQFRAMNKLKKVALKVVAENLSDEEIMGLKEMFRSLDTDNSGTITLEELRSGLPKLGTKISESEIKQLMEAADVDGNGTIDYAEFISATMHLNRLEKEDHILKAFEYFDKDHSGYITVDELEEALKKYDMGDDKTIKEIIAEVDTDHDGRINYQEFVAMMRNNSPEIVPNRRRMF

SEQ ID NO: 58452 - protein, 694 aa, Synechococcus sp. WH 7803
MMEHPLGIFALLVAIAVLVPPLTRRLRLPDLVGLLAAGVLVGPHCLQWLDAQGETITLLSDIGAIYLLFTVGLEIDLEEFNRVKNRSVGFGLLVFGFGVATGVGIGRLFGFPLVPSLLLGALMATHTPLGYPIVRSYGAQRDESVIVSVGSTILTDIAALLLLAVALGLGGGNLTATGITGLFASIAIFSVGVVWAIRWLGRRLWMRSITDENRVFLTVLLALFIASLGAELAGVEKIVGAFLAGLAVNSVLPEGRVKEQVIFVGGALFIPIFFIHLGLLLNLGDLAASVNTLDFTVLMLVGALGCKALAALCAGRWFGYNNNQILLMWSLAMPKVAATLATAFVGFQAGLLNATVLNSVLAVMVVTATLGPTLTTRSVVALMEPDEDSSQPGLASTTAPASATSPTRAVVRRPLNIVVPIANPATEGRLLTIAARLLKGDDDQRGQLLPLALVSPNLEDARGGLNRALAAARERLKEASAIGNSLSVTTRCLLRLDEDIPGGMSRSALEQSADLLLIGAGRPDRLRNWLFGDLVDGVCRTAHCPVVVVNLNKESNTGFRRILVPIKDLSSNAREQFELALRLQDSASETSDTHITLLHIHDPRFNRHDRSWMRDELLSWSSRGDAKALDLRIELCEGPGVDRIIHRKSRDHDLVILRSQRRRVAGLPIPASDRTSNLVNQLACGSLVISDPLL

SEQ ID NO: 58453 - protein, 434 aa, Silicibacter sp. TM1040
MRIAMIGTGYVGLVSGVCFSDFGHDVTCVDKDATKVARLQAGEAPIYEPGLEDLMARNVAAGRLSFTDDLATAVATADAVFIAVGTPTRRGDGHADLTYVMAASEEIAAALQGYTVVVTKSTVPVGTNRQVKQVIAKSNPAAEFDVASNPEFLREGAAIDDFMRPDRVVVGVQNERAAEVMAEIYRPLYLRDFPILTTDLESAEMIKYAANAFLATKITFINEIAGLCERVGADVKEVSHGMGLDGRIGNKFLHAGPGYGGSCFPKDTAALARIGQDHGYPMQITETVMRVNHEIKARMLEKLRDACDGSFNGKTITILGVTFKPNTDDMREAPSLTIVPALIGGGAKVRVVDPQGEAEGRDLLPGVKWEEDPYKAARNADLVVLLTEWNEFRALDLKALARKMAQPRMVDLRNIYTAKSARQAGFETYMSVGR

SEQ ID NO: 58454 - protein, 333 aa, Silicibacter sp. TM1040
MRTALITGTAGFIGYHLATYLLASGWQVVGLDCLSPYYDIALKRRRHAMLEVNDNFIPVIGKLEDPGRLMGLLADHKPNAVIHLAAQAGVRHSIDAPRDYLEANLIGTFEVLEAARAHPPEHIMIASTSSAYGANTNIPFDEHQKADHQMSFYAATKKAGETMAHSYAHLYGLPTTMFRFFTVYGPWGRPDMALFKFTKAIEAGEAIDVYNHGRMSRDFTYIDDLVAGITGLIEAVPGDTPVSTQDTLSPVAPFRIVNIGASKPTPLMDYIAALETALETTARKNLMEMQPGDVPATWADTTLLSQLTGYEPQVSVEEGVARFVAWYRGYYAS

SEQ ID NO: 58455 - protein, 433 aa, Listeria monocytogenes str. 4b H7858
MKVIKFGGSSLASGIQLNKVFQLVAEDPDRKIVVVSAPGKRFKEDTKVTDLLIDCAAKALLGEDTSELFESVIARYAGIALDTGMSDEIINQIRADLQATISSDKSDPDKFLDRMKASGEDNNAKLIAAYFKFKGLNANYINPKDAGLLVTDEHASAQVLPESYDRLFALREREGIIVFPGFFGYTKDGEISTFSRSGSDITGAIVANGAQAELYENFTDVDAVYAVNPAIVKNPKKVLELTYREMRELSYAGFSVFHDEALIPAFHAGIPVHIKNTNNPDSCGTRVVHERENNNGPVVGIASDDGFCSIYISKYLMNREIGFGRKVLQILEDAGLNYEHMPSGIDDLTIIIRENQFGEDTEQTIMSRLKEELNADQVIMQHGISLIMVVGETMRHNVGITSRASKALSDAKVNIEMINQGSSEVSIMFGVKK

SEQ ID NO: 58456 - protein, 365 aa, Acidobacteria bacterium Ellin345
MKWKNVAPTPGSPAALGYRMPAEWESHYATWIAWPHNRSDWPGKFEPIEWVMAEIVRHLAHDERVNILVNHEAGEERARKFLTRAQVIAEGSDGSIQFHHYPTNRIWTRDYGPIFVKAGKKLAAMDWRFNSWAKYNDWRRDDAIPQQILTELNVENWQPTTEVNGKAKRVVLEGGSIDVNGAGAILTTEECLLSDVQARNPDLSRNELEQVFADYLGCTKTLWLNKGIAGDDTHGHVDDLARFVDKHTIVVACENHRDDENHAPLLENYKRLQHMTDQDGRPLKIAKLPMPDPVWFEGRRLPASYANFYIANKRVLVPVFNSVNDLPALTTIQQLFPSRRVVPIYCGDFIWGLGAIHCMTQQQPA

SEQ ID NO: 58457 - protein, 473 aa, Silicibacter sp. TM1040
MIHPILLCGGSGTRLWPLSRKSYPKQFAPLVGDITLFQSSAQRLAGEGFASPMVVTNSDFRFIVTQQMAEVGIDPGAILIEPEGRNTAPAVLAAALFLQKHDPDGLMLVAPSDHVVPDSEAFRAAIAAAEPAAQAGQLVTFGIKPDRPETGYGYLELASKPEDFEPKVIGLKRFVEKPDLDTAKDMLRSGNFLWNAGIFLFSVESIIQAFKAHCPHMLVSVQTALDLGEHDLGFLRLDPDAWSGAEDISIDYAVMERAENLAVVPYAGGWTDLGGWDAVWREGVPDQDGVVIHGRASAIDCTDSLLRSEDERLEVVGIGLKNIITVAMPDAVLVADVSRAQDVKKAVETLKAKSVRQAEAFPKDHRPWGWFESLIVGERFQVKRIHVNPGAALSLQSHHHRSEHWIVVEGTARVTVDDTVSLVTENQSIYVPLGAVHRMENPGKVPMVLIEVQTGSYLGEDDIIRYEDVYARA

SEQ ID NO: 58458 - protein, 253 aa, Xanthomonas campestris pv. campestris
MSESPYTSGTTHFGFRDVAAKDKQKLVGEVFTSVARNYDLMNDLMSLGIHRAWKRYFVATAQVKPGDRVLDLAGGTGDIAVLLKERVGNEGAVVLGDINAGMLSVGRDRLTNRGLVAGFDYVQCNAEALPFPDQSFDLVTISFGLRNVTDKDAALREMYRVLKVGGQARVLEFSEVTADWFKPIYDFHSFKILPKLGQLFARDADSYQYLAESIRKHPPQDSLKGMMGEAGFARCHYKNLTGGIVAIHSGYKI

SEQ ID NO: 58459 - protein, 489 aa, Streptomyces avermitilis MA-4680
MSGSPGSPPPEGGFVRRVGLFQATTINMSQMCGIGPFVTIPLMVAAFGGPQAVIGFVAGAVLALADGLVWAELGAAMPGSGGSYVYLRQAFQYRTGRLMPFLFVWTAMLFIPLIMSTGVVGFVQYLGYLAPDMGRTTGDLVGVGIIALVVMLLWRGIENIARITAVMWTVMIASVLLVIVAAASDFSAHLAFTYPAHAFEPTSGHFWVGFAAGLTIGIYDYLGYNTTAYMGAEIKDPGRTLPRSILFSILGIMAIYLLLQIGTLGVIDWHRMTDAGDIASTSVASAVLEKTWGKGAADTVTVLILITAFASVFTGLLGGSRVPYDAARDRVFFRPYAKLHSRHRFPMLGLATMGVITAIGFLIGRHTDLATLIQLLTTVMVIVQALAQIVALTVLRKRQPTLRRPYRMWLYPLPSVIALVGWLVIYGYADKNSPGRHPIEWSLAWVALGCVAFVVWARLEKVWPFGPREIAEEYLTAAAPDADAEPAQT

SEQ ID NO: 58460 - protein, 235 aa, Brassica napus
  misc_feature (222)..(222): Xaa can be any naturally occurring amino acid
MSSLSRLLLRATNNFNTPTSGRFFSAATAAAAATSQRTPSLITLVNDEQDPKYITEKFKKASETEWFRKNIAVYERTVRRLAAAKKFEWIEEILEEQNKYHNMSKEGFVARIINLYGRAGMFENAQKVFDGMPERNCKRSVLSFNALLNASVNSKKFDLLESIFKELPGKLSIQPDIASYNTLIKGLCGKGSLSEAIALIDEIENKGLKPDHFTYNLLLHEXYTKGHFELGEGDM

SEQ ID NO: 58461 - protein, 195 aa, Escherichia coli
RADERPGKINLGIGVYKDETGKTPVLTSVKKAEQYLLENETTKNYLGIDGIPEFGRCTQELLFGKGSALINDKRARTAQTPGGTGALRIAADFLAKNTSVKRVWVSNPSWPNHKSVFNSADLEVREYAYYDAENHTLDFDALINSLNEAQAGDVVLFHGCCHNPTGIDPTLEQWQTLAQLSVEKGWLPLFDFAYQ

SEQ ID NO: 58462 - protein, 219 aa, Haemophilus somnus 2336
MDQLSMKKMAAQAALQYVKPDSIIGVGSGSTVNCFIEVLGTIKETIKGAVAASKASEELLLRQGIEVFSANDVSGLDIYVDGADEINPQKMMIKGGGAALTREKIVAALAKKFICIVDSSKQVDVLGSTFALPIEVIPMARSQVARKLVALGGSPEYRENVVTDNGNVILDVYNFKIMNPIEMEKELNNVAGVVTNGIFALRSADIVIVGTPEGTKIIG

SEQ ID NO: 58463 - protein, 241 aa, Picea sitchensis
MGCIAVIHVALLLLLAGVGKLAKADDTNSVFNPCSDTLVQKSDGFTFGVTFAARDSFYSNTVEYSPCDSRLGLSASHLAVFRPKVDEITLLTINTTAGSFSPEQDGGYMVAFAGHNHAARSTPTFVANQTLIITSFTLVLDFNKGRLQNLFWKTDGCNSCQGKSSFVCYRGQSCAIKLSDCKNKGGSVDCSLGIQLAFSGTDKHDSVFNSWYEISNLRQYSLFGLYSNLKNSLTSQYGKYF

SEQ ID NO: 58464 - protein, 175 aa, Triticum aestivum
MAPAMMASSATTVAPFQGLKSTAGLPVSRRSGSAGLSSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNMRQVQCVSFIAFRPPGCEESGKA

SEQ ID NO: 58465 - protein, 200 aa, Prototheca wickerhamii
YYALSFVRTADVIYELKDWLARQGATGTSAIGVLAKIESADSVANLEAILDAVDGAMVARGDLGAELPVEEVPYWQSKIVKGCRKRGKPVIVATNMLESMIKCPTPTRAEVSDIAIAVREGADAVMLSGETAHGSFPFKALDVMTTVAKRTELSMLRYEGARRYGSEESDAIDWILPPARRMNSLADVGISEMFAYHAVT

SEQ ID NO: 58466 - protein, 229 aa, Mycobacterium tuberculosis H37Rv
MLTAMRGDIRAARERDPAAPTALEVIFCYPGVHAVWGHRLAHWLWQRGARLLARAAAEFTRILTGVDIHPGAVIGARVFIDHATGVVIGETAEVGDDVTIYHGVTLGGSGMVGGKRHPTVGDRVIIGAGAKVLGPIKIGEDSRIGANAVVVKPVPPSAVVVGVPGQVIGQSQPSPGGPFDWRLPDLVGASLDSLLTRVARLEALGGGPQAAGVIRPPEAGIWHGEDFSI

SEQ ID NO: 58467 - protein, 370 aa, Oceanicola granulosus HTCC2516
MRTRAAVATAAGKPLEIMDVNLEGPRAGEVLVEVKATGICHTDEFTRSGADPEGLFPAILGHEGAGVVVEVGAGVTSLKPGDHVIPLYTPECRECEYCLNPKTNLCQSIRSTQGQGLMPDGTSRFSTLDGDPILHYMGCSTFANHTVLPEIALAKVREDAPFDKICYIGCGVTTGIGAVINTAKVEIGSRAIVFGLGGIGLNVIQGLRLAGADQIVGVDLNDDKQQMAERFGMTDFVNPSEVEGDLVAYLVHLTKGGADYTFDATGNVDVMRTALESAHKGWGESIIIGVAPAGAEISTRPFQLVTGRSWRGTAFGGARGRTDVPRIVDWYMDGKIDIDPMITHTMGLDEINKGFDLMHEGKSIRSVVVY

SEQ ID NO: 58468 - protein, 387 aa, Acidobacteria bacterium Ellin345
MTPQSPFCDVETALAEIRAGRMIVVVDDEDRENEGDLTMAAEYITPEAINFMAKYGRGLICLAMTEERLDALRLPLMSAENTSNFGTAFTESIDARDGVSTGISAYDRAHTIKVAIDPGTRPNDLARPGHTFPLRARKGGVLVRAGQTEASVDLARLAGLVPAGVICEIMNDDGTMARVAELTEFCKQHDMKMLTVAELIRYRMANERYIRRLAEATVPTRYGDFRMIAYESDITGESHVALVKGDVEHAPEPVLVRMHAHCLVGDVFGATQCDCSKTIERALEMIAREGRGALIYLHQTSKGYSVEKLGDKLTIQFHHDLRLPTLPEHQRKTQREVGIGAQILSDLGLTRIRLITNRPRRVAGLEGFGIHIVEQVPTAEPRPAAAK

SEQ ID NO: 58469 - protein, 512 aa, Bifidobacterium longum DJO10A
MGDPRGFLKVRTRRELAERPVEERIKDWFDVHAETGLQPWTQAQAARCMDCGTPFCMTGCPLGNLIPEWNDLVRQGKWEDACNRLSMTNNFPEVTGRICPALCEQACVLGIHQPPTMIRNDECTIIDQAWDLDIVKPLPPQRLTDQTVAVVGSGPAGLAAAQQLTRAGHTVVVYEKDDAIGGLMRYGIPNFKLEKGLIDRRVKQMEAEGTRFRTNVEIGKDITWDDLRDRYDAVVVAIGSRVPRDMKIPGRELDGIHFALDFLPDATRRIFGVKPVHDITAKDKHVVVIGGGDTGSDCLGTSIRQGAKDVTVLQIMPKEPSSRPDNSPWPTFARTYQKTSSMEEGGEYIYSTDSVNFEGTEEEKAKVTIDNSTTAEGFVADERGHVTGLKVVSVAPGENGPFTRQPGTERVLPADLVLISVGFLHPDTETILDQLPVELDKRGNIARNDKFATSQDGVFVCGDAGRGQSLVVWAIAEGRSCAAAVDEYLSSEQTSELPAPIKASQRPMMLPR

SEQ ID NO: 58470 - protein, 475 aa, Acidobacteria bacterium Ellin345
MTELRNFLALPYDELEELNLKAKEQRMKRVAADKIQEERLKYLTDEKRIKAVTVLFSDLEGRLHMLDYDKKFLLKSYDNLTFDGSSIRGFTAQRESDLRLYIDWSAFYWGPADIFGPGKVLVFGEVISKEGKHYEADVRGVLKTFSETLHKKEGYTLNAANEIEGFLFKGEDAERRFHDTHAFEYVNTGGYYHSLPGDPLRTFIDTTAEVQRSMGFQNEKDHPEVAPSQFEINYSYGEVVAAADQIQLYKLICRQVATKMGLSASFLPKPVVGVNGSGMHTNVSISKGGKNLFWDPKGEEQLSSFGWSFVDRILTHGNDICLMLNASVNAYRRLDPHFEAPNQIKASPTDRGSMVRIPIGNEKSMRVEVRSVGPDANPYMVMYSVFKTGLHGEIAKIKNLRQAERYLPDNIYTALEHFRLADWTTKLLGADVKGRYADLKQASADRCARLLGTVVKAPEVQFHHDVYNQYLWNQF

SEQ ID NO: 58471 - protein, 145 aa, Erythrobacter sp. JL-310
HDDLPGMDDDEMRHGKPTLHKAFDEATAVLAGDSLHALAFDILTQPDTSTDPFVRAELVATLARASGHDGMAGGQMMDIVSEEQSYDLRQVTRLQQLKTGALLAASVEMGAVLGRVAPEGRTHLRAYARDIGLAFQIADDILDVE

SEQ ID NO: 58472 - protein, 295 aa, Guillardia theta
MEHHSNIVPWQLVASKTGAVLKHVKLNSQQGFDMDHFRSILSDKTKIVAVVHVSNMLGCINPVQEIVAAAHAVGAKILLDACQSAPHMPLDVRLLDCDFLVASGHKLCGPSGSGFLYGKKEILESMPPWKGGGEMIDQVFLDHSTFASPPGRFEAGTPAIAECYGLGAACQYLMDIGMDKIESYEHAITKHLWETLAGREDLTLYGPAPAADGGGRAALVAFNHRTIQASDLTTFLDFEGVALRSGHHCTQPLHRILGVSGSARASCYLYTLEEEIDEFARHLKDTIEMFRNMDG

SEQ ID NO: 58473 - protein, 147 aa, Roseobacter sp. JL-126
HDDMPGMDNDDLRRGQPTCHIAFDEATAILAGDALQTLAFELLSESPLGGLKAERQLSMVNALARASGSAGMCAGQAIDLQATGQHVNDHELEHMHRHKTGALIEAAATIGVLCGEEEALKWQPHFKEFATHLGLAFQVHDDILDVE

SEQ ID NO: 58474 - protein, 196 aa, Oryza sativa Japonica Group
MASSPYHAAVGVAVLAILLAAPAAEAGAPTAAPLANYSLEDACKKTGPHYGLCIVTLSADRSAKSSDTVGLARVAVLAAQKNASETATYLSSIYDDDSIEKKTVQLQQCLEDCSERYEAAVEQLTDATVALDTGGYEEAMALVAAGQAEVKMCQRGFKAVPQHRNILTLRNREVDQLCSIAFTITKLIRVSPSAEE

SEQ ID NO: 58475 - protein, 332 aa, Vitis vinifera
MGFDSISNSSSPLPPFSKDLAKKKRTNRSARLKQSKLDVRREQWLSQVKNKGCEVDSSGRGGSPPSCMQIPHMQNRLVETSEMRSREEENDNSSIHDSDLESLLNSPVGSSLDSNASRKDHPRSSSSTSSDCCSRSLSEEEEDDGCLDDWEAVADALGINDNQQNPISEPPVKPEARIGSADTELPKRSSGVDLLKTESGGVVPISQMNSRAWRPDDALRPQSLPNLSKQCTFPMNSERHCHRAIPWAWKSTISQPSSCPICCEDLDLTDSSFLPCTCGFRLCLFCHKRILEADGRCPGCRKQYDPIHGDVGFNTGATPFKIGRSCSMISRS

SEQ ID NO: 58476 - protein, 346 aa, Flavobacteria bacterium BBFL7
MNKDIKAYDSVLDLIGETPLIKLSTTTANFTGEFFAKVEAFNPGHSSKDRIALHIIEEAERKGILKPGDTIIETTSGNTGFSIAMVSRIKGYDCILAVSSKSSADKIDMLKSMGAKVYVCPAHVSADDPRSYYEVAKRLHEEIKNSIYINQYFNELNIEAHYKSTGPEIWEQTGGQITHLVACSGTGGTISGTARFLKEQNPDIEILGVDAYGSVLKKYHETKEFDSEEIYPYRIEGLGKNLIPTATDFDSIDYFVKVKDEDAAHMARKISQTEGLFVGYTSGAAMQAVKLLNDEGRFDENSKVVIIFPDHGSRYMSKIYNDQWMQDQGFFDSKSTATKQPIEYIK

SEQ ID NO: 58477 - protein, 144 aa, Roseobacter sp. JL-129
HDDLPWMDDDDLRRGLPTVHKKWDEGTAVLVGDALQTLGFELVLSPECHPEPAVRSDLALTLAKAAGAKGMVLGQALDIAAETADQPLTLDEIIALQNGKTGALIRWSAEAGARLAKADIAPLTAYADALGLAFQIADDILDVE

SEQ ID NO: 58478 - protein, 476 aa, Escherichia coli
MKIVPVVLAGGSGTRLWPLSRTMYPKQFLKIFGHMTMLQTTLSRMNSFHDATDAIVICNEAHRFVVAEQLNQIDKKSTIILEPCGRSTAPAVALAAMHIVETINADQDVLLLVLPADHIIKDLDTFHQAVKVASSFACGGKLVTFGIPPLTPETGYGYIQRGNSIGTVEGSECFEVSKFVEKPDVNTATQFLNDSNYYWNSGMFMFSARTYLEELQKYCPDIVSVCQKSYDNSVCDLDFIRIDEKQFSNCLDLSIDYALMEHTNEAIVVPMDGDWSDVGSWASLWDITNKDNNGNVLWGDILTRDSSNNYIYGESGLITTLGVEDLVIVQTKDALLVANRKSVQDIKQLVEQLKLRDRSEYYIHRETYRPWGKCDTIDKGKRYQVKRIEVKPGEGISLQLHHHRSEHWVVVSGTAKITINGVEKIISENESIYIPLGAKHCLENPGKITLELIEIRSGSYLAEDDIIRFFDKYGRI

SEQ ID NO: 58479 - protein, 144 aa, Roseobacter sp. JL-135
HDDLPGMDDDDLRRGLPTVHKKWDEGTAVLVGDALQTLGFELVLSPECHPDPAVRTDLALSLAKAVGAKGMVLGQALDIAAETADQPLTLDEIIALQNGKTGALIRWSAEAGARLAQADAAPLTAYADALGLAFQIADDILDVE

SEQ ID NO: 58480 - protein, 406 aa, Azoarcus sp. EbN1
MVRKSAKLANVCYDIRGPVLIKAKQMEDEGHKIIKLNIGNLAAFGFDAPEEIQLDMIRNLPNSAGYSESKGIFAARKAVMHYTQQKHIKGVTLEDIYIGNGVSELIVMAMNALLNIGDEVLVPAPDYPLWTAAVSLSGGTPVHYICDEANEWLPDLDDMRARITPNTRAIVVINPNNPTGALYPDHILQGIVDIAREHGLIVYADEVYDKVLYDGATHRSMGSFSEDVLTILFNGLSKNYRSCGYRAGWMVVCGDKRHAQDYIEGLNMLASMRLCANVPGQYAIQTALGGYQSIDDLVAEGGRMRRQRDLAHELISAIPGVSCVKPKATLYMFPKLDPKLYPIEDDQAFIAELLEEERVLLVQGSGFNWPHPDHFRLVFLPHEDDLRDAIGRIARFLEQYRKRHAA

SEQ ID NO: 58481 - protein, 474 aa, Azoarcus sp. EbN1
MQVFDMIINGKPVRAGSTFDVVNPATGEVFARVQAGDASHVDQAVAAARAAFPGWSRTPDAERKRLMHALGAALEAHMPELMELVTKEAGKPLGGLNGVGSGMEVGGAIAWTHVTADLELPVEVIQDNDDARIEVHRKPLGVVGSITPWNWPLMIAIWHVIPALRAGNTVVIKPSGMTPTATIRFVELANAILPPGVLNIVTGESGVGSAIAKHPDINKIVFTGSTPTGKNIMQNAAGNLKRLTLELGGNDAGIVLPDVDPKAIAPKLFGVGFHNNGQTCACLKRLYVHDSIYEKVCAELARIAKETVVGDGLVEGTELGPVQNKAQLDFVQELVEDARAHGARILSGGKARSGGGFFFEPTVIADAKDGMRVVDEEQFGPVLPVIRYSDIEEVIARANNNENGLGGSIWSKDHAKAAELALRLECGTAWVNEHGAVQPDAPFGGVKQSGLGVEFGRYGLEEYTSIQTLKIMKA

SEQ ID NO: 58482 - protein, 522 aa, Photobacterium profundum SS9
MLLISEQSMKTLSQLVFNNTYSELPTTFGTAVIPQPLSDPFLVSVNPQVAEMLELDPLEAKTRLFINSFTGNKELAGTAPLAMKYTGHQFGHYNPDLGDGRGLLLGEVLTSTNAKWDIHLKGSGKTPYSRQGDGRAVLRSSIREYLGSAALNGLGIKTTHALALLGSTTLVSREKMERGATLIRVAESHLRFGHFEYLFYTHQHSELKLLADYLIKHHFPDLLTTESEQEDKQTASPNQHHNIYASMLTRIVELTAQLIAGWQSVGFAHGVMNTDNMSVLGLTFDYGPFGFLDDYNPDYICNHSDYSGRYAFNQQPSIALWNLSALGYALTPLIDKEDVDAILNRYHLTLQRDYSARMRNKLGLIEKREEDTVLFSSLFELLQSQMVDYTLFFRTLSSISATDLSVTSLPNSIERFDDLFTCTQPLEKWLKAYAVRLSFENDTSEKNGDTLRLTQMKLHNPKYILRNYLAQQAIDKAEDGDFTMIDELLQVLSSPFDEHLEFNQFADKPPYWGKKLEISCSS

SEQ ID NO: 58483 - protein, 328 aa, Zea mays
MSWCTIESDPGVFTELIQQMQVKGVQVEELYSLDVGSLSQLRPVYGLIFLFKWIPGEKDERPVVRDPNPNLFFAHQVITNACATQAILSVLMNRPEIDIGPELSQLKEFTGAFTPDLKGLAISNSESIRTAHNSFARPEPFISDEQRAATKDDDVYHFISYLPFEGVLYELDGLKEGPVNLGQCDGADDLDWLRMVQPVIQERIERYSQSEIRFNLMAIIKNRKEVYSAELEELEKRREQILQEMNNASSTESLSSSLTEVISAIETVTEKVIMEEEKFKKWKKENIRRKHNYIPFLFNLLKMLAEKQQLKPLVEKAKQQKSASPSTS

SEQ ID NO: 58484 - protein, 248 aa, Oceanicola granulosus HTCC2516
MRRKLAAGNWKMNGSRAALAEVEALCAAHPDSAVELLLCPPATLVAPMADARGSHPLRVGGQDCHSSESGAHTGDISAAMLKEAGASHVIVGHSERRTDHGETSETVAAKAAAAHAAGLVAVICLGETLAEREAGTTLAVVADQLGASLPEGATAANTVVAYEPVWAIGTGKVPTLEQIAEVHEYLRKELATHLPDAADGIRLLYGGSVKASNAADIFSVRDVDGALVGGASLRAEDFSPIVSALEQA

SEQ ID NO: 58485 - protein, 503 aa, Sinorhizobium meliloti 1021
MSTFKELGLSEHIVATLSANGFEKPTPIQAQAIPLVLKDHDLIGLAQTGTGKTAAFGLPMIEKLVADGRRPDPRNIRALVLAPTRELVNQIAANLKLFVKKSPLKIGLVVGGVSINKQTEQLARGVDILVATPGRLLDLVSRKAVTLTQARYLVLDEADQMLDLGFIHDLRKISKLVPKNRQTLLFSATMPKLIAELAGEYLTDPVKVEVSPPGKAADKVEQYVHFVPGKDLKTTILKQTLTANPDGLSLIFSRTKHGAEKLMKHLDHVGFKAASIHGNKSQGQRERALKAFRDGEIRVLVATDVAARGIDIPGVTHVYNYDLPEVPDAYVHRIGRTARNGRDGIAIAFCAPDEIRLLRDIEKLMGIQIAVASGEAPADQARPSKGRGGRGNGQPRGNGQPRGNGAGQRQGGPRRDRPQRQAAAGGFAGDELLRDERSHERRDQRAAGHGPADGRPEGHRNHKAQKHHGRPGPQQARRGSEQSGERNGGGNRPQRADGRGHQR

SEQ ID NO: 58486 - protein, 189 aa, Bifidobacterium longum DJO10A
MTWGNENMERMTTIIMNTSEGSITINLFDDKAPNTVANFLGLATGEKEWADPYTGQPSHGKFYNGLTFHRIIKQFMIQGGCPLGTGTGGPGYEFDDEIDPSLKFDKPYLLAMANAGLRRGMDGKVHGTNGSQFFITTVPTPWLDGHHTIFGEVADDDSKKVVDKLEALDTDPMDRPLEPAVILSVDVAE

SEQ ID NO: 58487 - protein, 178 aa, Physcomitrella patens subsp. patens
MGFVAWWYAWTHALLYMSPYVYSAIGIAISIGVSVLGASWGIYITGSSLIGAAIKAPRITSKNLISVIFCEAVAIYGVIVAIILQTKLETTKEPFHPDSMRAGYSLFASGVIVGFANLLCGLCVGIIGSSCALSDAQNSTLFVKILVIEIFGSALGLFGVIVGIIMSSQATWPVAVVV

SEQ ID NO: 58488 - protein, 199 aa, Pisum sativum
MATSVINRLRSSSTTKSLSSVLHGIRSYAKVATGTDILSAASNVSLQKARTWDEGVESKFSTTPVNDIFKDKKVVIFGLPGAYTGVCSSKHVPPYKHNIDKFKAKGVDSVICVAINDPYTVNAWAEKIQAKDAIEFYGDFDGSFHKSLELTTDLSAGLLGIRSERWSAYVVDGKVKALNVEESPSDVKVSGAETILGQI

SEQ ID NO: 58489 - protein, 337 aa, Oryza sativa Japonica Group
MDLQEAAMEARNGHRIPPTEEKVIIDTDPGIDDSVAIMMAFEAPGVKVVGLTTIFGNCTTSHATRNALILCDRAGRPEVPVAEGSAEPLKGGKPHVADFVHGSDGLGNTSFPDPTTTNKVEQSAAEFLVDKVSESPGEISVLALGPLTNIALAMKKDSSFASKVKRIVVLGGAFFAAGNATPSAEANIHSDPEAADIVFTSGADIYVVGLNITTQVYFTDKDMLELRNSKGKHAQFLCDICKFYRDWHVHSYGVDALFLHDPVSFTALVHPEYFTFKKGVVRVETQGICKGHTSMDMGLKKWNSDNPWTGYSPISVAWTVDVPKVLAYAKELLFNAQ

SEQ ID NO: 58490 - protein, 405 aa, Methanocaldococcus jannaschii DSM 2661
MLQRCIKCGKTYDVDEIIYTCECGGLLEIIYDYEEIKDKVSEEKLRKREIGVWRYLEYLPVKDESKIVSLCEGGTPLYRCNNLEKELGIKELYVKNEGANPTGSFKDRGMTVGVTRANELGVEVVGCASTGNTSASLAAYSARSGKKCIVLLPEGKVALGKLAQAMFYGAKVIQVKGNFDDALDMVKQLAKEKLIYLLNSINPFRLEGQKTIAFEICDQLNWQVPDRVIVPVGNAGNISAIWKGFKEFEITGIIDELPKMTGIQADGAKPIVEAFRKRAKDIIPYKNPETIATAIRIGNPVNAPKALDAIYSSGGYAEAVTDEEIVEAQKLLARKEGIFVEPASASSIAGLKKLLEEGIIDRDERIVCITTGHGLKDPDAAIRASEEPIKIECDMNVLKRILKEL

SEQ ID NO: 58491 - protein, 290 aa, Mannheimia haemolytica
AQHRDDIEVVGINDLIDVDYMAYMLKYDSTHGRFDGTVEVKDGQLVVNGKAIRVTAERDPANLKWNEIGVDIAVEATGLFLDDETARKHITAGAKKVVLTGPSKDATPMFVNGVNFDTYAGQDIVSNASCTTNCLAPLAKVIHEKFGIKEGLMTTVHATTATQKTVDGPSAKDWRGGRGASQNIIPSSTGAAKAVGKVLPALNGKLTGMAFRVPTTNVSVVDLTVNLEKPATYAEICAEIKRASENEMKGVLGYTEDAVVSTDFNGATETSVFDAAAGIALTDTFVKLVS

SEQ ID NO: 58492 - protein, 216 aa, Arachis hypogaea
MSPPIESPAKVAITQHSKPPPLNERIISSMTRRSVAAHPWHDLEIGPEAPKIFNCVVEIGKGSKVKYELDKKTGLIKVDRVLYSSVVYPHNYGFIPRTICEDSDPMDVLVIMQEPVLPGCFLRAKAIGLMPMIDQGEKDDKIIAVCADDPEYRHYNDIKELPPHRLAEIRRFFEDYKKNENKEVEVHDFLLATTAMRAIKHSMTLYADYIVESLRR

SEQ ID NO: 58493 - protein, 493 aa, Xanthomonas axonopodis pv. citri str. 306
MSRKQAFQFLDLPRTMPTRIPVELRTSGDWGELYGRFDKADAQYQAGRCLDCGNPYCSWKCPVHNAIPQWLQLVQEDRIIEAAALCHSTNPLPEVCGRVCPQDRLCEGSCTLEEFGAVTIGAVEKYIVDTAFKMGWRPDLGNVQASGHRVAVIGAGPAGLACADRLARAGIEAVVYDRYEQIGGLLQFGIPSFKLDKSVIGKRREILEGMGVQFRLGVEVGRDVSIEQLLGEYDAVFLGTGAYRYTDGGLPGQDLKNVLPALPFLVQNSRIVSGNDPHGRPIAGWEDQLALPDLTGKRVVVLGGGDTGMDCVRSAIRLGAAKVTCAYRRDEASMPGSAREVANAREEGVRFLFNRQPLSIESGADDEAIGVTVVETKLGEPDASGRRNAVPVEGSESLLEADVVIIAFGFSPTLPDWLASQGVDAGSNGRIVAPSDGNGRLPYQTTNPRLFAGGDCVRGADLVVTAVAEGRDAAGSIVQLLGVKAQVKEPAAA

SEQ ID NO: 58494 - protein, 290 aa, Mannheimia haemolytica
AQHRDDIEVVGINDLIDVDYMAYMLKYDSTHGRFDGTVEVKDGQLVVNGKAIRVTAERDPANLKWNEIGVDIAVEATGLFLDDETARKHITAGAKKVILTGPSKDATPMFVNGVNFDTYAGQDIVSNASCTTNCLAPLAKVIHEKFGIKEGLMTTVHATTATQKTVDGPSAKDWRGGRGASQNIIPSSTGAAKAVGKVLPALNGKLTGMAFRVPTTNVSVVDLTVNLEKPATYAEICAEIKRASENEMKGVLGYTEDAVVSTDFNGATETSVFDAAAGIALTDTFVKLVS

SEQ ID NO: 58495 - protein, 352 aa, Prochlorococcus marinus str. MIT 9312
MSSNNVLVTGGIGYIGIHTCFTLLERGYNVYVLDSLINSSEKTLEIIKEYSKSLNSKGFKNIFKFYKGDIRNIKNIENVFSDALLNSKPIGGVIHFAGKKSVNESINFPMEYWETNLLGTINLIRVMNSYSCFNFIFSSSASVYGKNSISPIKEFERIEPINPYGNTKATIEKFLIDVFNSKPNSWRIILLRYFNPIGSHPSGLIGESPLEESTNIFPKICEVAIRENNAFKIYGNDWPTKDGTCIRDYIHIMDLVEGHICSYNHLLSHDPEINAFNLGTGKGTSVLELLSIFQEVNKCKIFYEYEQPRKGDVGVCFADNTKAKKIMNWYPKKSINEMCKDGWRWYKSNFKN

SEQ ID NO: 58496 - protein, 245 aa, Guillardia theta
KPIVGGNWKCNLDKAGVSALVTSLNGMDCTDCEVVVAPVAVHLGSVVDNVKAPIEVSGQNCNFKGNGAYTGEVSADQLVDMGAKWVILGHSERREYFKEDNEMLRQKLEYALSKGLKVIFCIGEKLEERNANKTLDVCKSQLEPVKDLLKPETVVIAYEPVWAIGTGVTATPEQAQETHKQIRDYLATVNADMASKIRIQYGGSANAANAPTLSACPDIDGFLVGGASLKPEFADIIKAIAAAKK

SEQ ID NO: 58497 - protein, 129 aa, Malus x domestica
CHSLGVMHRDLKPENFLFVSQDEDALLKTIDFGLSIFLKPGVKYSDVVGSPYYVAPEVLRKRYGPEADVWSAGVIVYILLSGVPPFWAENEQAIFDQVLHGELDFESDPWPSISDGAKDLVRRMLVRDP

SEQ ID NO: 58498 - protein, 498 aa, Vitis vinifera
MAVPIPSRQLFIDGEWREPLLKKRIPIINPATQEIIGDIPAATAEDVDIAVEAARRAFSKPDSWASTSGSFRAKFLRAIADKILERKIELAKLEVVDCGKPIDEAISDMVSVAGCFKYYAELAEALDAKQRIPISIPMESFKTHVLKEPIGVVALITPWNYPLLMAAWKVAPALAAGCTAILKPSELASVTCLELAEVCRDVALPPGVLNILTGLGPEAGAPLASHPHVDKIAFTGSTATGIKIMTTAAQTIKPISLELGGKSPILVFEDVDLDNAIEWTLYGCFPNNGQICSATSRLLVHENIAAKFVEKLIQWSKSIKISDPLEEGCRLGAIVSEGQYEKILNFISTAKSEGATILYGGVRPQHLKKGFFIEPTIITDVSTSMQIWREEVFGPVLCVKTFATEEEATQLANDTHYGLGAAVVSNDLERCERLTKVLQAGVVWVNCSQPCFDQAPWGGIKHSGIGRELGEWGLENYLTVKQVTQYTSDKQWGWYSPP

SEQ ID NO: 58499 - protein, 145 aa, Synechococcus sp. WH 5701
HDDLPGMDNDDLRQGKPTNHKVYGEDIAILAGDALLSYAFEYVARTPDIPAERLLQVIVRLGQAVGAEGLVGGQVVDLESEGKTDVSVETLNFIHTHKTGALLEVCVTAGAVLAGAKPEEVQLLSRYAQNIGLAFQVVDDILDVE

SEQ ID NO: 58500 - protein, 290 aa, Mannheimia haemolytica
AQHRDDIEVVGINDLIDVDYMAYMLKYDSTHGRFDGTVEVKDGQLVVNGKAIRVTAERDPANLKWNEIGVDIAVEATGLFLDDETARKHITAGAKKVVLTGPSKDATPMFVNGVNFDTYAGQDIVSNASCTTNCLAPLAKVLHEKFGIKEGLMTTVHATTATQKTVDGPSAKDWRGGRGASQNIIPSSTGAAKAVGKVLPALNGKLTGMAFRVPTTNVSVVDLTVNLEKPATYAEICAEIKRASENEMKGVLGYTEDAVVSTDFNGATETSVFDAAAGIALTDTFVKLVS

SEQ ID NO: 58501 - protein, 523 aa, Oryza sativa Japonica Group
MACVLRLASRSRSRSGLRPTLAAPRPSPVPPPPPRVGPTPVAPSPAPLRGLLLPLSPLRLASPDAFSSSSPSPAWLLDGLNWRRAGIGRRWFATEASAASTAAELVDVPLAQTGEGIAECELLRWFVTEGDQVDEFQRLCEVQSDKATIEITSRFKGKVHQIHFGPGDIVKVGETLLKMMVGDSQTVSHDSIASSTDHSHAVDAANPSGEGSVPSGTLSTPAVRHLAKQYGLNISDIQGTGKDGRVLKEDVLSYAASKGLCKEPTSALEENIDQVELLEGRGSLPDANSYEDRRISLRGYQRSMVKSMTLAAKVPHFHYLEEINCDALVELKASFQNANKDHTIKHTFLPFLIKSLSKALSKYPLLNSCFVEETNEVIFKGSHNIGVAMATEHGLVVPNIKNVQSLSILEITKELSRLHEMASHNRLSTEDIAGGTITLSNIGAIGGKFGSPLLNLPEVAIIALGRIQKLPRFDDDENVYPSSIINVTVGADHRVVDGATVARFCNEWKSLVEKPERLLLHMR

SEQ ID NO: 58502 - protein, 145 aa, Synechococcus sp. WH 6501
HDDMPGMDNDDLRRGRPTAHIAFDEATAILAGDALQTLAFGWLAEAPGLDDQVRLAMVRELATASGHQGMAGGQAIDLESVGKQLTVEQLENMHRHKTGALIAASVRMGALTATEVNEDQLAALTVYSQTLGLAFQVQDDILDVE

SEQ ID NO: 58503 - protein, 104 aa, Triticum aestivum
  misc_feature (88)..(88): Xaa can be any naturally occurring amino acid
VRSIYDLSLATKQTHADINMYRLDWDNSVHVECMSPTTTKHVLNTWDAYEATKDAYGIFIMTDCDEHKTLDYKKIYDSMQNPAFVFDXLNICDSDKLMEIASLS

SEQ ID NO: 58504 - protein, 262 aa, Pseudomonas putida GB-1
MQLEIFQVDAFSAEPFGGNPAAVIPLQGWLPDDVLQRIAEENNLSETAYFVRNGETFDLRWFTPTVEVDLCGHATLASAYVLFEQLGEQTQVLRFNTRSGELRVSRGANGLLAMDFPAKQPEAVDIPAGLLQALGLNAAQALYRSDDYVVVIDDALLLDTLKPDFVALSAFDVRGIAVTAPGRGFDFVTRWFGPRVGVNEDPVTGSAHTSLAPVWAERLGKSVLGCEQGGARKGQLQCEVSGNGRVIISGRAALYLRGTVYI

SEQ ID NO: 58505 - protein, 766 aa, Vigna radiata
MGAAILPDLGTEILIPVCAVIGIAFALFQWLLVSKVKLSAVRDASPNAAAKNGYNDYLIEEEEGINDHNVVVKCAEIQNAISEGATSFLFTEYKYVGIFMVAFAILIFLFLGSVEGFSTSPQACSYDKTKTCKPALATAIFSTVSFLLGGVTSLVSGFLGMKIATYANARTTLEARKGVGKAFITAFRSGAVMGFLLAANGLLVLYIAINLFKIYYGDDWGGLFEAITGYGLGGSSMALFGRVGGGIYTKAADVGADLVGKVERNIPEDDPRNPAVIADNVGDNVGDIAGMGSDLFGSYAESSCAALVVASISSFGLNHELTAMLYPLIVSSVGILVCLLTTLFATDFFEIKAVKEIEPALKKQLVISTVLMTIGVAVVSFVALPTSFTIFNFGVQKDVKSWQLFLCVAVGLWAGLIIGFVTEYYTSNAYSPVQDVADSCRTGAATNVIFGLALGYKSVIIPIFAIAISIFVSFTLAAMYGIAVAALGMLSTIATGLAIDAYGPISDNAGGIAEMAGMSHRIRERTDALDAAGNTTAAIGKGFAIGSAALVSLALFGAFVSRASITTVDVLTPKVFIGLIVGAMLPYWFSAMTMKSVGSAALKMVEEVRRQFNTIPGLMEGTAKPDYATCVKISTDASIKEMIPPGALVMLTPLVVGILFGVETLSGVLAGSLVSGVQIAISASNTGGAWDNAKKYIEAGASEHARSLGPKGSDCHKAAVIGDTIGDPLKDTSGPSLNILIKLMAVESLVFAPFFATHGGLLFKIF

SEQ ID NO: 58506 - protein, 606 aa, Zea mays
  misc_feature (54)..(54): Xaa can be any naturally occurring amino acid
  misc_feature (81)..(81): Xaa can be any naturally occurring amino acid
MGTTYKCCFIFKRRFHTRDAPPPEDVRALFSVHAGGGPHMGADDLRRYLVATGXRRPRWSGCWSRSSRAVPASRASPARSXSLDDFHRYLFSHDLNPPIRHPQVHHDMTRPLSHYFIYTGHNSYLTGNQLSSDCSDTPIIMALERGVRVIELDMWPNSTIDDINIVHGRTLTTPVSLIKCLRSIKKHAFVASPYPVIITLEDHLPSQLQEKVAKMVVEVFGNILYYPPDDTHELKELPSPEQLKGRVLLSTKPPKEYLETKLSDSTKEGDADLHLGKGTGDDAVWGKEVPDFRTEIQSAEKDDENDDVDDEEEQKLQPHIAPQYKHLITIRAGKPKDSLADALKSDPEKVRRLSLSEQQLAKAAKDHATEIVRKSLLPLLKRSASSVPNPNRFTQRNILRIYPKGTRVTSSNYNPFVGWVHGAQMVAFNMQGYGRALWLMHGFYKANGGCGYVKKPDFLMQTEPQVFDPREPQPVKKTLKVKVYMGDGWRMDFKQTHFDQYSPPDFYTRVGIAGVPADSVMKKTNAIEDNWTPVWEKEFSFPLTVPELALLRVEVHEYDMSEKDDFGGQTVLPVSELRPGIRAVALFDRKGMKYNHVKLLMRFEFA

SEQ ID NO: 58507 - protein, 212 aa, Azoarcus sp. EbN1
MNSAAPHGSSNWDPVGLGLVPMVVEQSGRGERAYDIYSRLLKERVIFLVGPVNDVTANLIVAQLLFLESENPDKDVYFYINSPGGSVSSGMAIYDTMQFIKPSVSTLCIGQAASMGSFLLAAGEKGKRFCLPNSRVMIHQPLGGFQGQASDIEIHAREILGIRAKLNEMLAKHTGQPIEQIEKDTDRDRFMSAADAVEYGIVDKVLTNRADS

SEQ ID NO: 58508 - protein, 628 aa, Saccharomyces cerevisiae; identical to SEQ ID NO: 1009

SEQ ID NO: 58509 - protein, 728 aa, Bacillus cereus ATCC 14579
MIWNWLRKKKKSNKPEANETDNQEQHSNNEEDDNKEQTRSMKHNKGKNHEQKDSSQDKQQSTKQKDSSQDKQQSTKQEDSSQDKQQSTKQEDSSQDKQQSTKQKDSSQDKQQSTKQEDSSQDKQQSAKQDEPSQDKQQNSKQDDSSQDKQQSAKQEDSSQDKQQNSKQDDSSQDKQQNSKQDDSSQDKQQSTKQEDSSQDKQQGAKQGDSSQDKQQNAKQDEPSQSKQQHSKGNSIYDFTKPEKDRIHSLQNLIEKLKKSSDFVNYHTSDDETMPYWISYYRPSLDGEKLQKYLMPTLLERPNASLEELKEHIPMSGITITNDLQKIEDMVLKGHAIIQLNQQDQKCMLANIAIDNYRAPTPPLNESTVIGPQEGFVEDIDTNINLVRKRLPVLDLQTKEMIIGEFSKTKVVMMYLDNLAEKDNVDFLEESLRALEYDQINDSAYLQELMGEKSIFPLYINTERTDRVTKALIDGKIAIFVDGSPSVLLTPVSYFDFFISPEDYNVSWMYATFSRILRLIAVLFSICATPLYVAVLNYHYELIPSDLLETLILSRAQVPFPPLIEALFLELAIDLLREAGARLPMKVGQTLGIVGGIVIGQASVQAGLTSNILLIIVALSALASFITPIYKMGNAVRLLRFPFLMFAEIGGLFGISLGFIFLFTHLFRLTSLRKPYALFYPTRQQSVKDSWIRFPLTMIDTRDVQARPQHVKKAAKGISTKHRSDFDD

SEQ ID NO: 58510 - protein, 82 aa, Sonneratia alba
SFVIPAPSEEQKVLNARNCTQEGVRAGVKAAAIAGVASAVPTLVAVRVVPWAKANLNYTAQALIICAASIAAYFITADKTIL

SEQ ID NO: 58511 - protein, 467 aa, Hordeum vulgare
MSPSIVTVGLAAAALVAIVRVGPEELASRFSELRPAHMFLACFLPAAAAVVYLMLRPRAVYLVDYAGFRTPHTCRIPFASFLEHAKLLPELNERSIRFMTRLLERSGLGEETCLPPAHHYIGTHKYCTVDAARAEFELVAFSAIDDLLAKTGIAPEAIDILIVNCSLFCPTPSLVDMIVNKYKLRSDIRSMHLSGMGCSAGLIAVGLARNLLQVAPHGAHALVVSTETITPNYYLGIERAMLLPNCLFRIGGAAALLSTSPAKARFRLKHLIRTLTGAQDGAYRCVFQEEDGEGHRGINLSKDLMNIAGDALKANITAMGPLVLPASEQLKFAYSFVARKAINRRVKPYIPDFRTAFEHFCIHAGGRAIIDELQKNLGLSDEQVEASRMTLHKFGNTSSSSLWYELGYIEAKGRMRKGDRVWMIGFGSGFKCNGAAWECIQPARNADGPWATSIHRYPVDIPDVLTH

SEQ ID NO: 58512 - protein, 620 aa, Candida albicans SC5314
MIFNQFILWLISIPLILASGTIHRFDWNVSYVMANPDGIHPRRMIGINNQWPNPTIRSKKNDRVIINLTNELPDKNVSLHFHGLFQRGYNDQDGPAFVTQCPISPGVTFTYDFNVTDQSGTYWYHSHMGSQYGDGLRGLFIIEYDNDDEYNKEFPYEYDEDVTLSVGDHYHLESPEIVKNFMTRFNPTGAEPIPQNGLFNETKNVTWQVNPDTTYLLRIVNMGLFTSHYVYIEDHTFTIVEVDGVVVEPYETDSLYVAVAQRYVVLMKTKKSADKNFRFVNVLDQDMLDFLPSDLQIVSTNWIVYDKSLELPPALPFNQFHKTIKSLVGFDDFDLRPLRKVNLLDEPDYTIQVNLTMEVLGDGVTYAMFNGKTFRPPKVPSLYTVLSTHGNTNLTTNELIYGTNTNSFVLQGDEVVEIILNNMDPGKHPFHLHGHNFQVISRFDTDDEDNQLVFDPTNETYTNYPEFPMVRDTVEVGPNGFIVLRFKADNPGVWFFHCHVDWHLEQGLAILLVEDPLELLSSNTTIPQNHIDACNAIGMPIKGNAAGNDIDLLDLYGENIQPNPLPAGFTNKGYLAITCCTLIAIYGLWSIYNYGMEDISKDNAEDVIEKLYKILDDYDK

SEQ ID NO: 58513 - protein, 552 aa, Caulobacter crescentus CB15
MYQYDLIDKEFLADRSAEFRGQVARRLSGELTEDQFKPLRLMNGLYLQLHAYMLRVAIPYGSLNSTQARRLAQIARDFDKGYGHFTTRQNIQFNWIKLKDAPEILDKLAEVDLHAIQTSGNCIRNTTSDPYAGATAEEVDDPRVWSEVIRQWSTLHPEFSFLPRKFKIAITASAKDRTAAKVHDIGLMLRKGRDGTLGFEVIVGGGQGRTPYVGPTINEFLPTDRLLSYLEAVLRVYNRHGRRDNIYKARIKILVAALGAEEFARQVDEEWAKIDAARADLPTAELARIRAAFAKTPFETLPARSDAFETAKANDAAFARFVRNNVKPHKQPGYAIVEVSLKAQEQTPGDASAQQLEVVADLAERFSLNDLRVTHAQNLVLPHVKLDDLPTVFATLQASNLATPNIDLVSDIIACPGLDYCALANARAIPVAQDIARQFADLDRAEKVGELKIKISGCINACGHHHVAHIGILGVDKKGEEFYQLSLGGSGAEDASIGKILGPALPADKVATAVDQLVGAYLNVRNDGERFLDTYRRVGLEPFKEAVYAQAD

SEQ ID NO: 58514 - protein, 235 aa, Candida albicans SC5314
MSQLFEWAFGKKLTPQERLRKNQRALEKTQRELSREITKLQQQEKKLISDIKKSAKSGQISSAKIQAKDLIRTKSYVSKFTSMKTQLQAISLRIQSVRSNQQMAMSMRDATRVLGGMNRSMNLPQLSRIAQEFAKESDMMDQKQEFMDDAIDDAMAMDEDELGEEEQVDEILSKVLDEIGVDLNTTLKDTPTGINAGNIEQADRARVAEAVGANGASSHDADEDDLQARLDSLKK

SEQ ID NO: 58515 - protein, 657 aa, Desulfovibrio vulgaris subsp. vulgaris str. Hildenborough
MSESILLVDDEEGIRKVLGITLADAGYRVTTAADGEEAMRRFAEERPDIVLTDIKMPGMSGLELLESIKSRDSEVEVIMLTGHGDMELAIQSLKRDATDFITKPINDDVLDIALGRARERITMRRRLREYTENLEDMVAKQSARLVAAERQLAALQVMDGIASGVQTLSRMLDQAGIFNELPCFVSMHSRYLEIVATNDLYKERLGHKVGQPSWEVYKGREGSGNGCPVWKVIETGEGQRSNEILIDKHGQEIPVIVHTAPILDNDGEIEMVLEISVDVSKVRRLQDELRITRERYRQLFDEAPCYIAVIDRSLKVVDANRRFHHDFGEPAARHCHDIFAHRLAACQGCPVERSFDDGKPHQYETVVTTGDGRQANVLVWTSPLRDAAGNITEVMEMSTDITQVRQLQDRLSQLGLLLGSTAHGIKGLLTALDGGVYRLGSGLDRNDEARVRDSFEDIRHLTGRLRKMVLDILYYAKKRDLNWEVVVAERFATETAELIEGKAVNRGVGFQLEIAAESGTFEADAGALSAALVNLLENAVEACAAERSRPEHSVTFSVGGDANHVEFSVRDDGVGMDRETREKLFTLFFSSKGSAGTGIGLFVANQVVQQHGGHIAVASEPGHGTTFTVSLPRRLPDVARCPAPQNGQPEGDEADDN

SEQ ID NO: 58516 - protein, 82 aa, Sonneratia apetala
SFVIPAPSEEQKVLNARNCTQEGVRAGVKAAAIAGVASAVPTLVAVRVVPWAKANLKYTAQALIICAASIAAYFITADKTIL

SEQ ID NO: 58517 - protein, 477 aa, Sinorhizobium meliloti 1021
MTLHQNLIAGEWVGGDGVANINPSNTDDVVGEYARASAEDAKAAIAAAKAAFPAWSRSGILERHAILKKTADEILARKDELGRLLSREEGKTLAEGIGETVRAGQIFEFFAGETLRLAGEVVPSVRPGIGVEITREPAGVVGIITPWNFPIAIPAWKLAPALCYGNTIVFKPAELVPGCSWAIVDILHRAGLPKGVLNLVMGKGSVVGQAMLDSPDVQAITFTGSTATGKRVAVASVEHNRKYQLEMGGKNPFVVLDDADLSVAVEAAVNSAFFSTGQRCTASSRIIVTEGIHDRFVAAMGERIKGLVVDDALKPGTHIGPVVDQSQLNQDTDYIAIGKQEGAKLAFGGEVISRDTPGFYLQPALFTEATNEMRISREEIFGPVAAVIRVKDYDEALAVANDTPFGLSSGIATTSLKHATHFKRNAEAGMVMVNLPTAGVDFHVPFGGRKASSYGPREQGKYAAEFYTNVKTAYTLA

SEQ ID NO: 58518 - protein, 457 aa, Ashbya gossypii ATCC 10895
MSYNNKKRNGSFKRRNGGDYYFPNKRPHHHHQPTGTTSRYNNQVRPPTEPEPAAPAPADVATSAAVAATRQSRFQPHRALPKAPRQVSRYNNGNLPAPPAGPASLRVPATIITHTHSVESSYQRITQVGEGTYGKVYKCRNIYTNKLVALKKLRLETERDGFPITSIREIKLLQHCQHENVSTIAEIMCEAQKTVYMIFEYADNDLSGLLMNKEIHFSDANCKHLFRQLLKGMEYLHECRILHRDIKGSNILIDNRGNLKITDFGLARKMKQEPDYTNRVITLWYRPPELLLGTTRYGTEVDMWGCGCLLVELFLKAAFFQGTNELEQLRCIFQVLGTPTIEQWPGLFDMPWWFMMIPQQKENYPSRFDEKVSGVLPTQSCRDLARGLLLYDQKKRFSASEALKSAYFYELPRPEPLNLGDFDGCHEFEARRQRRKEREETKKAAAASASSASKKSA

SEQ ID NO: 58519 - protein, 454 aa, Haemophilus somnus 2336
MTIKTPVQATLASNQYFLDRQDIMESNVRSYPRKLPFAYQKAQGVWVTDVEGNEYLDFLAGAGTLALGHNHPKLIQAIKDVLDSGLPLHSLDITTPLKDAFTEELLSFFPKDKYILQFTGPSGADANEAAIKLAKTYTGRGNVIAFSGGFHGMTHGALSLTGNLGAKNAVQGLMPGVQFMPYPHEYRCPFGIGGEAGVKAVEHYFENFIEDVESGVVKPAAVILEAIQGEGGVVPAPISFLQKVREVTQKHGILMIVDEVQAGFCRSGKMFAFEHANIEPDIVVMSKAIGGSLPLAVLAIKKEFDAWQPAGHTGTFRGNQLAMATGYVSLKIMREENLAQNAKERGEYLTKALTELSQEFPCIGNVRGKGLMMGIDIVDEHQAKDATGAYPRDCDLAVAIQKYCFKNKLLLERGGRGGNVVRVLCAVNITQAECEEFIKRFKQSVAEAVKAVRG

SEQ ID NO: 58520 - protein, 100 aa, Glycine max
MAGSQDQLEIKFRLSDGTDIGPKSYSAATSIVTLKESVLAQWPKDKEYGPRTVKDLKLISAGKVLENNKTVGDCQSPLCDLPGGVTTMHVVVQPPSVEEG

SEQ ID NO: 58521 - protein, 329 aa, Ashbya gossypii ATCC 10895
MMDIKDRTIEFQRSVTSYSRRNAKQGAGGPGEGADRQSLRKSEFQQRASRISHEIANLAQMLSKLAQLAKRKPMFNDNPVEIAQMTYLIKHKIYSVEQEMMELSRHMPNNGGGVADGGAQTRLHTKNVVNLLNTKMKNISGDFKSVLEARQKLELANRDRWEKISADRNSAAAASLQDGLPMGGMGVSSGSAAAYNSANPFMSSLLAEDDASGQPNGQLSLPNEESVLLLEEQQTANQQYLQERGRAVETIESTIQEVGNLFQQLAHMVQEQGETIQRIDANVEDIDINIAGAQRELLKYFDRISSNRWMAVKIFAILFAFFLVWVIVN

SEQ ID NO: 58522 - protein, 419 aa, Ashbya gossypii ATCC 10895
MSLTAFNQLEILPPDALFDVKKRLTQDTRSFKVDLGLGAYRDENGKPWVLPCVREAEKQLMADPGYNHEYLGIAGLEEFRAAAARVLLGEDSEALAEGRVVSVQSISGTGALHVAAKLLAKTVPDATVYMSDPTWGNHFAVFETQGLRTATYPYWDAATRSLDMEGVLGALGAAPRGSVFVLHACAHNPTGLDPNEEQWVQILDAVAAREHTVLFDSAYQGFASGSLARDAYALRAGLRRLAEVTPVLVCQSFAKNIGMYGERVGALHVVLPRQPAESLAHVKAAVLSQLSHITRSELSNPPAYGAKIVTKVLTTPELAAQWKKDMITMSSRIARMRRVLRDRLVELGTPGNWDHIVQQCGMFSYTGLTKEMVARMEKDFAIYMVSSGRISIAGLNDSNVGHVANAIDNAVRHFSTPKL

SEQ ID NO: 58523 - protein, 112 aa, Prochlorococcus marinus str. MIT 9312
MPKIENKPWGTFENILDETYCKVKRIIIKPGERPSYQYHYKRSEHWIIVSGSAKVTLEGEEKEFSVGDYIYIPLKAKHRVENIGKNDLIFIEIQTGQYFGEDDIVRVSNDYV

SEQ ID NO: 58524 - protein, 418 aa, Porphyromonas gingivalis W83
MTIEQFNFAGKKAFVRVDFNVPLDDNFKITDDTRIRAALPTLRKIIADGGMTIIGSHLGRPKGVAPEFSLRHILPHVSELLGVDVLFADDCIGADAMDKAAKLKAGQVLLLENLRFYAEEEGKPRGLSDDASDEEKAAAKKAVKAAQKEFTQKLASMADCYVNDAFGTAHRAHASTALIADYFDRDHKMFGYLMEKEVKAVERVLHDIKRPFTAIMGGSKVSTKIEIIENLLNKVDNLILTGGMTYTFTKAAGGRIGLSIVEDDKLDLARDIVKKAAEKGVNLILSVDTKVADRFDNDAATQVCSNMEIPDDWMGMDIGPRSIEKFRKVILESKTILWNGPTGVFEFDNFSIGSKAVGEAIVEATANGAFSLVGGGDSVACVNKFGLADKVSYVSTGGGALLEAIEGKTLPGIAAIQG

SEQ ID NO: 58525 - protein, 118 aa, Vitis vinifera
MANSNGLFLISSIFVAALFTASVSAGGDFSQLNWEPAAKAAATCQGSIAECLAGRDEFEMDTEINRRILATTQYISYGALQRNTVPCSQRGASYYNCKPGAEANPYNRGCSTITRCRS

SEQ ID NO: 58526 - protein, 290 aa, Mannheimia haemolytica
AQHRDDIEVVGINDLIDVDYMAYMLKYDSTHGRFDGTVEVKDGQLVVNGKAIRVTAERDPANLKWNEIGVDIAVEATGLFLDDETARKHITAGAKKVVLTGPSKDATPMFVNGVNFDTYAGQDIVSNASCTTNCLAPLAKVIHEKFGIKEGLMTTVHATTATQKTVDGPSAKDWRGGRGASQNIIPSSTGAAKAVGKVLPALNGKLTGMAFRVPTTNVSVVDLTVNLEKPATYAEICAEIKRASENEMKGVLGYTEDAVVSTDFNGATETSVFDAAAGITLTDTFVKLVS

SEQ ID NO: 58527 - protein, 233 aa, Guillardia theta
LDLDMDQLDICILGAGKMARLLVQHLLPRNVKSITIVNRSQQGADNLASMFPDANIKTALMDSMLEMVGTSHVTFACTGAMEPILYQENLEGAMQRGAMLVDISVPRNIDDVGANKVEGVKAYNVDDLKAVVAANQARRQRLVLEAEELLQDEMKSFKGWHQSLGTVPMITKLQSRANKIRREELLKYERKLSGLTRRTKTWRADKGIVANCCTAHVALRTVMTFDRHRLVKA

SEQ ID NO: 58528 - protein, 466 aa, Ehrlichia canis str. Jake
MQNYDIVIIGGGPGGYKCAIRASQLGLKVACIDKNKILGGTCLRVGCIPSKALLHFSHEYYHLKNNLSEVGITFDNLNFDLNKIMSFKDKNIAELGSGISQLFSSYKIDYLCGAGKIKSVGSNDFIIAINGDNAEQQITSKNIVIATGSDVSSFPGITIDEENIVSSTAALSFKEPPKRLVVIGAGAIGLEMSSVWSRFGSEVTVVEFLDKIAPSMDGDISKALLTSLKKQCINFKLSTKVVSIDNKGSNLTVHLESVKDGKSEVIEADKVLVSIGRVPYTKGLIDNNLIECDSRGFIKVNSRYETNIPGIFAIGDVIGGAMLAHKAEEEGIAVAELISGHIPHVDYEIIPSVIYTHPAVASIGKTEESLKNANYSYSVGKSNFAANGRSRITNNAVGFVKVLTSKVNNAILGVHIIGTYADTMINEAAIAMAYRASSEDVFRICHSHPDVNEAFRDACEAAFLNH

SEQ ID NO: 58529 - protein, 145 aa, Prochlorococcus marinus str. SS2
HDDLPAMDDDDMRRGKPTTHIAFGEATAVLAGDALHALAFGLLADERTHHDPFVRAEMTACLAKAAGPAGMAGGQMMDLVAEHSTFNLQTVTRLQQLKTGALIAACVEIGAILGRVAEEGRTSLRGYAHDLGLAFQIADDILDVE

SEQ ID NO: 58530 - protein, 233 aa, Guillardia theta
RICACVRSAWSFPVAFPAHLHHPLLRAVCFFIKWISSILWFMMGRQVLAALALLPLAWCFQAPTSFLPGTRGITQQTCATLRPAVLGKMQLEAPERIKIPDTFNPAEWGVGGGKGGFGDGLGGFKVPDSFNPAEMEKERQGGRTAVMDRPSDKTDPGKKYKVLLFNDDKNTRQYVIDTLMKYIPGMTADKAKEITVAAHNTGMAIVGVWMYEMAEAYSDVLRSAGLRSDIDPE

SEQ ID NO: 58531 - protein, 183 aa, Oryza sativa
MDQEQGERELQLLLPAAASAAAAASRVLCGGGGGDAAAGLGGGGGSVDSSGGAAALDLDLSMSIGPTTRRQQPAAAVPSPSPAPAPAPVVDVRAVRQQTAEQMRQASAHRAYAERVREMARAELELAEREFARARAIWERAREEVERVERMKEIAARRLGIGPAAASAALEITCHACMQRFHP

SEQ ID NO: 58532 - protein, 145 aa, Prochlorococcus marinus str. CCMP1377
HDDMPGMDDDDMRRGKPTTHIAFGEATAVLAGDALHALAFGLLADERTHHDPFVRAEMTACLAKAAGPAGMAGGQMMDLVAEHSTFNLQTVTRLQQLKTGALIAACVEIGAILGRVAEEGRTSLRGYAHDLGLAFQIADDILDVE

SEQ ID NO: 58533 - protein, 600 aa, Debaryomyces hansenii CBS767
MKTCYYELLQVESTATDLELKKAYRKKALQLHPDKNPDDIEGATARFALVRAAYEVLSDPQERSWYDSHKSQILRDEDTFEVDENELVIPSISVEEILRYFNPSFYTTIDDSQVGFYNVVSRLFERIAAEEISHAKHQGLAKYEKYHDDASNVNVIDESMLLYPKFGNSKSDYISHVRPFYNTWLSFQSVKAFNWKDEYRYSMAPDRRTRRLMERENKKARDAARKEYNETVRSLVAFIKKRDMRVKQGISEYEKQKKKKQQEELEDQIKNNRQDELRKLATQNKFEIQDWQQLSVEELHELEQMLDEEYNSSSDSEFDEYEQTGDENFFECFVCDRCFGSEKQFETHEQSNKHKKVVSKLKWEMQKEGIELGIDKDDVDLDEFETASSGLDSEDDDIDTEDDNLSEVSDSPNDNLGQDNRVNSPQVIEHADNTIESIEFEVDDEINSDFEDGAEPIIVPQASLRKLKNKNKNKKSTPAYSDDENDDLQRELSKLTSNLNGVALDDDSDWSTNPKGKKNKKKRNPTADSETASPQPQAALPKKKKYTESDDLPTHVPKGSDICVVCKELFTSRNKLFQHVKTTGHAAPLPQAKKGKKKKN

SEQ ID NO: 58534 - protein, 383 aa, Abies grandis
MAYSGMATSYHGLHFMNIATQECNLKRLSIPSRRFHGVSPSLWASNGFQGHLKRELSANSFLVSSSRYSNTIAKFTNLPEKVKEKVIEFDFKEYLRSKAMAVNEALDRAVPLRYPERIHEAMRYSLLAGGKRVRPVLCISACELVGGTEEVAMPTACAMEMIHTMSLIHDDLPCMDNDDFRRGKPTNHKVFGEGTAILAGDALLSFAFEHIAVSTSKSVGTDRILRVVSELGRTIGSQGLVGGQVADITSEGDASVDLDTLEWIHIHKTAVLLECSVMCGAIISGASDNEIERIQRYARSVGLLFQVVDDILDVTKSSKELGKTAGKDLISDKATYPKLMGLEKAKQFASDLLIRAKEDLSCFDPMKAAPLLGLADYIAFRQN

SEQ ID NO: 58535 - protein, 407 aa, Bacillus cereus ATCC 14579
MDTLIFEVGTALVLVAFAAILAAKLKFSIIPFLIILGMLVGPHAPDLGLIDLRFIESGEVISFLGRVGVIFLLFYLGLEFSIKKLIKSGKSIAFGGTVHISLNFILGLLYGYIMGFPLLETLIIAGIITISSSAIVAKVIVDLRRSGNKETELILGIIMFDDIFLAVYLSVVSGLVLGGATSLVGALTSILIAVGYMLLFFVVARKATRFLNKMLDISSNEIFIIVIFAILFFVAGFSETIHVAEAIGALLLGLVFSETEHSDRIEQLVVPFRDFFGAIFFFSFGLSIDPFSLGGAVWLALGAVFITLIGNFTAGMVAGRKAGLSHKASTNIGLTLASRGEFSIIVANIGIAGGLMATIKPFSALYVLILASLGPLLTKESGRIYSLLDKIFKWSAKESAKREKEVG

SEQ ID NO: 58536 - protein, 151 aa, Streptococcus cristatus
MIQKIFAIRFANLLFENVWNRQYIDNVQITFAEKLGVEERGGYYDQSGALRDMVQNHTLQLLSLLAMDKPKSFTKDHIRAEKVKVFERLVQPSEEDLKRFFIRGQYKSGKINGRKYISYRSEPNVNPESTTETFASGAFFIDSDRFRDVPF

SEQ ID NO: 58537 - protein, 151 aa, Streptococcus cristatus
MIQSIFAVRFANLIFENVWNKDFIDNVQITFAERLGVEERGGYYDQSGALRDMVQNHTLQLLSLLAMDKPKSFTKDDIRAEKAKVFERLVQPSEEDLKRFFIRGQYKSGKNHGRKYISYRSEPNVNPEFSTGTFASGAFFVNSDRFRGVPF

SEQ ID NO: 58538 - protein, 472 aa, Thermobifida fusca YX
MSTTGEAPSSGEVNIAHVVMIAAAAAMGGFLFGYDSAVINGAVSAIQDTFRVGSTVIGFTVAAALIGSAVGAAIAGALADRIGRIRVMQLAAVLFAASAVGSALPFTVWDLAWWRVVGGVAIGIASVIAPTYIAEVSPPAFRGRLASLQQLAIVLGIATSQLVNYGLAAAVGGSALHRLGPLQAWQWMLGIEVLPAATYFVLTLVIPESPRHLVRIGRDARARRVLAEVEGGDVDGRVAEIRRVLGRERRPRLRDLRGRYGLLAIVWVGMALSAFQQLVGINVIFYYSAVLWQSVGIAETDSLLLSLFTSIVNIVGTLIAIGLVDRVGRKPLLLAGSAGMTVALAFTAFAFSHARGEGDDVVLSTAWALTALVSASTFVLFFALSWGVVTWVLLGEMFPLRIRAAAMAVATATQWITNWLVTVTFPSLRDWSLPGTYLVYTAFALLSFGFVLRFVRETKGRTLESMDELAGQ

SEQ ID NO: 58539 - protein, 271 aa, Mycobacterium sp. JLS
MRIIVTGGNSGVGRATASAMAAEGHEVVIACRTMSKGYDAAASMSGRVDVRELDLADLTSVRKFADTVDYVDVLVNNAGVLGLPLTRTADGFEAHMGTNHLGHFALTCLLGDRIRDRVVSVASTNYTTARMHFDDLNWQQRKYNPWSAYGESKLANLLFVHELVARGKTAYASDPGMTNTAITRDGSGVLQWAGRVISPHIAQSPDDGARSTIQAITTTLPNGTYLAPRGLMHQWGKPKPTKLKAKARDADSARRLWDLSAELTGCAWQEA

SEQ ID NO: 58540 - protein, 277 aa, Bordetella petrii
MDTQLSIAFIGGGNMASALASGLAGKTCPAGNLHAIDPTPAVQDAWRARGATAAGAPDAALQACRVWIYAVKPQQLREAVAATRAWLQPGTLVISVAAGIRADTLSGWLGEPGSPWQNLVRCMPNTPALVGAGVTGLAALPGVDRAGRELAERLLGSVGQVVWVDDDVALDAVTALSGSGPAYVFLFLEALIAGGVAVGLSPDQARQLALGTLDGATRLAAQSDDPPSVLRERVTSKGGTTAAALQVFQQADLAAIVRQAIEAAAQRSRELASEFGK

SEQ ID NO: 58541 - protein, 263 aa, Zea mays
MAGLGKAMYAVGFWIRETGQALDRLGCRLQGKYFFHEQISRHRTIMNIFDKTPHVHRDAFVAPSASLIGDVQVGQGASIWYGCVLRGDANNIQIGSGTNIQDNSLVHVAKSNLSGKVFPTIIGNNVTIGHSAVLQGCTVEDEAFVGMGATLLDGVVVGKHGMVAAGSLVRQNTRIPCGEVWGGNPAKFLRKLTDDEIAFITESASNYSNLSKVHAAENAKPLEKIEFEKVLRKKFAHQDEEYDSSIGITRGSPPELTSPNPAQ

SEQ ID NO: 58542 - protein, 164 aa, Zea mays
  misc_feature (61)..(61): Xaa can be any naturally occurring amino acid
  misc_feature (83)..(83): Xaa can be any naturally occurring amino acid
  misc_feature (140)..(140): Xaa can be any naturally occurring amino acid
MNLPSSTATSTSESPDTAAGAISPETCGGCKSQDSWVIHSARLRGILRFYCTHCLLRNHPXSFCPTCFAFYDSSPPHQSRRVXCNDCNSVTHIHCAGDAKSPPYRCPPCRDPDGFSFFRPIVDENGARCMDKALSEGFLXAAEIAPSSWSRAVLSQKRAGRKRG

SEQ ID NO: 58543 - protein, 150 aa, Glycine max
MAGAMGMKVDKIRQIVRLKQLMTRWKHISLRRRSSDEPSAVRRPPSGFIFVYVGPERTRFAIPARFLNLALFEGLLKQTEEEFGLRGNGGLVLPCQVPFFSNVVKYLHKDEHKYGSLSLQDFVNMLSASSSDSCKENVAVFAPLLQKAEV

SEQ ID NO: 58544 - protein, 392 aa, Zea mays
  misc_feature (116)..(116): Xaa can be any naturally occurring amino acid
  misc_feature (138)..(138): Xaa can be any naturally occurring amino acid
  misc_feature (276)..(276): Xaa can be any naturally occurring amino acid
MASATVLKSSFLPKKSEWGATRQAAAPRPPTVSMVVRASAYADELVKTAKTIASPGRGILAMDESNATCGKRLASIGLENTEANRQAYRTLLVTAPGLGQYISGAILFEETLYQSXAVDGRKIVDILAEQGIVPGIGXKVDKGLVPLAGSNNESWCQGLDGLASREAAYYQQGARFAKWRTVVSIPNGPSELAVKEAAWGLARYAAISQDNGLVPIVEPEILLDGEHGIERTFEVAQKVWAETFYAMAENNVMFEGILLKPSMVTPGAEAKDRATXPEQVAAYTLKLLHRRIPPSVPGIMFLSGGQSEVEATQNLNAMNQGPNPWHVSFSYARALQNTCLKTWGGQPDKVKAAQDALLLRAKANSLAQLGKYTSDGEAAEAKEGMFVKNYSY

SEQ ID NO: 58545 - protein, 119 aa, Oryza sativa Japonica Group
AIESNPSPAGATKYCGIAILICWTLRLRRSISEAAIAGLKAAAVTAVCTAIPTFASVRMSKWAKANLGNPVAKTVIITYAAGMAYFIAGEKKVVELSRKHSLEAAKARAKSEYTLTKSN

SEQ ID NO: 58546 - protein, 331 aa, Synechococcus sp. WH 7803
MTGFLTAARAEQEKIQHDTRRLRLFSGTSNPGLAREIAAYLGVPDGPRVCKRFADGELYVQIQESIRGCDVFLIQPTCAPVNDHLMELLIMVDACRRASARQITAVVPYYGYARADRKTAGRESITAKLTANLLVKSGVDRVLAMDLHSAQIQGYFDIPCDHIYGSPVLVDYLSAQELGEVVVVSPDVGGVARARAFAKQMNDAPLAIIDKRRTGHNMAESLTVIGDVNQRTAILIDDMIDTGGTICAGARLLRQQGASRVIACATHAVFSPPASERLSTDGLFEQVVVTNSIPIPSDRMFPQLQVLSVANMLGEAIWRIHEESSVSSMFR

SEQ ID NO: 58547 - protein, 256 aa, Synechococcus sp. WH 5701
MKDFRLDGKRALISGGSKGLGAAIAERFSEAGADIGVIGRDREGLGRIQGIVENNHRNCWVIEEDVSSIEGARRAGDKALALDPEWDVLVNNAGIARVQSILETTQDNWNDIFSVNLRSALLLSQAIVPQMIKRGHGKVVNISSIGAFIGTPGLGAYAASKAALNQLTRTMAVEWGPHNVQVNALCPTVILTQMGHDIWDSPSMEEPRKEKEKRIPLHRFGEPTEVANVALFLASPASNFVHGVSLPLDGGMSIAP

SEQ ID NO: 58548 - protein, 57 aa, Haemophilus influenzae
VDLARLAGFKEAGVICEITNDDGTMARTPEIVEFAKKFGYSVLTIEDLVEYRLAHNI

SEQ ID NO: 58549 - protein, 115 aa, Oryza sativa Japonica Group
MSTVTRAYLDQKLALAKRCSREATLAGAKAAAVATVASAVPTLASVRMLPWAKANINPTGQALIICTAAGMAYFVAADKKILSLARRHSFENAPEHLKNTSFQGTGHPHPAFFRP

SEQ ID NO: 58550 - protein, 317 aa, Synechococcus sp. WH 5701
MGLLVDGVWHDRWYDTSSSGGRFIRSASQFRHWVTPDGRPGPSGEGGFGAEADRYHLYISHACPWAHRTAIFRSIKGLASMVSVSVVHWLMGNEGWTFQPGEGVIPDPIHHAEVLHTIYTNSDPNYSGRVTVPVLWDKATGQIVNNESSEIIRMFNSAFDGLGAAPGDYYPEILWDEIDRLNQLIYDTVNNGVYRCGFATSQEAYDEAIQPLFATLDLLEQRLADQPYLFGRRLTEADWRLFTTLVRFDAVYVGHFKCNLRRVVDYPNLWRYVRELYLFPGVAETVNMQHIKGHYYQSHPSINPSGVVPAGPLIDWP

SEQ ID NO: 58551 - protein, 140 aa, Bartonella quintana str. Toulouse
MAVERTFSMIKPDATRRNLTGAITKMLEDAGLRVVASKRVWMNRREAERFYAVHRERPFFSELVEFMSSGPTLVQVLEGENAIAKNREVMGATNPADAQEGTIRKVHALSISENSVHGSDSAETAKTEITFWFSEMEIVG

SEQ ID NO: 58552 - protein, 496 aa, Desulfovibrio vulgaris subsp. vulgaris str. Hildenborough
MNGARLLLVDDEEGIRTVLSLVLADMGHDVRTAANGNEALALLHDRPADVVLTDVRMPGMDGLALLAAVREAWPDTGVIMLTGHGDMELAVKSLRLGATDFLTKPVGDEALSVALDRAFERRRLRMALRAHTEHLEALVEARTRELVEAERLAGMGETAAMLAHAIKNIASSLEGGLFVLGKGIELGRRDYLEDGWGLVREHVARVRDLALHLLNLGKPLTGDAAPVDPDAPVREVVQLLTARARERGVALSMAYGAGPTPLVLDGEAVRRVLTDLILNAIEAFSLPEGRSGEAAVHVSSFRAEWLDGRAAVRYVVRDNGPGLPMRLRPERREEAVAALLAGCLAGHGDLSPSVVPSQGEDCAPVDAAGTGKGTGTGMGALSAEASTGTHPVADVAMGGGDAALQLSPVSDDGIVLGGGGGASVFPSPGDDPARWGVDAVTGEALRGRLQTTKQGGSGVGLLTVRRIVHELGGEFRLGDAEGGGCEATVALPVAHS

SEQ ID NO: 58553 - protein, 193 aa, Bartonella quintana str. Toulouse
MKNHTFSFPNILTYARIVAVPMVVACFFLEGRLQSSDITRWIAVSIFVVASITDFLDGYLARIWEQTSNIGRMLDPIADKLLVSACLLLLAADSTIAGWTLWAAIIILCREILVSGLREYLAELKVSVPVSRLAKWKTFVQMIAIIFLLAGPAGSKVVPYTMEFGITMLWIAALLTLWTGWDYFRAGLKHVIP

SEQ ID NO: 58554 - protein, 509 aa, Triticum aestivum
MAGTDSSASSRQSSFNSLAKDLELPLEQGCLTIVVLGASGDLAKKKTFPALYHLFEQGFLQSGEVHIVGYARTNLSDDGLRGRIRVYLKGASEEHVSEFLQLIKYVSGSYDSGEGFEKLNKEISDYEMSNNSGSSRRLFYLALPPSVYPSVCKMIRTYCMSPTSRAGWTRVIVEKPFGRDLDSAEELSSQLGELFEEDQLYRIDHYLGKELVQNLLVLRFANRLFLPLWNRDNVDNIQIVFREDFGTDGRGGYFDQYGIIRDIIQNHLLQVFCLVAMEKPVSLKPEHIRDEKVKVLQSVNPIKDEEVVLGQYQGYKDDPTVPDDSNTPTFASIVLRVHNERWEGVPFILKAGKALNSRKAEIRVQFKDVPGDIFKCKKQGRNEFVIRLQPSEAMYMKLTVKKPGLEMATEQSELDLSYGMRYQDVKIPEAYERLILDTIGGDQQHFVRRDELKAAWQIFTPLLHDIDAGKLKAVSYKPGSRGPKEADELSEKVGYMQTHGYIWIPPTLA

SEQ ID NO: 58555 - protein, 501 aa, Ehrlichia canis str. Jake
MTNHSVILCILDGWGNGENNQFNAIAQAYKPCWDNITLQYPKSHLITHGSSVGLPDGQIGNSEVGHVNLGSGRIVLQDLCKINNEIKYIKDNVYLLEFINKIKKNNGICHIAGLLSDGGVHSSYTHILDIINTLSDFQIQVAVHIFLDGRDTPPISATKYISILCEHIKHLNNINIATLSGRYYAMDRDNRLDRTTKAYNAIAFANAKRYEDPLTAVQDSYNLGITDEFILPCIIGNYQGMKPQDGFIMTNFRSDRVIQIIKMIIGDIKTDNHITLDNTIGMVKYSDKINIPCLFPNNNITNTLGEVIANNQLHQLRIAETEKYAHVTFFFNGGKEDMFENEDRIIIPSPSVATYNLTPEMSAEKVTDTIIEKIKLQKYSLIIVNYANADMVGHTGNIDATKQAITTIDQCLSKILNCIQNTNYVLVITSDHGNAEEMFDVKNNMPYTAHTLNPVPFIICNYNKKIRLKNGRLCDVAPTILEILNLAKPKEMTGVSLIEQV

SEQ ID NO: 58556 - protein, 141 aa, Physcomitrella patens subsp. patens
MAYTQTATAQWNSGLCDCFQDCGSFCCSFCCPCVVVGRLAEIIDQGMTSCIGAGCIFYCLQTFTGLGCLYTCGYRARLRAKYGLVPEPCGDCCVDCWCLSCSLSQQHRELQSRGINPSLGWLANREAYEKSAPAPQRMGGY

SEQ ID NO: 58557 - protein, 513 aa, Triticum aestivum
MAGTDSSASSRQSSFNSLAKDLELPLEQGCLTIVVLGASGDLAKKKTFPALYHLFEQGFLQSGEVHIVGYARTNLSDDGLRGRIRAYLKGASEEHVSEFLQLIKYVSGSYDSGEGFEKLNKEISDYEMSNNSGSSRRLFYLALPPSVYPSVCKMIRTYCMSPTSRAGWTRVIVEKPFGRDLDSAEELSSQLGELFEEDQLYRIDHYLGKELVQNLLVLRFANRLFLPLWNRDNVDNIQIVFREDFGTDGRGGYFDQYGIIRDIIQNHLLQVFCLVAMEKPVSLKPEHIRDEKVKVLQSVNPIKDEEVVLGQYQGYKDDPTVPDDSNTPTFASIVLRVHNERWEGVPFILKAGKALNSRKAEIRVQFKDVPGDIFKCKKQGRNEFVIRLQPSEAMYMKLTEFVQVKKPGLEMATEQSELDLSYGMRYQDVKIPEAYERLILDTIRGDQQHFVRRDELKAAWQIFTPLLHDIDAGKLKAVSYKPGSRGPKEADELSEKVGYMQTHGYIWIPPTLA

SEQ ID NO: 58558 - protein, 371 aa, Ehrlichia canis str. Jake
MSQLTSYYNAVLVLSDGKHFFGKSIGSRIPTVGEVCFTTSMIGYQHTITDPSFAGQIITFTFPHIGNVGINHKDFENHNILTHGIIVKTISEDSHSRSYSNLEHWMIQNNLTGISEIDTRALTCHLRNNGSQNGVIYHFDDINLINLSELQKQASRYNYTKHCLTIKFKNNDRTTDDNTHLYNIVVVNFGVKSGILDALSELGCKIHMISGNEDNLSKKTLSLKPQGIVLSNGPGDPSAVSENTIEEIKTLIESKIPILAICLGHQLISLAIGAKITKMLFGHRGSNHPVYNKINNNIEITSQNHGFVVNEDSLPTSAQVTHRSLFDNTIEGIQVDGYPIISVQYHPEGNPGPNDSSYIFDNFINLIKANN

SEQ ID NO: 58559 - protein, 509 aa, Triticum aestivum
MAGTDSSASSRQSSFNSLAKDLELPLEKGCLTIVVLGASGDLAKKKTFPALYHLFEQGFLQSGEVHIVGYARTNLSDDGLRGRIRAYLKGASEEHVSEFLQLIKYVSGSYDSGEGFEKLNKEISDYEMSNNSGSSRRLFYLALPPSVYPSVCKMIRTYCMSPTSRAGWTRVIVEKPFGRGLDSAEELSSQLGELFEEDQLYRIDHYLGKELVQNLLVLRFANRLFLPLWNRDNVDNIQIVFREDFGTDGRGGYFDQYGIIRGIIQNHLLQVFCLVAMEKPVSLKPEHIRDEKVKVLQSVNPIKDEEVVLGQYQGYKEDPTVPDDSNTPTFASIVLRVHNERWEGVPFILKAGKALNSRKAEIRVQFKDVPGDIFKCKKQGRNEFVIRLQPSEAMYMKLTVKKPGLEMATEQSELDLSYGMRYQDVKIPEAYERLILDTIRGDQQHFVRRDELKAAWQIFTPLLHDIDAGKLKAVSYKPGSRGPKEADELSEKVGYMQTHGYIWIPPTLA

SEQ ID NO: 58560 - protein, 249 aa, Porphyromonas gingivalis W83
MTEETEKPLMDGSWDERTELLIGTEAADKLRHSHILIVGTGGVGGYAAEMLCRAGVGRLTLVDADVVNPSNINRQIIALHSTVGRSKVEVLADRLQDINPRVKVYPVAAFLKDEAMEELLDAAKYDFVVDAIDSLSPKVFLIALSKRRGLPVISSMGAGAKRDASLIDVADIARSYNCTLARAVRKRLRKLGISRGVPVVFSSELPDESSVMEIEGERCKRSTAGTISYMPAIFGCRIAAYVIEKLTEQ

SEQ ID NO: 58561 - protein, 260 aa, Zea mays
  misc_feature (216)..(216): Xaa can be any naturally occurring amino acid
  misc_feature (247)..(247): Xaa can be any naturally occurring amino acid
FGTRPRTVPQRQPWCSRTRAPAGTAQQIISDELMLDGNPRLNLASFVTTWMEPECDKLIMDSINKNYVDMDEYPVTTELQNRCVNMIAHLFNAPIKEDETAIGVGTVGSSEAIMLAGLAFKRKWQNKRKEQGKPCDRPNIVTGANVQVCWEKFARYFEVELKEVKLSEGYYVMDPVKAVEMVDENTICVAAILGSTLTGEFEDVKQLNDLLTEKNXETGWDVPIHVDAASGGFIAPFLYPELEWDFXLPLVKSINVSGHK

SEQ ID NO: 58562 - protein, 151 aa, Streptococcus gordonii
MIQSIFAIRFANSLFENIWNRDHIDNVQITFAEKLGVEERGGYYDESGALRDMVQNHTLQLLSLLAMDKPNSFTKDEIRAEKIKVFERLTQPSQEDLKKYFIRGQYKSGKVNGKKYIAYRSEPNVNPESMTETFVSGAFFVDSDRFRDVPF

SEQ ID NO: 58563 - protein, 396 aa, Fulvimarina pelagi HTCC2506
MNIHEYQAKQVLKGFGAPVAEGVAITDAGEAEKAARMLPGPLYVVKSQIHAGGRGKGKFKELGPDAKGGVRLAKSIEDVVANAKEMLGHTLVTKQTGESGKQVNRLYIEDGADIARELYLSILVDRAVGKVAFVASTEGGMDIETVAAETPEKIVNLPIDPTAGVTEADASKLSDALKLDGEARADGMTLFPTLYKAFMDKDMSLLEINPLIVMTNGRLRVLDAKVSFDSNALFRHDDIKALRDETEEDAKEIEASKYDLAYIALDGDIGCMVNGAGLAMATMDIIKLYGKEPANFLDVGGGASKEKVTSAFKIITADPNVKGILVNIFGGIMRCDVIAEGVVAAVKEVGLKVPLVVRLEGTNVDQGKQILDQSGLDITSADDLDDAAQKIVKAVG

SEQ ID NO: 58564 - protein, 151 aa, Streptococcus gordonii
MIQSIFAIRFANSLFENIWNRDHIDNVQITFAEKLGVEERGGYYDESGALRDMVQNHTLQLLSLLAMDKPNSFTKDEIRAEKIKVFERLTQPSQEDLKKYFIRGQYKSGKVNGKKYISYRSEPNVNPESMTETFVSGAFFVDSDRFRDVPF

SEQ ID NO: 58565 - protein, 548 aa, Landoltia punctata
MGVCFSKASKPSGNGYQPPPPQPYKPPPPPAARPAQPSVQIPQTHHTQQRQQSDHQSASQAAPSPAKQHLPSPRNSPAAAVSAATPATVLGKPFEDVKAKYTIGKVLGRGQFGVTYLCTCNSTGAKYACKSISKRKLVNRNDREDVKREIQIMQHLSGQENIVEFKGAYEDRHSVHVVMELCAGGELFDRIIAKGHYSERAAAAMCRSIVNVVNICHFMGVMHRDLKPENFLLSTKDPGAALKATDFGLSVFIEEGKVYRSIVGSAYYVAPEVLMRSYGKEIDVWSAGIIVYILLSGVPPFWGETEKKIFDSIMKDDIDFQSDPWPSISASAKDLVSKMLTRDPKKRITAAQVLDHPWIRVDGEASDKPIDSAVLSRMKQFRAMNKLKKMALKVIAESLSEEEIKGLRQMFQNMDTDQSGTITYEELKTGLARLGSRLSEAEVKQLMDAADVDGNGSIDYIEFITATMHRHKLEREEHLYSAFSYFDKDNSGYITRDELKQALEEHGMGDADSIREIISEVDTDNDGRINYDEFCAMMRSGTHPPGRP

SEQ ID NO: 58566 - protein, 159 aa, Glycine max
  misc_feature (65)..(65): Xaa can be any naturally occurring amino acid
  misc_feature (75)..(75): Xaa can be any naturally occurring amino acid
CRFPLKAVKVMHTVALRTEATIPGGQMPPNIGPVFKNHMSEMFAYHATMMSNTLGTSTVVFTRSXGFMAVLLSHXYRPSGTIFAFTDQKRVQQRLALYQGVCPIYMEFSDDAEATFRRALNLLQRQGMVKEGEEVALVQSGRQPIWRFQSTHNIQVRKV

SEQ ID NO: 58567 - protein, 151 aa, Streptococcus infantis
MIQSIFAVRFANMIFENVWNRDHIDNVQITFAERLGVEERGGYYDESGALRDMVQNHTLQLLSLLAMDKPASFTKDDIRAEKIKVFKNLYHPTDEELKEQFIRGQYRSGKIDGMKYISYRSEPNVNPESMTETFASGAFFVESDRFRGVPF

SEQ ID NO: 58568 - protein, 151 aa, Streptococcus mitis
MIQSIFAVRFANMIFENVWNREHIDNVQITFAERLGVEERGGYYDQSGALRDMVQNHTLQLLSLLAMDKPASFTKDEIRAEKIKVFKNLYHPTEEELKEQFIRGQYRSGKIDGMKYISYRSEPNVDPESTTETFASGAFFVDSDRFRGVPF

SEQ ID NO: 58569 - protein, 164 aa, Brassica napus
  misc_feature (115)..(116): Xaa can be any naturally occurring amino acid
  misc_feature (130)..(130): Xaa can be any naturally occurring amino acid
  misc_feature (144)..(144): Xaa can be any naturally occurring amino acid
  misc_feature (148)..(148): Xaa can be any naturally occurring amino acid
  misc_feature (151)..(151): Xaa can be any naturally occurring amino acid
  misc_feature (155)..(155): Xaa can be any naturally occurring amino acid
  misc_feature (157)..(157): Xaa can be any naturally occurring amino acid
  misc_feature (159)..(159): Xaa can be any naturally occurring amino acid
YNFTVDKPGTHFYHGHYGMQRSAGLYGSLIIDVAKGKKEPLRYDGEFNLLLSDWWHEDVLSQEIGLSSRPMRWIGEAQSILINGRGQFNCSLAAQFSSTSLPTCTFKEGDQCAPXXLHVEPNKTYRIRLXSSTALASLQLLLPXDITXVAXSTPXVXTXPLIPR

SEQ ID NO: 58570 - protein, 424 aa, Arabidopsis thaliana
MQQAMLTNKDEKVLKALERTRQLDIPDEKTMPVLMKLLEEAGGNWSYIKLDNYTALVDAIYSVEDENKQSEGSSNGNRGKNLKVIDSPATLKKTYETRSASSGSSIQVVQKQPQLSNGDRKRKYKSRIADITKGSESVKIPLVDDVGSEAVPKFTYIPHNIVYQSAYLHVSLARISDEDCCANCKGNCLSADFPCTCARETSGEYAYTKEGLLKEKFLDTCLKMKKEPDSFPKVYCKDCPLERDHDKGTYGKCDGHLIRKFIKECWRKCGCDMQCGNRVVQRGIRCQLQVYFTQEGKGWGLRTLQDLPKGTFICEYIGEILTNTELYDRNVRSSSERHTYPVTLDADWGSEKDLKDEEALCLDATICGNVARFINHRCEDANMIDIPIEIETPDRHYYHIAFFTLRDVKAMDELTWVSTMIKLP

SEQ ID NO: 58571 - protein, 170 aa, Bacillus cereus ATCC 14579
MIYPYKEKKPKIASSAFIADYVTITGDVYVGEESSIWFNTVIRGDVSPTIIGDRVNVQDQCTLHQSPQYPLILEDDVTVGHQVILHSCHIKKDALIGMGSIILDGAEIGEGAFIGAGSLVSQGKKIPPNTLAFGRPAKVIRELTAEDRKDMERIRTQYVEKGQYYKSLQK

SEQ ID NO: 58572 - protein, 187 aa, Solanum demissum
MAQVTGDDGESGGDQHASIFVLGRQLFVAMLMLDTWQYFMHRYMHQNKFLYKHIHAQHHRLIVPYAFGALYNHPLEGLILDTIGGALAFLVSGMSPRTSIFFFSFATIKTVDDHCGLWLPGNLFHIFFKNNSAYHDIHHQLYGTKYNYSQPFFVTWDRILGTYMPYELERRPEGGFEAKPVKDCKEH

SEQ ID NO: 58573 - protein, 124 aa, Bordetella petrii
MTDRQLAILAALNMIAAVGAGAFGAHGLKRMLAPDLLAVWQTGVLYHLVHALGLFVIALLGARFGSTPLSTAGLVMFAGIVLFSGSLYLLAVTGTRWLGAITPIGGVAFLVAWALVAWAAWRSA

SEQ ID NO: 58574 - protein, 320 aa, Brassica juncea
MEKNIKFPVVDLSKLIGEERDQTMALINDACENWGFFEIVNHGLPHDLMDNAEKMTKEHYKISMEQKFNDMLKSKGLENLEREVEDVDWESTFYLRHLPQSNLYDIPDMSDEYRTAMKDFGKRLENLAEDLLDLLCENLGLEKGYLKKVFHGTKGPTFGTKVSNYPACPKPEMIKGLRAHTDAGGIILLFQDDKVTGLQLLKDGDWIDVPPLNHSIVINLGDQLEVITNGRYKSMMHRVVTQKEGNRMSIASFYNPGSDAEISPASSLACKETEYPSFVFDDYMKLYAGVKFQPKEPRFEAMKNANAVTELNPTAAVETF

SEQ ID NO: 58575 - protein, 257 aa, Oryza sativa Indica Group
MPLAGAAAQPAPPPAVQGLFEACREVFGASAGAVPSPAGVERIKSVLDSISAADVSLTRNMSYFRRVNSNGIPKITYLHLYECEAFSIGIFCLPPRGVIPLHNHPNMTVFSKLLFGELRVKSYDWADASQDSTGVSLFLFVLSIDAQLQGARLAKVKVDGTLNAPCATSVLYPEDGGNLHCFTAHTACAVLDVLGPPYDDGSGRHCQHYNVSSSAPSAGDSKPLPGDDGYAWLEECEPPDNFHLVGSTYMGPRIVDN

SEQ ID NO: 58576 - protein, 503 aa, Synechococcus sp. WH 7803
MTNPLRVGLRQERVIAPQCLVIFGASGDLTHRKLVPALFELFLQRRLPSEFALLGCARRPWSDEEFRQKMAEAMTKTVNENRVAWDQFAAGMFYEPVDLQQPEDLVKLGHRLDSIDRLRATRSNRTFYLSVSPKFYGSGCRALADAGLLKDPQRSRVVIEKPFGRDYGSAQALNRIVQSCGQENQIFRIDHYLGKETVQNIMVLRFANTIFEPIWNRNYISSVQITAAETVGVEERAGYYETSGALRDMVQNHLTQMLAITAMETPGRFDPEAIRSEKAKVLQAARLADENEPWNCCIRGQYGPGGTQENPLAGYRQEPGVDPNSTTETYVAMKLFIDNWRWQGVPFYVRTGKRLPKRLSEVVLTFREAPVHLFDAAGGGPTANQLILRIQPDEGAEFRFEVKSPGSGMRSRPVEMEFSYDESFGEPSDEGYVRLLADAMLGDPTLFTRSDEVEAAWRLYTPLLELIEDSPWQLPIHPYESRTWGPAASDALMARDGLLWRRP

SEQ ID NO: 58577 - protein, 128 aa, Zea mays
MAASEAAAAAATPVAPTEGTVIAIHSLEEWSIQIEEANSAKKLVVIDFTATWCPPCRAMAPIFADMAKKSPNVVFLKVDVDEMKTIAEQFSVEAMPTFLFMREGDVKDRVVGAAKEELARKLELHMAS

SEQ ID NO: 58578 - protein, 577 aa, Rhodopseudomonas palustris CGA009
MITLRVPQRILMTLAALVLVVIPLAAPAQDMRSGMARGPAQAVVAKHGMVVAQERLAADIGAGFLSRGGNAIDAAVATGFAMAVTYPRAGNLGGGGFMVIHSAVKNEDVAIDYRETAPQAATQDMFLTDGKPDPDKSRKSALGIGVPGTVAGLALALEKYGSGKFKLADVIAPAIALARDGITVADDTADTLPDWHAWLSRWPSTRKVFARPDGSPLQAGDRLVQPDLAATLEAIAKRGPDGFYRGPIAEKLSRGIREAGGLITPEDLAGYQPMLRSPLRGSYRGYDIVAMPQPSSGGVVLIESLNILEGYAMHDLGQGTPPSLHLLIEAMKRAYADRARYLGDPAFSEAPVTKLLSKDYAASLRAGIDPERATPVAEPLPQPREGQNTTHFSVADAEGNAVSNTYTLNFSYGLGLVADGTGVLLNNELDDFTAAPGASNAYGLVGFAANLPAPGKRPLSSMSPTIVLKDGKPVLVTGSPGGSRIISAVLQVIVDVIDYRMNVADAVAAPRLHHQWLPDEVRVEGGFPEATLDTLRAMGHRIVTPLGQTSANSILIDADGFHGAPDPRTRGATAAGN

SEQ ID NO: 58579 - protein, 185 aa, Synechococcus sp. WH 5701
MALSTTVPELGEPIDLRGLVRDVPDFPKPGILFRDLTPLMRDPRGWKEVVRLLAGVCAQLRPDLIVGIESRGFIVGTALATTVEIGFVPVRKPGKLPGQVRAVDYALEYGHDRLEIQHDALAGGPRVLIVDDLLATGGTAAACAQLVTEAGGDLCGFGFVAELADLGGRSRLPGDHPVESLIVYA

SEQ ID NO: 58580 - protein, 77 aa, Synechocystis sp. PCC 6803
MNQEIFEKVKKIVVEQLEVDPDKVTPDATFAEDLGADSLDTVELVMALEEEFDIEIPDEVAETIDTVGKAVEHIESK

SEQ ID NO: 58581 - protein, 135 aa, Oryza sativa Japonica Group
SLSTTDPTSRRFSPPPSYFTSGLVSSQLHRSCSTMSTTVTRAHLEQRLALAKRCSREANIAGVKAAAVATIASAVPTLASVRMLPWAKANINPTGQALIICTAAGMAYFVAADKKILSLARRHSFENAPEHLKNT

SEQ ID NO: 58582 - protein, 485 aa, Medicago truncatula
MYPSLTDSVGGSSSLSSSSSGPILIPKRFVWPYGGTRVYLIGSFTRWSEHIPMSPMEGCPSVFQVICSLMPGYHQFKFNVDGQWRYDEQQPFVNGNYGIVNTIYLVREPDILPAILSAETSSRSHMEVDNDVFGHAEANPRMSPSDLEVSRRRISKFLSEHTAYDLLPESGKVIALDVNLPVKQAFHVLYEQDVSMAPLWDFCKSQFVGVLSAMDFILILKELGTHGSHLTEEQLETHTIAAWKEGKSKQRRALDNNEGSNPHCFVHAGPKECLKDVALKVLQNKVSTVPIISLEDGSFPQLLHLASLSGILKCICRHFEHSAGSLPILQLPIASIPLGTWVPNVGDPNGQPLIRLRPNASLGDALSMFVQAKVSSIPIVDENDSLLDIYSRSDITALAKDKAYARISLDETNIHQALILGQDANSPYGLNNGHRCHMCLRSDSLHKVMERLAKPGVRRLVIVEAGSKRVEGIISLSDVFRFLLG

SEQ ID NO: 58583 - protein, 247 aa, Spiroplasma kunkelii CR2-3x
MITIKTDKEIEYMRKACLTLKQIHQELKAMIKPGVTGVMLNQRAEEIIRANNCQPNFKGLYDFPATICVSLNEVLVHGIPNHTPFVEGDLVSVDAGCSYEGYNSDGAFTVIVGKPRTTEHVKLLTVTETALAKAIAILKPGVRIGDIGETIQTYVEGEGFFIPTEFTGHGIGRELHEEPMIPNVGTGGKGMRLQAGMTICIEPMVQIGTKAIKMLDDNSTPVSALHLCSAHFEDTILITPTGYEVLT

SEQ ID NO: 58584 - protein, 162 aa, Oryza sativa Japonica Group
MATPTKQERPSMTFSRPAAYGFSDRPAIDLALSENAEAKSHKKKKKKMSTVTRAYLDQKLALAKRCSREATLAGAKAAAVATVASAVPTLASVRMLPWAKANINPTGQALIICTAAGMAYFVAADKKILSLARKHSFEGAPEHLKNTSFQGTGRPHPAFFRP

SEQ ID NO: 58585 - protein, 568 aa, Desulfovibrio vulgaris subsp. vulgaris str. Hildenborough
MAIPSGATGKEPFLPRTLTVLREGYDGGTFFKDLAAGLTVGIVALPLAMAFAIASGTTPERGLFTAIVAGFLISLLGGSRYQIGGPTGAFVIIIFNVIMKHGYDGLVVTTLLAGAMLLVFGLCRFGALIKYIPYPVTTGFTAGIAVLIFSQQVKDFLGLSMQSVPPDFFEKWQAYIHNAATFDPATCGIAFLALGAIILTRKTIPRIPGPVVGVVLASLTVWALGLDVETIGSRFGGIPTELPTFTLPTVTLERVRQLLPDAMTIALLAGIESLLSCVVADGMTGDKHNSNVELAAQGAANIASVMFGGIPATGAIARTVTNIRSGGRTPVAGMIHAAVLVGFILYLAPLASFIPLASLAAVLMVVAWDMSEMHKFLRLLHAPKSDVLVMCLTFALTVVIDLTVAVYVGVMLASLLFMRRMSEVTQICTCLDGEATKVQGRETAELDVPEGVKVYEIDGPFFFGVADRFQNVLAALDRQPEVFILRMRKVSTLDSTAVNALEVFWRKCRSDGTQLLLSGVRETMRTTLRRMGTLSLIGEGNICENIDAALARAGQVLAERREAEDRPQ

SEQ ID NO: 58586 - protein, 472 aa, Ashbya gossypii ATCC 10895
MELQRMMQYLRKLGHFIGPGIMVSVAYMDPGNYSTSVAGGAQYKYHLLFSIFVSNIFAVVLQCLCVKLGTVTGRDLAENCRRHLPRKLNYVMYAFAEVAIIATDLAEVVGTAVALQILFGIPLIWGVLLTILDVLLILVFYRPEKQTMREVRMFEFFVSIFVAGTMVCFVLELFKLSVPSKLELFRGFLPSPVLFKEQRAIFISLGILGATVMPHSLYLGSALVKPRVQEYDIKKYGKLKESGPSLEAIKYTLNFSYAELIVSLFFIATFVNSAILIVAGATLFGEPEAEDADLISIYQLLCKTISPAAGLIFALAMLFSGQSAGVICTMAGQIVSSGFLKWNLDPWIIRLVTRLIAIVPCFIVALFMGEKGISNILNLSQVVLSLILPIVSAPLIYFTSSKKIMTVVDHDGNEDDLDEPSERTNLVTIKKPFVDYSNDKWLAYVSVGIWALIGSLNCYLVVSFLLGADVQF

SEQ ID NO: 58587 - protein, 1411 aa, Arabidopsis thaliana
MQSLTLTRYPTPISPPRLNLYPLRQIAASVLSAPTAGINRRDMASRHQSTSFKPLAVGRNLTGDDDDGYCTLIDFAGSGGGEGKNVGEDLVVLLYHLQHACKRIASLVASPFNSSLGKLSVNSSSGSDRDAPKPLDIVSNDIVLSSLRNSGKVAVMASEENDSPTWIKDDGPYVVVVDPLDGSRNIDASIPTGTIFGIYNRLVELDHLPVEEKAELNSLQRGSRLVASGYVLYSSATIFCVTLGSGTHAFTLDHSTGEFVLTHQNIKIPTRGQIYSVNDARYFDWPEGLRKYIDTVRQGKGQNPKKYSARYICSLVADLHRTLLYGGVAMNPRDHLRLVYEGNPLAFLVEQAGGKSSDGKRGILSIQPVKLHQRLPLFLGSLEDVAELESYGDVQQTVNPGYETTKDFSQVLCAGNRRDEIGEGERGEIMERNSVKFHAEKRSGAFDPGSGFGSSKRVKTHHTQLLSALVVPVGHAAFRLLCPLSHVGAVIGKSGNVIKQLQQSTGAKIRVEEPPSGSPDRVITIIAQADSKSRVKLGANNNGNAEGEKKEEEVEVSKAQGALIKVFELLAAEADSDTVVCRLLTESSHAGAVIGKGGQMVGSIRKETGCKISIRIENLPICADTDDEMVEVEGNAIAVKKALVSISRCLQNCQSIDKVRMVGNRPLEKEFQASLHRPIETIIQESLPRSVEVNPYDYRLRNDEIFPRGTVARANDVIPHDTLHLRRIEAVPQGALRMHIEADRQDVLRRHVEADRQDALRRRIDVVPQETLYMPSDVLRGDCFRQHRERDDSHDSLHRPFEMVPRDAMGMPFESFPRDAYGRPIETMTQETLRGQSADYLAHRYSTLDTHPHSFTTSASMANTATMKPPPSEVEVGNQDVVFKILCSTENAGGVIGTGGKVVRMLHSETGAFINVGNTLDDCEERLIAVTASENPECQSSPAQKAIMLIFSRLFELATNKILDNGPRSSITARLVVPTSQIGCVLGKGGVIVSEMRKTTGAAIQILKVEQNPKCISENDQVVQITGEFPNVREAIFHITSRLRDSVFSNSMKNSLAKSSSALTTERFYDRQSDNPLSIGSHQSVSNPATNSSSLHRRSEDSFLSGSHSSVNYSRSVGTDPYIRPEDPFPDRFNPSAGYSHNFGRRFTMDHSDNSHHLTEAPSRLWASPPPAAPRGLSDASGGLSSARAGHVLGSGHKSAIVTNTTVEIRVPANAMSFVYGEQGYNLEQLRQISGARVIIHEPPLGTSDRIIVISGTPDQTQAAQNLLHAFILTGRSAPRPRPAAARSPAPQPVHRAPPPAPAQASGGGGGMFSGIGSTIAQGMAFGTGSAVAHRAVDSVMGPRTIQHEAVEAASASAAPAGSAMLSSTCDIHAKAFQDCIGSYGSEISKCQFYMDMLSECRKNSGSVIGA

SEQ ID NO: 58588 - protein, 337 aa, Brassica napus
  misc_feature (248)..(248): Xaa can be any naturally occurring amino acid
MSAFTSKYADELIANAAYIGTPGKGILAADESTGTIGKRLASINVENVETNRRALRELLFTAPGALPCLSGVILFEETLYQKSSDGKLFVDILKEGGVLPGIKVDKGTVELAGTNGETTTQGLDGLGERCKKYYEAGARFAKWRAVLKIGENEPSEHSIHENAYGLARYAVICQENGLVPIVEPEILVDGSHDIHKCAAVTERVLAACYKALSDHHVLLEGTLLKPNMVTPGSDSAKVAPEVIAEHTXSEEEATKNLNAMNQLKTKKPWSLSFSFGRALQQSTLKTWAGKEENVKAAQEALYVRCKANSEATLGTYKGDAKLGDGAAESLHVKDYKY

SEQ ID NO: 58589 - protein, 115 aa, Oryza sativa Japonica Group
MATVTRAHLEQRLALAKRCSREANIAGVKAAAVATIASAVPTLASVRMLPWAKANINPTGQALIICTAAGMAYFVAADKKILSLARRHSFENAPEHLKNTSFQGAGRPHPAFFRP

SEQ ID NO: 58590 - protein, 273 aa, Ashbya gossypii ATCC 10895
MSRGVLLEALARNRQPKVITFDAYNCLFSTRLPVAEQYSAVGRRHGVDVAPSVLAARFPAGMLFRETSARHPDYGKYTGLSVQGWWTLVIQRLFKPAEVGEKMVAEILQRFQGHGAYKVFPDALWLLEELRVRRPEVVVGVLSNSDPTMRQVLLNLGLGSYFTDAIYLSYDLGAKKPERRAFDAALERILERNPQLLGDLGAEELRAACWHVGDEKSADLCGATGAGWNGILVDRQDIYGQLGQGSAVALGLNQFVVPDFYTVGKLFGLAYNI

SEQ ID NO: 58591 - protein, 465 aa, Physcomitrella patens subsp. patens
MTRFTLPRMEASATTMLVTALLVSLFMLQAAAISAPVAPATSAVPAHPFSGTQTIENHPLGYGRRLQATGRNGFAWSQWRAYIALRAWKKAITDDPKNVTRSWKGKYVCRYEGVFCQHPPGQKYSSIKVVAAIDLNGAHLKGTLVPELGLLREIAVFHLNSNRFCGGVPDSFRNMKLLYELDLSNNQFSGRFPMVTLAIPKLVFLDLRFNKFYGRLPSELFAKRTLKIIFVNNNKFEGTIPSNFGQSRVAAITLANNKFRGTIPRSISDMSNTLFEILALGNKFEGRIPSDIGKLKNILLFDFSTNKIKGDLPESIRNLTDLEVFNMSNNLLGGTVTAELCRLKNLATLDLSDNFFTKLESACRALNRRVLDISGNCLLTRSYYNQKSEATCASFYGWSPPPPLSSPPPPSPPPPPTPSPPPPPTPTPSPPPPPTPTPSPPPPPTLSPPPPPTPSTYTPPPPTSR

SEQ ID NO: 58592 - protein, 589 aa, Magnaporthe grisea 70-15
MSAVSVPSGPQAFTSSYAPRLRTYNNSLLIPVINQPQAGPISRTTKRGTTVINYAEDGYDDYDDDDDDSRRRPTGLRSLRREDSVNKADAAERVNKETTTPVTVPGIWREWMGKTRINRPEAHNFAQAQLPLTLIPIRLDVEIPAFIPGPNISKVDDPNQPKEMTTPYRLKDTFMWNLHETLITTDHFATQLAQDLDLPNKAHVIGEISKQIRTQLEEYAGVALHPLFHSAQKQGAPTQAATDRDASSTPIIGRSDTPLRNAALGRSTPSRPAAPATPGPTTSALQGEVTATAEHITADSEDFNLDDTYRCVVELNIHLGSQLYTDKFEWSLLHPPGTAEAFAKVTCEDLGLSGEWVPAMTHAIYEAVLRLKKEACESGGLVSGLAGDVGSLDPSLGVYSSATVHGGAGAGWRHDPDHLADDWEPRLEMLSKEEMEKREGDRERQIRRLRRETARFSSLAGMAGGVPVGFGFGGLIEQEEERMGRGERSKKKRRFRSLSPVGRSATPGGRGTPDVGGSGGYGGGGSLTDAERYQWRCTHCKVGGTCVWAVRDGPHGPRTLCNNCGFMYERDQKLPRFTKNLHLNDLRFA

SEQ ID NO: 58593 - protein, 295 aa, Bibersteinia trehalosi
AQNRDDIEVVGINDLIDVDYMAYMLKYDSTHGRFDGTVEVRDGKLVVNGKEIRVTAEKDPANLKWDEIGVDVAVEATGIFLTDETARKHITAGAKKVVLTGPSKDNTPMFVNGVNFNTYAGQDIVSNASCTTNCLAPLARVIHETFGIKEGLMTTVHATTATQKTVDGPSAKDWRGGRGASQNIIPSSTGAAKAVGKVLPALNGKLTGMAFRVPTANVSVVDLTVNLEKPATYEQIKQAIKDAAEGKTFNGELKGVLGYTEDAVVSTDFNGAVETSVFDADAGIALTDTFVKLVS

SEQ ID NO: 58594 - protein, 157 aa, Humulus lupulus
MSTGRKITLKSSDGETLEVDEAVALESQTIKHMIEDDCADNGIPLPNVTSKILSKVIEYCKKHVGAPKAEDRASSVDDELKAWDADFVKVDQATLFDLILAANYLNIKSLLDLTCQTVADMIKGKTPEEIRKTFNIKNDFTPEEEEEVRRENQWAFE

SEQ ID NO: 58595 - protein, 422 aa, Vitis vinifera
MPQRGSLHKPHHNLRERPLACISLKIYGTTKTNYIDMENMHSPLSFHSTHHMEEFWKKQILPGGATLGGHVVPLDRLLKDQVVDLRGKPGGDTCKGRLAREEEGILWSMEGWFPRGDFQVAGERARESLKPWRAGVKYLADADLVTADSVIQHWECAHYVKRRRPNGSQKRVSSGVVGFGRDISGLFKQTITVGKRVRTETNTTVGAVSVSSHTMELAFMKLSESSYVTTRMLVIGAGTMEKLVIKRLTAKGCTKMVIVNQSKGKSCRYHRGEHKGLPTELDHSWCWFLHSLDADDDSDGFGSGSSGSNLLRFYTDDPPGLKITPMVVLVTSLCFIGFVIALHVFGEIYRHRIWWSGLIKDLFNVFSNTVTYLSVLDLFLTEHLEVSTELGDYGGSSGSRHSGTQLLETFSPHWSTCLGSAA

SEQ ID NO: 58596 - protein, 374 aa, Vitis vinifera
  misc_feature (86)..(86): Xaa can be any naturally occurring amino acid
  misc_feature (155)..(155): Xaa can be any naturally occurring amino acid
MEYLGYVFVGIVTLLLVCIPHWLRSWRKPQCNGKLPPGSMGWPILGETLQFSTPYTNRGVSPFIRKRMDRYGPLFRTKLLGWPFVXSADPDVSRFVLQQEGKLFHCWYMESFDNLFGPQNVLSSQGALHKCLRSLILSQFGSESLRTRVLSQVEXLVLKKLQLWSNHTSVDLKEGITSMMFDFTAKMICNYDESKTPEKLRENYSAFLSGLISFPLNIPGTSYWKCLKGRERARKTLRNRLLERLASPEREHKDIMDFIIQEMKKDDTILTEEIAVDLLFGLPFGANETTSSTLILAVQYLGSHPSALAEITREHESILRNRKQKDSGITWEEYKSMSFTMMVVNETVRMGSILPSIFRKVDKDIEIKGTVWID

SEQ ID NO: 58597 - protein, 545 aa, Fulvimarina pelagi HTCC2506
MSTEIKVPTLGESVSEATIGTWFKQVGDRVEQDEALAELETDKVTVEVPAPAAGVLQEIVANQGDTVGVGALIGMIGEGEGAGKGSSDDATEQPSKEAKDKAASDSNGGYGGESQSDQQQSAGGSSGSLTDVNVPSAGESVTEATVGTIFKKVGDHVSMDEALLELETDKAAQEVPSPVAGVIRELAVSEGDEVQVGALLMKIEEGASAGEKGSDGSGGAVANRAPKADEHGADGPAAARSEEQAAEGKRPPAPSARKLMEERNLSADQVQGSGRDGQILKGDVLEAVSRGAPSSTQEKPAAPKRAEPSKDDAPREERVKMTRLRQTIAKRLKSAQDTAAMLTTFNEVDMTATMEMRKKYKELFEKKHGIKLGFMGFFTKAVCHALKEIPAVNAEIDGGDIVYKNFCHVGMAVGTDKGLVVPVIRDADQMTIAEIEKELGRLAKAARDGKLGVSDMQGGTFTITNGGVYGSLMSTPILNAPQSGILGMHKIQERPMAVGGEVKIRPMMYLALSYDHRIVDGKEAVTFLVRVKESLEDPERLILDL

SEQ ID NO: 58598 - protein, 475 aa, Fulvimarina pelagi HTCC2506
MDAMMSEPYDLVVIGSGPGGYVCAIKAAQLGMKVACVEKRETYGGTCLNVGCIPSKALLHASERFHEAGHHYASLGIKVSPELDLPAMMTHKDKTVKSNVDGIAYLFKKNKVDGFIGTGSIEAKGKVKVEKEDGSSETLDAKNIVIATGSEVAGIPGVDLTFDSDTIVSSDWAIALEKVPEHMIIVGGGVIGLELGSVWSRLGAKVTVIEYLDKVLGPMDVELSTAFQKLLVKQGIEFKLGAKVTGVEKHDGGGASVTFEPAKGGESETLDAEVVLVATGRKPHTEGLGLANAGVKADDRGRVEIDDHFKTNVDGIYAIGDVVRGAMLAHKAEDEGVALAELLAGQSAHVNYDAIPSVVYTAPEVASVGKTEEELKKAGIEYKVGKFPFLANGRARAMLATDGFVKMLVDAKTDKLLGCHILGASAGDLIVEAALVMEYGGASEDVALTSHAHPSLSEAMREAAMAAAYGKPIHI

SEQ ID NO: 58599 - protein, 245 aa, Thermobifida fusca YX
MPYHPTTTPPAAILFSVDDTLVDDYNAVSQGVRVLMERLGHPSFSAARVLWDVQGILSTSAYRAGRIPLAEKRRQLVRALATQAGHSHISDQHCDELYQRYLDAHRAAWRTFDDVAPTLTQLAQRNIRLGVITNGDQNRQHDKLSTLNLAHHFGAVVCAEAAGTSKPDPRIFLLACQQLGVAPHQTWYVGDQMYEDAIGALNAGLYPVLCDRHRLLPATEITTIHTLTELSALTTGTRSPGASLL

SEQ ID NO: 58600 - protein, 151 aa, Streptococcus mitis
MIQSIFAVRFANLIFENVWNKDFIDNVQITFAERLGVEERGGYYDQSGALRDMVQNHTLQLLSLLAMDKPASFTKDEIRAEKIKVFKNLYHPTDEELKEYFIRGQYRSGKIDGMKYISYRSEPNVNPESTTETFASGAFFVNSDRFRGVPF

SEQ ID NO: 58601 - protein, 151 aa, Streptococcus mitis
MIQSIFAVRFANMIFENVWNREHIDNVQITFAERLGVEERGGYYDESGALRDMVQNHTLQLLSLLAMDKPASFTKDEIRAEKIKVFKNLHQPSEEELKEHFIRGQYRSGKIDGKKYISYRSEPNVNPESTTETFASGAFFVDSDRFRGVPF

SEQ ID NO: 58602 - protein, 546 aa, Fulvimarina pelagi HTCC2506
MDPHLPRVAMPGAYPPAHPVVAFNGRIASCTSADAGNEQANCARRSDIRLELMFSTRNLKAEWLGNIRSDLLSGLVVALALIPEAIAFSIIAGVDPKVGLYASFSIACLTAIFGGRPGMISAATAATAVLMITLVADHGLQYLFAATVLAGILQLVAGALKLGDAMRFVSRSVMTGFVNALAILIFMAQIPELVGVPYLTYAMVALGLAIIYLLPRVTTAIPSPLVAIVVVTAIALVFGLDLRTVGDMGELPDSLPIFLIPDIPLNLETLQIILPYSLGIAVVGLLESLMTAQVVDDLTDTPSDKNRECLGQGVANTVTGFFGGMAGCAMIGQSVINVKSGGRTRLSCFFAGIALLFLIVVLGEWVAVIPMAALVAIMIMVSIGTFSWESIVNLKTHPRRSSLVMLVTVVTVVWTHNLAIGVVAGVLLSGIFFASKVAQLFYIESDLSEDRRHRTYRVLGQIFFASTSDFGDAFDFREDVDKVTIDVSRSHIWDLSGVGALDRAVLKFRREGTEVELVGMNEASRTLVGRLGIADKPDALARMEAH

SEQ ID NO: 58603 - protein, 151 aa, Streptococcus oralis
MIQSIFAVRFANMIFENVWNREHIDNVQITFAERLGVEERGGYYDQSGALRDMVQNHTLQLLSLLAMDKPASFTKDEIRAEKIKVFKNLYHPTEEELKEQFIRGQYRSGKIDGMKYISYRSEPNVDPESTTETFASGAFFVDSDRFRGVPL

SEQ ID NO: 58604 - protein, 151 aa, Streptococcus oralis
MIQSIFAIRFANMIFENVWNREHIDNVQITFAERLGVEERGGYYDESGALRDMVQNHTLQLLSLLAMDKPASFTKDDIRAEKIKVFKNLYHPTDEELKEQFIRGQYRSGKVDGMKYISYRSEPNVNPESMTETFASGAFFVNTDRFRDVPF

SEQ ID NO: 58605 - protein, 473 aa, Solanum demissum
MHIIFYELETEGWFERSKAYIAIERYLSKNSSTQAKRLKANAVKDGQSLVLTMDDHEEITDEYKGKKVWWISSQKPASRQTISLYREDEKRYFKLKFHKKNRDLITNSYLKYVLDEGKAISVKERQRKLYTNNKGDGGGYRYRGGRMWSGVVFEHPSTFDTLAMDPNKKQEIIDDLETFSKSKDYYAKIGKAWKRGYLLYGPPGTGKSSMIAAMANFLKYDVYDLELTSVKDNTELRKLLIDTTGQRETNKKKKEEEDKGKNEEDAVKEKMKKGGEVKEKQSEVTLSGLLNFIDGLWSAIGGERLIVFTTNYVEKLDPALIRRGRMDKHIVLSYCCFESFKVLAHNYLDVVESHVHFPEIRRLLEETNMTPADIAENLMPKSSKENAETCLERLIKALETAKEEAKLKAEEEERAKAAEKEKEEERAKAAEKEKEEKDREEKKEVTATEEAKNADDVNEKDNGVKENGDVSKD

SEQ ID NO: 58606 - protein, 258 aa, Thermobifida fusca YX
MAVPTVTLNNGVTMPQLGFGTWQVGYDAVAAALAAGYRCFDTAEMYRNETAVAAALADSGLDRSDVFITTKLWNNHHGFQPALDAFHASRRRLGLDVIDLYLIHWPNASDAVNVETWRALEQLYAEGVVRAIGVSNFSPAQLAVLLEACDVVPAVNQIELNPSRPRLEERVYHARHGIATQAWAPLAKGGALLTHPVITEIAEAHQKTPAQVVLRWHLQHGILVIPRSATPERIRSNFAVTDFSLAPQEMAAVDALGA

SEQ ID NO: 58607 - protein, 282 aa, Methanococcoides burtonii DSM 6242
MKIIAGPASQLLASRVARELNMEPTLCEFNRFPDGEVYTRILEDIVDDVTIIQSTPTDADLVSLLQLIDACEDAPTITVVIPYMGYARQDKAFRSGESISARAIARTIHADRVITVNIHEKSVLEHFNADSFDLDASHLIGNYIRSLGLEDPLIIAPDKGAITLAESAAADVGIEYDYLEKTRHSGDTVTIKTKNIDVTGKEIILIDDMIATGGTMAESIKLLRSQGAKDVYIACVHPVLTKNGVLRLYNAGVHEIIASDTLEKAHSHISVAPLIADFLKNL

SEQ ID NO: 58608 - protein, 105 aa, Oryza sativa Japonica Group
MTSSSSPSRKVLSKIACNRLQKELAEWQVNPPSGFKHKVTDNLQRWVIEVAGAAGTLYAGETYQLQVDFPEHYPMEAPQVIFLHPAPMHPHIYSNGHICLGKMIV

SEQ ID NO: 58609 - protein, 151 aa, Streptococcus oralis
MIQSIFAVRFANMIFENVWNREHIDNIQITFAERLGVEERGGYYDQSGALRDMVQNHTLQLLSLLAMDKPASFTKDEIRAEKIKVFKNLYHPTEEELKKQFIRGQYRSGKIDGMKYISYRSEPNVDPESTTETFASGAFFVDSDRFRGVPF

SEQ ID NO: 58610 - protein, 499 aa, Bordetella petrii
MSLHDTDYWRRKAATLQLRGQAYIDGAYVDAADGATFAAHSPIDGRKLADIAACGAADVDRAVQAARRAFEAGSWRDLPPRERKTRLQRLAALITEHTETLALVETLDMGKPIRDALAFDLPETAHCYAWYGEAIDKIYDEIAPTGGQALATITREPLGVVAAVVPWNYPLMMAAWKVAPALAAGNSVILKPAEQSSLSAIMLADLAAQAGIPPGVFNVVPGLGAQAGQALGLHPDVDCVAFTGSTATGKRFMQYAGQSNLKRVWLECGGKSPHIVFDDCPDLERAATAAAAAIFVNQGEVCIAGSRLYVQDGIYDEFMERVAAHARAMQPGDPLDPATAMGAMVDERQMQAVLARIEAGQREGASLRLGGGRARDDSGGYYIEPTIFDCADQNNSLVREEIFGPVLAAQRFGTEDQAIALANDSVYGLGAGLWTADLGRAHRLSRRLRAGLVWVNCYADGDITVPFGGVKQSGFGRDKSLHALDKYSDLKTTWISLAT

SEQ ID NO: 58611 - protein, 310 aa, Photobacterium profundum SS9
MSRPIIIDCDPGHDDAIALILACASPELDIKAVTTSAGNQTPEKTLHNALRILTLVGRTDIPVAGGALQPLSRELIIADNVHGETGLDGPVLPEPAFEPQPCHAVELMAKILTEATEPVTLVPTGPLTNIALLLATHRELHSQIDSIVLMGGSAEAGNWTPAAEFNIYVDPEAADIVFKSGIPITMCGLDVTHRAQIMDEDIEKIRKINNPVAQVTAELLDFFMIYHRDPKWGFEGAPLHDPCTIAWLLEPELFASINCWVGIETQGSHTLGMTVVDRYQLTDNPINTTVLFDVNRQGFVDLLAERLANY

SEQ ID NO: 58612 - protein, 659 aa, Oryza sativa Indica Group
MESEMADAAPAPAVAAAATAEPLAAVAEEGEEGGEAAVGSTLTMERVAAAKKFIENHYRSQMKNIQERKERFSVEKCAVNVVWMRRLCLSLSAVDNTLVAYHLFVLSGWRFRLERQLESSQVPREQQINLLKDLERKETEYMRLKRHKICVDDFELLTIIGRGAFGEVRLCREKTSSNIYAMKKLKKSDMVVRGQVEHVRAERNLLAEVASHCIVKLYYSFQDSEYLYLIMEYLPGGDIMTLLMREDTLTEHVARFYIAETILAIESIHKHNYIHRDIKPDNLLLDKNGHMKLSDFGLCKPIDCSKLSTLNEDEPMGDDNLRESMDIDSSFSETTNGRRWRSQHEQLQHWQMNRRKLAFSTVGTPDYIAPEVLLKKGYGMECDWWSLGAIMYEMLVGYPPFYSDDPITTCRKIVHWRNHLKFPEDSKVSPEARDLICRLLCDVDHRIGSAGADQIKAHPWFRGVAWEKLYEMEAAFKPQVNDELDTQNFMKFEEIHYIQIESLGVAEVRDAERSESTTMGGPGRAFVHQSRGGLGRAARLNAARRAGWGGWRGRAPQRGRSGEGSEVEFRAVMGDNDGGRRCVKQWRDMDNAPTRTGSGPSRKMMLNSKDLSFVGYTYKNFDAVKGLKHSGPADMDPSREPNGRDKHMHTVSSGDPMIQ

SEQ ID NO: 58613 - protein, 345 aa, Zea mays
MLLTKPYLSNSLLPVPSPPPSGPTLSSNHASPLAAPTCRRSRLRISATSTAAPSPSSAAAATASLSRVDVLSEALPFIQRFKGKTVVVKYGGAAMKSPELQASVIRDLVLLSCVGLRPVLVHGGGPEINSWLLRVGVEPQFRDGLRVTDALTMEVVEMVLVGKVNKNLVSLINIAGGTAIGLCGKDARLITARPSPNAAALGFVGEVSRVDATVLHPIIAAGHIPVIATVAADETGQAYNINADTAAGEIAAAVGAEKLLLLTDVSGILADRNDPGSLVKVVDIAGVRKMVADGKVAGGMIPKVECCVHALAQGVHTASIIDGRVPHSLLLEILTDEGTGTMITG

SEQ ID NO: 58614 - protein, 254 aa, Bartonella quintana str. Toulouse
MSPNIRPFIAGNWKMNGTVESLGELRAIAAGVSSDLGHLFEALICVPATLLSRASDALSGENLLLGGQNCHFDDCGPYTGDISAFMLKEAGASHVIIGHSERRTVYQESDAIVCAKVQAAWRAGLVALICVGETLEERTSNKVFNVLTRQLEGSLPDGATAENVIIAYEPVWAIGTGNSPTSAVVAEVHDFIRHKMCSRFGDDGRKMRLLYGGSVKPSNAFELLSTVHVNGALIGGASLKAIDFLTICDVYRKL

SEQ ID NO: 58615 - protein, 481 aa, Zea mays
  misc_feature (200)..(200): Xaa can be any naturally occurring amino acid
MVKICCIGAGYVGGPTMAVIALKCPDIEVVVVDISKPRIEAWNSDTLPIYEPGLDDVVKQCRGRNLFFSTDVEKHVAEADIIFVSVNTPTKTRGLGAGKAADLTYWESAARMIADVSKSDKIVVEKSTVPVKTAEAIEKILTHNSKGINYQILSNPEFLAEGTAIEDLFKPDRVLIGGRETPEGRKAVQALKDVYAHWVXPEDRILTTNLWSAELSKLAANAFLAQRISSVNAISALCEATGANVTEVAYAVGKDTRIGPKFLNASVGFGGSCFQKDILNLVYICECNGLPEVANYWKQVIKINDYQKSRFVNRVVSSMFNTVAGKKIAVLGFAFKKDTGDTRETPAIDVCKGLLGDKAQISIYDPQVTEDQIQRDLAMNKFDWDHPMHLQPTSPTAVKQVSCVWDAYEATKGAHGLCILTEWDEFKTLDYQKIFDNMQKPAFVFDGRNIVDSEKLREIGFIVYSIGKPLDAWLKDMPAVA

SEQ ID NO: 58616 - protein, 447 aa, Physcomitrella patens subsp. patens
MGNLRWPYFDPDYETTFSSFNPPKVTVETEANENATVVKVYSANRHGILLNVVQVLTDLDLTITKSDIFHDLGWFMDVFHVVDSNGNKTLDKRTCDHILKVRHTLPHSSAAAIYHLRRSTGLTCSEHTVIELTGPDRPGLLSEISAVLTRLECNVNGAEVWTHNQRVASIIYFNDINTGRPITAQSKLDHIRGQLSKVMKGDHDEEVARCKIEYATEITHVERRLHQLMYDDRVNEVPHVSGNPQQRPVIQIKRNERGYSVVSIQCKDRSKLLFDIVCTLTDMQYVIYHALINSPGPETSQEFFIRHVNGCTLDTADAEHLKVCLEAAINRRTSEGLRLELCMSDRIGLLSDVTRLFRENGLSVARADITTRDDKAVNVFYVVDASGSPVNMNVVETMRKSLGHSILEVKGLPRPEPELPSSKLSLGGLFRNFYGLTNMTWRSTATV

SEQ ID NO: 58617 - protein, 607 aa, Ashbya gossypii ATCC 10895
MPPVFTSKAKREAIKAERDAKRASSGKPTTARRTKKKDGDDADLAADEIAKLKLQQDKDGISDRVVTGVLDSLETSRDVKMSSVSLLFHGKVLIQDSQLELNYGRRYGLLGENGCGKSTFLKAIASREYPIPENIDVYLLDEPAEPSEYSALEYVVREAQNELKRLEDLVEKILLEDGPESELLDPLYEKMDSMDPSTFESRAAIILIGLGFNAKTINRKTKDMSGGWKMRVALAKALFVKPTLLLLDDPTAHLDLEACVWLEEYLKRFDRTLVLVSHSQDFLNGVCTNMLDMRLQKLTAYGGNYDSYVKTRSELETNQMKQYHKQQEEIAHIKKFIASAGTYANLVKQAKSRQKILDKMEADGLIQAVVADRVFSFRFPEVERLPPPVLAFDEISFSYDGNPENNLYEKLNFGVDMDSRTALVGPNGVGKSTLLKIMTGELTPHGGRVSRHTHVKLGVYSQHSQDQLDLTKSALEFVRDKYAHISEDFQFWRGQLGRYGLTGEAQTAQMATLSEGQRSRVVFALLALEQPNVLLLDEPTNGLDIPTIDSLADAIDAFNGGVVVVSHDFRLLDRIAKDIYVVENKTATRWDGSILDYKNKLAKNVVL

SEQ ID NO: 58618 - protein, 422 aa, Bartonella quintana str. Toulouse
MTIIVDIIGREILDSRGNPTVEVDVHLENGIVGRAFVPSGASKGAHEAVELRDGGIRYQGKGVERAVAAVNGEILEELVGRDARNQIAIDQAMIALDGTPNKARLGANAILGVSLAVAKAAAESLCLPLYRYIGGTQAHVLPTPMMNIINGGVHADNSIDFQEFMIIPVGASTLKEAVRYGAEIFHMLKKRLKDAGHNTNVGDEGGFAPQFKSAEQAIDFIMESIITCGYKPGEQIALGLDCASTEFYKNGSYFYKGEGKCRNTQEQVDYLAQLVKTYPIITIEDGMAEDDWEGWKLLTDSIGKQCQLVGDDLFVTNSARLRDGIKMGAANSILIKMNQIGTLSETLDAVETAHRASYRAIISHRSGETEDSFIADLAVATNCGQIKTGSLARSDRLAKYNQLIRIEEMLGAQACYAGNWHC

SEQ ID NO: 58619 - protein, 474 aa, Oceanicola granulosus HTCC2516
MAEAKGKITQVIGAVVDVQFDDHLPAILNALTTDNNGKTLVLEVAQHLGENTVRTIAMDATEGLVRGGVVTDRGEPISVPVGNATLGRILNVVGEPVDEKGPISADERRPIHAPAPDFAQQSTEAEILVTGIKVVDLLAPYSKGGKIGLFGGAGVGKTVLIQELINNIAKVHSGFSVFAGVGERTREGNDLYYEMIEGGVINPDNLEESKVALVYGQMNEPPGARARVALTGLTLAEQFRDQSGTDVLFFVDNIFRFTQAGSEVSALLGRIPSAVGYQPTLATDMGALQERITSTRSGSITSVQAIYVPADDLTDPAPATSFAHLDATTTLNRAISELGIYPAVDPLDSTSRLMDPQIVGEEHYQVARDVQGILQRYKSLQDIIAILGMDELSEEDKLTVARARKIQRFLSQPFDVAKVFTGTDGVQVPLEETIASFKAVVAGEYDHLPEAAFYMVGGIKDAVAKAERLAASAA

SEQ ID NO: 58620 - protein, 229 aa, Arabidopsis thaliana
MEAEVEEEEEDMFEDAVCTTQARVNTPLSVITEAFEDLADLVKPQRSDEIDEDELRLDDFCSACTHVSVLFNCLGFAFKFAEMEYIAKVKDLVEASKTFETLHNILDLDVEKETVKTPGSHSRNLRRVRQGLDLIRAIFEQFLIADDYSLKDAATTAYTEVCAPFHTWAVRTAVYAGMYTLPTRDQLLLRLNETDQSVEKNMRRYMEASRPIIEYIDKLYIERNIKLDW

SEQ ID NO: 58621 - protein, 556 aa, Rubrobacter xylanophilus DSM 9941
MSRSIPRDIRQYPFDLIVIGAGINGAGIARDAAMRGLRVLLLDKGDISDGTTQWSTRLIHGGLRYLEYYEFGLVRESLREREILLHIAPHLVRPLGFLVPVYERSKRGPRTIRLGMIAYDLLSFDKSLENHRMFSAREALEREPGLNPEGLLGAAFYYDAQAEYAERLAVENALSAARHGAVVLTYARVERLLQEGGSVVGVEFADLLGGGRHTARAPVTVNVAGPWVDEVLRGGGYGGPRLIGGTKGSHIVVDPFPGAPREEALYVEARRDGRPYFIVPWNGRYLIGTTDLRYEGDLDHVEATEEEIEYLLDETNHVIPGANLSREDVLFTYSGVRPLPYQPEGEAGSITRRHIIHDHARDERPTGGLVSIVGGKLTTYRNLARQTVNLVYEKLRLPDPGCRTDRIPLPGGLADDFAAFAADFKATSGLSEELAGRLLRVYGTRAPEVLECAGDDASLRMPLSSRASLPTGLIGAEVVYAFRREMAQTLADVLLRRSMAGMGPRVALDVDEAAAEVARKHLGWSEERAAEEVRRYREFVRRYHPKDFRRRKAVNV

SEQ ID NO: 58622 - protein, 329 aa, Ashbya gossypii ATCC 10895
MSELKVDTGRLSHIANSGPMSILAYCASSILMTVTNKCVVGSDKFNMLFVMLFAQSLVCVTALVLLKALGYVQYRPLNKVDVKNWLLISVLLVLMTYTSSRALKYLAVPIYTIFKNLTIILIAYGEVLFFGGRVTAMELSSFLLIVLSSVVATLADQQALSKKPLAAAVESILGLNVGYFWMFTNCICSALFVLIMRKRIALTKFKDFDTMFYNNILSLPLLMLASFMFEDWGAANIARNLTKDYIIIMIISGLASVGISYCSGWCVRVTSSTTYSMVGALNKLPIALSGLLFFDAPKNFLSIFSIFLGFLSGIVYAVAKQKKQSQPAN

SEQ ID NO: 58623 - protein, 450 aa, Rhodopirellula baltica SH 1
MPIGRNRLPSLYDSAHRNWPTKPVPDDKEATMSMEPVTAWALLSGLIFLLAALGRGPMRRWPVSMPAIYLLIGAAIGPWGLRLLDFQLIKHVKVVESVTEVAVLISLLTAGLQLKPRWHHYLRAPIPLASVTMVVTIAGVAMVGTMLLDLPLGAAILLGAVLAPTDPVLASDVQVKHHDDTDRLRYALTGEAGLNDGAAFPFIMLGLGLLGHHQLGEYGWRWITVDLLWATTAGLGIGWLSGYSVSRVAVWIKRQTNSPAACEEALTLGLIGLSYGAALLLHAYGFLAVFAAGVAMRRYAERQSDDEQPDKLMHTVTEVNDQFGHIVEVAVVVLVGALATSYWTMASDWWIAMLVFFLFRPIGVLLALAVKDIRFSQKILISLFGIRGIGSLYYLSYAISHGLEDPIANRLAGIVLTTITLSIVIHSNVASLMMRRYAEEKDDKTSAATN

SEQ ID NO: 58624 - protein, 442 aa, Triticum aestivum
MATRHNQQNAAAAPQPAANRGAAVPAGKQKDAAAAGGRPGAGGNRRVLGDIGNVVHAHVLDGKIQLPAGINRPITRSFGAQLLQKAQADPSKNGVAVPPAARAGLKPVAKKVPVKLKPAAPRPEPAAKIVTGSGENRKPSEVAAVCSAPRKKVVHTLTTVLSHRSKEASIDDIDKLDGDNELAVVDYIDDIYRYYKEAQHECRPIDYMGSQPEINPKMRAILIDWLVEVTHKFELMPESMYLTMYVIDRFLSLQAVPRRELQLVGMAAMLISCKYEEIWAPEVDDFISIADYSYSRQQILSMEKNILNSMAWNLTVPTPYVFLVRFAKAAGSDKELEHMIFFFAEMALMEYGLVTVRPSLVAAFAVYAARCTLKRSPIWTETLKHHTGFAEPQLLEPAKVLVMAHAAAPECKLKAIYKKYSSEQYGRVSLRPPAVAAPQRLA

SEQ ID NO: 58625 - protein, 411 aa, Glycine max
MYKNQLQELAQRSCFNLPSYTCIREGPDHAPRFKATVNFNGEIFESPHYCSTLRQAEHSAAEVALNSLSNRAPSHSLAARILDETGVYKNLLQEIAQRVGAPLPQYFTFRSGLGHLPVFTGTVELAGIMFTGEPAKNKKQAEKNAAMAAWSSLKQLAKETARSSTEPENNDELEQITIARALLNYRLKEKISMSNSNAPVPFPKKFQIQNPRPTSPQPPPATTSKILPLICQKGAHRSRHLVAASPAPASSDNSVMPQLPATPDSRGIRRPKFPAAGAAPYVPIRQMRPCQGMAPPVTIRTAIPVFSPPPPPAAAAVSHQVLRAPHVRVAPPVTIRQAVPVFAAPPPPVRKDEPVPIPKDEPVAVPKDDSPTISAPSLEDKLPTKTPETETKTENIPPEPETVQSLEQLKI

SEQ ID NO: 58626 - protein, 308 aa, Prochlorococcus marinus str. MIT 9312
MVKPNKLANNNYLSSFDMTTDEFINILDLAKNFKNKKINIDPNNKVLGLIFDKSSTRTRVSFQVAMSRLGGTTIDLNPITSQIGRGEPIKDTARVLSRYCDVIAIRTFNHSDLEEYAKWSTIPVINALTDLEHPCQALADFLTIQEEFIDFRNVVLTFIGDGNNVANSLILCGALLGVEVRIACPRGYEPNVSVINKALEIYKNKNLLKIIHDPYDAVLGANVLYTDVWSSMGEENQKEDKDKDFKGFTINSSLVRKANKDAIILHCLPAYRGKEISAEVFESKISRIFKQAENRLHVQQALLAGLLS

SEQ ID NO: 58627 - protein, 521 aa, Zea mays
MQFSSVLPLEGKACMSPVRRGSGGYGSERMRINCCSIRRNKALRRMCFSARGAVSSTQCVLTSDAGPDTLVRPNHPFRRNYADPNEVAAVILGGGTGTQLFPLTSTRATPAVPIGGCYRLIDIPMSNCFNSGINKIFVMTQFNSASLNRHIHRTYLGGGINFTDGSVEVLAATQMPGEAAGWFQGTADAVRKFIWVLEDYYKHKAIEHILILSGDQLYRMDYMELVQKHVDDNADITLSCAPVGESRASDYGLVKFDSSGRVIQFSEKPKGAALEEMKVDTSFLNFATCTLPAEYPYIASMGVYVFKRDVLLDLLKSRYAELHDFGSEILPKALHEHNVQAYVFTDYWEDIGTIRSFFDANMALCEQPPKFEFYDPKTPFFTSPRYLPPTKSDKCRIKDAIISHGCFLRECAIEHSIVGVPSRLNSGCELKNTMMMGADLYETEDEISRLLAEGKVPIGVGENTKISNCIIDMNCQGWKERLHNKQRGRSKSPDRPGRRILIRSGIVVVLKNATIKDGTVI

SEQ ID NO: 58628 - protein, 182 aa, Magnetospirillum magnetotacticum MS-1
MFIQTEPTPNPATLKFLPGTVVMGQGTADFAEASRASGSPLATRLFAIEGVGSVFLGTDFITVAKADSADWQVVKPQVLAAIMDHYNSGDPVINPGSEAASASGDDDGIVMQIKELLDTRVRPAVAQDGGDIIFRAFEDGIVYLHLQGACSGCPSSSATLKHGIENMLKYYVPEVMAVQAVD

SEQ ID NO: 58629 - protein, 374 aa, Synechocystis sp. PCC 6803
MPLDNGSITDDTRIRAALPTIKDLLSKGAKVILGSHFGRPKGKVVDSMRLTPVGDRLGELLGQPVVKCDDCIGAEVTAKIASLPNGGVALLENLRFHAGEEGNDAEFAKALAANADLYVNDAFGTAHRAHASTEGVTHFLSPNVAGYLIEKELQFLQGAIEAPKRPLVAIVGGSKVSSKIGVIETLLDKCDKLIIGGGMIFTFYKAQGLNTGKSLVEEDKLDLAKSLMAKAKEKGVEFLLPTDVVVADNFAPDANAQTVGVDAIPDGWMGLDIGPDSVKTFQDALAGCGTVIWNGPMGVFEFDKFAVGTEAIACSLAELTASGTVTIIGGGDSVAAVEKVGVAEKMSHISTGGGASLELLEGKVLPGIAALDDR

SEQ ID NO: 58630 - protein, 296 aa, Fulvimarina pelagi HTCC2506
MFEQSLAQTAELVEGRLSEILSGHDRVARGAPERLLAAMRHGTLGGGKRLRPFLLIESARIFGIQDDAVLDIACALEAIHCYSLVHDDLPAMDDDDLRRGRPTVHKAYDDATAILAGDSLLTLAFGLVAGASKIPPEARVRIAALLSADAGAGGMAGGQALDLAAEQSALSEDEIARMQAMKTGALIAFACEGGAIAAAASSEDQRRLRRFGEIIGLAFQLADDLLDETADAAQLGKAAGKDRARGKKTLPALKGIEWTRNRLAALVAEAESELAPFGDKATVLLEAARFIASRDR

SEQ ID NO: 58631 - protein, 370 aa, Methanococcoides burtonii DSM 6242
MSGRGFAQRVLDIDISGIRKMFEAAGSDAVNLGLGQPDFDTPGHIRQAAIDAINEGFTGYTYGAGIVELREALSQKFREQNGFEVSPDGIIVTSGASEALEIAIAALIDPGDEIIISDPGFVSYNALAGFMGGKVVGVPLGDDLTMRPENVMESITPKTKAVIVNSPCNPTGGVLSKSDIKAYAEIADDNDITLISDEVYEHFLYEGEHVSPAKFTDNVITVNAFSKTYAMTGWRVGYTAASQEYTNQMLKVHQYVQACANSIAQKAALAATTGPQDFVYMMRDEFKSRRDVLVEGVNALGMECEAPKGAFYMFPKVENSTEVATKLVANGVVVVPGTAFGKNGDGYIRMSYATSMDEIKRALKIMEKVL

SEQ ID NO: 58632 - protein, 332 aa, Trichodesmium erythraeum IMS101
MVGKISQADKRKEVIRTLESAYPISTEKANLAILGVGAWGSALAGLVSHNQHKISLWSRNLNISLEQVIKDVDMIVSAISMKGVNETIEKIQKIGLPKKVIIITATKGLDPETTCTPSQIWEANFPNNPVVVLSGPNLSKEIDDKLPAATVVASKNIEAVTAVQNIFASGLFRVYSSSDPIGTELGGTLKNVIAIASGVCDGLELGTNAKSALLTRALTEIIRIGTHLGGKTETFFGLSGLGDMLATCSSSLSRNYRVGYGLAQGKNLEEILEELPGTAEGVNTTNVLINIANREEISLPISSQVFLLLNGKITLEEAVEALMGRDLKSEFY

SEQ ID NO: 58633 - protein, 128 aa, Brassica napus
MEGRLANMWRLTVNESKFVETALQSELRVDGRGLYDYRKLTIKFGKEYGSSEVQLGHTHVMGLVTAQWVQPYKDRPNEGSLSIFTEFSPMADPSLEPGRPGEYAEGLGRIIDRGLRESRAVDTESPRV

SEQ ID NO: 58634 - protein, 374 aa, Pseudomonas fluorescens Pf-5
MAKRDYYEVLGVERGSSDAELKKAYRRLAMKHHPDRNPGDKASEDMFKEANEAYEVLSDSSKRAAYDQYGHAGVDPSMGGGGGGFGGQNFSDIFGDVFSDFFGGGRGGSRGGAQRGSDLRYTLELNLEEAVRGTTVNIRVPTLVNCKPCDGSGAKKGSSPVTCPTCGGIGQVRMQQGFFSVQQTCPRCHGQGKIISDPCDSCHGEGRVEEYKTLSVKVPAGVDTGDRIRLSGEGEAGTQGGPTGDLYVVINVREHAIFQRDGKHLFCEVPISFVDAALGGELEIPTLDGRVKLKIPEGTQTGKQFRIRGKGVAPVRGGGAGDLMCRVAVETPVNLSRRQRELLEELRGSLDDDNSHSPKTTGWFEGVKRFFGDL

SEQ ID NO: 58635 - protein, 641 aa, Oryza sativa Indica Group
MLSARAAATAAAAAAAASPLWKRGEGGSSGSGSGCTSCREVRRRAAAVRVRAAAPRRVEAVAMESAAETEKEEEVAAAGGGVEDMATEEVPVTPWAFSVASGYTLLRDPHHNKGLAFSEKERDAHYLRGLLPPAVVSQDLQVKKIMHNLRQYSVPLQRYMAMMDLQERNERLFYKLLIDNVEELLPVVYTPTVGEACQKYGSIFRQPQGLYVSLKDKGKVLDVLRNWPERNIQVIVVTDGERILGLGDLGCQGMGIPVGKLSLYTALGGVRPSACLPITIDVGTNNEQLLNDEFYIGLRQRRATGKEYHELMEEFMSAVKQIYGEKVLIQFEDFANHNAFDLLAKYSKSHLVFNDDIQGTASVVLAGLLSSLKVVGGTLAEHTYLFLGAGEAGTGIAELIALEISKQTKAPIEECRKKVWLLDSKGLIVNSRKESLQAFKKPWAHEHEPVTTLLDAVQSIKPTVLIGTSGVGKTFTKEVIEAMASFNERPVIFSLSNPTSHSECTAEEAYNWSQGRAVFASGSPFDPVEYNGKIHVPGQSNNAYIFPGFGLGVVISGAVRVHEDMLLAASETLADQATQENFEKGSIFPPFTNIRKISARIAASVAAKAYELGLATRLPQPRDLEKYAESCMYTPVYRSYR

SEQ ID NO: 58636 - protein, 95 aa, Sonneratia alba
GTIFHRNIKGFMIQGGDPTGTGKGGTSIWGKKFNDEIRESLKHNARGILSMANSGPNTNGSQFFITYAKQPHLNGLYTVFGRVIHGFEVLDLMEK

SEQ ID NO: 58637 - protein, 486 aa, Bartonella quintana str. Toulouse
MANLYDVIVIGSGPGGYVTAIRAAQCGFKTAIVEREHLGGICLNWGCIPTKALLRSAEIKHFSEHVKDYGLKINGSIEADIKDVVARSRRVSARLNAGVGFLMKKNKIDIIWGEAKLTKKAKESQLAEIMVSSSSKPVMQPQNSVPKETLGEGTYQAKHVIIATGARPRSLPGIEPDGKLIWTYFEAMIPHTIPNSLLVMGSGAIGIEFASFYHGMGAEVTVVEMMPHIMPTEDIEISAFARRQLEKKGIRILSQAKVTRVEKASNSVTAHIDVNGKIETITVDRLISAVGVQGNIENLGLEALGIRTDLECIVTDEWGWTGVKGIYAIGDVAGPPMLAHKAEKEGVICIEHLAGLKNAHPLDKKKIPGCIYCTPQVASVGFSEAAAKEAGYDIRVGRYSFSANGKAIALGEDQGLVKTIFDKKTGQLLGAHMVGAEVTELIQGFVIAMNLETTEEELIHTVFPHPTLSEMMKESVLDAYDQVLNA

SEQ ID NO: 58638 - protein, 378 aa, Pseudomonas fluorescens Pf-5
MTKPAILALADGSIFRGEAIGADGQTVGEVVFNTAMTGYQEILTDPSYAQQIVTLTYPHIGNTGTTPEDAESDRVWSAGLVIRDLPLVASNWRNTLSLSDYLKANNVVAIAGIDTRRLTRILREKGAQNGCIMAGDNISEEAAIAAARGFPGLKGMDLAKVVSTKESYEWRSTVWDLKTDSHATIEASELPYHVVAYDYGVKLNILRMLVERGCRVTVVPAQTPASDVLALKPDGVFLSNGPGDPEPCDYAIKAIKEILETEIPVFGICLGHQLLALASGAKTLKMGHGHHGANHPVQDLDSGVVMITSQNHGFAVDEATLPGNVRAIHKSLFDGTLQGIERTDKSAFSFQGHPEASPGPNDVAPLFDRFINEMAKRR

SEQ ID NO: 58639 - protein, 385 aa, Staphylococcus aureus subsp. aureus Mu50
MYYHQPLLLTPGPTPVPDAIMREIQAPMVGHRSKDFEDIAQQAFQGLKPIFGSQNDVLILTSSGTSVLEASMLNIVNPEDHFVVIVSGAFGNRFKQIAQTYYKNVHIYDVTWGEAVDVKDFINYLSTLDVEVKAVFSQYCETSTTVLHPIHELGNAINQFNSNIYFVVDGVSCIGAVDVDINKDKIDVLVSGSQKAIMLPPGLAFVAYSHRAKERFKEVTTPKFYLDLNKYISSQADNSTPFTPNVSLFRGVNAYVETVKAEGFNHVIARHYAIRNALRSALKALDLTLLVNDKDASPTVTAFKPNTNEVKIIKDELKNRFKITIAGGQGHLKGQILRIGHMGKISPFDILSVVSALEIILTEHRKVNYIGKGISKYMEVIHEAI

SEQ ID NO: 58640 - protein, 173 aa, Synechocystis sp. PCC 6803
MAKRRKTSREKKEDTNWQERVIQIRRVSKVVKGGKKLSFRAIVVVGNETGQVGVGVGKAGDVIGAVRKGVADGKKQLIEVPLTKSNSITHITNGVSGGAKVVVRPAAPGTGVIAGGAVRTVLELAGVKNILAKQLGSNNPLNNARAAINALETLRTFSEVAEERGVSVEHLYT

SEQ ID NO: 58641 - protein, 391 aa, Bartonella quintana str. Toulouse
MLAAGRGKRAGSLQKNPKQYRLLGQKPVICHTVRCFCQHPAITTIILVIHPEDRQICEQAITDFKEHLIIVEGGNTRQISTLRGLHALKKFKPKYVHIHDGARPFIENKLLEKIHTTVNHQEGVLPVLPVSDTLKRVNSTHRVLETIPHTHLYSAQTPQCFPFERILAAHERAMQTCKKEFTDDSAIAEWFGIPMHTIPGDSHNIKITWHEDFDTAHLYLKKKMQMFPDIRTGNGYDVHSFEEGTSLILCGIKIPFHKKLKGHSDADVAFHALTDALLATQGAGDIGTHFLPSDPQWKNAPSEIFLRHALEIIKQAGGRIANVDITLIAETPKIGPYRHTMTENLMNILSLSLDRISIKATTNEKLGFIGREEGIAALATATVLYPGEIPK

SEQ ID NO: 58642 - protein, 477 aa, Humulus lupulus
TLPNTLVMGIPLLKGMYGNFSGDLMVQIVVLQCIIWYILMLFLFEYRGAKLLISEQFPDTAGSIVSIHVDSDIMSLDGRQPLETEAEIKEDGKLHVTVRRSNASRSDIYSRRSQGLSATPRPSNLTNAEIYSLQSSRNPTPRGSSFNHTDFYSMMASGGGRNSNFGPGEAVFGSKGPTPRPSNYEEDGGPAKPTAAGTAAGAGRFHYQSGGSGGGGGPHYPAPNPGMFSPNTGGGGGTAAKGNAPVVGGKRQDGNGRDLHMFVWSSSASPVSDVFGGGGGNHHADYSTATNDHQKDVKISVPKGNSNDNQYVEREEFSFGNKDDDSKVLATDGGNNISNKTTQAKVMPPTSVMTRLILIMVWRKLIRNPNSYSSLFGITWSLISFKWNIEVPALIAKSISILSDAGLGMAMFSLGLFMALNPRIIACGNRRAAFAAAMRFVVGPAVMLVASYAVGLRGVLLHVAIIQAALPQGIVPF

SEQ ID NO: 58643 - protein, 210 aa, Bartonella quintana str. Toulouse
MSNPMKTALSLVPMVIEQTNRGERAYDIFSRLLKERIIFINGPVEDSMAMLVCAQLLFLEAENPKKEISLYINSPGGVVTSGMAIYDTMQFIRPPVSTLCMGQAASMGSLLLTAGAKGHRFTLPNARIMVHQPSGGFQGQASDIERHAQDIIKMKRRLNEIYVQHTGQDYEVIERTLDRDHFMTAEEAKQFGLVDDVIQYRAETEKEEKD

SEQ ID NO: 58644 - protein, 242 aa, Petrotoga miotherma
MGDPQGFLKYERKNPEERPPKMRINDWEELYIEMEKDELRIQAARCMNCGTPFCHSGILINNMVSGCPLNNLIPEWNDLAYRNLWREAYERLIETNSFPEFTGRVCPAPCEKACVNNLVKDPVSIKSIEYYIIEEAFKNGWVEEDKPSYSTGKKVAVVGSGPAGLSCAWELNRYGHEVTVFEKNEYPGGLLTYGIPNMKLDKKIAKRRIELMGKSGIQFKTNVNVGKDYPVQKLKEEFDAVT

SEQ ID NO: 58645 - protein, 528 aa, Oryza sativa
  misc_feature (437)..(437): Xaa can be any naturally occurring amino acid
MQGANMLLDEPVRLTSVLTPVKPKVFPSLTKIVGTLGPNSHSVEVIQECLTAGMAVARFDFSWMDASYHQETLNNLRKAAQNVNKLCPVMLDTLGPEIQVHNSTGGPIELKAGNHVTITPDLSKAPSSEILPIKFGGLAKAVKKGDTLFIGQYLFTGSETTSSWLEVVETSGENVECLVTNTATLAGPMFTLHVSKAHVSLPTLSDYDKEVISTWGLHNSVDIISLSHTRSAEDVRELRSFLQSHGLQDTQIYAKVENTEGLDHFDEILQEADGVIISRGDLGIDLPPEDVFISQKTAIKKCNLAGKPVIITRVVDSMIDNLRPTRAEATDVANAVLDGTDGILLGAETHRGPYPVDAVSTVGRICAEAESVYNQLVHFKKLVKHVGDPMPHEESVASSAVRTAMKVKAAAIVVFTFSGRAARLVAKYKPPMPVLAXVVFPREGSDPTKWRSYGTTQARQCFAARGVYPLMASTEEAETGGLTREEYGIKLAQNYGRSVGMLKPYDRLIIFQKIGDSSVVKIIECDSS

SEQ ID NO: 58646 - protein, 333 aa, Synechocystis sp. PCC 6803
MLKMLKNLPLPKNITWRSVWMRGTSVVIIFVLAFTLVFTPTFEAEARRSGGRIGGGSFRAPSAPSRSYSGPSGGSYRSGGTYGGGGFGFPFIIPFFGFGGGFGGIFGILVMIAIANVVINAIRNGGGSSGEGGGGLAASSDPQVGIAQIQVGLLASAKELKKELDELALSADTGTANGRSLVLQEATLALLRHPEYWVYGSSQSDKVRLSAAEAAFNQLALTERSKFTDETLSNFNNQLRQGGRATAIGGDSPDAVPDGAGEYILVTIIAAALGNLNLPAVNDSSQLKQSLQTLGGISSDRLLAIEVLWTPQEEGDTLTSNDIISEYPELRLV

SEQ ID NO: 58647 - protein, 155 aa, Zea mays
MSIEKIWAREILDSRGNPTVEVDLHTAKGLFRAAVPSGASTGIYEALELRDGDKQRYLGKGVLKAVDHINTTIAPVLISSGLSVVEQEKLDNLMLDLDGTENKSKFGANAILGVSLAVCKAGAAERELPLYRHIAQLAGNSDLILPVPAFNVING

SEQ ID NO: 58648 - protein, 445 aa, Wolinella succinogenes DSM 1740
MNIAVIGTGYVGLVSGTCFAEMGNSVICVDVDHQKIEKLKQGIIPIYEPGLEEMVLENHKKGDLLFTTSLKEALKSAEVAFIAVGTPMGEDGSADLQYVLAVAREIGEGMDRYLVVVDKSTVPVGTADLVKETILAAQKARGVEIPFDVVSNPEFLKEGDAINDFMKPDRVVVGAESARAMEKMRELYAPFTRSHDRFIAMGVRSAEMTKYAANAMLATKISFMNEISNICEATGADVNDVRVGIGSDKRIGYSFIYPGCGYGGSCFPKDVKALEKIALEHGITPRVIGAVEEVNREQKKVLVRKITARFGENLQGKSFGIWGLSFKPETDDMREASSIVLIKELLARGATIKAYDPKAMEEARHFYLKEHPEILYTSNKYDALNGASAMVLVTEWKEFRSPDFYEIKNRLLEPVIFDGRNQYKKERLGEMGIEYHQIGVAIHRT

SEQ ID NO: 58649 - protein, 167 aa, Prochlorococcus marinus str. MIT 9312
MNDFTPKFRIGNGYDIHRLVTGRKLIIGGVNLKHPDNLGLDGHSDADVLTHSIMDALLGALSLGDIGKYFPPSDDKWKDVDSLILLSKVIDLVRKQGWEINNIDSVLVAERPKIKPFVEIMKKNLSNTLKIDNSFIGIKATTNEKLGPEGREEGISCHSVVLLEKKE

SEQ ID NO: 58650 - protein, 309 aa, Vibrio vulnificus YJ016
MKTIAVIGSNMVDLISYTDRMPKEGETLEAPSFKMGCGGKGANQAVAAAKMGADVVMVSKVGDDMFADNTIRNFQSYGINTQYVSKVPQTSSGVAPIFVNSTSQNSILIIKGANEFLKPDDIDKAESTLVECSLIVLQLEVPLETVYAAIEFGNKHSIPVLLNPAPAVPELDIEYACRCDFFVPNETELEILVNKPVETVEQIKEAATILLNKGLNNIIVTMGSKGALWLSKDGKDVFIEPTKVNAVDTSGAGDAFIGCFSHYFMQTGDVQKSLEKASLFAAFSVTEKGTQFSYPSIEQFEEFETKHSK

SEQ ID NO: 58651 - protein, 363 aa, Triticum aestivum
MGEASSPAIAKDVTELIGNTPLVYLNKVTDGCVGRVAAKLESMEPCSSVKDRIGYSMITDAEEKGFIVPGKSVLIEPTSGNTGIGLAFMAAAKGYRLVLTMPASMSMERRIILKAFGAELVLTDPLLGMKGAVQKAEELAAKTPNSYILQQFENAANPKIHYETTGPEIWKGTGGKIDGLVSGIGTGGTITGSGKYLKEQNPNIKLYGVEPTESAVLNGGKPGPHKIQGIGAGFIPGVLDVDIIDETIQVSSDESIEMAKSLALKEGLLVGISSGAAAAAAIKVAQRPENAGKLFVVVFPSFGERYLSSVLFHSIKKEAREHGGRVTLGTPQAREAVLQSQIPPFVGALLTEIKALASLLVLV

SEQ ID NO: 58652 - protein, 526 aa, Oryza sativa
MASESESNGHHHAGDEARAENSGAGCLHGGDDGGGTPRTTPEIRYTKLFINGRFVDAASGKTFETSDPRTGDVIARVAEGDKEDVDLAVKAAREAFDHGEWPRMSGSERGRVMAKYAEVVERHADELAALESLDAGKPLAAARAVDVGECVGILRYFAGAADKIHGETLKMSRQLQGYTLREPLGVAGLIVPWNFPAIMFFSKVSPALAAGCTVVVKPAEQTPLSALFLAHLSKQAGVPDGVINVVTGFGPTAGAAISSHMDVDVVAFTGSTEVGRLIMEASAKSNLKPVALELGGKSPFIVFDDADLDKAVELAIGGNFFNKGEACVAGSRVFVQEGIYDRFEQKLADTMKSWVVGDPFDPRVNQGPQVDKAQYERVLGYIEQVKAEGATVLTGGKPCGKKGYYIEPTIFTNVKDDMVIAREEIFGPVMCLMKFKTVEEAIERANGTRYGLAAGLVTRDIDVANRMARSIRAGVVWVNCYFAMDRSCPFGGRKMSGFGKDDSMHALDKFLAVKSVVTPVHGSPWF

SEQ ID NO: 58653 - protein, 297 aa, Bordetella petrii
MTTGKDTIGMIGVGLMGHGIASNIVKHGYPLVLLDHPGNQPVDGLLTAGAAKVASPAQVARQANVVILCVTGTPQVEDVLFSPDGLLQGLRPGTVVIDCSTAIPSSTVRIAQAVAEAGGQFLDAPMTRTPKEAAEGRLNLLVGGDRALYERCQPLLRCYAENITYAGPVGSGHRMKLIHNYVSLGCAAIIAEAAACAKRAGIEAQVLVDILAKGGGGGAALERMRPFLESGDDSGLRFSLSNARKDLDYYTTMAHEAGAAHGAADAIEQLFERGAQATPPQTTVPHLVTLLATDGAL

SEQ ID NO: 58654 - protein, 340 aa, Bordetella petrii
MHVRLKKLHDQVIVITGAGSGIGLATARLASRQGAKVVLACRSQQSLDDAVAAIRAEGGEALAVRADVGVAADHDRILGAAIDQYGRIDTWVNNAGVSIFGRLEDVPIEDQRKLFDTNYWGVVYGSTTAVAYLKQHGGALINVGSEVSDRAIPLQGAYSASKHAVKGYTDALRMELEAEAAPVSVTLIKPASIATGYSEHARNYMDVEPRLPPPVYTADTVARAILYAAQHPRRDIFVGGAAKAISSVGLRMPALADRMAGWLIRHQRSDTAARERADALYDAGAPARGDTARDGAGPPHVRKTSMYTQLATGGRGLLWAGAAVLVCGTVIGAARGRRWH

SEQ ID NO: 58655 - protein, 336 aa, Photobacterium profundum SS9
MKVLVTGGMGYIGSHTCVQMINAGLEPIILDNLSNSNSAVLERVHALTGVTPLFYEGDVRNQTILSQIFSEQKIDSVIHFAGLKAVGESVEKPLEYYDNNVHGTLVLVDEMAKANVKSLVFSSSATVYGDPSEMPINESTPTGDVTNPYGRSKYMVEECLRDIHFADPTWSITLLRYFNPVGAHPSGSMGEDPQGIPNNLMPFIAQVAVGRREYLSVFGDDYPTPDGTGVRDYIHVMDLSDGHVAALNVVGQQSGLHIYNLGTGQGSSVLEMVNAFSLACGHDIAYKICPRRSGDIAECWANTQKAEQELGWKARYKVADMAQDTWRWQSENPQGY

SEQ ID NO: 58656 - protein, 251 aa, Pseudomonas fluorescens Pf-5
MRRPMVAGNWKMHGTRASVAELINGLRHLALPSGVDVAVFPPCLYINQVIDGLKGKSIQVGAQNSAVESMQGALTGEIAPSQLVDAGCSLVLVGHSERRLIMGERDATLNRKFAAAQACGLKPVLCVGETLEQREAGKTLEVVGRQLGSIIEELGVGAFANAVIAYEPVWAIGTGLTATPQQAQDVHAAIRAQLAAENSEVARGVRLLYGGSVKAANAVELFGMPDIDGGLIGGASLNADEFGAICRAAGN

SEQ ID NO: 58657 - protein, 404 aa, Candida albicans SC5314
MRKCKIFVGSSHPELGQLVCDRLGVEPAPCTLKKFSNGETSVQIGVSVRDEDVYIIQSGSPHINDHIMELLILISACRGGSANKITAVIPQFPYSKQSKMKKHRGAITARMLANLLVMAGADHVVSMDLHASQMQGFFSKPVDNLFGAPTLARWIRHHIPDWENAVVVSKNPGGTKRVTALADSLKINFAMIHTDRRRTQDEYAKKKELKQAQIIEEGEDNIVSELQTARVVQGHVVDDDYQANGTSEHLAKEGILDSDVLGGTYDATGSDDEDETTTSSEEKLITLVGDVKDKVAIILDDMIDKPNSFIAAAEHLRLNCGAKAVYVVGTHGVFNDKCLKDLTDSKCIDKIVVTNTYPISKEQIEKHKDKLVVIDVSPIFAECIRRDHFGESISVLFDSLSSIE

SEQ ID NO: 58658 - protein, 390 aa, Oryza sativa Japonica Group
MSVLTCVLDNMGSSCSRSHSLSEAETTKNAKSADIDRRILQETKAEQHIHKLLLLGAGESGKSTIFKQIKLLFQTGFDEAELRSYTSVIHANVYQTIKILYEGAKELSQVESDSSKYVISPDNQEIGEKLSDIDGRLDYPLLNKELVLDVKRLWQDPAIQETYLRGSILQLPDCAQYFMENLDRLAEAGYVPTKEDVLYARVRTNGVVQIQFSPVGENKRGGEVYRLYDVGGQRNERRKWIHLFEGVNAVIFCAAISEYDQMLFEDETKNRMMETKELFDWVLKQRCFEKTSFILFLNKFDIFEKKIQKVPLSVCEWFKDYQPIAPGKQEVEHAYEFVKKKFEELYFQSSKPDRVDRVFKIYRTTALDQKLVKKTFKLIDESMRRSREGT

SEQ ID NO: 58659 - protein, 325 aa, Triticum aestivum
  misc_feature (85)..(85): Xaa can be any naturally occurring amino acid
  misc_feature (172)..(172): Xaa can be any naturally occurring amino acid
LLASVRNSYAMGKVRMVATEFENAGRLVKNRNAARCAEPGRFVLWQMAPEKWYIELAVGGSKVHAGCNGKLVWRHTPWLGSHAAXGPVRPLRRALQGLDPLTAASMFAGARCIGERKVNGEDCFILKLCTDPETLKARTEGLAEIIRHVMFGYFSQRTGLLVHIEDSHLTRXIQSTTGGDAVYWETTINSFIEDYRPVDGIMIAHSGRSAVTLFRFGEVAMSHTKTRMEEAWSIEEVAFNVPGLSMDCFIPPTDIKSGSVSETVELPHGGEKSKFGSSPWSPRQSCCAGEDGWWRASMEGSPYLKIEIDFQAIGTCFVSLQLTDE

SEQ ID NO: 58660 - protein, 1228 aa, Arabidopsis thaliana
MINLSLYQTNSLSYTIIWMLFVIPSCVLSVDERQKHCSPTFRCGKQTDLYYPFWSPDREECGHPVFKVNCSGDFAEFTISTVKFHVLEMNYESRIIRLVRTEYLNNLCPWHPENRSINQEVLPFLQDTELGTFYYNCSGPTVDELANGYIRQLGCDEEVGGKSYFVSSPSHPGNRAILDGLSASCERNVDIPVSRSAMETTATNQSLEAIKKVLDVGFELGFNSDCSLCVASKGACGFNQSSKAFVCYCKDEPHEHTCGKMGIGVSKKAKIGIGLGCGFLGATLITRRTSHHLRPRDNNLKGLVQLKQYSYAEVRKITKLFSHTLGKGGFGTVYGGNLCDGRKVAVKILKDFKSNGEDFINEVASMSQTSHVNIVSLLGFCYEGSKRAIVYEFLENGSLDQFLSEKKSLNLDVSTLYRIALGVARGLDYLHHGCKTRIVHFDIKPQNILLDDTFCPKVSDFGLAKLCEKRESILSLLDARGTIGYIAPEVFSGMYGRVSHKSDVYSYGMLVLEMIGAKNKEIEETAASNSSSAYFPDWIYKNLENGEDTWKFGDEISREDKEVAKKMTLVGLWCIQPSPLNRPPMNRIVEMMEGSLDVLEVPPKPSIHYSAEPLPQLSSFSEENSIYTEIWMTTRITTICSQKRKFAVMFPHSKTESCEKRDGQCGDITVGFPFWGENRQSDCGHFSLKLNCNKPSNTTSLTISGHNYSVLHIDNKSNILSLSRQDFSGPFCSASFSSTPLRSDLFQNLQPYRNLTVFYMCDPRRHFFGNFTCPVKGLGSVVQNSTYRKLCDKSFSVTVPTSYVPEEEALNLTHLESVLRKGLEVKLKISEMSGQECVTTDGNSGFTRFCCTNVSGPEISCLTSITTMNNGTYSDNRPFLVTIGTAFYLNERRIAKAARIQHLEALGTLRGYNYKQIKKITKSFTEVVGRGGFGTVYRGRLRDGRKVAVKVLKDSKGNCEDFINEVASMSQTSHVNIVTLLGFCYEGSKRAIIYEFLENGSLDQSLNLDVSTLYGIALGVARGLEYLHYGCKTRIVHFDIKPQNVLLDENLRPKVADFGLAKLCEKQESILSLLDTRGTIGYIAPELFSRMYGSVSHKSDVYSYGMLVLEMIGARNKERVQNADPNNSSAYFPDWIYKDLENFDNTRLLGDGLTREEEKNAKKMILVGLWCIQFRPSDRPSMNKVVEMMEGSLDSLDPPPKPLLHMPMQNNNAESSQLSVESSIYSEV

SEQ ID NO: 58661 - protein, 421 aa, Bradyrhizobium japonicum USDA 110
MKTAKRSPIWHPFTQHALQRDMTKVVRGEGAYLYTEDGRRLIDAISSWWVVTHGHCHPCIVNAIREQAGKLNQVIFAGYTHDPAEQVATELLKVTSPALEHVFFSDSGSTSVEVALKMALGYWRNTGRERTKIVVMQHSYHGDTIGAMSVGSRGIFNAAYGALMFEVTSIPFPARDCEQRALDALENACRNEHPAAFIVEPLILGAGGMLMYSPSVLREMKRICEAFDVLFIADEVMTGWGRTGTLFACEQADVTPDIACYSKGLTAGALPLAVTLCRADIFDAHYSEDRTRTFFHSSSYTANPVACAAAKANLDLWQDQEYRWRLASLARMQEQALAPFRLDSRFANVRRTGTVTAVELNTRDAGYLADIGPRLLAFFQARDLLLRPLGNTIYVMPPYCVTAADLDEIYTAIRDAADLLM

SEQ ID NO: 58662 - protein, 431 aa, Trichodesmium erythraeum IMS101
MIKEIFMPALSSTMTEGKIVSWQKTSGDWVEKGETVVVVESDKADMDVESFFSGYLATIIVEAGDVAPVGSTIGLLAETEAEIEQAKQQGVTTLNKEPANTSSSTTPVATAPISTATENQENSSRRNGRIIASPRARKLAKDLKVDLSTLKGNGPHGRIVAEDVEMAAGRIPAVVAASAKSTIPTTPTQVSIPAPPPPPSVVSAPVTPGQVVPMNSLQNAVVRNMNVSLSVPTFHVGYTITTDNLDRLYKQIKSKGVTMTAILAKAVAITLQKHPLLNAVYVDQGIQYPSGINIAVAVAMPDGGLITPVLPNADKMDIYSLSRTWKGLVDRARAKQLQANEYSTGTFTISNLGMFGVNRFDAILPPAQGSILAIGASQPQVVATDDGMIGVKRQMEVNITCDHRIIYGADAAAFLQDLANLIENNSQSLTM

SEQ ID NO: 58663 - protein, 486 aa, Frankia sp. EAN1pec
MTEVAGDRVRVLIPEQEDGRGPHRRLTQLFDAGSFVPFPGSAGSRVLAGRGRIDGEVAIAFCTDGTRMGGAIGADGAARIVSAIEEAVRIGRPVIGLWHSGGANLTEGVQSLDGIGRIFSTMIHASGQIPQVSVVLGPAAGGAAYGPALTDVVIMAPAGRVFVTGPDVVRSVTGEQIDMEGLGGADAHGRRSGVVHVQASSEGDAYQRARRITTLLSRSGPFVLDPAITAELDANEHLRPDPRALLPERPRRAYDVHPLILRLLDDDQHPFEELQPRWAPNAVVGLGRLYGQPVGVVANNPIRKGGCLDSLSAEKISRFVRMCDSFGIPLVVLVDVPGYLPGVRQEWEGVVRRGAKLLYAFAEATVPRVTLVTRKSFGGAYIAMNSRSLGATAVLAWPEAEVAVMGAEAAVGILHRRKLAAAAEEERPAVLAQLLEEHTRTAGGVDRGLALGVIDSVITPADTRRRIAEALADAPARHGSHGNIPL

SEQ ID NO: 58664 - protein, 425 aa, Rubrobacter xylanophilus DSM 9941
MSSAEPLVIKFGGTSVGDGEGFARAARITAGAAAEGRPVAAVVSAMSGVTDALLAAAAGTATAGTRTARGLARDLRRALGERHLAAARCAVSGDLLPEVEARVLSLLDRLEEELARRALPEAERRAEIAVCGERLSAEILAGALRAAGAPAAVAADPIATGPGGEEVLSEETRARCTRHVRPLLEEGLVAVVPGYAGRSPDGAVTTLGRGGSDLSATALGRGIGAGEVWIMTDVDGVLDADPRLVPGAATLPRLSYREAGAFAALGAEVLHPRTMEPAAAAGIEVLVRNTFDPHSPGTRISARECGPGLRALALRRGLSVEPLEALDGRSGDVFCLLGADVYGIRALVERPSGSAAAVIGVGSPGDEELAAGLRRLHRAGIRPLWAGNTAAGLAFVVAGSRAEEALRELHAALLRREALAGEAVA

SEQ ID NO: 58665 - protein, 342 aa, Bartonella quintana str. Toulouse
MRALQLFDERRLEITHIAPPPPPGPNEVTVRIKAVALNHIDVWGWRGMAFAKRKMPLIIGAEASGEVVQLGDNVENLQLEQIVSIYGAHTCGVCKACHEGRDNLCSHVKGIYGFHLDGFACEFVNLPARLLVPAPAKCNELQAAVAPITFGTVEHMLFDNAKLQAEETILIQAGGSGIGSAAIQLAKHMSCTVITTVGSDEKIAKAKSLGADYVINYCKDRFEGVVRKLTKKQGVDVVFEHVGANTWNGSLLCMKRGARLVTCGSTSGVTAPLNLMQLFQQQFKIFGSFGCRVKNMQNAMQKMAQGVVHPVIDTIVQFEEIDTALKRMESRNVFGKIILKID

SEQ ID NO: 58666 - protein, 411 aa, Triticum aestivum
HASAHASAHASGSEPRLVKAATDQLNKLPFYHSFWNRTTKPTLDLADDLLSMFTASKMGKAFFTNSGSEANDSHVKLVWYYNNALGRPNKKKFIARSKAYHGSTLISASLTGLPALHQKFDLPAPFVLHTDCPHYWRFHLPGETEEEFATRLAKNLEDLILKEGPETIAAFIAEPVMGAGGVIPPPKTYFDKVQAVVKKYDILFIVDEVITAFGRLGTMFGSDMYNIKPDLVTLAKALSSAYVPIGATLVSPEIAAVVDSQSNKLGSFAHGFTYSGHPVACAVAIEALKIYRERNIPDHVKQIAPRFQEGTKAFAGSPIVGEIRGVGLILGTEFANNKSRDDPFPAEWGVGAIFGQECQKRGMLVRVAGDSIMMSPPLTMTPGEVDELVSIYGEAMKATEERVAELKSKKN

SEQ ID NO: 58667 - protein, 283 aa, Ehrlichia canis str. Jake
MKQRLEGILSCNISELMKHYSSLLIQKLESMLPENNQDILLTSIRYSIFSPGKHIRPFLVNAVAQMFDVNVDRTLPVSAAVEIIHVYSLIHDDLPGMDNEEIRRGQASSHKKFNEAVAILTGDALLTLAFEILSTINESPLIRCRIIKTLAHAIGYQGMIQGQILDTETIAKDINEIQNIHVLKTAQFFSAICELGGILGNASNIQLNALANYGLNLGHAFQIKDDIADEDQDKSKNNILNIINNKDAKNYASNLIDKSIEHLTIFSHKADILHSLAGFIRNL

SEQ ID NO: 58668 - protein, 539 aa, Zea mays
  misc_feature (59)..(59): Xaa can be any naturally occurring amino acid
TRPLQYISGSLCVRALTAAEPHSCSCAVYLSLVVLCRPSYCGREKGVCRPAAKHCYPAXAAMEVSSVEFGHHAAAASKCFDDDGRLKRTGTMWTASAHIITAVIGSGVLSLAWAIAQLGWVAGPTVMLLFSFVTYYTSALLADCYRSGDACTGKRNYTYMDAVNANLSGVKVWFCGFLQYANIVGVAIGYTIAASISMLAIQRANCFHVEGHGDPCNISSTPYMIIFGVVQIFFSQIPDFDQISWLSILAAVMSFTYSTIGLGLGIAQVVSNKGVQGSLTGISVGLVTPVDKMWRSLQAFGDIAFAYSYSLILIEIQDTIRAPPPSESKVMRRATVVSVAVTTFFYMLCGCMGYAAFGDNAPGNLLTGFGFYEPFWLLDVANAAIAVHLVGAYQVYCQPLFAFVEKWARQRWPKSRYITGEVDVPLPLGTAGGRCYKLSLFRLTWRTAFVVATTVVSMLLPFFNDVVGLLGALGFWPLTVYFPVEMYIVQKKVPRWSTRWVCLQLLSVACLVITVASAAGSVAGIVSDLKVYKPFVTTS

SEQ ID NO: 58669 - protein, 271 aa, Glycine max
MATVSAVSAPIRRLEGKVAIITGGASGIGEATARLFSKHGAHLVIADIQDDLGLSLCKHLESASYVHCDVTKEEDVENCVNTAVSKYGKLDIMLNNAGICDEIKTSILDNNKSDFESVISVNLVGPFLGTKHAARVMIAAKRGSIINTASVAGILGGVATHAYTSSKHALIGLMKSTAVELGQFGIRVNCVSPYVVPTPLTKKHANIDEEGVREIYSNLKGVHLVPNDVAEAALYLAGDESKYVSGHNLVLDGGFTNVNIGFSVFDQNKLN

SEQ ID NO: 58670 - protein, 446 aa, Rubrobacter xylanophilus DSM 9941
MDASEARGERAGDHPALRRAVTPLLLLFFIVGDMVGGGIYALVGEVGAITGGAIWSAFLLALVLALFTAFAYAELVSKYPRAGGAASYVHRAFKTPFFTFMVAFAVVMSGVTSASALSIAFGGDYLAEFIAGPTVIIALVFILVVGFVNFYGIRESVTLNAIFTCIELGGLLLIVLIGVVALVSGSGEPSRAFEFREGVSVPLAVLSGAALSFYALIGFEDSVNVAEEVQDPQRSFPRALFGGILLAGIIYLLVTFTAAMVVPVERLAASSGPLLEVVEASPLGVPTWLFALIALFALSNGALINMIMASRLIYGMGDQGVMPSVFARVHPLRRTPWVSIAFTTLIAVGLISTGDIEDLASTTVVLLLLVFVVVNATVLVLRRDRVEHEHFRAPSVFPVLGILVCVGLLTQQEADIWLRALVLLVVGAVLYGVNYLATRYLDRRGA

SEQ ID NO: 58671 - protein, 370 aa, Fulvimarina pelagi HTCC2506
MDAHTPEPYKSPVPTGYFRWEPEEDEFLICRAVRDETHDVKTFVLAPRNERQFEFVSGQFMTFEFEIGGETIQRCYTISSPPSRRDTVSITVKRVPGGPVSNWLHDEFKPGMMVKATIPMGEFTWSGMQQSKYLFISGGSGITPMMAMTRSAYDLALISDIEFIHAARTPADIIFRDELDFMGRRNHWIKPTFICEQDAPFERWNGFRGRFDRQKLEVICPDYAERTVFVCGPAPFMKAVKTTLKDAGFDMSRFYQESFNFDSFTEEAQEQIAEATEAITTDVRVFQLEFTKTGRTVECPEGITVMEAARRAGIRVPSSCSKGLCGTCKSTITAGTVDMKHSGGIRQREIDRGMALLCCSKPTSDLVIDR

SEQ ID NO: 58672 - protein, 693 aa, Zea mays
  misc_feature (86)..(86): Xaa can be any naturally occurring amino acid
  misc_feature (93)..(93): Xaa can be any naturally occurring amino acid
MAAGRHGGYRDYEARERELDAEASRRSKEQHHHLGGRHRDVDRHRDGGRSRGGRDFANGYGRRRSPPPRSRLAGRLGDREPGEVLXRSASDDXGGRPHRGRENGVRSSSREGDMVAGTGISSPIKKRKFSPIIWDRDSPKPPHSGAARDKKSVESVPSELPPPPPLPQDHIPLSLSVEKSPMDVETTVGTESAEQLPEHEVNKVIEQEEDYPSPTMRNISTSRWAGANDDEEGGAAPMKKRSVSPADSSVPGQWKRASPEPGEVSGGRAMSRSSDSGKIGNDEKEDSEVDKDDYMDVDREHASDSGTENCMSDTDSDNEMCRPETPEPERPPHRCINMLQGCRSVDEFERLNKINEGTYGVVYRARDKKTSEIVALKKVKMEREREGFPLTSLREINILLSFHHPSIVDVKEVVVGSSLDSIFMVMEYMEHDLKGVMETMKQPYTQSEVKCLMLQLLEGVKYLHDNWVLHRDLKTSNLLLNNRGELKICDFGLSRQYGSPLKPYTQLVVTLWYRAPELLLGTKEYSTAIDMWSVGCIMAELLAKEPLFNGKTEFEQLDKIFRTLGTPSEKIWPGYAKLPGVKVNFVKQPYNRLRDKFPAASFSGRPILSEAGFDLLNRLLTYDPDKRISADDALKHKWFSEVPLPKSKDFMPTFPALNELDRRTKRYLKSPDPLEEQRLKELQGNIGNRGLFG

SEQ ID NO: 58673 - protein, 398 aa, Pasteurella multocida subsp. multocida str. Pm70
MTQYNREIFDQVMIQNYVPAQFIPVRGKGSHVWDQQGKDYIDFTSGIAVNSLGHCADEIVDVLKQQSEKLWHSSNWFTSEPTLALATKLVEKTFAERVMFVNSGAEANEAALKLARRYAVDHFGYQKSKIIAFKQSFHGRTLFTVSVGGQAKYSDGFGPKPADIVHVPFNDLAAVQAVMDENTCAVIVEPIQGESGILPASQDFLQGLRELCDQHNALLIFDEVQTGVGRTGYLYAYMKYEVVPDILTSAKALGNGFPIGAMLTTHEIAKSFAPGVHGTTFGGNPLACAVAEKVIDIISAPPFLQKIQRTSEKFMQKLQEINQQCGLFKEIRGEGLLIGAELIEQYHGRASEFVKKAADNGLMILVAGPNVLRFAPALNISEEALALGFERLAKTLHI

SEQ ID NO: 58674 - protein, 1191 aa, Synechocystis sp. PCC 6803
MSPIALNLLQSTPYQVGGSLAANHPSYSQREADRELLAQLRAGKFCYVFNCRQMGKSSLRVRAMHQLQQDGVVCVSIDITSLGTEADPQKWYNGIITQLYLGLPLAGKVALKPWLREREQLSPIQKLREFVETIILQTIGDRQIVIFIDEIDKVLSLPFSLDDFFSYIRFCYNQRADDHEYNRLSFALFGVATPSDLIDNKTQTPFNIGQAIALTGFTLTEALPLSAGLPVDEVSAREILGEILAWTGGQPFLTQKVCELVAEALQKGDLDCQSQTIATTIAQLIEEKIIRHWESNDEPVHFRTIGDRLLKDQARSGQLLGLYQEILHKGAIPADDSVEQTVLRLTGLVVKVKGQLRPYNPIYQAIFNAQWVSKELNKLRPYGTNLQAWINSNYQDSSRLLRGEALREALAWASSKNLSGVDYRYLNASQNQEQEASLAANQILTQANVKAKRMISFGIVVLMMSLGGSAIALSQAYFATLKQQRSQQGTELQRLGTSAQRQFTFDQIPGLVTALEAGNQLHHLVKADETLSQYPATSPLVSLQQILSQIAEKNVLTGHRDGVTSVAISSHKNLIASASRDGTVHLWTPQGEFLREFTGHTGSIYRVDFSPNGKIFATAGQDQTVKIWDLDGNLLQTLKGHQDSVYSVSFSPDGEILASTSRDRTVRLWHWRSGKTLAVLGGHTKSVDDAQFSPDGQTLVSVCRDGQIRLWDLDGNLIRQFGLPEVAFFGVNWHPNGNLLAVAADDGTVRLWTPQGEIKATLSGHDEFVTRVVFTPDGKQLFSSSSNGSVIHWSTSGKMLKKYQGYPEAIFGLALASNGALLAIGAENNLVKVWDMSPKSDLVNLNLPAVLGAVAENAKTNTIALAMENEPLILFNTKNRSRQFLSDASQNLDRLKFSADGQWLLGQRGRQWQLWQLQTKSQLLKTWRTDISRVYDVDLRTTPTSPQWAIAMATGSGEVQLWQGTKNNQTSGNQSQGVPIELNDPIVLALGNSIQRKEPIRSVSLHPTLPQLAAGDEQGNLTLWNFDGTLIRSIVAHGDRLNQLQYSPNGKYLLSAGREGTAKIWSVEGQLLHTLKSDPLPIDQIAISPDSQWIATAASDGMVRLWDQQGNLRGEFTSTSGSLLGLDFNRQGQWLLAVAQNGDLQSWPVTPEKERLRQLVEQGCDWLRDYLATEKQPAQTYSLEFCQPTGN

SEQ ID NO: 58675 - protein, 407 aa, Prochlorococcus marinus subsp. marinus str. CCMP1375
MTAYRLDVLSLAPDSFQSLNELGVIGRAFSTGIADLNLYNPRNFTKDSYHKVDDEPYGGGVGMVLKTEPFFEAFESIPALPKRRVLMMTPQGNKLTQNDLWRWAKEYEQLVFICGHYEGFDERIRTLADEEISLGDFILTGGELAAMTIINGVLRLLPGTIGSAESLVDESHADGLLEHPHYTRPEIFRGLNVPKVLLSGNHAAISTWRQEKREQRTKERRPDLYELWVAKEASNKTRIDLSGFTSVPFRIGNGYDIHRLVTDRPLIIGGVRLHHPEGLGLDGHSDADVLIHSLMDAMLGALSLGDIGKYFPPNDPQWKDANSLMLLEKVGCLIKEEGWKVVNIDSVVIAERPKLKPHIDAMRQNIADKLGIETSSVGVKATTNELLGAEGREEGISSHAVVLLEKT

SEQ ID NO: 58676 - protein, 104 aa, Zea mays
YETLLGFVNFKLYHLINVNYPPILDPRLEALAAELYALCRYMSAGSRRMIGNSQTDEVMEDKDEKSKAEEVIEEEKVVKNKASSKADESHANGLLYHFDGGLSL

SEQ ID NO: 58677 - protein, 72 aa, Vibrio parahaemolyticus
NAKGIPSLDESFVVIRLRGIKNVDFPYLLAMIDGSFMSRHNTIVVPGGKMSFAMELIVRPILQQLIETGKIG

SEQ ID NO: 58678 - protein, 505 aa, Oryza sativa Indica Group
MYRAASGLGAIKRHGLDGQMLNVAIRCASTSVAQRSSGGFWTWLTGARSNALPPPDFTLPGVTIPPPLPDLVEPGKTKITTLANGVKIASETTPGPSCSVGVYVNCGSVHEAPETLGATQLLKKMAFTTTTNRSHLRVVREIEAVGGNVKASANREMMSYSYAALKTYMPEMVEVLIDCVRNPAFLDWEVKEQIMKLKAELAEASSNPETFLLEALHSTGYSGALATPLIASESSVSRLNTNVLEYFLAENYTAPRIVLAATGVDHDELVSIAEPLLSDMPGVTGPAKPKSTYVGGEYRRTADSSNTDVALAFEVPGGWLKEKEFVTVSVLQTLLGGGGTYSWGRHGKGLHSSLNHLANEFDQIRSIAAFKDVHSNTGIFGIHTSTDAAFVPKAIDLATRELTSLATPGKVDQTQLDRAKATAKSAILMNLESKASATEDMGRQILAFGERKPVEHLLKAVDGVTLKDITALAEKIISSPLTMASHGNVLNVPTYDSVSGKFRSK

SEQ ID NO: 58679 - protein, 267 aa, Eremothecium gossypii
MVAPTALKKSGTDGQTAPGPTGSRIVGTDNTRSIEDDDDILIDQEDSGAAAAEQAEGAREQQGVVLDAEGKPRFAAAASVAETRVKAESRKVPVPPHRMTPLRNSWTKIYPPLVDHLKLQVRMNLKTKSVELRTHPRHTTDPGALQKGADFIKAFTLGFDLDDSISLLRLDDLYIETFEIKDVKTLHGDHLSRAIGRIAGKDGKSKFAIENATRTRIVLADSKIHILGGFTHIRMAREAVVSLILGSPPGKVYGNLRTVASRLKERY

SEQ ID NO: 58680 - protein, 535 aa, Arabidopsis thaliana
MELFTKGNNVKLRSHLDKFLVADDDQETIRQSRKGDARRAVWTVEPVVDKPNLIRLKSSHGTYLTASNKPLLLGMTGEKVTQTASFNKLMDWQTQWEPERDGFQVKLKSWCGKWMRANGGTPPWRNSVTHDEPHTSKTKNWLIWDVITIDGSDLENMSDGDESSVSSPVGSEFGSEPGSPVSARSTKSSISRFASLGLSTSPRWSSKPKSTASSFNQKETPVSVSAMEFFQKAKAIRMRNSHNKYLTADDDEETVTQNRNGSTKNARWTVEPVRDSFHVIRLKSCYGKYLTASNERFLLGATGKKVIQLKLSRVDSSVEWEPLREGSKIKLRTRSGNYLRGNGGLPPWRNSVTHDVPHLSATQDSISWDVDVVEILTDSEFKTESAKAPPPKTTSPPPHRRPTSSPLSAESPRTSSSLSDRSDSDLYRFPVIENFDFDFDQSVESPPKSDGRTIYYHVADEEGHVEDETTVGYAFTFKGNSVAELTQTLREETCMEDAVVCTRSPLNGKLFPLRLQLPPNNGTLHVILLPSSASL

SEQ ID NO: 58681 - protein, 589 aa, Burkholderia pseudomallei K96243
MSLIEVKVPDIGDFSGVDVIEVNVKPGDVIEKEQTLITLESDKASMEVPSDVAGTVKEIKIKAGDKVSQGTVIAIVEASAGAAAPAPAKAPEAPKPAAAAPAPAAAPAPAPQAGSYSGSADIECDMLVLGAGPGGYSAAFRAADLGMKTVLVERYSTLGGVCLNVGCIPSKALLHTALVVEEAQALASHGITFGKPQVELDKLRDFKGGVVKKLTTGLAGMAKARKVEVVTGVGAFVDPYHMEVQGENGKKIVKFKQAIIAAGSQAVKLPFMPEDPRVVDSTGALELRQLPKRMLVIGGGIIGLEMATVYSTLGAEIDVVEMMDGLMMGADRDLVKVWEKYNAKRFGNVMLKTKTVGAQAKEDGIYVTFEGEKAPAQAQRYDLVLVAVGRSPNGKKIGADKAGVAVTDRGFIDVDKQMRTNVPHIFAIGDIVGQPMLAHKAVHEGHVAAEAAHGEKAYFDALQIPSVAYTDPEVAWAGKTEDQCKAEGIKYGKAVFPWAASGRAIANGRDEGFTKLLFDEETHRVIGGGIVGLNAGDLISEVCLAVEMGADAEDIGKTIHPHPTLGESIGMAAELYEGVCTDLPPQRKK

SEQ ID NO: 58682 - protein, 347 aa, Hyphomonas neptunium ATCC 15444
MKALVYRGPRDIAFETMKDPDLHDDRDAIIKVDKCAICGSDLHIYHGETFSEDTGYCVGHEAVGEVVEIGRGVRQLKVGDKVMISAAVGCGQCRACLAGVVNRCEFNAGSCYGLSAKLQGCQAEAVRVPAADFNAQKIPDGISLDQALMMTDALATAWFGARNADIQRGATVAVVGLGPIGLLAAEAAFIMGASRVFGIDLVEERRAAGRAIGLETPDPADARAIIQEATKGRMCDSVIEAVGHSATIRAALGLSGKRATVSVVGVAQDRTFDFPMSKAFGMGLTFRIGTCSVPQEWPELIPLVQSGRIKPEKYITHTLPLSDGARAYDIFDKRTEGAMKMVFDLTL

SEQ ID NO: 58683 - protein, 461 aa, Campylobacter coli RM2228
MNLEKLRSKLGKENLSAVFGEITKISATSIEIRGLKTGVGDIIKLVSNENENLNTLAMVVEIKEQFSYLSPFSFIEGFKIGDRAFISDAGMQIGVSDELLGRVVDPFMRPKDGKGAIEATKYMPIMRAPIDAMKRGLIEEVFPVGVKTIDALLTCGVGQKLGIFAGSGVGKSTLMGMIVKNSKAPIKVVALIGERGREIPEFIQKNLGGKLDDTVIIVATSDDSALMRKYGAFCAMSVAEYFKEQGKDVLFIMDSVTRFAMAQREIGLALGEPPTTKGYPPSVLSLLPQLMERTGKEEGKGTITAFFTVLVDGDDMSDPIADQSRSILDGHIVLSRELTDFGIYPPINIQNSASRVMGDIISPEHKLWARKFKRLNSLLKENEVLLRIGAYQKGSDKELDEAIAKKEFMQKFLGQNPEESFEFEETIRLLSQIDANVAPSAVQQNINMGSSNATLPNPNLK

SEQ ID NO: 58684 - protein, 292 aa, Oryza sativa Indica Group
MAIATESRCEEEKASPHSQEVKRWVLSDFDIGKPLGRGKFGHVYLAREKRSNHIVALKVLFKSQLKQSQVEHQLRREVEIQSHLRHPNILRLYGYFYDQTRVYLILEYALKGELYKELQRCKHFSERRSATYIASLARALIYLHGKHVIHRDIKPENLLIGSQGELKIADFGWSVHTFNRRRTMCGTLDYLPPEMVEKTEHDYHVDIWSLGILCYEFLYGVPPFEAKEHSETYRRIVKVDLKFPLKPFVSPAAKDLISQMLVKNSAHRLPLHKLLEHPWIVQNADPSGVYRG

SEQ ID NO: 58685 - protein, 505 aa, Ostreococcus tauri
MSTLAESFLADLDALSDAEDDRGADAHGDARADGGEDGTTVAGERMMGGETLRASDDVDDVSTLRTTERYREITSAVDEALRKRENAMETTESGKALGAVDRGAEALVMKCNALTVEVDNEIAIVHRFIKDKYKKKFPELESLVLHPIDYARVVKAIGNETDIMGVDLDGVLPSATIMVVSVTGSTTSGVPLSESDLEKTLIACDRALELDESKKKMFNYVATRMADTAPNLSAVLGSDIAAQLIGIAGGLHALSKMPACNVQVLGSKKKNTGGMSSASAIRSGDMHAGYIYDCDIIQKKTPPAWRSKAARLIGAKCTLMARVDAFGQAPDGSMGQKFAEEIIKKIEKWQEPPPARTAKPLPAPGIEAKKRRGGKRARALKERYGITDMRKAANRVNFNEVEEVGYDGEGLGLLGSSAGSAAIAGRLRLQAKAAKLIKTDNKGGKSTFASTSGTAGTASSLAFTPIQGIELVNPNRVQSDGPVSGTDSVFSERRGFSNVARQLKR

SEQ ID NO: 58686 - protein, 617 aa, Spiroplasma kunkelii CR2-3x
MTKIIFEADDNCKGIVDKIFVTNKQVVQKGDKLSNIITQNKVYEIKAPITGEVLNIIVYENKVINSGDVLLNLLPFEATLNEHDNNFEQPYNTIYFNGSGKYNVQNRPPIDVKKSETEIFREELIETLLAREVAGENSQDDFEDSIEIDLSEENIVQDSTPFFSQNNDSKTFLFKNKVENVLENIPSEENIETLQKDLGDLKEDLAIVKDDLATIRIEEEEVIEELENLERDLSFTAGMAARKQVDYKKIDPLHHQPFDREEYKEENYTKEELKSNFSQSINNVDDSKIEPIINLEQDKLVENNPKDHHSQHSKSHSTVHLSVSSHYEKHKPVEDKSKGHHGEHSKSHSTVHSSVSSHLKKHKSEDITSREHSISSEHKIKENPQTLQVDKIKLNQEAIIRAKEIMESKKNIVNGFIDVEVDVSELVSLLLIMREAYSQNDIELTLLPFYVKAVYDGLKKFPVLNASFISQKNKILLKWFYNIAFSVDSYTAVKMPVLYNLKNVSIKEIASKVTKLISKSINNELKEKDCQNASFSIINYGEYGITRGTFTIPYDNVAGIAMGIIFKKPVVVEKNDIAIRDIMVITLGYNEAVIDITEASKFIHYVAYLLSNPGLLL

SEQ ID NO: 58687 - protein, 194 aa, Campylobacter coli RM2228
MFIPYVIEKSSRGERSYDIYSRLLKDRIIMLSGEIHDELAASIVAQLLFLEAEDPTKDIYLYINSPGGVITSGFSIYDTMNYIKPDVCTICIGQAASMGAFLLSCGAEGKRFALPNSRIMIHQPLGGARGQATDIEIQAKEILRLKAILNDILAKNTKQKVAKIVKDTERDFFMSAQEAKEYGLIDKVLEKSFK

SEQ ID NO: 58688 - protein, 509 aa, Capsicum chinense
MEGTTWTAYAAVFLGTLFLLLLSKFLRQKKLNLPPGPKPWPIIGNLHLMGNLPHRSIHELSVKYGPILQLQFGSFPVVVGSSVEMAKIFLKSMDINFVGRPKTAAGKHTTYNYSDITWSPYGSYWRQARRMCLTELFSAKRLDSYEYIRAEELHLILRNLNKLSGKPILLKDYLTTLSLNVISRMVLGKRYLDESKNSIVTPEEFKKMLDELFLLNGVLNIGDSIPWLGFMDLQGYVKRMKVLSKKFDKFLEHVLDEHNVRRKAVENYVAKDMVDVLLQLADDPSLEIKLERHGVKAFTQDLLAGGTESSAVTVEWAISELLKRPDIIKKATEELDRVIGQNRWVQEKDIPNLPYIEAVVKETMRLHPVAPMLVPRECREDCKVAGYDVQKGTRVLVSVWTIGRDPTLWDEPEAFEPERFLEKSIDVKGHDFELLPFGAGRRMCPGYSLGLKVIQASLANLLHGFKWSLPDNMTPEDLNMEEIFGLSTPKKFPLSAMIEPRLPPSLYSV

SEQ ID NO: 58689 - protein, 431 aa, Synechococcus sp. WH 5701
MGSSPTAPITLPRASSQPPPQPQAPLAVAHTPVSAVMDTYARLPLELVKGRGVWVRDQHGRRYLDCVAGIATCTLGHSDRVMRRALGKQLGRLQHVSNLYKIPEQEELARWIVGRSCADRVFFCNSGAEANEAAIKLARKHGHQVRGIERPLILTAQASFHGRTLATVSATGQPKYHKGFEPMVEGFHFFPYNDTAAFEALLSRSEADGPRVAAVMLEPLQGEGGVNPGDPAFFQRVRQLCDQHRILLIFDEVQIGMGRSGCLWGYEKLGVEPDAFTTAKGLGGGFPIGALAVKQAFDHFRPGDHASTFGGNPLACRAALTVAQELERRLLVPHVQRMGELLQQLLAELVSRHPQLLEGVRGWGLLQGLVLRPEAPTAPQIVQSALEKGLLVVPAGPRVVRLVPPLVIQPRQLRQAVALLEQALLAISAGT

SEQ ID NO: 58690 - protein, 769 aa, Bartonella quintana str. Toulouse
MSTERNNDFSPQKAELDNAALFYHQYPKPGKLEIQATTPLDNQRDLALAYSPGVAAPCLAIYKDPNLAAQYTARSNLVAVISNGTAVLGLGNIGPLASKPVMEGKAVLFKKFANIDVFDIEIDASDIEQMVQTVAALEPTFGGINLEDIKAPECFEIEEKLRAKMNIPVFHDDQHGTAIIVSAAVLNALSLAGKKIENAKIVASGAGAAALACINLLVRLGAKVENIWLSDLEGVVYEGRKTLMDRWKINYAQKTDARTLSEIIDNADIFLGVSAGGVLKPEYLKKMAPNPLILALANPTPEIMPEEARSVRPDAMICTGRSDYPNQVNNVLCFPYIFRGALDVGAIAINEAMKIAAVYAISSLAREESSDVAARAYSKEPPSFGPDYLIPSPFDPRLILRIAPAVAKAAMETGVAIRPIRDMEAYYDVLNRFVFRSGLTMKPVFAAVKTVKRKRVIYANGEDERVLRAAQIVLEEQTAIPLLIGRPYVVEARLKRFGLRIRPSIDFELINPEDDPRFRDYVNLLLRYTGRRGVSPEVAKTIVRTSTTAIAALAVMREEADAMICGLEGRFERHLELIEQIIGLNSNTSCFSSVSLLISPHRTLFLTDTYVNENPSAEEIAEMTVLAAQEIEAFGITPKAALLSYSNFGSKNTDSARKMRRATEILAELYPNLEADGEMQGDAALSKIFRDRVFPDSRLKSEANLLVFPTLDAANITLNIVKNLTNALHVGPILIGAARPIHILTPSVTSRGVVNMTALAVLAANRKIP

SEQ ID NO: 58691 - protein, 450 aa, Burkholderia pseudomallei K96243
MEPTFTETGARASEPHATTLAGRAASSGDKLQRLKSIFSASAGNLIEWYDWYVYSAFALYFAHSFFPAGNQTAQLLNTAAVFAVGFLARPVGGWLMGIYADRYGRRPALLVSVVLMCVGSLIIALCPGYDVIGTAAPVLLVVARLLQGLSVGGEYGTSATYLSEVATARDRGFYSSFQYVTLVAGQLVALALLIVLQQFVLTTQQLESWGWRIPFFIGAACALAAMRLRSSMEETGEFKRTLNARDKRGTLAELSKHPRAVLTVVGLTMGGTIAFYTYSIYMQKFLVNTVGMSKHDATLVSAASLALFAILQPVVGSISDRIGRRPVLIAFGVLGTLFTVPIMTAISRTHDVWTAFFLNMAALVIVSGYTSINAVVKAELFPAKIRALGVGFPYALTVSIFGGTAEYLALWLKQAGHESLFYWYVTAAIFCSLLVYVCMRDTGKHSLIKD

SEQ ID NO: 58692 - protein, 129 aa, Sonneratia alba
FKRLQQDPPAGISGAPHDNNIMLWNAVIFGPDDTPWDGGTFKLTLQFIEDYPNKPPTVRFVSRMFHPNIYADGSICLDILQNQWSPIYDVAAILTSIQSLLCDPNPNSPANSEAARMFSENKREYNRRV

SEQ ID NO: 58693 - protein, 129 aa, Sonneratia caseolaris
FKRLQQDPPAGISGAPHDNNIMLWNAVIFGPDDIPWDGGTFKLTLQFTENYPNKPPTVRFVSRMFHPNIYADGSICLDILQNQWSPIYDVAAILTSIQSLLCDPNPNSPANSEAARMFSENKREYNRRV

SEQ ID NO: 58694 - protein, 295 aa, Silicibacter sp. TM1040
MTRIVVIGECMVEMAPVDGGLYRMGFAGDTFNMAWHLRYLLGSDHCVDYLSAVGDDSTSNAMLDFIQSQGVGIAHIRQIAGMTTGLYLIRQENGDRAFSYWRETSAARQLADDPAALARALQEADLVCLSGITLAILSPKAREVLWAAITESGAQVAFDPNIRPTLWSSQEDCRAALTYAAVRSDVILPSFDDDAALFGDVAPQATVARYTRLGVGEVVVKDAARPAIYSGSDGTLEIAADRLAVPVVDATGAGDSFNAAWLAARLQGAAPKEALIAAHKHAACVLQVSGALLVS

SEQ ID NO: 58695 - protein, 482 aa, Synechococcus sp. WH 5701
MSDASAASFDFDLIVIGAGYGGFDAAKHAADHGLRTAIVESRDMGGTCVNRGCVPSKALLAASGRVRELADAEHLRGFGIHAAPVRFERQKIADHANQLVATIRTNLTKTLERAGATILRGKGRLEGPQRVAVREASGIERVYSARDVIIATGSDPFVPPGIETDGRTVFTSDEAISLEWLPRWIAIIGSGYIGLEFADVYTALGCEVTMIEALDRVMPTFDPDIAKIAARKLIDGRDIDARSGVLAKTVTPGSPVRIELVEMASREPVETLEVDAVLVATGRVPVSKYLNLESVGVTTNRGFIPVDEAMRVLVDGNPVPHLWAVGDVTGKMMLAHTAAAQGSVAVDNILGHQRLIDYRSIPAATFTHPEISSVGLSEADAKELAAADGFELGLVRSYFKANSKALAELESDGLMKLLFNRSSGEVLGAHIYGLHAADLIQEIANAVARRQSVRELANEVHTHPTLSEVVEVAYKQAAAALV

SEQ ID NO: 58696 - protein, 417 aa, Triticum aestivum
  misc_feature (223)..(223): Xaa can be any naturally occurring amino acid
TRPVDAPARADKRAAPATTTTTTPPPSSSGGNTTTTTSSRAAVAAPEPAACNLYQGWWTYDAEASQVPLYREAECEFLTEQVTCMRNGRRDDSYQRWRWQPSSCDLPRFDARALLERLRNKRLMFVGDSLNRNQWESMVCLVSSAIPARDQRSLAKFVGPNGSLNVFRAAEYNATVEFYWAPFLVSSNSDDPQAHSVADRVIAWRSIAKHARHWRAADLLVFXTYIWWLNNFEMKVLTRWGAGPGGVPGRGSKTWAQVGGNPHVDPGRTKVFFMGMSPNHGVPEAWGGGPGAIKCAMETQPILNHTGPLYIGTDWRLHGAAEAVLRTMRRVPVHLVDITALSEFRKDAHTSVHTLRQGKLLTPEQQADPRTYADCIHWCLPGLPDTWNHFLYAQIVAAPPPPPAQAQPLPQSSSSSL

SEQ ID NO: 58697 - protein, 399 aa, Gibberella zeae PH-1
MAYSQHDDTFFVESDEPQHRITAQEAARMMARQRQDIIGVELSRLAGDEYLEDIMQHMRQMEDETLPDASLIDMQREIQWFMRPYLIDFLIEAHAAFGLLPETLFLTVNLLDRYCSKRVVYKQHYQLVGCAALLIAAKYGDKKDRVPQIHELNNMCCGLYDAGMFTQMEMHVLNTLDWIIGHPTVDFFSQLMVAEEGDDQEVSHMAAYLCEIALYHRDFVSTKPSVLARSSLALARAILGRTEVNDGGWDQTENVTLITLSHHLHQPSPTLARKYSTTGFSRVSQKLAEFMAEQAAIARRAASANPATPLAEPINKHTSNIYSTPSKGHSAMGFDGYLTPPITPDGNTLMGNHNLAKESYVLPPRCPVTPTPPHHAAVYGQQQQQNQYVGYVNQHGMNQ

SEQ ID NO: 58698 - protein, 340 aa, Coprinopsis cinerea
MSQVNVGINGFGRIGRIVLRNALQHGKINVVAVNDPFIDLEYMVYMFKYDSVHGRFKGHVEAKDGKLWVEGKPISVFQEKDPANIPWGSVGADYIVESTGVFTTTEKASAHLKGGAKKVIISAPSADAPMFVVGVNLESYDPKYTVISNASCTTNCLAPLAKVINDKFGIVEGLMTTVHSTTATQRTVDGPSHKDWRGGRAVGNNIIPSSTGAAKAVGKVIPSLNGKLTGLAFRVPTIDVSVVDLVVRLEKPASYDEIKQAVKEASEGPLKGILEYTDEKVVSTDFTGSTSSSIFDAEAGIALNKNFVKLISWYDNEWGYSRRVCDLITYAAAKDKEAGV

SEQ ID NO: 58699 - protein, 297 aa, Synechocystis sp. PCC 6803
MSSTQDYIGEEAATRVKILSEALPYIQHFAGRTVVVKYGGAAMKDSNLKDKVIRDIVFMASVGIRPVVVHGGGPEINTWLDKVGIEPQFKDGLRVTDAATMDIVEMVLVGRVNKELVNLINQAGGKAVGLCGKDGQLMTARTMTNKDVGFVGEVSSVDARVVETLVKSGYIPVISSVAADEFGQAHNINADTCAGELAAALGAEKLILLTDTRGILRDYKDPSTLIHKLDIQQARELIGSGIVAGGMIPKVTCCVRSLAQGVRAAHILDGRLPHALLLEVFTDLGIGSMIVASGYDL

SEQ ID NO: 58700 - protein, 707 aa, Ashbya gossypii ATCC 10895
MSSTLIIAAKSPAVAYAELIAARAVNEAKQDAVAIQFTEGKEAAAASFDGESQNALERMVEKYPDVLGSVPEEAAWWIAYARTDLVVKDFKKLSGSLEKLDAHLNLRTFVLGGMQPTVADVAVWGALRSNGPVGSIIKNKVYVNVSRWYTTLELIPAFGGAHEFLAKSLKELKAAGNVNKKKETHKANFEIDLPDAKIGEVVTRFPPEPSGYLHIGHAKAALLNQYFAQAYKGKLIIRFDDTNPSKERVEFQDSILEDLELLGIKGDRITHSSDYFQEMYDYCVQMIKEGKAYCDDTPTERMREERMEGIASARRERSVEENLKIFTEEMKNGTEEGLKNCVRAKRDYAALNKTLKDPVLYRCNLTPHHRTGTAWKIYPTYDFCVPIVDALEGVTHALRTIEYRDRNAQYEWMLNALKLRKVHIWDFARVNFVRTLLSKRKLQWLVDKQVVSNWDDPRFPTVRGVRRRGMTIEGLRNFVLSQGPSRNVINLEWNLIWAFNKKVIDPIAPRHTVVTNPVKLHLNGADVPQTPLTEMKPKHKKNPAVGEKKVIYYKDVLIGAEDAAMLAAGEEVTLMDWGNAIIRGKNDDGSLTADLNLEGDFKKTKFKLTWLADTSDTVPVDLVDFDHLISKDRLEEEDNFEDFLTPETEFHTTAIADLNVKDMKVGDVIQFERTGYYRLDTVGSGDKPFVFFTIPDGKAVNKYGAKK

SEQ ID NO: 58701 - protein, 129 aa, Sonneratia ovata
FKRLQQDRPLGISGAPCDDNIMLWNAVISVPDAAPWDGGTFKLTLQFTEDYPNKPPTVRFVSRMFHPNIYADGSICLDILQNQWSPIYDVAAILTSIQSLLCDPNPNSPANSDAARMFSENKREYNRRV

SEQ ID NO: 58702 - protein, 270 aa, Colwellia psychrerythraea 34H
MLESTPLQSTTLKGKTALITGSTSGIGLASAHVLAEQGINLVLHGLMSDDEGANLAQEFSEKYQIKTLFDNANLMDTSAISVFMDKATKTMGSIDILINNAGIQHTEAVDTFPESKWNAIIAINLTAAFHTTQHALSGMKANSWGRIVNIASVHGLVASKNKVAYCAAKHGIVGLTKVVALECAEHGITANAICPGWVDTPLINDQITEIANKESTSFEQAKYQLITAKQPVPDMMAPRQIGEFILFLCSDSARSITGSSLPMDGAWTAQ

SEQ ID NO: 58703 - protein, 1242 aa, Arabidopsis thaliana
MSAIYLLRKISTKTPSRFHRSLFFSTFSKDSPPDLSRTTSIRHLSSSQRFVSSSIYCFPQSKILPNRFSEKTTGISVRQFSTSVETNLSDKSFERIHVQSDAILERIHKNEEEVETVSIGSEKVVREESEAEKEAWRILENAVVRYCGSPVGTVAANDPGDKMPLNYDQVFIRDFVPSALAFLLKGEGDIVRNFLLHTLQLQSWEKTVDCYSPGQGLMPASFKVRTVALDENTTEEVLDPDFGESAIGRVAPVDSGLWWIILLRAYGKITGDFSLQERIDVQTGIKLIMNLCLADGFDMFPTLLVTDGSCMIDRRMGIHGHPLEIQSLFYSALRCSREMLSVNDSSKDLVRAINNRLSALSFHIREYYWVDIKKINEIYRYKTEEYSTDATNKFNIYPEQIPPWLMDWIPEQGGYLLGNLQPAHMDFRFFTLGNFWSIVSSLATPKQNEAILNLIEAKWDDIIGNMPLKICYPALEYDDWRIITGSDPKNTPWSYHNSGSWPTLLWQFTLACMKMGRPELAEKALAVAEKRLLADRWPEYYDTRSGKFIGKQSRLYQTWTVAGFLTSKLLLANPEMASLLFWEEDYELLDICACGLRKSDRKKCSRVAAKTQILKSPTNFDQTSFWSKRKNMSITKLARSNAFKPIPNFVRSSLRNAGVESSQNTEYPPYKPKKHHILATNLIVSYFEKGLVEEARSLFDEMPDRDVVAWTAMITGYASSNYNARAWECFHEMVKQGTSPNEFTLSSVLKSCRNMKVLAYGALVHGVVVKLGMEGSLYVDNAMMNMYATCSVTMEAACLIFRDIKVKNDVTWTTLITGFTHLGDGIGGLKMYKQMLLENAEVTPYCITIAVRASASIDSVTTGKQIHASVIKRGFQSNLPVMNSILDLYCRCGYLSEAKHYFHEMEDKDLITWNTLISELERSDSSEALLMFQRFESQGFVPNCYTFTSLVAACANIAALNCGQQLHGRIFRRGFNKNVELANALIDMYAKCGNIPDSQRVFGEIVDRRNLVSWTSMMIGYGSHGYGAEAVELFDKMVSSGIRPDRIVFMAVLSACRHAGLVEKGLKYFNVMESEYGINPDRDIYNCVVDLLGRAGKIGEAYELVERMPFKPDESTWGAILGACKAHKHNGLISRLAARKVMELKPKMVGTYVMLSYIYAAEGKWVDFARVRKMMRMMGNKKEAGMSWILVENQVFSFAVSDKMCPNASSVYSVLGLLIEETREAGYVPELDSLVNDQEVGT

SEQ ID NO: 58704 - protein, 311 aa, Flavobacteria bacterium BBFL7
MSELSVDHLLGIKDLTKEDIQLIHTTADQFKEVINRPIKKVPSLRDITIANLFFENSTRTKLSFELAEKRLSADVINFSAAQSSVKKGETLVDTVNNILAMKVDIVVMRHPNPGAGVFLSKHVDARIVNAGDGAHEHPTQALLDSYSIREKLGTLEGKKVVIVGDILHSRVALSNIYCLQKLGAEVMVCGPATLIPTHIASLGVKVEYNLRKALEWCDVANMLRVQNERMDISYFPSVREYVQQYGVNKELLDSLKKKIVIMHPGPINRGVEITSDVADSDQAIILNQVENGVAVRMAVLYLIASKIQRND

SEQ ID NO: 58705 - protein, 496 aa, Colwellia psychrerythraea 34H
MGNPTGFINVGRALPTERKAGERLSDWLEVYEEIPLKAVEKQASRCMDCGVPFCQSAKSEFAPAVAGCPVNNVIPEWNDLIYRGRWKDAIELLHKTNNFPEFTGRVCPAPCEGACVLGINADPVAIKLHEKEIIDHAFKEGWVVAQPPSARTGKNVAVIGSGPAGLAAAAQLNKAGHMVTVYERADRIGGLLMYGIPNMKLQKELVQRRVDILAEEGIVFVTNTEVGKDVSVEKLESDFDAIVLCIGATVPRDLPVEGRELNGVHFAMDFLKANTKSLLDSEHKDGQYINAQGKNVVVIGGGDTGTDCIGTSLRHQCTNALQLEIMPRPPEKREENNNPWPQWPKRLLVDYGQKEAIEIQGQDPRQYLVMTKKIESDVQGNVKAVHTVDITWERNDKGQMFPQEVAGSEKAIPADIVLIAMGFMGPEGGLVEQFGLEQDNRSNIAAEYDKFATSKQGVFAAGDGRRGQSLIVWAIDEGRRCAREVDSYLMGKSYLP

SEQ ID NO: 58706 - protein, 376 aa, Porphyromonas gingivalis W83
MNTYFDNATSSYPKPDAMRQALAYFYDVPVGSYGRSRDRETLRVTSEVEELRDALADLIGVSESAHICFADNATTGINTILRGSLQAGCSVLVSPMEHNAVMRPLQCLADTIGLKIALMPSMPDGRVDTDRLVSAIPTDTALAVVNLESNVNGLVQPIEEIARLLTQERGIPILADATQYLGTSRLKADELGLAYVAFTGHKGLLGPSGTGGFYIRDPRSVHPLTTGGNGLHSADWTVGVEMPERFMAGTVNVLGLTALLASVRQLPPFRISRDAWKQCMQQMQRFPGLRVYGAADPIEQGYLCSLTHDRLTPARIGDALYEAFDIVTRTGIHCAPLAHRSIGTFATGTVRLSLSPYHEEADLEYLLNALSHVLRS

SEQ ID NO: 58707 - protein, 546 aa, Burkholderia pseudomallei K96243
MSQAIEVKVPDIGDYKDVPVIEVLVKPGDAVEPEQSLVTLESDKATMDVPSPSAGTVKEVKVKVGDAVSQGSLIVLLDGAQAAAQPAQANGAATSAAQPAAAPAAAPAPAAAAGGGTVDVKVPDIGDYKDVPVIEIAVKIGDTVEKEQSLVTLESDKATMDVPSPAAGVVKDIKVKVGDAVSEGSLIVVLEASGGAAASAPQAAAPAPAPAPAPAPAPQAAPAAAPAPAQAPAPAASGEYRASHASPSVRKFARELGVDVSRVTGTGPKSRITKDDVTAFVKGVMTGQRAAPGAAAAPAGGGELNLLPWPKVDFSKFGPFEAKPLSRIKKISGANLHRNWVMIPHVTNNDEADITELEALRVQLNKEHEKAGVKFTMLAFVIKAVVAALKKFPTFNASLDGDNLVFKQYYHIGFAADTPNGLVVPVIRDADKKGLVDIAKEMAELSKAAREGKLKPDQMQGGCFSISSLGGIGGTHFTPIINAPEVAILGLSRGQMKPVWDGKQFVPRLMLPLSLSYDHRVIDGAEAARFNAYLGALLADFRRIIL

SEQ ID NO: 58708 - protein, 479 aa, Prochlorococcus marinus str. MIT 9312
MTDSSFDFDLIVIGAGYGGFDAAKHAAGKGLKVAIVESSDMGGTCVNKGCVPSKALLAASGKVREIADYEHLAKFGIHASPVRFERSKIADHANNLVLNVRENLTKTLKRSGVEIILGIGRIEGNQKVGVRDKNGIDKIFTCKNIVIATGSSPFVPRGITLDNRTVFTSDDAVKLEWLPRWIAIIGSGYIGLEFADVYTALGCEVTMIEALENIMPTFDPDITKIAKKNLIQARDIDTKSNVFATKITPGCPVKIELTDAKSKEVVETLEVDAVLVATGRSPNSNNLNLESAGIETVKGFIPIDDQMRVKNGDEIIPNIWAVGDVTGKLMLAHTAAAQGTIAVDNICGGNVEINYKSIPAATFTHPEISSVGLSEAEAKEISAKENFTLGVVKSFFKANSKALAELESDGLLKLIFNKDNGKVLGAHIFGLHAADLIQEISNAISRNQDVIELSTEVHTHPTLSEVVEVAYKQAASQIK

SEQ ID NO: 58709 - protein, 518 aa, Methanococcoides burtonii DSM 6242
MNFTKRPFLLTILDGWGYSPEVEGNAIHAANTPNLDDLLETYPNTLLSASGEDVGLPEGQMGNSEVGHLNIGAGRVVYQDLTRINRDIGNGDFFKNPVLKQAIENAKAQGSALHLMGLFSYGGVHSHMKHLRALIEFAKDEGITEIFIHAFLDGRDVSPRAALEDMKEHVEYCNNLSVGKIATVSGRYYAMDRDNRWDRTEDAYNAITRGDGVYYSKGPVDAISEGYGRGENDEFIKPTVIVDENGRPIGRMNENDTVIFFNFRPDRARQLTYAFVNDEFDNFERKSHPKVHFVCMTEYDEKLEVPIAFPSEELKNTLGEVLSKEGIKQLRIAETEKYAHVTFFFNGGVEKQNEGEERCLIPSPKVATYDLKPEMSAYEVTEELIERIGSGKYDVIVLNLANMDMVGHSGIMEAAVKAVEVVDDCVGKIITAIKEVGGEAMVMADHGNAEKMVEFCNNTERQCYTAHTSNPVRCIYVTQEKRVELQKGRLSDVAPTILKIMGIEKPPEMTGVPLIKNT

SEQ ID NO: 58710 - protein, 316 aa, Triticum aestivum
  misc_feature (133)..(133): Xaa can be any naturally occurring amino acid
  misc_feature (165)..(165): Xaa can be any naturally occurring amino acid
MVRTKDPELVILLNAIQTACKLVARSVRKAGIAGLYGTAGSENATGDVQKKLDVLSNEMFVNALYNSHSCAVLVSEEDDNPIIVPEDRAGKYCVAFDPLDGSSNIDCNVSTGTIFGVWLKKSEGPATVDDNIXPDNEMVCAGYCAYGSATELVITYGHGVERFTXLDPSIGEFILTGVKMTIPEISKTIYSINEGNYTTWDSAIQRAVDGFKFNKPTPYTARYVGSMVADVHRTLMYGGIYMYPADAAKGNGKLRILYEGFPMAMIIEQAGGMASTGMFRGEITRLLDLQPKGIHDKCPVLIGSNRDVERVLSHYA

SEQ ID NO: 58711 - protein, 153 aa, Brassica napus
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNM

SEQ ID NO: 58712 - protein, 248 aa, Bacillus pumilus SAFR-032
MIICKTPRELEIMREAGRIVALTHEKLKKHIKPGISTKELDQIAERFITKQGAIPSFKGYNGFRGSICVSVNEELVHGIPGKRVLRDGDIISIDIGAKLNGYHGDSAWTYPVGVISDEDRKLLEVTEESLYKGLQEAKPGERLSNISHAIQTYVENENFSVVREYVGHGVGQDLHEDPQIPHYGPPNKGPRLKPGMVLAIEPMVNAGSRYVKTLADNWTVVTVDGKKCAHFEHTIAITDTGFDILTKI

SEQ ID NO: 58713 - protein, 1114 aa, Cryptococcus neoformans var. neoformans JEC21
MSSAILPYPSQPSYPLSRPSTPRPTTTLSAPPTPITPTHLLPVAMERARSTEGVVNGVEQALNQARGIKDNKEPKPGRLKFEWEHIERPKTPESDHGIDDDEEQKMDVDEEQPIQPPYLGLGEPVSTYDEERAQRENAMRQMDIHHEEPPPPIIWGMPKWGREAERQEVAKGVRLLGMEELPQLVKTHSLIDTPSSVMFPWLHGISDDGHKGQEMAQFFGYSPPFGPPPYRGLCLLFCPPHPLDKHHLRPPPQRNDTDLTTVPTSAPYKVPDRKDSESESTSSESYNSSGATELTSPSLGNSLPSPSLSSFKPLPETDTQSMDSSKDDSNGAEVAMHPCYSKRLSPTTVAKGLDEDNHPLPCSSILNAAAEPETQKPSLSSSVSSSSSDVDEAVGQNQNPSCILFNALHVHDIFDLSKIGDDTEKRASFRAAKLPDQINLRNLNIQQIKYATVSDIVLYSKTGLTQGLLHIAEQIAQAQEDLYNQRLQEIYHVNHTGGDGEGSSEPIRYGVWVVLESFNEIEKHYPELVNIDSKGRDKHPHLQTDLFEREAKESREMTKASEVVEGFWVGNDCDVPGATLEGAGSFIRFDLCLKASECSEMPSTSALSSAYRKLLDIDRRRREAGEESQSTSAFNWTASPATHALRNLLSPSSSSVTTEVPSKRTASPTPSDRQLRAKPSLTTDHEYVALDCAGSSRTITGHTRNMVTMTDRVIELVYFLRKLVEGRDNGRKRKILVHCQDGYTESSIIVLAYIMSSLSISLPEAFLHLQVNANRSFFLYPADKPLLRKVDARLAADRKAKAIKLLSATSAGSASSHTDSDGKQSNPSPRWRPWGMNFGAKREQAPNRTSAIGGKERSKSTADVAREMLAEHENGGSAAAQEARLWFDDKRFDGFPSRILPFLYLGNLEHAGNAAMLHSLGITHVVSVGESLMNMDNSVIAYYGHKSENTLAAAVRAGKLSVLDLTDVRDDGNDPLRPVIARACEWIEEARARGGKILVHCRVGVSRSASIVIAYMMQYEHMRLMDAYMVCRARRLNVLIQPNLRFFHELFGWEVELAKREAEAAKARREEAEKQGVRDPEALKLIEGEARKIIYSWPSFCRDLYCLNRRFLCN

SEQ ID NO: 58714 - protein, 142 aa, Solanum lycopersicum
MIKPDGVQRGLVGEIISRFEKKGFSLKGLKLITVDRAFAEKHYADLSAKPFFNGLVEYIVSGPVVAMVWEGKGVVATGRKIIGATNPLESAAGTIRGDFAIDIGRNVIHGSDAVESARKEIALWFPEGIAEWQSSLHSCIYE

SEQ ID NO: 58715 - protein, 630 aa, Oryza sativa Japonica Group
MAGQRSDSQSDESFEYMLLERDPDLYRTVFSGPSQISPWIDPSVLTLQHRIGRGPFGDVWIATHHQRTEDHDRYHEVAVKMLHPIREDQLQAFSVRFDEIFSKCQGLSNVCFLHGISTQNGRICIAMKFYEGSIGDKMARLKGGRIPLSDVLRYGADLARGIIDLHSRGILILNLKPCNFLLDEHDHAVLGDFGIPSLLFGLSLPNPDLIQRLGTPNYMAPEQWQPSIRGPISYETDSWGFAWSILEMLSGIQPWRGKSPDEVYQLVVLKKEKPIFPYNLPPAIENVLSGCFEYDFRDRPQMTDILDAFESAKDVDYENTDQGNSENLRMVSPALPSRTNWSFFKDKLQVGDKVRSRKLKNTCSPTTMEVPDGTIVGMEDNGERDGYILVRIHGLHDPLKVRSSTVERVTYGFAAGDWVRLREDEKKRSQVGILHSIDRSGTVYVGLIGVDTLWKGEYSDLQMAEAYCVGQFVRLKANISSPQFEWQRKRGGGLATGRISQILPNGCLFIKFPGKFNLGEVCSCLADPSEVEVVSFDKCEGIVKKYEHLEDFHWAVRPLFIAVGFFTALKLGIFVGKGIARPRSRKVASVSDQSDHQQLQQQEVQNNANAAWLPPTVANMLFRDGPTLSG

SEQ ID NO: 58716 - protein, 310 aa, Vibrio vulnificus YJ016
MNHIKRVAVIGECMVELRRNNGVLEQGFGGDTLNTAVYLSRLTHEHGVASSYVTGLGRDAFSQQMLSAWQVEALDTEHVFISEDKLPGIYVIETAADGERSFFYWRNDSAAKYWLRGQEIPQLAHALRHHQMIYLSGISLAILPSDCCDALLELLRLLRAQGATIAFDNNYRPALWPSQQQAQSVYRQVLALTDIAFLTFDDEQALYGDETEQQAVDRTQTLGVKEIVIKRGAEPCMVVTQVGIESIASQPVEKIVDTTAAGDSFSAGYLAKRLLGGSTGESALAGHTLAGAVIQQRGALIGTDAMPTII

SEQ ID NO: 58717 - protein, 461 aa, Oryza sativa Indica Group
MGGKLLPAAAFAGSAPPLSQVATSAAHGEDSPYFAGWKAYDEDPYHAVDNPDGVIQMGLAENQVSFDLLEAYLRDHPEAAGWSTGGAGAGSFRDNALFQDYHGLKSFRKAMASFMGKIRGGKARFDPDHIVLTAGATAANELLTFILANPGDALLIPTPYYPGFDRDLRWRTGVNIVPVRCDSANGFQVTVAALQAAYDEAAAAGMRARAVLITNPSNPLGTTVRRKVLDDILDFVSRNDIHLISDEIYSGSVFAAPDLVSVAELVEARDGDGIAGRVHIVYSLSKDLGLPGFRVGVVYSYNDAVVTAARRMSSFTLVSSQTQKTLAAMLSDEAFAGEYIRTNRRRLRERHEHVVAGLARAGVPCLRGNAGLFVWMDMRRLLLGGGGVGSELRLWEKLLREAKLNISPGSSCHCSEAGWFRVCFANMSLDTLDLALHRISRFMDTWNGTKQQASCQQQEQQ

SEQ ID NO: 58718 - protein, 953 aa, Pseudomonas fluorescens Pf-5
MLELTVEQISMGQSAVDKSAALHLLADKLVADGLVAEGYLAGLQAREAQGSTFLGQGIAIPHGTPETRDQVFATGVRLLQFPDGVDWGDGQIVYLAIGIAAKSDEHLRLLQLLTRALGETDLGQALRRASSPQALLKLLQGAPQELALDAQMIGLGVAAEDFEELVWRGARLLRQAECVSNGFAAVLQQVEALPLGDGLWWLHSEQTVLRPGLAFVTPDKPIRYLGQPLSGLFCLASLGEAHQALLERLCALLIEGRGQELGRATSSRAVLEVLGGELPADWPSARIALANAHGLHARPAKVLAQLAKNFEGEIRIRIVDGKDSAVSVKSLSKLLSLGARRGQVLELIAEPSIAADALPALLAAIEEGLGEEVEPLPAVSTPRQEPQEVVEPLSAPASGSLIQAIAAAPGIAIGPAHIQVQQSIDYPLRGESTAIERQRLQQALAEVREDIQGLIQRSQAKAIREIFITHQEMLDDPELSDEVDTRLKQGESAEAAWMTVIESAAKQQEALQDALLAERAADLRDIGRRVLAQLCGIETPAEPDQPYILVMDEVGPSDVARLDPTRVAGILTARGGATAHSAIVARALGIPALVGAGASVLLIKSGTSLLLDGQRGRLHVDADSTTLQRAAEERDNREQRLKAAAEQRHQLAHTADGHAVEVFANIGESAGVAAAVENGAEGIGLLRTELIFMAHPQAPDEATQEAEYRRVLDGLAGRPLVVRTLDVGGDKPLPYWPIVKEENPFLGVRGIRLTLQRPLIMEAQLRALLRSADNRPLRIMFPMVGSVEEWRQARDMTERLRREIPVADLQLGIMIEVPSAALLAPVLAKEVDFFSIGTNDLTQYTLAIDRGHPTLSAQADGLHPAVLQLIDITVRAAHAHGKWVGVCGELAADPLAVPVLVGLGVDELSVSGRSIAEVKARIRELRLAQAQTLAQQALAVGSANEVRALVEAM

SEQ ID NO: 58719 - protein, 123 aa, Sonneratia apetala
FKRLQQDRPLGISGAPCDDNIMLWNAVISVPDAAPWDGGTFKLTLQSTEDYPNKPPTVRFVSRMFHPNIYADGSICLDILQNQWSPIYDVAAILTSIQSLLCDPNPNSPANSEAARMFSENKR

SEQ ID NO: 58720 - protein, 571 aa, Cryptococcus neoformans var. neoformans JEC21
MSFHPQNEPASPVSEQTRHTDANPVPESLSPSSTLTLSSAATPAPVPVSAAAATPFSHAHPAFPALPQLGKLPTTPQEIHQILSLPANQFTAKALPLLAKVADGKPFEGASLKAWERRNAGEQLLALYEAGDEVYETADERVKEIGGGLIYVLSARITLGQGNAVVWSDKMLNFAIRLCELADPAQLRICHQRVAAFAWGLLRLSQQLSKVKLVIPAITSLIQKLNYHQTFSPIFGALLEACLVTRQFDHPSLGLVLDIIFLDVKTTAPTYLDILTYYHHAGAVTMAVGDFCKAKEYYLTAVTVPTTTASAIQLACAKRALLCELIVTGKKIVWPKYTPTPVTRIIEKYATSYNELAKEFEAHNWANVRRAHTVAEFEKDCNSGLIEQVVNSIHRHMILRLRKTYMRLTVDSLARRLRVGDDMPKAERVVAILDDMIKSGEVSAILTPSATQPQSHSQAIIEFITATESFTSPAALGRLERASAVAALLQEHLAEGSRRLGASKEYLVKQAQYLESNSKKNKGDEFDQLMEAEETMEPGAGSGKMMGSSGGGGSKSGSLRGVASNMADIGF

SEQ ID NO: 58721 - protein, 226 aa, Candidatus Blochmannia floridanus
MKRDMKEYLIEPSILAADFSKLGEDVSNVISAGADVLHFDVMDNHYVPNLSIGPMVLKSLRNYGIDIPINVHLMIKPINDRLILDFLEAGATGISFHPESTDHVDRFLQLIKEHGCKTGLVLNPSTDLSCLEYVMHKIDVIILMSVNPGFGGQIFLPEILRKITQTRKLIDNNPYDINLAVDGGINMSNFCKICESGANVFIIGSAIFNASNYHDVIYNFRSMLLY

SEQ ID NO: 58722 - protein, 240 aa, Synechococcus sp. WH 5701
MSRKFLAEMIGTFWLVFGGCGSAVLAAVFPYDQAGANPLGLGFLGVSLAFGLTLLTMAYAIGHISGCHINPAVTFGLWASGRHPGSQLLPYIAAQVLGGLIAGGLLLGIAGGRPGFELTGSNPLATNGFGAHSPGGYGLVSALVIEVVLTFIFLLIILGVTHKDAIKDLAGVPIGLSLVLIHLISIPITNTSVNPARSTGVAFWAGGDAMGQLWLFWLAPIVGALLAGWVQRNLLDGPKD

SEQ ID NO: 58723 - protein, 152 aa, Bartonella quintana str. Toulouse
MTKEIHKKLHVLIVEARFYDGISDALLKGAVRTLQKAGASYDIVTVPGALEIPGAIAFAEKNSKVFYNGYVALGCVIRGETYHFEIVANDSCRALMDLTVHKHLAIGNGILTVEDEKQAWVRANQDEKNKGGFAAEAALCMIALKKRFGDNH

SEQ ID NO: 58724 - protein, 566 aa, Physcomitrella patens subsp. patens
MLTCGNWTQTLGCVGKVRLGGGGVSSDKTVFGAHNGLRRSSSAGLSSVAKELRVVSSFRRRQAANVGAGDLSVRAASGNGAAPKQFDYDVVIIGAGVGGHGAALHAVEKGLKTAIIEGDVVGGTCVNRGCVPSKALLAVSGRMRELRDEHHLKALGIQVGAANFDRQSVADHANNLATKIRGNLTNSMKALGVDILTGVGSIVAPQVVKYGKIGFSDKTVTARNIIIATGSVPFVPPGIEVDGKTVFTSDHALKLEWIPDWITIVGSGYIGLEFSDVYTALGSEVTFVEALDGLMPGFDPEIGKLAQRILINPRKIDYHVGVLAKKITPAKDGKPVQIELVDTKTKEPKDILEVDAALIATGRSPFTKGLGLEKINVTTQRGFVPVDERMQVLDSEGKPVPHLYCIGDANGKMMLAHAASAQGISVIEQIAGRDNILNHNSVPAACFTHPEISMVGLTEPQARALGTEEGFKVSVAKTSFKANTKALAENEGEGLAKMIYRPDTGEILGVHILGLHAADLIHEASNAIAMGNTIRDIKFAVHAHPTLSEVLDELFKAAKVFLSNSK

SEQ ID NO: 58725 - protein, 481 aa, Rubrobacter xylanophilus DSM 9941
MEAIPSASYSMTLRVEFPHRAGALGRILTTIGDAGGMVGAIDIVRMGQERSIRDITVNARDSEHGQRIVRAVGALPEVRVVNVSDRTFLLHLGGKIEVHSKIPVRTRDDLSMAYTPGVARVCRAIAQEPERAFNLTIKRNSVAVVTDGTAVLGLGDIGPYAAMPVMEGKAMLFKEFAGVDAFPVCLDTKDPEEIVRTVKYVAPAFGGINLEDISAPRCFEIEERLKQELDIPVFHDDQHGTAVVVLAALINALRIVGKRMEELKVVVCGVGAAGVACAKILLAAGVKNIVGCDRYGVVYRGRGDADTSRGWFAENTNPENIRGTLADAIRGADVFIGVSAPDVLTVEHIESMADEPIVFAMANPDPEIRPEIAYGHARIIATGRSDYPNQINNVLCFPGVFRGALDIRAREINEEMKLAAARAIAGVIPEESLSEDYIIPSVFDERVVPAVAGAVAEAGVESGVARRVRERSETDFSAASF

SEQ ID NO: 58726 - protein, 576 aa, Arabidopsis thaliana
MATHSMIIPSPSSSSSSLATAASPFKETLPLFSRSLTFPRKSLFSQVRLRFFAEKHSQLDTSNGCATNFASLQDSGDQLTEEHVTKGESTLSITVVGASGDLAKKKIFPALFALFYEGCLPQDFSVFGYARTKLTHEELRDMISSTLTCRIDQREKCGDKMEQFLKRCFYHSGQYNSEEDFAELNKKLKEKEAGKISNRLYYLSSTPKLLVDEVRCASLRASSENGWTRVIVEKPFGRDSESSGELTRCLKQYLTEEQIFRIDHYLGKELVENLSVLRFSNLVFEPLWSRNYIRNVQLIFSEDFGTEGRGGYFDQYGIIRDIMQNHLLQILALFAMETPVSLDAEDIRSEKVKVLRSMKPLRLEDVVVGQYKGHNKGGKTYPGYTDDPTVPNHSLTPTFAAAAMFINNARWDGVPFLMKAGKALHTRGAEIRVQFRHVPGNLYKKSFATNLDNATNELVIRVQPDEGIYLRINNKVPGLGMRLDPRDLNLLYRSRYPREIPDAYERLLLDAIEAERRLFIRSDELDAAWELFTPALKEREEKKIIPELYPYGSRGPVGAHYLASKYNVRWGDLGEA

SEQ ID NO: 58727 - protein, 296 aa, Frankia sp. EAN1pec
MEMFLPPYADRPVAVVTGASSGIGRATARTLAEQGWQVIGVGRDPVRSAATEAEIAAAARKDGGFTMLRGDFTLMADVRRVAGEIQHLTPRLDILINNAGGVRDRQIISAEGTEATFAVNHLAPFLLTRELTPLLRASAASLPAGSTRVIAVSSSGHRAVDGLDWDDLQSLGEFRPAVAYCRAKLANILFTRELARRAGPDGIVAQAMHPGVVASNFSAHGDAAMRAHMAAADTVPPDEPAETLAWLATEPEGGRTGGRYFHRRAEELPAEAARDDAAAARLWTESERLLDGLGFR

SEQ ID NO: 58728 - protein, 417 aa, Prochlorococcus marinus str. MIT 9312
MELVDAPHSKCGTFGYVGSSPTAPTLMNTYSRFDISFKKGKGCWLWDKKGKKYLDAVAGIATCSLGHSDRVLRRRLSTQLKKIQHISNLYNIEEQEQLSKTLTNISCAESVFFCNSGAEANESAIKLIKKYGNTTNKGKESIILSAESSFHGRTLAALSATGQPKYQEGFEPMIKGFKFFKFNNFDSVKKLFEECENKDQKISGVLVEPIQGEGGVIPGSKIFFKSLREICDKYGSLLIFDEVQSGVGRTGKMWGYENLGIEPDGFTLAKGLGGGHAIGALLVKEKANIFSPGDHASTFGGNPFACKAALTVLEEIKRRNLINNVYLRGDQLSAGFEELSKKFPNIIRGKRGLGLIQGLVINNDYADAKEITLKAFDKGLLVVPAGGNVVRIVPPLIISRREINILLDKLNSIFEEL

SEQ ID NO: 58729 - protein, 180 aa, Pasteurella multocida subsp. multocida str. Pm70
MNDKLALIKSSIKSIPNHPKEGIIFRDITSLLEVPAAFQTVVDLFVTRYKEKGITKVLGTESRGFIFGAPVALALNVPFVLVRKPGKLPRETISQTYQLEYGQDTLEIHTDAIHAQDKVLIIDDLLATGGTVEATVKLVQRLGGDVQDAAFVINLPDLGGEARLNALGIDAYTLVDFAGH

SEQ ID NO: 58730 - protein, 481 aa, Prochlorococcus marinus subsp. marinus str. CCMP1375
MSKTKFDFDLIVIGAGYGGFDAAKHAAENGLKVGIVESRELGGTCVNRGCVPSKALLAASGKVRELANADHLALFGIHAAPVRFERQKIADHANNLVANVRNNLTKTLERAGVIILRGQGRLEGPQRVGVRESSGVDKVLTAKDVILATGSDPFVPPGIETDGRTVFTSDEAISLEWLPRWIAIIGSGYIGLEFADVYTALGCEVTMIEALERVMPTFDPDITKIASRNLIAGRDIDAKSGVLASKVKPGCPVKIELADVNTRVVVEELEVDAVLVATGRVPSSKDLNLESMSVETHKGFIPIDESMRVLVDGKPLPHLWAVGDVTGKLMLAHTAAAQGTVAVDNILGNKRKIDYRSIPAATFTHPEISSVGLSEEQAKEISAKENFSLGIIRSYFKANSKALAELESDGLMKLLFRKDNGQILGAHIYGLHAADLIQEVANALARKQSVVDLALEVHTHPTLSEVVEVAYKQAVQQMKKL

SEQ ID NO: 58731 - protein, 373 aa, Triticum aestivum
MASSAGDMPEVKFKRTGSLGSSDYVRADKIDLTSLDIQLEQQLNKKWGKTNIKSQGPKADWEIDLAKLEIRHVIAQGTYGTVYRGTYDGQQVAVKLLDWGEDGFATEAETTALRTSFKQEVAVWHKLSHPNVTRFIGASMGTTDLKIPVNDNGARANLPARACCVVVEYLAGGTLKQYLIKNRRRKLAYKVVVQLALDLSRGLSYLHSRKIVHRDVKTENMLLDTQRNLKIADFGVARVEAQNPKDMTGATGTLGYMAPEVLDGKPYNRKCDVYSFGICLWEIYCCDMPYPDLSFADVSSAVVHQNLRPDIPRCCPSAFANIMRKCWDGNPDKRPDMDEVVQLMEALDTSKGGGMIPDGQSSGCLCFTRARGP

SEQ ID NO: 58732 - protein, 78 aa, Porphyromonas gingivalis W83
MSEVEKKVIDLVVDKLNVEASEVTREASFSNDLGADSLDTVELMMNFEKEFNMSIPDDQAQEIKTVGDAIDYIEKNLK

SEQ ID NO: 58733 - protein, 395 aa, Prochlorococcus marinus subsp. marinus str. CCMP1375
MLDTYKRLPLKIVKGNGCWLWDETGKKYLDAVAGIATCSLGHSDKKLSKVLSQQLRKIQHVSNLYRIPEQEDLAQWLVNQSCADSVFFCNSGAEANEAAIKLARKYGQIKRGIKRPIILSAKSSFHGRTLAALSATGQTKYQKGFEPLVEGFEFFSFNDSNSVQDLYENLEKDEPRVAAILIEPIQGEGGLNLGDQKFFYFLRDYCNKNNILLLFDEVQSGMGRTGKLWGYEHFNVEPDAFTLAKGLGGGHSIGALLVKENASIFEPGDHASTFGGNPFACKAGLTVAKEIQNRNLLENTYCRGNQLREGLQKLINNYPHHLEEVRGIGLMLGLAIKKNSNLTSQKIVELAIKEGLLVIGAGEKVIRMLPPLIITKREIETLLTRLNACFRKLNN

SEQ ID NO: 58734 - protein, 358 aa, Triticum aestivum
MASPSVFAEQMLIQNESRVKEYLPITGLADFNKLSAKLIFGADSPAIQENRVATVQCLSGTGSLRVGGEFLARHYHERTIYIPQPTWGNHPKVFTLAGLTARSYRYYDPATCGLDFQGLLEDLSSAPSGAIVLLHACAHNPTGVDPTLEQWEQIRQLMRSKALLPFFDSAYQGFASGSLDKDAQSVRMFVADGGELLMAQSYAKNMGLYGERVGALSIVCGSADIAVKVESQLKLVIRPMYSNPPLHGASIVATILKDSAMFDEWTLELKAMADRIISMREQLFNALKIRETPGDWSHIIKQIGMFTFTGLNSDQVAFMRQEYHIYMTSDGRISMAGLSSRTVPHLADAIHAAVTKLK

SEQ ID NO: 58735 - protein, 313 aa, Triticum aestivum
EFGTRIDLAHATKNFSEHLGTGGFGSVYKGALSDSTTIAVKRLDGARQGEKQFRAEVSSIGLIQHVNLVKLIGFCCQGDNRLLVYEHMFNGSLDGHLFKSNAFVLNWDIRYQIVLGMARGLSYLHQSCRECIIHCDIKPENILLNASFSPKIADFGMAAFVGRNFSRVLTTFRGTVGYLAPEWLSGVAITPKVDVYSFGMVLFEIISGKRNLPETCTGSGAGDHVEYFPLQVISKLCGGDMQSLVDPQLHGDFDLKQAERVCKVALWCIQDNESDRPTMGEVVRVLEGLQEIDMLPMPKLLAAITGRPNGTSV

SEQ ID NO: 58736 - protein, 1714 aa, Ustilago maydis 521
MSSARTSSGSRPPVVPATPVGRSMRKRNHLNLSAKAFDKMSKRLSSVEKSTGQSVMASWRTSDANEPLAAASNRIEGIPELGEGGHRTTASYVIGEADDNATNAPEQKSTTEYHLRRFGKVPVSRGLTQGAGKGPDGAALAAAAAKSLKGKGIAPVDSFLNEGSFVFNPLNRRVPQPTPRKAKTRTVSSANNAASSRAASGTVTSMTGAVATEARAPSQRYHPQSEQAGSSNQLPALSTAAAPTVRQAAPQSDSATTATATATADSDDLAFVALTLVDRDLQEALILEDLLYVLLGIEGQYIAYASTYDPENVAHRLRGAQFTIDPALDAPLRDLVDRILPLATDYTAIYAFIETDSGLEFGTVNHALCAAIRDLLHDYELLVVQLEHQMASSTSFSLQKLFMWVQETARTLAVVRALTDEIVGISHADLFDEDDDDDDSSDGDGGSEISGTSALERERRALLGLDDPDDQGVEGGIAKGGEVLSMLWDRITRMSGDPKARTLFTTLFQRASQPYAQTLIKWITTGDLSDTYEEFMVMEDAKVTRAALESDPTDEYWETRYTLRDETTLAKRERQRQLGLDLDAELEDEEENPRGILTGGAKIPSFLEPWKHKILLAGKYLNVIRECGLEVPPDPDKVETGSDVGAKLRTSAASSLTVVMNDESFFRRIEGAYQRANSALLKLLLGDQQILERLRSLKHFFFFSESDFLSSFLEQSAHELVKKVSPSKTRETVQQRLQTHLGAVLGSSSTVGFEDPFREDVRIVLASEGAYDQLKRIAETKGGIEATKLAQANAAAAAAAASAAGSSAKETLVSAVTLLQFDVAVKFPVSLVISRKNILRYQFVSRGLLHLKTLERSLSELWLDHSSNPLWKQRTHPALEKWKQKLFMLRWRMAFFVQQLLAFQMMEVVEPNYLELQRKLSNVKTVDQLMKDHFAFLNTTRKELMFTDLRYLELHSQLTNVISVFVENRTRFQDQMRLETQRWKEAGGDKRSVPEPALQEATVEFVAKFHKHWDKYAKTYKDVVNLLSTTDNPAALPLAYRRDVGRFVLVGAMSDSDSDFGKCGVFRLSDNGHAAPALDRRISPPTLMVANRIYTASSLVLNVSLSSLDYHRLSVAPVGTSLIGDRDVRVMSDLLPRTTLPAEILAYIIELVIITSTPSPRTIAPASAANTSCFTTPLASSSTSDWCSTSSLLLVSKFFFSVAHPLLLRTLTLDSTRAGLAFFRSETADKWLNKVQNGWFGNVSALQRHAGTSIDPVEWRLRQAAWYEECPGGFVVGHAYASRNKAKKTSERAERERKYRSVSVYWAEEELLEEVSDPDRSSSSESDDATDQDQPVPLWQQSSAMARSLPSHTTTSFGYRPTTPRPSTLRRSSHQASSTSWDASHSHPHEPAWQTLYSRPRRSSPGRSRSQASSCAMNGTGSSQGGTESPIGPSEGDLDPWDMQDAQERLTALANASSDHQDAVTSGDSLQSSVVNIALDSPPPMSASPTWFTLHNHARRREIYAYHICTATLEAFIQPLLSSIRTLRLITLTLYPGHLLDDDKLEHMLRRILSASESPRLETLLIRIVFDAATAGSRTRRFERTKTIAGAVNRIGDERVRVMLVNASVGEGELVESRSDQADEIWSPISRKAITSTKEGWWSRVLQQNHYTAQQEQTQLSSTPNSTNLTVPEEHQHQFNNWSMFFPPHRHADPTHLVNLIHHSDPWPDCPSPV

SEQ ID NO: 58737 - protein, 211 aa, Thalassiosira pseudonana
MVTFPQIGKRAPNFVTVGVFKKRLGRIRLSDYRGKKYVLLFFYPANFTPVSPTELINLSDRISEFRKLSTQILAVSIDSPFSHLQSLLLSRKEGGLANLNYPLISDLSQTITKDYKVLTEEGLGLPGVFIIDKEGIIQYYTVNNLLCSRSVNELLRILESIQYVKKNPGQACPENWHPSSLIGRQQYDQILYSHPLKSKLYFRDLYSSKKN

SEQ ID NO: 58738 - protein, 739 aa, Photobacterium profundum SS9
MDRKKVVLLVTLITLIGLWFAFDLSQYFTLEQAKAQQLALQDTIAEKPFLSSLVYFAVYILVTALSLPGAAIMTLLGAALFGFWWSLLLISFASTIGATLAFLFSRFILRDWVQAKFGNRIAPINAGIEKDGPFYLFTLRLIPVFPFFLVNLLMGLTPISTRMFYLVSQLGMLAGTAVYINAGTQLGEIESLSGIISAPVLMSLALLGLFPLIAKFIMNIITQRRVYANWKRPEKFDQNMVVIGAGAGGLVSSYIAAAVKAEVTLIERHKMGGDCLNTGCVPSKAIIRAAHTMAEISRAHEFGITTDKPQVNFEKVMSRIHNVIDKIEPHDSVERYSSLGVNCISGEAQILSPWEVEVNGQRITTRNIVIATGARPLVPGISGLQDVNYLTSDSIWSLKVQPKKLLVLGGGPIGCELAQSFSRLGSDVTLVEMAEQLLIREDTDASLLVKESMHKDGVDIKLNHKATRFESITAEDGTRIQRAYLEYNGKEVIVEFDAVMLALGRVANVQGFGLEELGITTTQRGTVDVNDYLQTKYPNIYAVGDVAGPFQLTHAAAHQAWYAAVNGLFGQFKKFKADYSVLPAATYTAPEVARVGINEKEAENLNIEFDVTRYGIDDLDRAITDGEDYGFVKVITPKGKDKILGVTIVGNNASELLAEFTLAMRHGLGLNKILGTIHPYPTMSEANKYTAGVWKQANAPQALLAWVKKYHAGMRNDKSQKITQPTAPNTQAKLEEEQR

SEQ ID NO: 58739 - protein, 151 aa, Methanosarcina acetivorans C2A
MNKQDLTYIAIFLVFLITVLLFALRPEDSPSVPESPAGFETVSVEEARGMIEKDEVFILDVRTPAEFNSSHIEGATLIPVTNSGGSNLSPDQLLEARINEVPRDKKILVYCRTGHRSITASKILVTAGYSDVYNMEGGITAWIGAGYPVVS

SEQ ID NO: 58740 - protein, 1041 aa, Polaromonas sp. JS666
MKRMLVNATQAEERRLAIVDGQKLLDYEIEIEGREQRKGNIYKAVVTRVEPSLEACFVDYGEDRHGFLPFKEISKQYFAQGVPVSQARINDVIREGQELLVQVEKEERGNKGAALTTFVSLAGRYVVLMPNNPRGGGVSRRIEGDDRAELKEAMDQLEYPNGMSIIARTAGIGRSAPELQWDLNYLLKLWTAIDGAGKGGKGAFLIYQESSLVIRAIRDYFNSDIGDILFDTDDVYEQARQFMAHVMPEHEHRVKRYRDDAPLFSRFQIEHQIESAYARTVQLPSGGAIVIDHTEALVSVDVNSARAIKGGDIEETATRTNLEAADEVARQMRLRDLGGLIVIDFIDMEESRNRRDVENRLRDALRQDRARVQFGTISKFGLMEMSRQRLRPALSEGASIPCPRCGGSGHIRDTESSALQILRVIQEESLKDSTASVLCQVPVDVASFLLNEKRSEIGKIELKQRINVLLVPNKTLETPNYRLERLKHDDPRLDNIEASYKLADEVEDPTTVTRRSQEKHNKQEPVIKGVLPDAPAPIAPPKPEPVAPAAKAAPRPAPAAPAHVAAEKGFFGWIKSLFGGTEAPAAAPAAEVKKDERSGEARREGRDGRGERGERSERGGRDGRRGGRSRGEGRGEGRGEARPESRPEGRGDRGEGRGGERRERSPEARGEGARQERPAGEARAEARPENRGEGQPRSEGRTDGRGEGRGDRSRRERGERGDRIPRDAAEQDLALANQAAMAAAMGGDAAVQGQDRPAQEAGRDGDRQQGGREGRGEGRRERGERGGERGGRRNDRRGERTEGQGPAADTAGNTVSGEAAPMAAVALDETGQTLTQNQNGQGDSPVDEQRQPRERRSRDRYGRDRRERGEERAESGERSEQAAESATAPASSEQNQAPALEERAPVATEFVASSVAPVAASAPAPAYTAPMAAAAPVATPVPVPVPVPAPAAASIMLPKVQAYALPLQDLAQVAESSGLQWVNSDAAKIAEAQAAIAAEIKPVHVPRERPPLAVSDEGPLVLVETRRDLGSMAQPFEQPSA

SEQ ID NO: 58741 - protein, 335 aa, Cytophaga hutchinsonii ATCC 33406
MQKKVDATKIAVIGGGSWATALVKILSEQNVRINWWLKNKKDVDYILQHGKNPNYLSNVPIDTKKVTPTTNVRKALEGASVVIFVVPAAFIGEVLETIPAADLKDKIVVSAIKGMIPSENILVTDLLQKTHAVPSQKICIIAGPCHAEEVALEKRSYLSIAGEDFTAASVVADLLQCGFVKATVVEDLYGVEYCAVMKNVVAIACGIARGLNYGDNFQAVLVSNAMLEIELFVDALSKKERNWNASAYLGDLLVTCYSPYSRNRTLGNMVGRGYSVKAAQVEMNMIAEGYYAVKCVYELNKKLHVQMPITKAVYNILYEKISPSVELRILEDSMC

SEQ ID NO: 58742 - protein, 162 aa, Vitis vinifera
MKVSSDMIEKMHQEAEMAWAPELVRVMKETKEPFLNAIYDCDPLEQIFWDNVVLIGDAAHPTTPHGLRSTNMSVLDAAVLGKCLEKWGVENLSSALEEYQSTRLPVTSKQVLHARRLGRLKQGLILADREPFDPKTASLEDCEELQQKNMPFFADIPLPLNS

SEQ ID NO: 58743 - protein, 528 aa, Candida albicans SC5314
MAIVETVIDGINYFLSLSVTQQISILLGVPFVYNLVWQYLYSLRKDRAPLVFYWIPWFGSAASYGQQPYEFFESCRQKYGDVFSFMLLGKIMTVYLGPKGHEFVFNAKLSDVSAEDAYKHLTTPVFGKGVIYDCPNSRLMEQKKFAKFALTTDSFKRYVPKIREEILNYFVTDESFKLKEKTHGVANVMKTQPEITIFTASRSLFGDEMRRIFDRSFAQLYSDLDKGFTPINFVFPNLPLPHYWRRDAAQKKISATYMKEIKSRRERGDIDPNRDLIDSLLIHSTYKDGVKMTDQEIANLLIGILMGGQHTSASTSAWFLLHLGEKPHLQDVIYQEVVELLKEKGGDLNDLTYEDLQKLPSVNNTIKETLRMHMPLHSIFRKVTNPLRIPETNYIVPKGHYVLVSPGYAHTSERYFDNPEDFDPTRWDTAAAKANSVSFNSSDEVDYGFGKVSKGVSSPYLPFGGGRHRCIGEQFAYVQLGTILTTFVYNLRWTIDGYKVPDPDYSSMVVLPTEPAEIIWEKRETCMF

SEQ ID NO: 58744 - protein, 313 aa, Pseudomonas fluorescens Pf-5
MSKMMVFTGNANPDLARRVVRQLHIPLGDISVGKFSDGEITAEINENVRGKDVFIIQPTCAPTNDNLMELVVMADAFRRSSATRITAVIPYFGYARQDRRPRSARVAISAKVVADMLTVVGIDRVLTVDLHADQIQGFFDIPVDNIYGSPVLVDDIEDQRFENLMIVSPDIGGVVRARAVAKSLGVDLGIIDKRREKANHSEVMHIIGDVEGRTCILVDDMVDTAGTLCHAAKALKEHGAAKVFAYCTHPVLSGRAIENIENSVLDELVVTNTIPLSAAAQACARIRQLDIAPVVAEAVRRISNEESISAMFR

SEQ ID NO: 58745 - protein, 177 aa, Vitis vinifera
  misc_feature (9)..(10): Xaa can be any naturally occurring amino acid
MAGPSSSWXXALVQISPYTFSAIGIAVAIGVSVLGAAWGIYITGSSLIGAAIKAPRITSKNLISVIFCEAVAIYGVIVAIILQTKLESVPASKIYAPESLRAGYAIFASGIIVGFANLVCGLCVGIIGSSCALSDAQNSSLFVKILVIEIFGSALGLFGVIVGIIMSAQATWPAGSA

SEQ ID NO: 58746 - protein, 253 aa, Rhodopseudomonas palustris CGA009
MTEPGETTHFGYRDVPLDEKQTLVNDVFHSVAGRYDLMNDLMSGGMHRLWKDVMITTLNPPRDDTPFRLLDVAGGTGDISFRAAKASGAGFHSTVCDINTDMLEVGRQRAVERNLDDKVDFVEGNAESLQFDDRSFDAYTIAFGIRNVPRIDLALKEAYRVLKPGSRFLCLEFSSVDVPGLSKLYDLFSFKVIPEIGRVVTGDADSYQYLVESIRKFPKPYDFAEMMRDAGFARANWQVMSGGIVALHSGWRL

SEQ ID NO: 58747 - protein, 469 aa, Zea mays
MGWSAGLWWLVAALWVVAAAAAAAEGEVVVGSAPRRHAYASMMYMGTPRDYEFYVATRVMMQSLRRLSADADRVVIASLDVPPLWVQALKDDGVKVVSVENLKNPYERQENFNMRFKLTLNKLYAWSLVSYERVVMLDSDNIFLQNTDELFQCGQFCAVFINPCIFHTGLFVLQPSMNVFKNMLHELSVGRENPDGADQGFLASYFPDLLDQPMFHPPANGTKLQGTYRLPLGYQMDASYYYLKLRWSIPCGPNSVITFPSAPWFKPWYWWSWPVLPLGLSWHEQRRENLGYSSEIPLVLIQAVLYIGVIAVTRLARPSLSKMCYNRRMEKNTMFLLSLLRIVAAWSILAAYTIPFFIIPRTVHPLLGWPLYLLGSFSLSSIVINIFFLHPITVLTTWFGFIGALVVMAFPWYLNGVVRALAVFAYAFCCAPLIWASLVKTMSSLQVLIERDAFRLGEPSQNAEFTKLY

SEQ ID NO: 58748 - protein, 352 aa, Ostreococcus tauri
MDAIPKETVLRRRERQSTARGVDGGAMPTQCVPTAVIGAAFCAKRCSSEALAKSLAFFPPDPPSYDLECANGETRARYNAARGTLPEAHARAFQRVLDACEATTRETTRGNEIVILACEAPSTADAASATRERVGGVTIVFSHGNAVDAGEVAPFARKLAQQLECRVVTYDYSGYGRSRGEASVADTHADIDAVVRHVRERYGVERREIILLGQSIGSGPTCAHASKNPGFGAVVLVSPLLSALSVVSSPSAWCTPAKVFKSLDVYKNYQHVKSAQCPFLLVHGELDAVVHVSHGEALWAAIKKTARPEDLVLEPYWIQGAGHDDTYDRNPAEFIRRLREVCALVRERCRQV

SEQ ID NO: 58749 - protein, 379 aa, Arabidopsis thaliana
MTTICDLPRDLVARILSRVPLTSMRRVRFTCKRWNTISKDPSFAKTHFGKAARQFIMMSQSRVSLMSVKLHGDGKLTSLNNLDQVEISKVFHCNGLLLCLTKDKTRLTSLVVWNPYLGQTRWIKPRHAFHRLDVYALGYDKNLKNHKILRFVDSYEPAVKHSIIEHEIFDLKSNAWRVLDATPDWEIDSYQRGVSLKGNTYFFAKEKIVVEGDDVVVIEDFKDFLICFDFTKTVTLSSVREEQLAVLYQQDTCLMEIWVTNKIEPDVVSWSKVFLAVDMEPLTGSFIPFAFFAGSFFIDEEKKIAVVFDKDQEEINDRAYLIGENGYYKEVDLGYMNGYYQQQVDPRGPDPVFPLVCSYSPSLVTIPQGTRGKRKERDY

SEQ ID NO: 58750 - protein, 514 aa, Candidatus Blochmannia floridanus
MMKKYQESFSCQEMCPSEYLKIALHSHVYEVAQVTPLQVMHKLSSRLKNIVLVKREDRQPVHSFKLRGAYAMLSNLTEKQQSSGVITASAGNHAQGVAFSASHLGISSVVVMPVNTADIKIDAVRHFGGKPLLFGSNFDEAKVKAIYLADKNCLTFIPPFDHPFVIAGQGTVAMELLQQDSHLDRIFVPVGGGGLAAGIAVLIKYLMPKIKVIGVESEESASLCAALEAGFPVYLSKVGLFAEGVAVRCIGHETFRLCQKYLDDVITVDNDSICAAIKDLFEDVRAIAEPSGALALAGMKKYIQRHAIHGEKLVHVLSGANINFHELRYISERCELGEQREALMVVTIPEKKGSFLEFFKILEDKSVTEFNYRYNGSKNVCVFIGVRLQNGRCERDSIVENILNHGFPVVDLSDNEMAKLHARYMVGSRSLQSFRERIFSFEFPEAPGALLKFLNTLGTDWNISLFHYRNHGTDYGRVLAGFELSHQELEFDQHLSKLGYTCHDVTTNPVFQFL

SEQ ID NO: 58751 - protein, 441 aa, Pasteurella multocida subsp. multocida str. Pm70
MNIYTYICFLSAISIFIGFVTRKLSDKIQYTIAITATSIIVSVLFLIFGHLSWFKLDIIATQVMEQLDFKSFLLNGILGFLLFAGALGIKLPVLKNQKWEITVFALFSTLASTFIIGVLLYSVAYLIGLPIDLIYCILFGALISPTDPIAVLAIIKNLKAPKRLSMQVEGESLFNDGVGLVIFTTIFAVAFGGHAPTLAGITELFLQEAVGGILFGLVIGFVAHLLISSTDDGSLEILLTLTIPTAGFMLANMLHVSGALAMVVAGILIGNWTRHTGFSKQSQLYLDHFWEMIDHFLNSLLFLLIGLALLLVDFGAQGFILLILAIPICLIGRYISVWMPFKVMQRFRSYNPYTLRILTWGGLRGGLSLAMALSIPKGMLYLEHIGMDVRDLLLVMTYAVVTFSILVQGSTIETMIKKSKESILHQRGYVGLHPNKTSSED

SEQ ID NO: 58752 - protein, 393 aa, Staphylococcus aureus subsp. aureus Mu50
MQFDNIDSALMALKNGETIIVVDDENRENEGDLVAVTEWMNDNTINFMAKEARGLICAPVSKDIAQRLDLVQMVDDNSDIFGTQFTVSIDHVDTTTGISAYERTLTAKKLIDPSSEAKDFNRPGHLFPLVAQDKGVLARNGHTEAAVDLAKLTGAKPAGVICEIMNDDGTMAKGQDLQNFKEKHQLKMITIDDLIEYRKKLEPEIEFKAKVKMPTDFGTFDMYGFKATYTDEEIVVLTKGAIRQHENVRLHSACLTGDIFHSQRCDCGAQLESSMKYINEHGGMIIYLPQEGRGIGLLNKLRAYELIEQGYDTVTANLALGFDEDLRDYHIAAQILKYFNIEHINLLSNNPSKFEGLKQYGIDIAERIEVIVPETVHNHDYMVTKKIKMGHLI

SEQ ID NO: 58753 - protein, 374 aa, Methanosarcina mazei Go1
MFRFADELGPFKIIHIYEPSIDLKAVLVVDNIARGPALGGVRIAPDVSAEECFRLARAMTLKNAAADLPYGGGKIVVYGDPKMPFEKKSQLLRALAGALRYTEEYIFAPDMGTDEICMACIKDEIGRVVGLPCEMGGIPLDEVGATGWGLFNATEVALKYCDFELKGARVVIQGFGAVGKHAARFLVRKGAVLVGVADSRGAVHNPEGLDVDSLIALKNEGKNVFEYPEGKKLASDEIVSVPCDIWIPAARPDVINGNNVHLLDTKLVVEGANIPLTGEAEKILYDKGILYVPDFIANAGGVICAASEHQKTTRSIVFGLIEEKVRSNTEQVLEASKTRGILPREAAFELAIKRVNRAMKYRRWSIFSSAPGFV

SEQ ID NO: 58754 - protein, 345 aa, Chrysanthemum x morifolium
MILINPTSLFYGASLKPRSTSFIYQTRKSQSVSISALLTKEQQSKHTQLESEFDFKSYMVQKANTVNQALDDAVPIREPKKIHESMRYSLLAGGKRVRPILCLASCELVGGDQISAMPAACAVEMIHTMSLMHDDLPCMDNDDFRRGKPTNHIVYGEEIAVLAGDALLSFAFEHVATATKDVSAERIVRAIGELAKCIGSEGLVAGQVVDICSEGADVGLEHLEFIHLHKTAALLEGSVVLGAIMGGGSDVEVERLRKFVRSIGLLFQVVDDILDVTKSSEELGKTAGKDLVADKTTYPKLLGIEKSREFAEKLNKEAQEQLKEFDIRKAAPLIALANYIAYRDN

SEQ ID NO: 58755 - protein, 580 aa, Sagittaria sagittifolia
MTSKNAGRVAGFFCCLVALLLFPSTYAITGSSSQLGRKHGMQGRQQRDECSRLDRLNQLQPSWQLQSEAGFSEVWDHNENELQCAGVSVTRHTIHQQGLLLPSHSNSQRVVYVVEGEGIGGVVIPGCSETFTSSEQEQGPYSSSPRGQSGQFPGGLQQAFSSQGDQHQRVQQLRKGDVLTIPAGFATWAYNNGDRPLILIVFLDFGDSANQLDSTPRRFFLSGGQQQQGQSQTQIRGGQSGRGQGQQQQQHGYRGSSSVSEQFPEGNLFDGFDVDIIAQSFGVNYETAQKLKSSSQQHQGFIIRVERDLQVARPTQREAQEWFQSQTEQGAGQIRRAGSRFQPFQQGGGRPSSPFQQGGTGGVSPYQQGGRGSPPYQMGGQSGRGSYGPLSNGIEESICNLKFKVNIGNPIHADVYSREGGHLTTLNSFKLPILSYLQLTVEKGHLRQNALVSPHWNGNAHSVMYAIRGNARVQIVDNSGRAVFDDMVNEGQVVVVPQNYAVVKQAVNDEFEWISLKTNDNAMVNQITGKNSVLNGIPEDVLVNAYQLSRDEVKELKQNRHQESLVLTPHQSQWSGRAAQ

SEQ ID NO: 58756 - protein, 526 aa, Oryza sativa Indica Group
MAVRRRRRRSRAAAVLVAALLLAASAATASAASSYPAKVVTGLLSSTASAVVKQLWSLKSTATRTGSAAAGRSMVKYEGGYAVETVFDGSKLGIEPHDVEVTPSGELLVLDSMNSNVYRVQLPLSRYSRPKLVAGSPEGLSGHVDGRLREAKMNHPKGFTVDDRGNIYVADAMNMAIRKISDTGVTTIAGGKSMRGGHLDGPSDDAKFSTDFEIRYISSSCSLLVIDRGNQAIREIALHNDDCEYQYEAGFPLGIALLFAAGFFGYMLALLQRQVLGMVSTADVHCFKDTEKEPQTPPRPSIASIPPYQKPLKPSLRPPLIPTEDQAGKHEAEEGFFTSIGKLIGGAKSSAVEIFSRKKRPTHQYHHHLQQQRANPWPVQESYAIPHDETPPPLDMRAATPRKNYAFMTKEPEKVHHVCHGRPYFNGWDMQHAPQQQPEQQMYHQQHLQQHRQYSAGPQTFYEQSCETTNEIVFGAVQEVDTKRRMVEIKAVNYGDTFYEQYGMRYRNNYIGYNNSSNGNNNSYYY

SEQ ID NO: 58757 - protein, 225 aa, Synechocystis sp. PCC 6803
MEITAVQSSYYGDMAFKTPPPDLESLLLKERIVYLGMPLFSSDEVKQQVGIDVTQLIIAQLLYLQFDDPDKPIYFYINSTGTSWYTGDAVGFETEAFAICDTLNYIKPPVHTICIGQAMGTAAMILSSGTKGYRASLPHATIVLNQNRTGAQGQATDIQIRAKEVISNKQTMLEILSLNTGQTQEKLAKDMDRTFYLTPAQAKEYGLIDRVLESPAELPKPMAVI

SEQ ID NO: 58758 - protein, 794 aa, Sagittaria sagittifolia
MPLPRSVPLHLCHLSRLLAPRGTEEAARTQQSEECARLDRLNALEPSMQVQSEGGFSEFWDQNEDQLQCAGVTAAQHTIHPQGLFLPSYSNSARFIYVISGEGIGGVVIPGCAESFSSFKQSSQQGQFSQGGGSGGQFGGQDIAGGSRQYQFQGDQHQKVHPLRKGDVITLPAGVVAWAYNEGDTPLVIVILIDFANAQNQLDRNVRRFFLAGNQQHVAQLQGGGSSMKGSESAGGNVLAGFDLDILSQSLGIDQETARKLKTSSQEQDGFIIRVERGLQIARPSWRESQEWSQSQSGSGYGTGGQTGPLPGGQGRQHGPFPGGQPGPFPGGQTGPFQGRDHGPGFGGQTGPFPGGQQTGPYRPGMGGQTGPFSAGQGSQESRGQSGPYPGGQGIGGQTGPFSRGSGSQGSRGQSGSYPGGHGIGGQSGSYPGGQGIEGQTQTGPFSGSQGSRGQSGSYPGGQGIEGQTGPFSGSQGSRGPSGSYPGGHGIGGQTGPFSGSQGRGQSGSYPGDQGIGGQTGPFSGSQGSRGQSGSYPGGQGIGGQTGPFSGSQGRGQSGSYPGGSESHGSRGQSGPFSGGPGGQSGPSSQRPGSQGSRGQCCQCYNGIEQSMCTMKFQSNVGDPRKADVYSRDGGHWTTLNSFKLPILSYLQLTFEKGQLRQNAMTAPHWNVNAHAVVYIIRGAARFQVVDQNGRTVHDDVVRQGQLLVVPQNFAVANQAQEDNFEWIALKTNENAIINQITGKGSAINALPDDLLANAYGLSNEEVKMLKQNRAQESLILPPQQGQLGGRTSL

SEQ ID NO: 58759 - protein, 336 aa, Xanthomonas axonopodis pv. citri str. 306
MSRPSLTRFLIEEQHAGRIDAELRQLITIVSRACKRISIAVSKGALGGVLGDAGTGNVQGEAQKKLDVLSNDILLEANAWGGHLAACASEEMDHSQPVPDQYPSGDFLLLFDPLDGSSNIDVNVSVGTIFSVLRAPKGTEKPGDEHFLQPGTQQVAAGYCIYGPSTMLVLTLGHGTHAFTLEREEGSFLLTQANMRVPEDTAEYAINMSNQRHWEPAMQAYVGDLLAGKDGARGKDFNMRWIASMVADVHRILTRGGIFIYPWDKKDPSKPGKLRLMYEANPMSMLVEQAGGAATTGRERILDIQPTQLHQRVPVFLGSKNEVAEATRYHLDADKA

SEQ ID NO: 58760 - protein, 549 aa, Oryza sativa Indica Group
MAAAAARRGSSLLSRCLLSRPSAAASPAVPSALRRADGTQGLLPGILQRFSTAAVAEEPISPPVQVNYTQLLIDGKFVDSASGKTFPTLDPRTGELIAHVAEGDAEDINRAVHAARKAFDEGPWPKMTAYERSRILLRFADLIEKHNDEIAALETWDNGKPYAQAANIEVPMVARLMRYYAGWADKIHGLVVPADGPHHVQVLHEPIGVAGQIIPWNFPLLMFAWKVGPALACGNTVVLKTAEQTPLSALFASKLLHEAGLPDGVVNVVSGFGPTAGAALASHMDVDKIAFTGSTDTGKVVLELAARSNLKSVTLELGGKSPFIIMDDADVDHAVELAHFALFFNQGQCCCAGSRTFVHERIYDEFVEKAKARALKRVVGDPFKNGVEQGPQIDDEQFNKILRYIKYGVDSGANLVTGGDRLGDKGYYIQPTIFSDVQDNMRIAQEEIFGPVQSILKFNDLNEVIKRANASQYGLAAGVFTNNLNTANTLTRALRVGTVWVNCFDVFDAAIPFGGYKQSGIGREKGIDSLKNYLQVKAVVTPIKNAAWL

SEQ ID NO: 58761 - protein, 147 aa, Oryza sativa Japonica Group
MASARGRAAPWARALVARHAAERRNEPLLRRIMGGDVYERAVSSAGAAVARSRRIVRRSQRVACSSRRKRRSLAMAAASGGGGALAARRMVKGRLRLLRRLVPGGEALRGFSLLSETLDYVVCLKTQVELMHSLCKGSQQKLHLQLG

SEQ ID NO: 58762 - protein, 400 aa, Xanthomonas axonopodis pv. citri str. 306
MSFFANVEQVPGDPILGLTEAYNADSRPNKVNLGVGIYYDENGRIPLLRAVHKIEQQLAQDAKPRGYLPIDGLAAYDKATQELLFGADSALVTSGRVATSQTVGGSGALRVGADLLKKLLPTATIAISNPSWENHRAVFGAAGFEVVDYTYFDAAIHGLNFDGMLADLAKLEPGTVVLLHACCHNPTGADLSKEQWKQVAGLLKERNLFPFVDIAYQGFDKGIEADAYAVRLLAAEGIDSYVVASSYSKSFSLYGERVGALSVVSATAAEAKAVQSQVKRIIRTIYSSPSTHGAALVAGVLTSPELRDLWEQELTEMRERIHSLRAGLVEKLATLGAPEFDFIQRQAGMFSYSGLTKTQVDRLRDEFAIYAVGTGRICVAALSQRNLDYVAQAVATVSRV

SEQ ID NO: 58763 - protein, 482 aa, Frankia sp. EAN1pec
MLEREQMFVGGAWVAPSTDSRIEVTSPHTEKLIGRVAAASTEDVDRAVAAARRAFDEGPWPRTDPAERVEVIRRLATLYRGHRDELAELITAELGAPISFARRAQVALPGALMTALADTAAGYSWQEKRPGTYGQDIILRKEPVGVVAAVVPWNMPQFLTVTKVIPALLAGCTVVLKPAPESSLDALFFADLLDQVGLPPGVVNVLPADREVSAYLVAHPGIDKVSFTGSTAAGRQVAAACAPNLTKVSLELGGKSAAIALDDADPATVARAVRLSGMGMAGQICNSLTRVLVPTSRVGDYADALAATLSAIRIGDPADPATEMGPLVARRQQERVRQYIDTGVREGARLVVGGTDLPDGIDRGWYVRPTVFSDVDNAMTIAREEIFGPVLVVIPYGDEDEAVRIANDSEYGLAGSVFTADTGHGLEVAGRVRAGTFGVNQGYSMDPAAPFGGVKASGYGRELGREGLEGYLDVKSISVATA

SEQ ID NO: 58764 - protein, 152 aa, Rubrobacter xylanophilus DSM 9941
MPAEVGERAPGFALPADSWEREVSLEEALERGPVVLFFYPGDWSSVCTDQLDEVQERLSEFSRRGAGVLAISVDSPWSHRAWAEARGITFPLLSDFHREVVRAYGVLNEQGFAERAYFVVDREGRIRARRVERTPRDRPPLERVLEDLDGAL

SEQ ID NO: 58765 - protein, 488 aa, Oryza sativa
MASPPPPPPSAAAPGSPPSAQVVGNAFVHQYYNILHQSPDLVHRFYQDGSRIGRPASPAAAEMDTVTTMEAINAKIVSMDIVRAEIKAVDAQESLGGGVTVLVTGHLTGSDDVRREFSQSFFLAPQEKGYFVLNDILRYVGGEGDQEVEPEPELELSFPPSQQPDSVPAPSANGTSVPREQEAFSQPEQHVADPAPNAQEADLNGEEVYNPPNNTEGPVVEETPIPEVIDEVPNNVAVAMPTPSAPAPAPAPVPQEEAPKKSYASIVKVMKEIPPQISAIPSRPAPPKQEKQVAPAPVAPVADAPTFSPNPESSNIQEAEVDAHAIYVRNLPLSATPEQLEEAFKKFGAIKPDGIQVRSHKIQGFCYGFVEFEDPSSVQSAIAGSPVTISDRQCYVEEKRTAGSRGGGRGRFAPGRGGNFRGEGMRGRGNYTGGRGYGRGEFNYRSDYGGRGAGRGGSSRGGDVGYQRVDHSAGRAARAPSGTSAVAK

SEQ ID NO: 58766 - protein, 202 aa, Tuber borchii
MASHADDELKPSTTEGYKVGEKKSVDEYKKLDAEDESLNRWKRSLGIGAGSTGGSLGEPGDARKVVVLQLCLLITGRPDVVINLDSPGALESLSGKPFTIKEGAEYRMRVRFRVQHEVISGLRYLQLVKRKGIKVDKSEEMMGSYPPNVSESPYYEKTFADEEAPSGMLYRGHYNALSKFMDDDGNNHLEFNWSFEIKKSWD

SEQ ID NO: 58767 - protein, 521 aa, Rigidoporus microporus
MPSFASLKSLVVLSLTSLSLAATVALDLHILNANLDPDGTGARSAVTAEGTTIAPLITGNIDDRFQINVIDQLTDANMRRATSIHWHGFFQAGTTEMDGPAFVNQCPIIPNESFVYDFVVPGQAGTYWYHSHLSTQYCDGLRGAFVVYDPNDPHLSLYDVDDASTVITIADWYHSLSTVLFPNPNKAPPAPDTTLINGLGRNSANPSAGQLAVVSVQSGKRYRFRIVSTSCFPNYAFSIDGHRMTVIEVDGVSHQPLTVDSLTIFAGQRYSVVVEANQAVGNYWIRANPSNGRNGFTGGINSAIFRYEGAAVAEPTTSQNSGTALNEANLIPLINPGAPGNPVPGGADINLNLRIGRNATTADFTINGAPFIPPTVPVLLQILSGVTNPNDLLPGGAVISLPANQVIEISIPGGGNHPFHLHGHNFDVVRTPGSSVYNYVNPVRRDVVSIGGGGDNVTFRFVTDNPGPWFLHCHIDWHLEAGLAVVFAEDIPNIPIANAISPAWDDLCPKYNANNPDSGLA

SEQ ID NO: 58768 - protein, 1099 aa, Candida albicans
MLESLNRRNSIDSNQADNDNDNDNHSNDELSPSELYYSPSGSPPKSQLLLRKSSSPSSYSPIKSDLPNIYSHLRSNDSESPPQPSPKQQSSLSSSSSSSSSSNTKSSTTKNIFKKLLRINKSSDNIDESRSIVSNNGGSPMSDSTTVTSTLSTDTAPKRGKSIQRSQILHHTDSDSLYLENQIELRPEISKSIGNIKIPSIFTNDGMPLLKISHKSKKRILFWIDPSCFKFSWRMANSTTTTTSATTSATTSGLPQGITNTTALSNSAIISTPAIATSAIHRLSITNRTTHEFVLDDIKSIYIQNEGSGYREELNISQKLEKNWITIIYFNHKKNSLKSLHLITDNDHDFKKLISAIYNLKQLRSQLAKEFLIDLNELDENYVKMLLNKELLAGDNGNVDGNEVDIRKSHKHVREFLSFNDILKYSKRLNINVNTNHLQQIFDQVLLLSSATTEKPVSTPLFEKGLNFEQFKQFVSILKDRKDLQEIWDSLAQGKEVLQFDEIKNFIINIQKENFSDDDDNSTINLIFQKYCSNDNGWNKESLNEYLLSSYSTPYREITQTQTNYYDYPLNEYFISSSHNTYLTGRQVAGDSSVEGYIRTLQRGCRCVEIDIWNGDSNTTTTTVIGTKDDDDKNEYEPIVNHGRTFTKPISFANVIRAIKKFAFIVSPWPLILSLEIHCSPECQIKVVNILKDILGENMIIAPIDIDSVILPSPAELKHKFIIKVKKTTSFQNLIETENGSFTTSTTTTTTTTTTTTTATSLSEDNENNKSNSSSTSSFIIRRRKNKSPKIINELSNLGIYTQGIKFRNFSLPESKTFNHCFSLGEKSINRMIKDDDKKISLDKHNRRYLMRVYPSGTRLKSSNFNPLPYWSHGVQMVATNWQTYDLGQQLNEALFENKIFQGYVLKPSVLRKPTLKSSSSNVDTRTSLTTTNSKTIRFNFEIISGHQLPKFPKDDYKDQAINPYISFEIIGAQDVQWDNNDSSPIAPTTSSSPFIRTTKIIRENGFNPNFNTKFSGSIITTTNDLIFIKFVVYASTSLNYPDYGENFPIAILVTKLNYLKQGYRYIYLNDLLGEQLVYSSIFIKIEYDEDLLNEFINK

SEQ ID NO: 58769 - protein, 76 aa, Wolinella succinogenes DSM 1740
MAIFDDIKEVVVEQLNVNPEEVKEESKFVEDLGADSLDVVELVMALEEKFNIEIPDEEAEKIATVGDVVRYIETNK

SEQ ID NO: 58770 - protein, 352 aa, Bacillus pumilus SAFR-032
MIGQDDVRKLVGKMDEPFLHIPLGELDAIKEISLKPEKEHVSLKVAIAKTGTAEQMKLQQDIVQALKAEGANTVGLRFEELPQETLERFMPSQDEEENLLNSKNPPEFLAIASGKGGVGKSTVSVNLAVALARLGKKVGLIDADIYGFSVPDMMGITVRPTVKGEKIIPVERFGVKVISMGFFVEENAPVIWRGPMLGKMLNNFFHEVEWGELDYLLLDLPPGTGDVALDIHTMLPSCKEIIVTTPHPTAAFVAARAGAMALQTDHDVLGVVENMSYYESKKTGEKEYVFGKGGGDKLAEELRVSVLGQIPLRQPDWNEDDFAPSVYDASHPTGEVYQHIANKVIEQLAVKA

SEQ ID NO: 58771 - protein, 247 aa, Wolinella succinogenes DSM 1740
MKFSGKNVLITGSSRGIGADIARVLAEMGLKVWINYRSQSSLADELKAEIEAKGGQAAVISFDATDEEAFISGIKTIIDADGELAYLVNNAGITNDKLAIRMKTEEFRSVIEANLTSAFIGSREALKSMSKQRFGSVVNISSIVGERGNAGQTNYSASKGGMIAMTKSFAFEGAPRNVRFNCVTPGFIQTDMTHGLKEEVKEAYIKNIPLGRFGDSKEIAHAVAYLLSDYSSYITGEILKVNGGLYM

SEQ ID NO: 58772 - protein, 413 aa, Glycyrrhiza uralensis
MGSLGAIARHPDDVYPLLKLKMAARHAEKQIPEEPHWAFCYTMLLKVSRSFALVIQQLDPQLRNAVCIFYLVLRALDTVEDDTSIATDVKVPILIAFHRHIYDRDWHFSCGTKEYKVLMDQFHHVSTAFLELEKNYQAAIENITKRMGAGMAKFICNEVETVDDYDEYCHYVAGLVGLGLSKLFHASGKEDLAPDHLSNSMGLFLQKTNIIRDYLEDINEIPKSRMFWPRQIWSKYVNKLEDLKYEENSVKAVQCLNDMVTNALLHAEDCLKYMSALRDMSIFRFCAIPQIMAIGTLALCYNNIEVFGGVVKMRRGLTAKVIDRTKTMADVYGAFFDFSCMLKSKVDKNDPNATKTLSRLEAIQKTCRESGLLSKRKPYILRNESTNSSTMVLILVIILSIIFAYLSANRQNN

SEQ ID NO: 58773 - protein, 412 aa, Glycyrrhiza uralensis
MGSLGAILKHPDDLYPLLKLKIAARQAEKQIPREPHWSFCYTMLHKVSRSFAFVIQQLGPDLRNAVCIFYLVLRALDTVEDDTSIATDVKVPILIAFHRHIYDRDWHFSCGTKEYKVLMDQFHHVSTAFLELGKNYQEAIEDITKRMGAGMARFICKEVETVDDYDEYCHYVAGLVGLGLSKLFHASGSEDLASDYLSNSMGLFLQKTNIIRDYLEDINEIPKSRMFWPRQIWSKYVNKLEDLKYEDNSVKAVQCLNDMVTNALMHAEDCLKYMAALRDLAIFRFCAIPQIMAIGTLALCYNNIELFRGVVKMRRGLTAKVIDRTKTMADVYGAFFDFASMLESKVDKNDPNATKTLSRLEAIQKTCRESGLLNKRKSLLRNGNGYGSTMILILVILFGIMFAYLSANHQDN

SEQ ID NO: 58774 - protein, 438 aa, Cytophaga hutchinsonii ATCC 33406
MNTHKATTINLFSLKTPNMKAFHMTWMAFFLCFFGWFGIAPLMVMVRDELHLTKGEIGNIMIASVSITIFARILIGYLCDRVGPRIMYAALLILGAFPVMLIGLSNDYTSFLLFRLTIGVIGASFVVTQFHTSAMFAPNIIGTANAVTAGWGNLGGGVTQLVMPLIFAGFVGLGYSNSESWRLAMVVPGIALLIMGILYFLYTTDTPEGNLADLKKKDPNFTLKKKQSQVSFAEIFKDYRVWVLAFCYGACFGIEITIDNIAALYFKDKFNLSLEAAGLIAASFGMMNLFARALGGMLSDKIGNTKGLNGRVLVLGACILLEGIGILIFSNMEVLVFSVISMIGFALFVKMSNGATYAVVPFVNKNAVGSVAGIVGAGGNIGAVLMGFLFKSESLTYNDAFSIIGYCVLGIAVLAFTIRFVTSTEKKQVEFTAVESLA

SEQ ID NO: 58775 - protein, 480 aa, Bacillus pumilus SAFR-032
MKDLFVKQEWFGYVRQDVLAGILVALALIPEAIAFSIIAGVDPKVGLYASFCIAIVISFVGGRPGMISAATGAMALVMVNLVADHGLQYLFAATILTGLIQIVFGLCRVSRLMKFIPRSVMVGFVNALAIMIFMAQLPHFVGESLAMYIMTGGALLIIYLLPMVVKVIPSPLIAIIVMTIIAVFGHIDVRTVGDMGELPSTLPAFLIPQVPFSWETLAIIFPYSLALAMVGLLESLLTAQIVDDMTETSSRKNKEARGQGIANVVAGFFGGMAGCAMIGQSVINTKAGGRGRLSTFVAGAFLMVLIFVLGDVVVQIPMAALVAVMIMVSVGTFDWSSFQQLKKNPKTDSIVMIVTVVTVVLTHDLSKGVFAGVLLSAVFFVAKISKLHITSTEKQVGTWVYRIKGQIFFASVTDFIQAFHQGNDLQTVVIDLSEARIWDESGVAAIERVKEKYHAAGVQVDIVGMDTQSRNLVKQVNGSS

SEQ ID NO: 58776 - protein, 321 aa, Bacillus pumilus SAFR-032
MLVRLNQVLGRMMPFITPISVLLGVLLAAYLKDFTFMVPWVFAIMTFSGSLSSTFSALKHTVMHPLPLILSFMILHVLMPLYAWSAGHLIFAGDSMTITGLTLAMVIPTGVSSLIWAAMYKGNVGLTLSIILIDTLLSPLIVPVSLSLFVGTQVHMDMVAIMKGLFGMVVLPSILGMLVRQYAKPSVTKAMSQTLAPFSKLGLFVVVSINSSVVAPYLRELDAAFFSKAATVFFIAMSGYAFAWLIGKVMKCTQGEIVAIVYTGGMRNISAGAVLAISFFPPAVAVPVVIGMLFQQVLAALFGSLLNRFELKAPAVTKSLT

SEQ ID NO: 58777 - protein, 535 aa, Arabidopsis thaliana
MSSELQISPAIHDPQGQEKQQQAAGVGILLQIMMLVLSFVLGHVLRRHKFYYLPEASASLLIGLIVGGLANISNTETSIRTWFNFHDEFFFLFLLPPIIFQSGFSLQPKPFFSNFGAIVTFSVLGTFVASMVTGLLVYLGGVMFLMYRLPFVECLMFGSLISATDPVTVLSIFQELGSDVNLYALVFGESVLNDAMAISLYRTMSLVRSHSSGQNFFMVIVRFLETFVGSMSAGVGVGFTSALLFKYAGLDVDNLQNLECCLFVLFPYFSYMLAEGLSLSGIVSILFTGIVMKHYTYSNLSANSQRFVSAFFHLISSLAETFVFIYMGFDIAMEKHSWSHLGFIFFSILFIVIARAANVFGCGYLVNLARPAHRKIPMTHQKALWYSGLRGAMAFALALQSVHDLPEGHGQTIFTATTAIVVLTVLLIGGSTGTMLEALEVVGDSHDTSLGDGFEVVNSRYMTSYDDEDTPPGSGFRTKLREFHKSAASFTELDRNYLTPFFTSNNGDYDDEGNMEQHHEERIPFTRRGNLNNRG

SEQ ID NO: 58778 - protein, 402 aa, Streptococcus pyogenes SSI-1
MKIAVAGSGYVGLSLGVLLSLQNEVTIVDILPSKVDKINNGLSPIQDEYIEYYLKSKQLSLQATLDSKAAYKEAELVIIATPTNYNSRINYFDTQHVETVIKEVLSVNSHATLIIKSTIPIGFITEMRQKFQTDRIIFSPEFLRESKALYDNLYPSRIIVSCEENDSPKVKADAEKFALLLKSAAKKNNVPVLIMGASEAEAVKLFANTYLALRVAYFNELDTYAESRKLNSHMVIQGISYDDRIGMHYNNPSFGYGGYCLPKDTKQLLANYNNIPQTLIEAIVSSNNVRKSYIAKQIINVLEEQESPVKVVGVYRLIMKSNSDNFRESAIKDVIDILKSKDIKIIIYEPMLNKLESEDQSVLVNDLENFKKQANIIVTNRYDNELQDVKNKVYSRDIFGRD

SEQ ID NO: 58779 - protein, 513 aa, Synechococcus sp. CC9605
MLGDLWSFQGRYRTLHLTWIAFFLTFVVWFNLAPLATTVKTDLGLTVGQIRTVAICNVALTIPARVLIGMLLDKFGPRITYSSILVFSAIPCLLFASAQDFNQLVVARLLLSIVGAGFVIGIRMVAEWFPPKEIGLAEGIYGGWGNFGSAFSALTMVALAGFLSFSGGFELPTGAVLNWRGAIALTGIVSAVYGLFYFFNVTDTPPGKTYQRPEKTAGLEVTSMRDFWGLLGMNVPFAAILCVLCWRLGKVGFLTPSTYPLALGAVAVWFAFQTWGIIRTNRDLILGNKVYPKEDRYEFRQVAILELTYIVNFGSELAVVSMLPTFFETTFDLPKATAGILASCFAFVNLVARPAGGLISDSVGSRKNTMGFLTAGLGVGYLVMSMIKPGTFTGTTGIAVAVVITMLASFFVQSGEGATFALVPLVKRRVTGQVAGLVGAYGNVGAVTYLTIFSLLPMWMGGGGEPTPEVIAASNSAFFQILGVAGLIVAFFCFFFLKEPKGSFADLHEGETA

SEQ ID NO: 58780 - protein, 283 aa, Oryza sativa
MVVRAGAYDDELIKTAGGLGDGRVERDVREEAGVDRNRQAYRTLLVTAPGLGQYISGAILFEETLYQSTVDGRRIVDVLAEQGIVPGIKVDKGLVPLAGSDPESLEDGLVPIVEPEILLDGEHRVERTFEVAQKVWADTFFHMSENNVMLEGILLKPSMVTPGAESKDGAATPEQVAAASRRRCPASCSSPAASRRWRRRGNLNAMNQAAPSANPWRWRVSFSYARALQNTCLKTWGSRRENVAAAQGELAGAARQVHQRRRGRRGQRGHVRQELHLLKIIFD

SEQ ID NO: 58781 - protein, 262 aa, Candidatus Blochmannia floridanus
MKNLSIIANWKLNGNKNTITNSLINLTTQLTNIPQYIKIAIAPPILYIDMVKNHLTSYNNKTIELCSQNVDIHLSGAFTGDISASMLKDLSVKYVLIGHSERRIYHKENNSLIAQKFSIIKQTELIPILCIGENKEERDSGSTQSICIQQIDSIIKLVGIKAFENTIIAYEPVWAIGSGSSASPRNVQSIHQFIRNYIAQYDKTIANQISIQYGGSITTDNVLEFITQKDIDGVLVGSASLDIRNLIKIINLSSNLIKKTYQ

SEQ ID NO: 58782 - protein, 187 aa, Alkaliphilus metalliredigens QYMF
MIVIIDNYDSFTYNLYQYIGEINPEVMVFRNDKVSLVELKEMDISHIIISPGPGFPTDTGISKVVIKELGIKIPILGVCLGHQAIGEAFGGKVVHAKRAIHGKISLIQHNQDDVFEGIEKPLKATRYHSLVVEVDSFPEELEITATSDDGEIMGLKHKKHPIFGLQFHPESIATEGGKKMIRNFLNI

SEQ ID NO: 58783 - protein, 244 aa, Candidatus Blochmannia floridanus
MSSNKVDIVWNNMIIEARLLIDSEPILKKFLNVTLLNHDNFQDALVYLLFKKLNNLDMMTIDLIDILKDIYRTNDIIDAAAQDICTIRLRDPSVQKYLTPFLYLKGFHALQAYRITNWLWNHNYPGLAMYLYNRISIIFNVDIHPAAKIGCGIMLDHATGVVIGETAVIDDNVSIMQSVTLGSTGKIDGNRHPKIKKGVLIGAGSIILGNIEIGCGSKIGAGSIVVHSVPPYSTVVGRPARLVQ

SEQ ID NO: 58784 - protein, 468 aa, Ostreococcus tauri
MPAPARVRALEHAGDLRDKIVLVRVDHNCVKNGVVRDAYRIEQSLPTLYNIVERGGRPILITHVNRPRDGADGSITIDKSRDGVDAVVDVLRRMLGVTFAAPTFGTAGRGDGIASVDTSINFLLDDLRARRIGGIYLPNSRWFAGEEAKAGSEAYEAFSRQLAGLADVFVNDAFGSWQPHVSTVGVTKYLPSYAGLLMQRELRAVEAVLEPVRPFVAVVGGSKLDTKIETLNAVASRCDSLVLGGVVYNAYLCAKYGVEIEGVSERDVELAGQLLAPETQAKIIELPVVVESTSLQGCGCVPKEGECGKPMEGAGTTRPLHIDQLQRGASYGYVLDVAASSFEDEKVKLAMQGAKTIFVNAVMGFTSSGFHEGTTALDHAIAENKSARKYFGGGDTIQEFKSLTPALFMSAVLDPTFYLFTGGGTVLKALELGGGEKLETVQCLLADADEKIPLKEEPKCMRFADCAC

SEQ ID NO: 58785 - protein, 499 aa, Arabidopsis thaliana
  misc_feature (86)..(86): Xaa can be any naturally occurring amino acid
  misc_feature (98)..(98): Xaa can be any naturally occurring amino acid
MPQAPMPEFSSSVKLKYVKLGYQYLVNHFLSFLLIPIMAIVAVELLRMGPEEILNVWNSLQFDLVQVLCSSFFVIFISTVYFMSKXPRTIYLVDYSCXYKPPVTCRVPFATFMEHSRLILKDKPKSVEFQMRILERSGLGEETCLPPAIHYIPPTPTMDAARSEAQMVIFEAMDDLFKKTGLKPKDVDILIVNCSLFSPTPSLSAMVINKYKLRSNIKSFNLSGMGCSAGLISVDLARDLLQVHPNSNAIIVSTEIITPNYYQGNERAMLLPNCLFRMGAAAIHMSNRRSDRWRAKYKLSHLVRTHRGADDKSFYCVYEQEDKEGHVGINLSKDLMAIAGEALKANITTIGPLVLPASEQLLFLTSLIGRKIFNPKWKPYIPDFKLAFEHFCIHAGGRAVIDELQKNLQLSGEHVEASRMTLHRFGNTSSSSLWYELSYIESKGRMRRGDRVWQIAFGSGFKCNSAVWKCNRTIKTPKDGPWSDCIDRYPVFIPEVVKL

SEQ ID NO: 58786 - protein, 335 aa, Bradyrhizobium japonicum USDA 110
MNNMQTGSTPHDDRAGVSANGILGAQARGASGRLLPEIWMQDGAKRVEEALARLLCAEDDGETELMAAMRYATLHGGKRTRALLCLAAGALADTPAHMLDDVGAAIEMMHACTLVHDDLPAMDDDVLRRGLPTVHVKFGEATAILVGDALQAHAFLTLASLNAPGDSPIALVRELAQAVSAEGAAGGQAIDLSLVGKHVELDRIVAMHRMKSGALVRASVRMGALCAVGVNAAHAALYCALDHYSACFGLALQVIDDILDVTADTAALGKTPGKDAAAQKPTCASIMGLQEARQFALDLLRDAGEAIAPLGPRAERLAQLIQRANAYLFKHAPRA

SEQ ID NO: 58787 - protein, 1338 aa, Kluyveromyces lactis
MSFLKKKSSTAGHSRSGSASSILNKHVDPANISEFYPSSLDHKVTSGLKNDYSFDSSSKGSRKSSGGSTNSLTSERLLFNWDVTDPSQWTMPRIIQWFRANDFNDQWITFFKRNSISGNKFLKLLAYDNFAPYEKSLQQSKSSSYERFQYLLKKTLEENVVKGNNRNGNRIINNSRSSSESAKVSQRLSTSFSTHIRSTSESALLNIENITKDSSSSEPTTSKKQEASNYSLPLRQAKTNSASALYRRSLISLRNASSTKDNASKNDIKITIPPRPLSTTENTNKSPTTPSSVSPSHTAYTGIFRRQHKTSSSESSLFTSIFGHGVVEEPEETPKPRPVENRRIPAASTVNASTSKQSINVDDKARLWDKIKRKGQLPAEPSSQPAARIIIEEVKESPKAEPPEIVIPEEIYPKRPSDSRELFIMLTKDNSTFSPFNVQPHLGTDVSELKKAVALALGLTHSNFSIHLTDFGAEFGSQIPDGLLADFQKTSFQNIPNKLYIQDLEKKANLNPRPRTETLASQHSTAASTKSKTSVKSNASAASNGEGSSSDLTSIDDQGSSHRRAYPQTPSHYYDNSTSAETDYWSFKDSVPETISDAPHITLPKSRPSLKLNSSVLNTHASEKSTFRIIRQTSDTDIDFNKRRESPYVRVAELAPKRKAPKPPVNGNPVTSGSLPSAAAKNVSESPLESPPKLDRNGKTIYQKNKPRPPPPLTTERSSRRSVSSLSGQDLNEVKESPVQSFTPASTQVMVPQPYKGALETLKPRKSSADLSIRPRMSLRQFSRSNSSLNRKVLSTSRQTLNRTNSKPLVTSSTAADIFDENDISFADAPELSDSDDYSASSDEIIWSRDRKSISNDVPEFSFNTEDTIDLVGTDTTQVSVGATEGSDTPKKMALRPSPDVVYQNLEKFFPDADLDNPILEGLTPPPSPNADSSPPSPRGFEKSLKTKSEQQPAFLSSRGESSQFLTPVKSLKPPKRTKTIRIIAQEASEARKNEVSQKLQRKNTKMWGTKVVEITDKRTISINKSRNSRGEYKEFAWIKGEIIGKGSFGAVYLALNVTTGEMLAVKQVTVPEFSSQDESAISMVEALKSEVSTLKDLNHVNIVQYLGFEEKNGIYSLFLEYVAGGSVGSLIRMYGRFDDQLIRHLTKQVLEGLAYLHSKGILHRDMKADNLLLDNDGVCKISDFGISRKSNNIYSNSDMTMRGTVFWMAPEMVDTAHGYSAKVDIWSLGCVVLEMFAGKRPWSNFEVVAAMFQIGKSKTAPPIPDDTKDLVSPAGQSFLDQCFEIDPEMRPTADSLVGHPFCKTSSSFDFPKTKLAQFIKSNDKLNSSRLRISSQEL

SEQ ID NO: 58788 - protein, 273 aa, Zea mays
  misc_feature (32)..(32): Xaa can be any naturally occurring amino acid
  misc_feature (38)..(38): Xaa can be any naturally occurring amino acid
  misc_feature (255)..(255): Xaa can be any naturally occurring amino acid
ADAATLQRATVERDTREQRLQAAAAQRHEPAXTRDGHXAVEVFANIGESAGVASAVEQGAEGIGLLRTELIFMAHKQAPDEATQEAEYRRVLDGLGGRPLVVRTLDVGGDKPLPYWPIAKEENPFLGVRGIRLTLQRPQIMEAQLRALLRSADNRPLRIMFPMVGSVDEWRQARDMTERLRLEIPVADLQLGIMIEVPSAALLAPVLAKEVDFFSVGTNDLTQYTLAIDRGHPTLSAQADGLHPAVLQLIDITVXRAAHAHGKLGSAFGGELA

SEQ ID NO: 58789 - protein, 429 aa, Arabidopsis thaliana
  misc_feature (29)..(29): Xaa can be any naturally occurring amino acid
  misc_feature (39)..(39): Xaa can be any naturally occurring amino acid
MIVKALEIRRKVTKEIIKESLVRKGRFGXTYATNVTDRXGDFVDHVMIQAAALKRLPEFSESRFNLRARTVIEDSNFVPLVRWLKHHELSYNRIAKIICMSKGNLDSIRIMIEWLKSIHVKGEFIAVAFLRSGDNILQRNREELNEIVEYLESNGVRRDWMGYVVGRCPELLSFSMEEVKSRVDFFLKMGMNQNDFGTMVYDYPKIIGFFSFQVMEKKINYLKEFGLSTEEVGRLLAYKPHLMGCSIEERWKPLVKYFYYLGIPKEGMKRILVVKPILYCIDLEKTIAPKVRFLQEMGIPNEAIGNMLVKFPSLLTNSLYKKIRPVVIFLLTRAGVTQKDIGKVIAMDPALLGCSIGTKLEPNMRYYISLGIRFYQLGEMIADFPMLLRYNVDNLRPKYRYLRRTMIRPLQDLIEFPRASDNPKAHHYG

SEQ ID NO: 58790 - protein, 422 aa, Colwellia psychrerythraea 34H
MSIVAVGINHKTAPVAVREKISFNPDKLSIALQEMLNAVQCREVAILSTCNRTELYLVQDGDFDVTQQRLIKWLESFHNVPASTILPSLYWHKDQQAVNHMMRVACGLDSLVLGEPQILGQMKQAYSQAKAAGSMSLIMDRLFQRTFGVAKQVRTETEIGASAVSVAFASVNLAKHIFGGLEKTKVLLVGAGETIELVAKHLYENNVGKITVANRTLARAENMATKIGADVITLAQIPEHMCNADIVISSTGSTLPIIGKGMVEQALASRKHQPIFMVDLAVPRDIEEQVSELEDVFLYTVDDLQGIIAKNIANRRKAAVQAESIVNSQSDNFMAWLRGLNTQDTVISYRKQCLDNRDVLLEKAFIQLKNGKNSEAVLAELANKLTNKFMHAPTSALQSAAQGGELDKLIYLRDIFNIDSQE

SEQ ID NO: 58791 - protein, 475 aa, Burkholderia pseudomallei K96243
MTYRTEDIADVAPLYASAAPAHRTSAEYRALDAAHHLHPFSDMGSLNRAGSRVIVKAEGVHLWDSDGNRIIDGMAGLWCVNVGYGRDELIEAGSRQLRELPFYNTFFKTTHPPVIELSALLAQIAPPAFNRFFYCNSGSEGNDTVLRIAHQYWRAQNRPQKKFVISRRNGYHGSTIAGATLGGMSYMHEQMPSKVEHIVHIDQPYYFGEAREGQTPEAFGLERARQLEAKILELGAQNVAAFIGEPFQGAGGVIFPPSTYWPEIERICRQYDVLLVADEVIGGFGRTGEWFAHQHFGFAPDLMTLAKGLTSGYVPMGAVALSDRIADALIAHGEFNHGMTYSGHPVAAAVAVANLKVLRDERIVERVKTDTGPYFQQRLRETFANHSIVGDIAGAGLVAGIQLAREPRTRKRFENGGEVGTICRDYCFNGNLIMRATGDRMLLSPPLVISKPQIDEIVEKAKRAIDATAKQLGFA

SEQ ID NO: 58792 - protein, 444 aa, Burkholderia pseudomallei K96243
MQDIDDFLRQHRITEVEAIIPDMAGIARGKIIPRNKFETGESMRLPQAVMVQTVTGDYPEDGTLTGVTDPDMVCVADASTICLIPWAVDPTAQVIHDCVHFDGSPVEISPRYVLRRVLDLYRARGWKPVVAPELEFYLVDMNKDPDLPLRPPVGRTGRAETGRQSYSIEAVNEFDPLFEDIYEYCELQGLDIDTLIHEVGAAQMEINFLHGDALSLADQVFLFKRTVREAALRHNMYATFMAKPMESEPGSAMHIHQSVVDIETGRNLFIGASGDVTPMFRSYLAGLQKYTPALMPIFAPYINSYRRLSRFMAAPINVQWGYDNRTVGFRIPHSAAAARRIENRIPGVDCNPYLAIAGTLAAGYLGVTQGLEPTEPLASDGYSLPYQLPRNLEEGLTLMSACAPLAEMLGEKFVKAYLALKETEYEAFFRVISSWERRHLLLHV

SEQ ID NO: 58793 - protein, 354 aa, Oryza sativa
  misc_feature (214)..(214): Xaa can be any naturally occurring amino acid
MEDQSLKPIRCKAAVCRAASEPLIVEEIVVDPPKAYEIRIKIICTSLCHTDVTLWHKVDPAFPRILGHEAYGVVESVGENVEGLAAGDTVVPTFMGQCDSCASCAAEWTNQCTAVPFTMGPGMRRDGTTRFWDGEGKPLSDTVAVTSFSQYTVVDVNQVVKVDPAVPPKIACLLGCCGGTDILNLLGVGAAWRLAKVQPGSSVVVFGLGSVGLXGKEFGVTDFVNPSQLGDKSVSEVINAMTDGGADYSFECIGISSVMTEAGRGKTIILGVEKDSQPLCLPSFEFLFGKCVMGSLFGGAKPKTDIPILAEKCMNKELELEKLVTHEVGLTEINTAFDLLLQGKSLRCIIWMDK

SEQ ID NO: 58794 - protein, 522 aa, Methanococcoides burtonii DSM 6242
MESFKKLGIEDAILRSIEDKKFEEPTEIQKMAIPLILEGKDIIGGAATGSGKTLAFGCGIIQKIEKGNGIRALVLTPTRELAEQVQNSLKEFSRHKQLRVAPIYGGVAINPQIRQLERADVVVATPGRLLDHIERGTIDLGDVEILVLDEADRMLDMGFIDDVEEIIDECPSDRQTMMFSATVSKDIQYLSSKYMNNPSKVFAKAYVDSDKLKQVYIDVPKKMKFSLLVHLLKSEKSGLVMVFCNTRSNVDFVQKNLRKNDIDAIAIHGGHTQAKRKSTLSKFHSSNAHALVCTDVAARGLDIPHVSHVYNFDIPDDPSEYVHRIGRTARAGREGKVINVVADVDKGGFTRLSKMHRNFKIEREDLPEFERVLIKSEDSGGRPTRGRREDRKGGRREDRKSAYGGRSSGGSSGGRSSDRSSGGSSGGRSSDRSSGGSSGGRSSDRSSGGSSGGRSSDRSSGGSSGGRSSDRSSGGSSGGRSSDRSSGGSSGGRSSDRSSGGSSGDKARTGFKKRTGVQRKRE

SEQ ID NO: 58795 - protein, 495 aa, Polaromonas sp. JS666
MTLITESKELLPINIGGEMRLGGGDESATLYPATGEVVARLRAPSLADVDEAIARADHAFRTSGWAQRKPHERAAVLYRVASLIRERAEPLAQRQRLDNGKPINETRALVASAAGTFQFFASACETLEETITPSRGDFMTMSVYEPMGVVAAITPWNSPIASEAQKVAPALAAGNAVVIKPAEATPLMALELAAICEEAGIPRGLISVLPGRGSVIGDAITQHPLVKRVSFTGGTSTGKHIAHIAADKMMPVSLELGGKSATMVLDDADLDHAVNGVLYGIFSSSGEACIAGSRLFVARRLYGEFMERLATRAAALRVGDPADERTQMGPLITARHRESIERHVALGLSEGASVRTGGARPQGGLYERGYYYQPTILEGVKNTDQICQQEIFGPVLVAMPFDTEDDLLAQANDSLYALAAGIWTRDYKRAWRIGRAVQAGTVWINTYKQFSISTPFGGWRDSGLGREKGRLGILQYMEQKSLYWGLNEQPLAWAE

SEQ ID NO: 58796 - protein, 333 aa, Candidatus Blochmannia floridanus
MEKFSVTVIGAGVYGTAIAVAIAKHGNMVLLWGHNSQHIKILKIDRSNQVDLPGVFFPDSLYVEESLSVAADFSQNILIAVPSHVFRCVLLKLRLNLKNNFRIIIASKGLEPKTGWLLQDVVYDVLGKEVPCAVISGPTFAHELAIGLPAAIELASADIKFRYDIEHLLYSVKNLRVYKTTDVIGVQIAGAVKNVIAIGVGISDGMGFGANARAALITRGLSEMIRLGKSIGAISVDVFVGLAGLGDLVLTCTDDQSRNRRFGMLLGQGMHVDYAQKSIGQLIEGISNTKEVYMLSVKYKVIMPITEQIYKILYENKNVHEAVYSLIRRSYIL

SEQ ID NO: 58797 - protein, 220 aa, Oryza sativa
  misc_feature (18)..(18): Xaa can be any naturally occurring amino acid
  misc_feature (160)..(160): Xaa can be any naturally occurring amino acid
MAGEADGKAPAGIKIPPXAALNERILSSMSQKHVAAHPWHDLEIGPGAPAVFNCVVEIPRGSKVKYELDKATGLIKVDRVLYSSVVYPHNYGFIPRTLCEDGDPMDVLVLMQEQVVPGCFLRARAIGLMPMIDQGEKDDKIIAVCADDPELRHFADFQEXPPHRVKKTAGFETPHILPQLLANFPQNTTAISGHRPLYSPHSPHESCELPSDMTPRHDHT

SEQ ID NO: 58798 - protein, 309 aa, Vibrio sp. Ex25
MNPISRVAIIGECMVELKKHDGVLQQGFGGDTLNTAVYLSRLTKQHGVETSYVTGLGHDPFSREMLTAWREEGINTDMVYLSEGKLPGIYAIETAEDGERSFFYWRNDAAAKYWLRERALLSLVKDLCQHQMIYLSGISLAIISDDCRQMLIELLTMCRKEGVKIAFDNNFRPKLWPNIEQARDFYSKILSVTDMAFLTFDDEVMLWGDKHEDEAISRTKNFGVKEIIVKRGADDCFVVTQDQQHTVAALKVDAVVDTTAAGDSFSAGYLAKRILGGDVAESALAGHKVAGTVIQHRGAIIPSQAMPTI

SEQ ID NO: 58799 - protein, 287 aa, Synechococcus sp. CC9605
MDLTIVGCGYVGLALAERLQPKRPQLKLTLTTTSSERLEQLSPLADRVELCDATDPAQLLNALQQSTNAVFCLGPKGDRQVDANGYRHTFVDSFRCLTSLLPQLPKLRQIVYTGSCSVYGDAEGDWVDEQTSPAPGRGHGNVLLEGEELLSGISDRRVCILRLGALYGPGRDLDRRLRGLAGLERPGSGATYSNWLHVADAAGALEAALDAEWAGLVNVVNDEPIRLRDLVGRSLQRQGLAPVHWLGQNGPGSGGRRIRNTRLKQLGYQLQHPRLDQSGVLAASQVP

SEQ ID NO: 58800 - protein, 354 aa, Methanosarcina mazei Go1
MRLNHNSYEIFDFMRSRSAIGVLSKIIITIPPINLRMIIGVMGPEGSYSERAAKLWARKNGLRGAEFHYFADIEDAFLAAVGGKTDISVVPVENSIEGSVGVTLDLLLENEAVIIGEIVVKIEHCLLSKGEPEKIRVILSHPQGLAQCRHFLKTHFPEAELRSTGSTSHAARLAGEFEEMAAIASPEAAERYGLKILLSNVQDRKENHTRFIVVRGGEKVLSGKIKGKADSGEKLNTVFGRNAEHKLCSETETGTENSSSYAFKTSLIVYLEKDRPGALYEPLGFFAKRGINLTKIESRPSKKELGDYYFYIDLEGNISDVLIKDALEDIKSKASKKSRSSTLKVLGSYPAFKK

SEQ ID NO: 58801 - protein, 899 aa, Burkholderia pseudomallei K96243
MFLGKWKREDCMPNHFSNGRTNQSRTVVIRSGAMPRLLGQPALEFLSLRGEEHLGKLYTYELLLRTPDDFHVPLATSANLDLKAMIGTEMTVCIQLDGIGTGAQGGVGAGAREISGLVVKAGFLRCEGRYNVYRIELRPWLWLATLTSDYKIFQDKSVVEIIDTVLHDYPYPVEKRLDIDKYSVAGESARNEPRAFQVQYGETDFDFVQRLMEEWGIYWFFEHSDNKHRLVLCDHIGGHRKAPSEAYHEIAHHPEGGKIDIEYINYFSTDEALRPGRVVIDDFDFTRPLASLVTSNHQPRETNWGEGELFEWPGDYTDSKHGDLISRVRMEERRATGSRAYGRGNVRGLACGHTFVLSKHKHDGANREYLVIESALMLTEVADETGSGYRYECDNELVVQPSNEVFRMPRETPKPTTSGPQSAIVVGPPGHEVWTDEFGRVKIRFLWDRYARNDATDSCWVRVSQAWAGVNFGGIYIPRIGQEVIVGFMNGDPDRPLILGSLYNTITPPPWDLPGDATKSGFKSKSITGGRENYNGIRFEDKLGAEEFHMQAEKDMNRLTKNDESHTVGANFSIGVGLTHTRAVGAMFSSIVGGAASYAVGGAESTMIGGAYALNVGGAHAVAVGGASSVSVGGAYARNVGGAYALTVGGVLSIVCGASSITMTACGSIKLVGKNIRIIGSDEVVVQGAPLQLNPGDSDCGGGGGGGGGGGAIPPIPLPSFFLDITKPILPPPPPPPTEVPPDPTPTPTPTPTPTPTPTPTPTPTPTPTPTPTPTPTPTPTPTPTPTPTPTPTPTPTPTPTPTPTPTPTPTPTPTPTPTPTPMPTPTPTPTPTPTPTPTPTPTPTPTPTPTPTPTPTPTPTPTPTPTPTPTPTPTPTPTPTPTPTPTPTPTPTPTSSEI

SEQ ID NO: 58802 - protein, 419 aa, Picea sitchensis
MFTASNPRQDGPKVGGLSGSAPHKFAPRNSNYRTSREEGKIMSQSVRPESGGAEGDNDDNEAETVNSLGHEAMKKHKVFKKLFESMDALTFKEVNNREWTCPACRAGAAETHKGLKPLIDHAKNARQWNVRLHRKLVKVLEEELKRRSAAGFAVQEVYGKWLSLQEGHIDSQIVWPPIVIVENTGFKLQDNQQSSGMGNKELLEAFKAYKPTKAKQAYGPKGHRGRSLLIFEESAVGYLEADRLQKDFLKEGRGRADWDRRGTLIHPTGAKRVLYGYMANKEDMENFNKHSGSGKSKYDMLSYKAMVIEPVKKMKENSQKLDWLDAKMLEDKAVTKSLEETVDTMAARLEIQKSEVKIIIGKVAEKCDEWKKGLDHLERIYKEQIDELMGDVEKRDKEIKQMKELTTAEAGAISLIKAF

SEQ ID NO: 58803 - protein, 262 aa, Rhodopseudomonas palustris CGA009
MRFNGKVAVVTAAASGIGAATAARLAREGAYVYLSDIDQDALGRQAESLVDVAERISTVVADVTVPEQVSALIDGAARERGRLDILINNAGMGAFGRITEVTPEAWHRVFGICVDSIFHASRAAIPHLIKARGTIVNTASISGLFGDYGFAAYNAAKGAVINLTRNMALDYSRDGLRVNAVCPGLIATPLSLKLRDNAAVMAEYDRLIPLGRAGSPEEVAGAIAFLASDDASYITGVAFAVDGGLTARTGQPNFLGHLAPKP

SEQ ID NO: 58804 - protein, 401 aa, Campylobacter coli RM2228
MFDEIRFNTIERLPNYVFAEVNAIKMAARRAGKDIIDFSMGNPDGKTPQHIIDKLCESANKDKTSGYSTSMGIYKLRLAICNWYKRKYGVNLDPESEVVATMGSKEGFVNLARAIINPGDVAIVPAPAYPIHTQAFIIAGGNVAKMPLKYNEKFELDENKFFEDLDKTLHESIPRPKYVVVNFPHNPTTVTCEKSFYERLVATAKKERFYIISDIAYADLTYDDYKTPSILEVEGAKDVAVETYTLSKSYNMAGWRVGFTVGNKRLVAALKKIKSWFDYGMYTPIQVAATIALDGDQSCVDEIRATYDKRMHILLEAFENAGWKLHKPRASMFVWAKLPESKMYLKSLEFSKQLLQHAEVAVSPGIGFGEAGDEYVRIALIENENRIRQAARNIKKYLKEE

SEQ ID NO: 58805 - protein, 277 aa, Staphylococcus aureus subsp. aureus Mu50
MEVKTFYNGNTMPQIGLGTFRVENDENCMESVKYAIEQGYRSIDTAKVYGNEEQVGAGIRAGLESTGIAREDLFITSKLYFEDFGRENVAAAYEASLSRLGLKYLDLYLVHWPGTNEAVMVDTWKGMEDLYKNNKAKNIGVSNFEPEHLEALLAQVSIKPVINQVEYHPYLTQHKLKLYLAAQHIVMESWSPLMNAQILNDETIKDIAQELGKSPAQVVLRWNVQHGVVIIPKSVTPNRISENFQIFDFELSDEQMTRIDGLNQDKRIGPDPKTFEG

SEQ ID NO: 58806 - protein, 475 aa, Salmonella enterica subsp. arizonae serovar 62:z4,z23:--
MMSTEIKTQVVVLGAGPAGYSAAFRCADLGLETVIVERYNTLGGVCLNVGCIPSKALLHVAKVIEEAKALAEHGIVFGEPKTDIDKIRTWKEKVITQLTGGLAGMAKGRKVKVVNGLGKFTGANTLEVEGENGKTVINFDNAIIAAGSRPIQLPFIPHEDPRVWDSTDALELKEVPKRMLVMGGGIIGLEMGTVYHALGSEIDVVEMFDQVIPAADKDIVKVFTKRIGKKFNLMLETKVTAVEAKEDGIYVSMEGKKAPAEAQRYDAVLVAIGRVPNGKNLDAGKAGVEVDDRGFIRVDKQLRTNVPHIFAIGDIVGQPMLAHKGVHEGHVAAEVIAGKKHYFDPKVIPSIAYTEPEVAWVGLTEKEAKEKGISYETATFPWAASGRAIASDCADGMTKLIFDKESHRVIGGAIVGTNGGELLGEIGLAIEMGCDAEDIALTIHAHPTLHESVGLAAEIFEGSITDLPNPKAKKK

SEQ ID NO: 58807 - protein, 626 aa, Salmonella enterica subsp. arizonae serovar 62:z4,z23:--
MAIEIKVPDIGADEVEITEILVKVGDKVEAEQSLITVEGDKASMEVPSPQAGVVKEIKVSVGDKTETGKLIMIFDSAEGAATAAPAPAEEKKEAAPAAAPAAAAAKEVHVPDIGGDEVEVTEVMVKVGDKVEAEQSLITVEGDKASMEVPAPFAGTVKEIKINTGDKVSTGSLIMVFDVAGEAGAAAPAKAEAATTPAATGKKDVNVPDIGGDEVEVTEVMVKVGDKVEAEQSLITVEGDKASMEVPAPFAGTVKEIKISIGDKVKTGSLIMVFEVEGAAPAAAPAKQEAAAPAPAAKAEKPAAAPAAKAEGKSEFAENDAYVHATPLIRRLAREFGVNLAKVKGSGRKGRILREDVQAYVKEAIKRAEAAPAAAGGGIPGMLPWPKVDFSKFGEVEEVELGRIQKISGANLSRNWVMIPHVTHFDKTDITDLEAFRKQQNAEAEKRKLDVKYTPVVFIMKAVAAALEQMPRFNSSLSEDGQRLTLKKYINIGVAVDTPNGLVVPVFKDVNKKSVTELSRELTTISKKARDGKLTAGEMQGGCFTISSIGGLGTTHFAPIVNAPEVAILGVSKSAMEPVWNGKEFVPRLMMPISLSFDHRVIDGADGARFITIINNMLSDIRRLVM

SEQ ID NO: 58808 - protein, 418 aa, Zea mays
MRFVCRIDSGSASPACTRTRCPSPPVACWRRGGAPVRPRNPATCAHSQPPAPHVPARRAPPLSHPPAFLSRARRRPSMAATFTVAARLPLRGPARAPSRPAVAAVTRLRSRQERRGLAATGGRGPARVRAETFSGGGGVGRRDPMAPPYNVLITGSTKGIGYALARKFLEAGDNVIICSRSAQKVESVVGDLKEEYGEQHVWGTVCDVRNGKDVKALVEFARDKLKHIDIWINNAGSNAYTYKPLVETSDEALMEIITTNTLGLMICCREAINMMRNQPRGGHIFNLDGAGSDGRPTPRFAAYGATKRSVVHLTKSLQAELQMNEVNNVMVHNLSPGMVTTDLLMSGATTKQAKFFINILAEPPDVVADYLVPNVREIPTKQSMKPTYIRFLTGLKAYSRIFSRLAFGARRNKYVTED

SEQ ID NO: 58809 - protein, 228 aa, Escherichia coli
SYELESLLELRVKRQLLAEVQSICPPGVTIMNVRQSEPLGLGHSILCARPAIGDNPFVVVLPDVVIDDASADPLRYNLAAMIARFNETGRSQVLAKRMPGDLSEYSVIQTKEPLDREGKVSRIVEFIEKPDQPQTLDSDIMAVGRYVLSADIWPELERTQPGAWGRIQLTDAIAELAKKQSVDAMLMTGDSYDCGKKMGYMQAFVKYGLRNLKEGAKFRKGIEKLLSE

SEQ ID NO: 58810 - protein, 348 aa, Escherichia coli
MCQRGCLVKYKKIEDALSSKSETWLITGVAGFIGSNLLEALLKLNQKVVGLDNFATGHQANLDEVKESVSAEQWSAFTFVEGDICEPETCVEVVKGVDHVLHQAALGSVPRSIKDPITTNNTNISGFINMLVAAKDANVRSFTYAASSSTYGDHPALPKIEENIGNPLSPYAVTKYVNELYAQVFARTYGFKSIGLRYFNVFGKRQDPNGAYAAVIPKWTAAMINDEPLYINGDGETSRDFCFIENVVQMNILAAQSDASARDQVYNVAVGDRTTLNQLFNVLKNTLKNNNVIYEKKPVYKDFRAGDVRHSQANIDKAKRLLGYVPTHDILDGIKESMPWYISTLDVK

SEQ ID NO: 58811 - protein, 127 aa, Haemophilus somnus 2336
MAYSEKLLDHYENPRNVGSFDKKDPTVGSGMVGAPACGDVMQLQIKVNDEGIIEDAKFKTYGCGSAIASSSLITEWVKGKSLDEAQAIKNSQIAEELELPPVKVHCSILAEDAIKAAIADYKAKKAE

SEQ ID NO: 58812 - protein, 756 aa, Claviceps purpurea
MKFLAVSSILFASSLAVPTSHGGGSCRPRRPPPVNYPGGDYPGGQGGDKPPGGGYPGTTYPGGDYPGGDHPGGYGGGGYGGGDYPGGDYPGGDYPGGDYPGGDYPGGDYPGGNHGGGNHGGGNGGNNGGGNGGGNGGGGNNGNGTDPGGNNGGGNGGGGNVPYKPCPSGLYSNPQCCSTNVLGVAALNCKTPSFAPTSFQSFKSACSGGQPQCCVVPAAGQGVLCQAPIGGGNGGNNGGNNGGNNGGNNGGNNGGNNGGNNGGNNGGNGGNGGNNGGNNGGNGGNNGGNGGNGGDGGDYSACPSGLYSNPQCCATDVLGVASLDCVNPSSKPRSGDDFKSTCGAEGKHASCCAIPVAGQGVLCQPAMGGGGNGGNNGGGNGGNGGNGGNGSNDGGNGGNGGNNGGNNGGNGGNGGDGGDYSACPSGLYSNPQCCSTDVLGVASLDCVNPSSKPRSGDNFKSTCAAAEKHASCCVIPVAGQAVLCQPAMGGGGNGGNNGGNGGNNGGNNGGNNGGNNGGNNGGNNGGNNGGNGGNGGNNGGNNGGNGGNGGNNGGNNGGNGGNGGGNGGDYSACPSGLYSNPQCCSTDVLGVASLDCVNPSSKPRSGDNFKSTCAAAGKHASCCVIPVAGQGVLCQPAMGGGGNGGNNGGGNGGNGGNNGGNNGGNGGNNGGNNGGNGGNNGGNGGGSHEVCPSGLYSVPQCCATGLLGVLDLDCQSPSRTSFSSSDFKSTCRSEGRKARCCVLPVAGQDVLCTNPL

SEQ ID NO: 58813 - protein, 340 aa, delta proteobacterium MLMS-1
MAGGVTVLGAGSWGTALAGVLAGKGLPVYLCCRDPQHAARMAAERENSAYLPGFKLPPGIQPTTDLGVVADCRAVVMAVPSHGFRSVFKRVIPHLAPDTAIVSATKGIENDSLLTMTAVMAEELAAADPSPACHLGCLAGPSFAREVAEGLPTAVTVAAASREEALFFQELFFTQRFRVYIGTDLIGQELGGALKNIIAIAAGISDGLGYGTNSRAALITRGLAEITRLGVAMGANPLTFSGLAGLGDLVLTCTGDLSRNRSVGLKLGQGMSLADILAEMRMVAEGVKTTRSARALAHRQGVEMPILEEVYLVLYEDKPCRQAVYDLLAREGKEELEFGG

SEQ ID NO: 58814 - protein, 250 aa, Triticum aestivum
MPVSRIAVGSHREVYEVGALKAALAEFISTLIFVFAGQGSGMAFSKLSPDGAATPAGLISAAIAHAFALFVAVSVGANISGGHVNPAVTFGAFVGGNITLFRGLLYWIAQLLGSTAACFLLRFSTGGLPTGTFGLSGIGAWEAVVLEIVMTFGLVYTVYATAVDPKKGSLGTIAPIAIGFIVGANILVGGAFSGASMNPAVSFGPALVSWEWGYQWVYWVGPLIGGGLAGVIYELLFISRTHEQLPTTDY

SEQ ID NO: 58815 - protein, 338 aa, Arabidopsis thaliana
MADKKIRIGINGFGRIGRLVARVVLQRDDVELVAVNDPFITTEYMTYMFKYDSVHGQWKHNELKIKDEKTLLFGEKPVTVFGIRNPEDIPWAEAGADYVVESTGVFTDKDKAAAHLKGGAKKVVISAPSKDAPMFVVGVNEHEYKSDLDIVSNASCTTNCLAPLAKVINDRFGIVEGLMTTVHSITATQKTVDGPSMKDWRGGRAASFNIIPSSTGAAKAVGKVLPALNGKLTGMSFRVPTVDVSVVDLTVRLEKAATYDEIKKAIKEESEGKLKGILGYTEDDVVSTDFVGDNRSSIFDAKAGIALSDKFVKLVSWYDNEWGYSSRVVDLIVHMSKA

SEQ ID NO: 58816 - protein, 170 aa, Alkaliphilus metalliredigens QYMF
MIKDLGNKKTEIHESCFIAESADVIGKVKIGKNSSVWYKVVIRGDGNYIEIGENTNIQDNTVVHIDSEKYPTIIGDNVTVGHSAIVHACKVGNNALIGMGAIILDGSEIGDNTIIGAGSLVPPGKKIPSGVLAMGSPVKVVRELTEDEKNGLKKSAEEYVKYGKEHKNNQ

SEQ ID NO: 58817 - protein, 170 aa, Alkaliphilus metalliredigens QYMF
MNLDSKIRVIEDFPKKGISFKDITTLLKDKEAFRSMVDQLSDQLIDLDIDIVVGPEARGFLVGAPVAYKIGAGFVPIRKPGKLPGETISYEYELEYGTDSLEIHTDAIQPGQRVAILDDLLATGGTVVATAKLIEELGGEVVSINFLIELGFLNGGEVLKGYSVKSLLKY

SEQ ID NO: 58818 - protein, 395 aa, Methanococcoides burtonii DSM 6242
MSMTIGLAGKPNAGKSTFFKAATLADVEIANYPFTTINANKGVTYVRAVCPCTERDKRCGNCQDGIRYVPIEIIDVAGLVPDAHMGRGLGNTFLDELRQAQAIIHVIDASGGTDIEGNPVDIGEHDPLEDVNFLNREIAMWMTGILKKNWDKLSRKIRAEGMKMEQAVSDQLLGAGVNESQARQALLACKMPEECTQWTDEDMAKLCETIRAITKPTMIAANKIDVAPAENVKALEELDIMVVPTSAAAELALRSAAKNNIISYNPGDMGFEIISDKVSEAQKNGLQSLKEMITTLGTGGAGIQECINRAVFDLLELIVVYPVEDEGKWADKNDRMLPDAFLMKKGSTPHDLAYRVHTDIGNRFLYAVDGKTKMRLGEKHDLQNGDVVKIVSTAK

SEQ ID NO: 58819 - protein, 569 aa, Wolinella succinogenes DSM 1740
MRSFWGEFVPKSWIVWKEGYPRAHFMPDLFAGLTVAIVALPLAMAFAIASGVEPQRGLYTAIVAGILVSLFGGSRVQIGGPTGAFVVIIYDIVMRHGYEGLALATLMAGFFLILMGFFRFGAIIKYIPYPVITGFTSGIALIIFTSQIKDFLGLPLGVLPSDFLQKWALYAKEIGNVSLESLAVGGVSILLIIGCKRFAPKIPGPIVAVIFGAVAVQMLHLPIETIESRFGMIPSTLPTPSLPAWSFEQAKALVPDALTIALLAAIESLLCAVVADGMTGYRHRSNTELIGQGIANLGSVFFGGIPATGAIARTATSIKSGAKSPLAGILHGIFVWLFMFFLASLIVKIPLATLAGILIVVAWNMSEIEHFRGLLKAPRSDVAVLLSTFLLTVLVDLTVAVQVGVVLAAILFIKRISEVTEIKERRLDEEWSGDGLEGMDDPDATSKKVVPLGVEIYEINGPFFFGVADRLKGVLDVIEETPKVFILRMRRVPVIDATGMHALWEFQESCEKRGTILLLSGVSDRLYGALNRFGFIEALGEERVFDHIDKALAYAKLLVETAEERGRES

SEQ ID NO: 58820 - protein, 417 aa, Zea mays
MQLGFFKFSISMEEVFKMVEEKCLHSYKMLPSDLSIGKLLSEPISCEAAVGISDDVAGGSSVLESSEPCLQNSLVAWNPELAHCNQKTTHDTTDISKGEERVRIPVVNEFGSETCPPSFYYIPRNLVFQNAYVNISISRICDEDCCADCSGNCLSAPVPCSCARITGGEFSYTLEGLLKTAFLDECTSVNHFLQEHHRFYCPVCPLERSKNEGSPGPCKGHIVRKFIKECWSKCGCGMQCGNRVIQRGITCKLQVFFTREGKGWGVRTVEDLPRGAFVCEYVGEILTSAELHERAIENARNGVVLRDEDACSLDGSFYGNVGRFINHRCYNANLVQIPVEVETPDHHYHHLAFFTNKKVEAFEELTWDYGIDFDDMEGPSKPFRCMCGSRYCRDPNNPSMLPFSVLPLDVNGEGMYV

SEQ ID NO: 58821 - protein, 157 aa, Brassica napus
  misc_feature (2)..(2): Xaa can be any naturally occurring amino acid
  misc_feature (8)..(8): Xaa can be any naturally occurring amino acid
  misc_feature (10)..(11): Xaa can be any naturally occurring amino acid
  misc_feature (18)..(18): Xaa can be any naturally occurring amino acid
  misc_feature (26)..(26): Xaa can be any naturally occurring amino acid
  misc_feature (29)..(30): Xaa can be any naturally occurring amino acid
  misc_feature (36)..(36): Xaa can be any naturally occurring amino acid
  misc_feature (44)..(44): Xaa can be any naturally occurring amino acid
  misc_feature (48)..(48): Xaa can be any naturally occurring amino acid
  misc_feature (50)..(50): Xaa can be any naturally occurring amino acid
  misc_feature (52)..(52): Xaa can be any naturally occurring amino acid
  misc_feature (55)..(55): Xaa can be any naturally occurring amino acid
  misc_feature (57)..(57): Xaa can be any naturally occurring amino acid
  misc_feature (64)..(64): Xaa can be any naturally occurring amino acid
  misc_feature (67)..(67): Xaa can be any naturally occurring amino acid
  misc_feature (70)..(70): Xaa can be any naturally occurring amino acid
  misc_feature (73)..(74): Xaa can be any naturally occurring amino acid
  misc_feature (92)..(92): Xaa can be any naturally occurring amino acid
  misc_feature (104)..(104): Xaa can be any naturally occurring amino acid
  misc_feature (106)..(106): Xaa can be any naturally occurring amino acid
  misc_feature (112)..(112): Xaa can be any naturally occurring amino acid
  misc_feature (114)..(114): Xaa can be any naturally occurring amino acid
  misc_feature (119)..(119): Xaa can be any naturally occurring amino acid
  misc_feature (124)..(125): Xaa can be any naturally occurring amino acid
  misc_feature (129)..(130): Xaa can be any naturally occurring amino acid
  misc_feature (132)..(134): Xaa can be any naturally occurring amino acid
  misc_feature (136)..(141): Xaa can be any naturally occurring amino acid
  misc_feature (143)..(156): Xaa can be any naturally occurring amino acid
MXSSMLSXAXXVTSPAQXTMVAPFTXLKXXAAFPVXRKGNNEIXSIAXNXGXVSXMXVCPPVRXKKXETXSYXXDLTEVELAKEVDYLLRNXWIPCVEFEWEHXFXVYRGHXSXPGYYXGRYWXXRKPXXFXXXDXXXXXXGXXXXXXXXXXXXXXK

SEQ ID NO: 58822 - protein, 175 aa, Triticum aestivum
EQRGGEVYRLYDVGGQRNERRKWIHLFEGVDAVIFCAAISEYDQLLFEDETQNRMMETKELFDWVLKQTCFEKTSFMLFLNKFDIFERKIQKVPLTVCEWFKDYEPIAPGKQDVEHAYEFVKKKFEEVYFQSSKPERVDRVFKIYRTTALDQKLVKKTFKLMDESMRRSREGTGT

SEQ ID NO: 58823 - protein, 503 aa, Rhodopseudomonas palustris CGA009
MINIATRINPAIAPAVSEVISQLQARHLIGNTLVPSVGGATLDVIDPATGQVIGKAPAASGDDVARAVEAASAAFPGWAATPARQRGKLIAAAASAIAERSDVIATVLALETGKAIRTECRGEVATAIDITTMYAGLASELKGETLPFDPQILTYTSREPLGVVAAILPWNVPLVLMMLKIAPALVAGNTVVVKASEEAPYATIEMARLMARLLPDGVLNVICGTGRDCGAALVEHPAVAKVTFTGSQAVGELIYQMAAKKIIPVSLELGGKSPMIVYPDADMARVVAGAIAGMRFTRQGQSCTAASRIYVHTTLIDAFVAALREAVSKLKIGDPLDEATDIGTVISPRQKAKVESYIDLGARTAGAKVDRCGELPGAAHLKDGLFLQPTIITGVPEDSPLMREEIFGPVVCVQPWDDEDDVIARANDSDFGLAATVWTNDLRSALRTVQRLDAGYVQVNQNLTIQPNLSYGGFRKSGLGKEASLEAMLEHFTKKKTVVIDMR

SEQ ID NO: 58824 - protein, 259 aa, Clostridium thermocellum ATCC 27405
MRIPIYQIDAFTNVQFKGNPAAVCPLEAWIGDDLMQKIAAENNLSETAFFVKKGHDYELRWFTPKGEIDLCGHATLATAYVIFTYLDNSIANVKFHTMSGVLEVSKEGSLLSMIFPSREGEICEVPEVLIKGLGKKPIEVYKSRDYMAVFETEQDILNLKLNMDELKKLDAFGVIATAKGNEADFVSRFFAPKAGVDEDPVTGSAHCTLVPYWKNKLRKTEFVALQLSERGGKLYCTDLGKMVKISGEAASYLEGYINV

SEQ ID NO: 58825 - protein, 499 aa, Ostreococcus tauri
MGGVGVFGRCADEPAQAGRGTRGAHGGWQQPPTQDGGGWGAPTNAPGAQANAYAAHPAYAAQQGGQGGWNAMPSAPAPISTGAPRGFGDASSSARGAGGGGFGQPMSPRSLAAAGLGMYGGKFLNDGASFVSSNYAKYFSTASMRAYFDVTESYVFHKLRLLLCPFLHKGSWARLPESVAGGTAYKPPRNDINAPDLYIPLMAFWTYVLTASIREVFSSKSGAFTPEALATHAWWSGLLWSVESAFIWIALRTASTSNHIVSAPMLDIAAYVGYSFVYGSVTLMSKFSSGSLIYWLFLSWSAVCNAVFMAKTLKKIIFSESRHGGYSHSMSHNYVLLCVVIVQFPIHFCKRLASFSKPVSRSTSSIAAFALSPRNSASSATITDDHPFLHLLEHRHAEEDQKQPEERCGADHARSPNRIQSHQHQRLPPRLTTSFHLGHHPHPIPEPHQPRAHSRLPARAQNPPPLSFVPSASSLRSPPHRARSSWTVFGAEHVVVISS

SEQ ID NO: 58826 - protein, 473 aa, Candidatus Blochmannia floridanus
MNVDYFISFINKNKVKFIDLRFTDIMGKEQHFTIPQSQIDNHFFENGKVFDGSSMVGWKNVHESDMILIPDLTNDHIIVDPFYQDTTVILRCDVLDPHSMQNYDKDPRYISKKSEKFLQDSGIADFAMFGPELEFFVFDDVRFKTSMSGCHVMIDDPEASWNSDKVYFYGNKGHRPKIKGGYSPVPPIDSSQNLRSMMSIMMEKMGLIVETHHHEVATAGQNEIITRFNSLTRKADEVQIYKYIVHNVSNKFGKTATFMPKPIIKDNGSGMHCHISLYKNKVNLFSGDQYGNLSEIALFYIGGILKHTKALNAITNPTTNSYKRLIPGYEAPTFLTYSLSNRSSAIRIPAIINNNPNLCRIEVRFPDPSANPYLAFPALLMAGIDGIINEIHPGNPVNKNLYTLSDLEKEHTLYTSQSLNESLQYLSEDYEFLIRNNVFSKNFIDSYILIHKKMDSLVRSVPHPMEFELYYSI

SEQ ID NO: 58827 - protein, 457 aa, Salmonella enterica subsp. arizonae serovar 62:z4,z23:--
MMDSQQHGEQLKRGLKNRHIQLIALGGAIGTGLFLGSASVIQSAGPGIILGYAIAGFIAFLIMRQLGEMVVEEPVAGSFSHFAYKYWGGFAGFASGWNYWVLYVLVAMAELTAVGKYIQFWWPEIPTWASAALFFVVINAINLTNVKVFGEMEFWFAIIKVIAVIAMILFGAWLLFSDTAGPQATVRNLWEQGGFLPHGWTGLVMMMAIIMFSFGGLELVGITAAEADNPEQSIPKATNQVIYRILIFYIGSLAVLLSLLPWARVTADTSPFVLIFHELGDTFVANALNIVVLTAALSVYNSCVYCNSRMLFGLAQQGNAPKALLSVDKRGVPVNTILLSAIVTALCVLINYLAPESAFGLLMALVVSALVINWAMISLAHMKFRRAKQQQGVKTRFPALFYPLGNVLCLLFMAAVLLIMLMTPGMAISVWLIPVWLLILGVGYVCKEKTAKVVKAH

SEQ ID NO: 58828 - protein, 83 aa, Glycine max
SSCVVCLGNGVECVEESHEIFVIEEHDHQKFLSRDLSNQQPHCQVDADTNSALGHPIEFICLDLPEPAVCKYCGLRYVQDHHH

SEQ ID NO: 58829 - protein, 254 aa, Candidatus Blochmannia floridanus
MYKKKIKKNTITHFGFQNVPTFIKSYLVSNVFHKVATKYDLMNDLMSFGIHRIWKQFLIQQSEVHNGYKVLDLAGGTGDLSIKFSKLVGKKGIVILLDNNDTMLRLGQKKLRNLGILNNVHYIQANAEFLPFSENTFNCVAISFGLRNFTYKQKSLYEIYRVLRPGGKLLILDFSIPTSKLLTILYDLYSFHIIPKIGKIIAQDSKSYQYLVESIRMHPDQETLKNMILSIGFNDVQYFNMTGGIAALHCAYKY

SEQ ID NO: 58830 - protein, 508 aa, Synechocystis sp. PCC 6803
MTTDYLERILKARVYDVAIETPLDLAANLSKRLGNRVYFKREDLQPVFSFKLRGAYNKMAQLSPELLAKGVIAASAGNHAQGVALGASKLGTRAIIVMPETTPQVKVEAVKARGGVVVLYGETYDDAYGHARQLEQEKGLTFIHPFNDPDVIAGQGTIGMEILRQYQQPIDAIFVAIGGGGLIAGVAAYVKRLYPEIKIIGVEPTDADAMRQSLAAGKRVKLNQVGLFADGVAVREVGDLTFPLCQQYVDDILLVDTDDTCAAIKDCFEDTRSILEPAGALAIAGLKQYVQKQGCRDQTLVAIACGANMNFDRLRFVAERAEYGEQREAIFAVTIPEQRGSLRKFCEGLGKHNITEFSYRIAEGPDAHIFVGIQVQNRSDASQLAASFNRQGFKTLDLTDDELTKLHLRHMVGGRPPQVTQLENQRELLYRFEFPERPGALMKFLGCMDPAWNISLFHYRNHGADYGRIVVGMQVPLAEMEQWQQFLANLGYRYWDESDNPVYRLFLR

SEQ ID NO: 58831 - protein, 522 aa, Colwellia psychrerythraea 34H
MTETLKQVSPQEPLDYLRRILLAPIYDLAVETELTACNKLSSRLNNHIYLKREDQQPVHSFKLRGAYNKLNSLTEEQCIHGVIAASAGNHAQGLALAAKKLGINATIVMPKTTPDIKVDNVRRFGGEVRLVGNSFNEAQAASIEYAKAENKTLVHPFDDVEVIIGQGTVAKELLQQLPQADVVFIPVGGGGLLAGMAVYLKQLNPRTRIIGVEAEDSACLKAALEAGEPVDLTQVGLFADGVAVKRIGENTFGLIQEFCDEVITVSTDEICASIKDIFEETRVIAEPAGALSLAGLQKYCLTSKGGESLAAILSGANMNFHTLRYVSERCELGEKKEAILAVTIPEEKGSFKRFCQSIGNRAITEFNYRYSGKPSAEIFVGVRLGGSVEERQELLQGLESANYQVRDFTDNELAKLHVRYMIGGKTPNSAKNTNSVGEKDERLFSFEFPEHPGALEKFLAAMGEYWNITLFHYRNHGAAFGQVLAGFDLEKSQQNEFFQHLDDLGYQWQEETDNLAYQTFLN

SEQ ID NO: 58832 - protein, 149 aa, Synechocystis sp. PCC 6803
MERTFIMIKPDGVQRQLIGEIVGRFEKKGFKLVAMKVMTVSQELAEKHYEALNDKPFFSGLVNFICSSPVVAMVWEGNSIVSTSRQMIGATDPHAAAPGTIRGDYGVSVGRNIIHGSDAIETAKREISLWFKDEEVNEWDATLNPWLYE

SEQ ID NO: 58833 - protein, 321 aa, Pseudomonas aeruginosa
MALNPDIAAYLELVGNGRSSGKSLPMHQLTVQQAREQFDQSSALMDPGLDEPLARVETLFVPARDGTPLPARLYSPQGLSASPPLPGVLYLHGGGYVVGSLDSHDALCASLAERAGCVVLSLAYRLAPEWRFPTAAEDAEDAWCWLAAEAARLGIDPQRLAVAGDSVGGSLCAVLSHRLALRGEASQPRLQVLIYPVTDASRTHQSIERYAVGHLLEKDSLEWFYQHYQRSPEDRQDPRFSPLLGVVPADLAPTLLLVAECDPLHDEGIAYAEHLRQGGARVELCVYPGMTHDFLRMGAIVDEADDAKDMIADALVAALAT

SEQ ID NO: 58834 - protein, 534 aa, Arabidopsis thaliana
MASRRVSSLLSRSFMSSSRSIFSLRGMNRGAQRYSNLAAAVENTITPPVKVEHTQLLIGGRFVDAVSGKTFPTLDPRNGEVIAQVSEGDAEDVNRAVAAARKAFDEGPWPKMTAYERSKILFRFADLIEKHNDEIAALETWDNGKPYEQSAQIEVPMLARVFRYYAGWADKIHGMTMPGDGPHHVQTLHEPIGVAGQIIPWNFPLLMLSWKLGPALACGNTVVLKTAEQTPLSALLVGKLLHEAGLPDGVVNIVSGFGATAGAAIASHMDVDKVAFTGSTDVGKIILELASKSNLKAVTLELGGKSPFIVCEDADVDQAVELAHFALFFNQGQCCCAGSRTFVHERVYDEFVEKAKARALKRNVGDPFKSGIEQGPQVDSEQFNKILKYIKHGVEAGATLQAGGDRLGSKGYYIQPTVFSDVKDDMLIATDEIFGPVQTILKFKDLDEVIARANNSRYGLAAGVFTQNLDTAHRLMRALRVGTVWINCFDVLDASIPFGGYKMSGIGREKGIYSLNNYLQVKAVVTSLKNPAWL

SEQ ID NO: 58835 - protein, 316 aa, Kineococcus radiotolerans SRS30216
MSVPLFLDCDTGIDDAMAIGWLVATPGVDLVGVSTVSGNLDAAGGARNTLDLLALLGRPEVPVSVGAHDFLDHPYSGGAPEVHGVNGIGEVELPRSPAAPTGTSGAQAIVDAARAHPGELHLLAIGPFTNVALALDLEPRLPELVGRFTVMGGAAMAPGNVSAVAEANVANDPLAAHRVFTAGFDLTMVGLDVTMEHVFEESHRQALLAVGTPGAVAIARMLGHYFGFYAQRYGRPCAVLHDPLAAAVATGDVDLALAPTVPVVVDHTDGPGRGQTVVDLRDRYQGYPRTYENGTRVALEVPGDFAGQLLARLSTL

SEQ ID NO: 58836 - protein, 351 aa, Thermus thermophilus HB27
MRPPLIERYRNLLPVSEKTPVISLLEGSTPLIPLKGPEEARKKGIRLYAKYEGLNPTGSFKDRGMTLAVSKAVEGGAQAVACASTGNTAASAAAYAARAGILAIVVLPAGYVALGKVAQSLVHGARIVQVEGNFDDALRLTQKLTEAFPVALVNSVNPHRLEGQKTLAFEVVDELGDAPHYHALPVGNAGNITAHWMGYKAYHALGKAKRLPKMLGFQAAGAAPLVLGRPVERPETLATAIRIGNPASWQGAVRAKEESGGVIEAVTDEEILFAYRYLAREEGIFCEPASAAAMAGVFKLLREGRLEPESTVVLTLTGHGLKDPATAERVAELPPPVPARLEAVAAAAGLL

SEQ ID NO: 58837 - protein, 402 aa, delta proteobacterium MLMS-1
MAGPIELAARVKEIKASPTLAVDAKAKALKAQGADVLNFSVGEPDFDTPPHVCEAGKAAIDEGFTRYTPVPGILPLRQAVCDRQAADHGRHYQPDEIQICCGGKHGLYNMAQAMFGPGDEVLIPAPYWVSYPPIVQLAGATPVIVPLDEKSAFDLDPAILADYTSPRTRGIILNSPSNPTGSVLSARALTAIAAMALEQGWVVISDDIYDTIVYGTEKLPHILDLEPKLRDQTLILNGVSKSFAMTGWRIGYTAGPQHVIAAMNKIQSQSTSNPSSIAQKAALAALTGPQDFPTTMRDAFVPRLDFMVGALNAMAGISCVRSRGAFYVFPNMSAYYGRKTPAGTSIDGSLALADYLLEDALLATVPGVAFGADDFIRFSFATSLAVLEEGMERLAAALAKLN

SEQ ID NO: 58838 - protein, 465 aa, Gibberella zeae PH-1
MDDHSKAVFTHRRSSVPLDIIIVGAGLSGLAAAVSCSLSGHKVTIFESATALQEVGAGLQVTPNASRLLHQWDLPQRFWDSVAEPTYLAVHRYSGQLLALEEDFDKKIRKQYGAPFVDVHRVDLQLSLLERAQELGAKLKLSQKVIDIDFNTPKITTQDGTEAKADLIIAADGLWSRCRSAFLGTKDMPKPTGDLAYRVVLNLDDIKDPELIDWVKHCSCHFWIGPGAHAVGYSLRGGNMYNIVLLVPDDLPPGASRLPGSVDQMKALFEGWDPILLRFLDLVTEVDRWKLMHHDEMQHWINDQSNFVFIGDACHPMLPYLAQGANSAIEDGAVLGLLLGAVEARNQIPEALKLYEKMRKSRGEAIVRETFKQRESFHMVDGPQQVKRDEIFLSQLGKKELKAPFPSRWTCPEVQPWLYGYDAYKEVHDALAKNSFTRFSVVAQPASPVVTSRSWLSRLLTYIHS

SEQ ID NO: 58839 - protein, 195 aa, Prochlorococcus marinus str. AS9601
MIPLVLEESGGSERVFDIYSRLLRERIIFLGEQVTSETANRIVAQLLFLEAEDPDKDIYMYINSPGGSVYDGLGIFDTMQHVKPDIHTVCVGLAASMGAFLLAAGTKGKRSSLRHSRIMIHQPLGGARGQASDIRIQADEILFLKERLNTELSERTGKDYDTIKEDTDRDFYMSPNEAVEYGLIDLVLDKKPIKV

SEQ ID NO: 58840 - protein, 267 aa, Alkaliphilus metalliredigens QYMF
MLFWLRFILVYNIRRRDMALHPFSRSELLIGTEGLNKLKGCTIGVFGIGGVGTFAVEALARTGVSKFILVDDDDICLTNINRQLHATRVTVGKSKVETMKQRVLEINPKAEVITYKELYNRDSAERLLDYSYDYVVDAIDMVSAKLDLIERCKNKNIPIISSMGAGNKLDPTKLEVADIYETSICPLARIMRKELRKRGIQDLKVVYSQEEPMIPLEIDSNCHTGCICPNQDRTCTTRHQIPGSVAFVPSAVGLIIASVIVRDLISC

SEQ ID NO: 58841 - protein, 348 aa, Wolinella succinogenes DSM 1740
MNAWKKTAVLALMSASVLMAKPQVTILATGGTIAGSGESSVKSSYSAGAVTVDKLLAAVPAINDLATIKGEQISSIGSQEMTGKVWLKLAKRVNELLAQKETEAVIITHGTDTMEETAFFLNLTVKSQKPVVLVGAMRSGSSMSADGPMNLYNAVNVAINKASTNKGVVIVMNDEIHAAREATKLNTTAVNAFASPNTGKIGTVYYGKVEYFTQSVRPHTLASEFDISKIEELPRVDILYAHPDDTDVLVNAALQAGAKGIIHAGMGNGNPFPLTQNALEKAAKSGVVVARSSRVGSGSTTQEAEVDDKKLGFVATESLNPQKARVLLMLALTKTSDREAIQKIFSTY

SEQ ID NO: 58842 - protein, 333 aa, Fusarium heterosporum
MMLVLSLLSIIAFTAAGPVPSVDENTRVLEHRAVTVTTQDLSNFRFYLQHADAAYCNFNTAVGKPVHCSAGNCPDIEKDAAIVVGSVVGTKTGIGAYVATDNARKEIVVSVRGSINVRNWITNFNFGQKTCDLVAGCGVHTGFLDAWEEVAANVKAAVSAAKTANPTFKFVVTGHSLGGAVATIAAAYLRKDGFPFDLYTYGSPRVGNDFFANFVTQQTGAEYRVTHGDDPVPRLPPIVFGYRHTSPEYWLNGGPLDKDYTVTEIKVCEGIANVMCNGGTIGLDILAHITYFQSMATCAPIAIPWKRDMSDEELEKKLTQYSEMDQEFVKQMI

SEQ ID NO: 58843 - protein, 507 aa, Crocosphaera watsonii WH 8501
MLPMTLLEAEVHISLREFLRHQGQPLWDHHLTMARLVSRALRLDRSALIQTGSTFSRYGLSYLMPCLLSDRPILLVVPSNIQQKLIEEDIPYLQRWLNTNKAIATQKQSVNFTTFKGLLLLSPDVWLGDHLNNQGQLPDDILTLIDQADYLEEWTKDYLTLTISPDDWQQLQQQYSSSGNLIQEVKLFLEKSILSRPNNPYQCCLLDHEEIESLAHLCDTFAHHPLLQNFTQSFDNNNKLLWATINQEEKTFFIHSSPLDVSAILSPHLDNSTIVLMGGFIDSQKMAPIYRQNIGLNQDILCLKFFPHRQNELINLYIRGRLPMPNTPEFHKILIEEVKKLVFSCYQSLKPITIIVDDVPTKAQVATFLAAEFGSKVKVENTTIDEQSILISGWKFWHQNQGKLPNPQLLIIATLPIPSLENPLVAAQVNYYKRQHKDWFRFYLLPTALTEIQRAVMPLRESQGIVALLDNRVNYRSYGSLILSALEPYAKLDYIDLNLLEQNTKTY

SEQ ID NO: 58844 - protein, 180 aa, Triticum aestivum
  misc_feature (47)..(47): Xaa can be any naturally occurring amino acid
  misc_feature (57)..(57): Xaa can be any naturally occurring amino acid
  misc_feature (62)..(62): Xaa can be any naturally occurring amino acid
  misc_feature (87)..(87): Xaa can be any naturally occurring amino acid
  misc_feature (127)..(127): Xaa can be any naturally occurring amino acid
  misc_feature (155)..(155): Xaa can be any naturally occurring amino acid
MVLSHAASAGSSDDSVHSTFASRYVRASLPKFRDAGESIPKEAAYKXINDELMLDGXPRLNXLGFFVTTWMEPECNNLMMDSIHKEXVNIDQYPGTTSFQNHLLTLSRILFNVLFGEKENTVGVGPXGFWRAHLSAGVGFRRGWGKKIKAAGKPXKKPKFYRGKISILWEKISPPFLRGA

SEQ ID NO: 58845 - protein, 99 aa, Crocosphaera watsonii WH 8501
MATYKVTLINEAEGINTTLEVPEDEYILDVAEEQGIELPYSCRAGACSSCAGKITAGGVDQGDQSFLDDDQIEAGYVLTCVAYPTSDCTIETHQEEALY

SEQ ID NO: 58846 - protein, 462 aa, Bacillus pumilus SAFR-032
MAQKELKRGLSARHIQMIALGGTIGVGLFMGSAKAIQWTGPSVLLAYAVCGIFIFFIMRAMGEMLYVEPSTGSFATFGHQYIHPLAGYMTAWSNWFQWVIVGMSEIIAVGAYMKYWFPELPAWIPGLIAMIILGAANLISVKSFGEFEFWFAMIKIVTIILMIIAGLGIIFFGFGNGGTPIGLSNLWAHGGFFTGGFTGFLFALSLVIAAYQGVELIGITAGEAQNPEKTLTNAIKSIIWRILIFYIGAIFVIVTVYPWDQLNTLGSPFVATFAKIGITAAAGIINFVVITAAMSGCNSGIFSAGRMLYTLGVNGQAPAFFTKISKNGVPYFGTFAVLIGLAIGVVLNYVAPPNIFVYVYSASVLPGMVPWFVILISHIGFRKAKGAALDQHPFKMPLAPFSNYLTIGFLLMVLVFMLINQDTRISLIVAIGFLIVVALSFYVFGIGKRKPIETASSDQTVK

SEQ ID NO: 58847 - protein, 637 aa, Hyphomonas neptunium ATCC 15444
MTDLRRTLDVITIGRAGVDLYGQQVGGNLEDVHSFAKYLGGCPANIAVGASRLGLRSGIITRVGSDHMGRFLQTEFQREGVNTDGIVTDKERLTALVILGIQDEDTFPLIFYRENCADMALCEADIDTSFIAQSRSILITGTHLSTEQTRATSRAAITAAKASNCSIILDIDYRPVLWGLTSRELGEERFVSDAKVTATLQEFIPACDLIVGTEEELHILGGTTDTIAAMHAIRALSDAVIVCKRGALGCSVFPETIPQTLDQGISGQSFKVEVFNVLGAGDAFMSGFLSGWLHDKPLEECCRLGNACGAIVVSRHGCAPAIPTAEELAWFLENGSPHLALRKDAALEHIHWTTTRSPRERDLAVFAIDHRSQLEAISREAAAPLEKISEFKSLALSALQMMDVSDVDLGILLDGRYGSRALATASGLPIWVGRAVELPGSRPLDFDSQSTVTGEMLEWPRSQVAKCLCFYHPDDPSEIKNIQERRIQEAFKASRETQREFLLEIICSQNGALADTTVSSAMRRIYELGVFPDWWKLEATASAQSWVETSRVIDEMDPRCRGILLLGLAAPAEDVVACFKVAAAFPLIKGFAVGRTIFQEPARQWFKGEIDDGEAVFALRRNFSQLIDGWRQSRQAP

SEQ ID NO: 58848 - protein, 558 aa, Candidatus Blochmannia floridanus
MKNINPTKTKSWKSLKKHFLNINTTHILDLFKQNKYRFLSFSTIFNNEILLDYSKNLITEETINKLIDLAKECDLPGAIKSMFQGAKINRSENRAVLHTALRNRKNIPILVDGHDIMPNINTVLEKMKIFCQNIIQGYWKGYTNKNITDIVNIGIGGSNLGPHMVTEALTPYKNHLNIHFVSNIDGTHLFEVLKKINPETTLFLITSKTFTTQETMTNAFSARNWFVQKITKSSSFNHYEQHISKHFIALSANPVEVKKFGINPSTNMFEFWEWVGGRYSLWSSVGLSIMLSLGSNHFESLLDGAYAMDMHFKNTPLNKNIPVILALIGIWYNNFFLSETEAIFPYDQYMHRFAAYIQQSNMESNGKCVDRNGYPINYQTGPIVWGESGTNGQHSFFQLIHQGTKMIPCDFIAPVLSHHPIFDHHDKLIANFLAQTKALAFGKKLEEITQEYITKKQSYIYDLNILPFKVFKGNNPSNSILIKKITPYTLGALIALYEHKIFTQGVIFNIYTFDQWGVELGKQLADDIYSILKQTNINPQYDSSTNGLINYYKYWSQA

SEQ ID NO: 58849 - protein, 350 aa, Bradyrhizobium japonicum USDA 110
MAARACRAGSREAGMKTVRSAPQPGKPRLTTSAMIASIAAEGQKTRPGPFGHALVELARHRPEVVGMTADLGKYTDMYIFAKEFPDRYYQMGMAEQLLFGAASGLAAEGFMPFATTYAVFASRRAYDFIHQTIAEEDRNVKIVCALPGLTSGYGPSHQAAEDLALFRAMPNMTVIDPCDAHEIEQLVPAIAAHQGPVYTRLLRGQVPVVLDEYDYKFELGKAKLIRDGKDALVISSGIMTMRALEAVQTLKDDSIDIAVLHVPTIKPLDTETILREAGKSGRLVVVAENHTTIGGLGEAAAALLMRSGVHPPFRQIALPDEFLDAGALPTLHDRYGISTAEVARQIKRWL

SEQ ID NO: 58850 - protein, 484 aa, Burkholderia pseudomallei K96243
MRNESHTARERRRSTKIVATLGPSSSTETAIEALARAGADVFRLNFSHGTHADHALRHAAVRAIEARIGHPIGVLLDLQGPKLRVGQFASGRAQIAKGRPFVFDRDPAPGDARRVSLPHPEIFDAARPGHLLLVDDGKLRFRVDAVSSARIETTALLDGIVSDRKGVSVPDATLAIPALSAKDRDDLEFGLSLGVDWVALSFVQTAQDVRDARALIGARAAIVAKIEKPQAVANIAEIVDAADAVMVARGDLGVEMSLEDVPSVQKQIIRLARAAGKPVIVATQMLESMTLAPTPTRAEASDVAAAVYDGADAVMLSAESASGQYPVEAVDFMRKIISTTEADPIQPQLMKAIVTAHAPNATDAIGAAIEVVSDTLRLGVAVTYTASGATAIRLSRLRPSTAILSLTPRAEIARRLTLAWGVRSRVAAEATGIENIVEIAIEAAHAEGFATDECPIVVAAGVPFGHPGSTNLMRIVWPTEMTRQ

SEQ ID NO: 58851 - protein, 413 aa, Oryza sativa
  misc_feature (90)..(90): Xaa can be any naturally occurring amino acid
MLSDQELARYVESFVRQAAAVPGAVAAAGGISAESVARQLGPQLGLDLTPKAPLIRDILLALFSPPPQGAPFTSSAPSPSASASASASAXAAAGHFFSQQQQQQQLQTFLTASQQYQHRGGAGAAAAPPSAYGVAAAAAGYRYGQPFPQDEGAHLQRLVQMHHHQQQQQQQQQQQMAAAAAGVAAAPPTAVESPRPAAASKKESASTGVKRRGGPGGLNKVCGVSPELQAIVGEPTMARTEIVKQLWAYIRRNNLQDPNNKRKIICNDELRLVFETDSTDMFKMNKLLAKHIRPLEAKMLKILAEDSNRDSKKLKPVDSEPISPAETDVNQLPIILSDALASFFGTGEKEMPSSEAVKRVWDHIKSNNLEDPANPTMILCDSKLKQLFGCESLTAMSVSELLSQHLFKQPNKL

SEQ ID NO: 58852 - protein, 457 aa, Alcaligenes faecalis
MSRFEQIQSREAGLHKRLNARQMSMIAIGGAIGTGLFLGSKFAIGFAGPGVVLSYVIGGFIALVLMGCLAEMTVEHPTSGSFGAYAEFYIHPLAGFLVRYSYWACIVLAVGTEVTAVADYMKFWFPEVSPWIWIVFFSAVLIAVNAYSVKAFGSVEYWFALIKVFAIIAFIVLAIGMLTGYYQPAQVQENLLGQGGFMPNGWYGVWVGVIISIFSYLSIEMIAVAAGEAENPEQAVRQAFKATIWRLIIFYLLSLSLIVMLVPWQVLIADGTSSPFITVMQSVGIPYADSILNFIVIIAALSAMNSMLYISTRMMFSLSRAGDAPLVLGKVARNGVPLNALALSASGVGVAAVVYAYNPETAFPVMIALSMFGALFTWGMIFLTHLFFRRRVAQEGVQLRFRMPAYPIGTLLGLIGIVAILITTWFINIFHYTLLFGVPFLLTLIVIYFVRSKSRVA

SEQ ID NO: 58853 - protein, 341 aa, Burkholderia pseudomallei K96243
MTEVDAGQTPHAAILQMVTGKWHAQALYVAAELGIADLLAQRERTADELAAETQTHPEALYRVLRALGSLGVFVEEDGRRFRNSPLGDTLRRDAPGSMRGFVRFAGMDAGWRAWGQLMYSVRTGRSAFEHVVGGPGFAYIDSHPEIAAIVNDAMTSMSELEAPAVARAYDFSQARTIVDVGGGHGFLLATLLRANPHANGVLFELPHACEGARQLFAKHRLTERVKVIAGDASQSIDAHGDVFVMKHVICDWDDEQATRIMTNCAEAMRPGGKLLLVEAVLTPPGEPHFAKLHDLEMLIMSSGGHGRTADGYGRLYAAAGLTMTAVRPTQGMNSVIEGVKP

SEQ ID NO: 58854 - protein, 314 aa, Bradyrhizobium japonicum USDA 110
MAEWLKEAGLPDGVFNVVQGDKEAVDALLHHPNVSAVSFVGFTPIAQYIYSTAANTGKRCQALGGAKNHMIVMPDADMDQAVDALMGAAYGSAGERCMAISVAVPVGEGTADKLISALEPKVRGLKVGPGTDPEAEMGPIVTKQHLDKVRSYIDAGVADGAKLLVDGRKFKMQGYEDGFFLGGTLFDHVKPSMKIYKEEIFGPVLSVVRAPDYATAARLINEHEFGNGTSIFTRDGDAAREFAHQIKVGMVGINVPIPVPMAFHSFGGWKASIFGDHHMHGPEGVRFNTRMKTVTSRWPTGIRAGAEFVMPTMS

SEQ ID NO: 58855 - protein, 170 aa, Triticum aestivum
  misc_feature (9)..(9): Xaa can be any naturally occurring amino acid
  misc_feature (50)..(50): Xaa can be any naturally occurring amino acid
MAPTVMASXATSVVPFQGLMSTAGLPVSRRSNGASLGSVSNGGRIRCMQXVWPIKGIKKCETLSYLPPVRTEALLKQVDYLIRSMWVPCLEFSKVGFIFREHNASPGYYDGRYWTMWKLSMFGCTDATQVINEVEEVKKEYPDAYVRIIGFDNMRQVQCVSFIAFKPPGC

SEQ ID NO: 58856 - protein, 517 aa, Lactobacillus rhamnosus
MANDQNKDYDKIIVLDYGSQYNQLITRRIREFGIYSELKPHTITAAEVKKIAPKGIIFSGGPNSVYDEGALGVDEDIFKLGIPILGVCYGMQLMAQRLGGDVEPADNREYGKADIEVTDASAKLFHDLPKDQTVWMSHGDLVTRVPDGFRTTATSVNCPISAMDDDDRKFYGIQFHAEVQNTQYGHEILHHFAFDVCHAEANWSMDDFITKQIAKIRAEVGDKRVLLGLSGGVDSSVVGVLLHKAIGTQLTSIFVDHGLLRKGEAEQVMDSLKGKFGLNIIKVNAKDRFLNDLRGVTDPEKKRKIIGRDFIEVFNEEAAKLNGIEFLAQGTLYTDVVESGTDTAQTIKSHHNVGGLPEDLKFKLIEPLNKLFKDEVRELGEKLGMPHSLVWRQPFPGPGLGIRVIGEVTEDKLEIVRDSDYILREEIAKHGLDKDIWQYFTVLPGIRSVGVMGDGRTYDYTIGIRAITSIDGMTADFARIDWDVLQEISSRIVNEVKHVNRVVYDITSKPPATIEWE

SEQ ID NO: 58857 - protein, 429 aa, uncultured bacterium pCosHE2
MTTDDLAFDQRHIWHPYTSMTSPLPVYPVVSAEGCELILSDGRRLVDGMSSWWAAIHGYNHPQLNAAMKSQIDAMSHVMFGGITHAPAIELCRKLVAMTPQPLKCVFLADSGSVAVEVAMKMALQYWQAKGEARQRFLTFRNGYHGDTFGAMSVCDPDNSMHSLWKGYLPENLFAPAPQSRMDGEWDERDMVGFARLMAAHRHEIAAVIIEPIVQGAGGMRMYHPEWLKRIRKICDREGILLIADEIATGFGRTGKLFACEHAEIAPDILCLGKALTGGTMTLSATLTTREVAETISNGEAGCFMHGPTFMGNPLACAAANASLAILESGDWQQQVADIEVQLREQLAPARDAEMVADVRVLGAIGVVETTHPVNMAALQKFFVEQGVWIRPFGKLIYLMPPYIILPQQLQRLTAAVNRAVQDETFFCQ

SEQ ID NO: 58858 - protein, 586 aa, Colwellia psychrerythraea 34H
MIHHSFLLRFSTLAFVVTHLLISQTALAKREIREPEAATGFNQKKAVFAKQYMVVAANPYASKAGLAMLDKGGSAVDAAIAAQLVLSLVEPQSSGLGGGTFMLHWHNKNQKLTTFDGRETAPQNATSELFLDKNGKPLKWSDAVVGGKSVGVPGLLAALNKAHQQFGVLPWKALFQPAIELAENGFIVSPRLEQLLGMNFNPGIHILPEIKNYFSPNGIGIKAGDTLKNPKLAKALHSIANEGVEVFYQGWIAKKIVAKVKNSVVSPGLLSLDDMKNYQAIERASVCGPYHQYKICGMAPPSSGGISVIQILAQLQSFELAQYPPNSLHAIHLLTQSSRLAFADRNKYIADSDFVSVPVKGLLAEDYIAKRAALIDEKRDMGQAIAGNPQNSLVLANDNAIERPSTTHLVVVDKQGNAISMTSSIENGFGSALMVQGFILNNQLTDFSLAPKRDGKWVANRVEPLKRPRSSMAPMMVFNEDNSLRLILGAPGGSRIINYVAQTIIGVLDWQLNVQQAVNLPKVTNRNYVTTLELDTDVAKLKPALEARGHTVKIRALNSGLHAIEVTNSGLVGGADPRREGLALGR

SEQ ID NO: 58859 - protein, 516 aa, Cryptococcus neoformans var. neoformans B-3501A
MFRSPLPQRTSHNSASEAGPSIPTPIPTDGDAVTLENASNTTGEATLSSSGSSEGESLISKMMADNPYFSAGAGLMGIGVALTALRRSITLGATMAQRRMLVTLEIPSKDRSYPWFLEWMAHQSAAQTRGNVKPPGLFGWGQGMRSHELAVETSYKQHENGASEAIFNLVPGPGTHYFKYGGAWFQVKRERDSKLMDLHSGTPWETLTLTTLSTSRDLFSSLLEEARTLAEASTEGKTVVYTAWGVEWRPFGKPRRRREMGSVVLGKGIAEEIESDLKGFLGRGKWYAERGIPYRRGYLLHGPPGSGKTSFIQALAGSLNYNICLMNLSERGLTDDKLNHLLGLVPERSFVLLEDIDSAFNRRVQTSEDGYKSSVTFSGLLNALDGVASSEERIIFMTTNHYDRLDPALIRPGRVDIQQLLDDAAGEQAKRLFVKFYGNSVNEDGTKGRVLREGELPLNDEEVESLGNSVQRIVDDERAHGKVVSMASLQGHFIRTGAKESLDGIRELCRPREGQA

SEQ ID NO: 58860 - protein, 647 aa, Ipomoea nil
MKVAVNTFLLFLCSTSSIYAAFALNSDGAALLSLTRHWTSIPSDITQSWNASDSTPCSWLGVECDRRQFVDTLNLSSYGISGEFGPEISHLKHLKKVVLSGNGFFGSIPSQLGNCSLLEHIDLSSNSFTGSLTELTKLSLGENSFSGGIPTSLFQSNKLLNLQLGGNLLAGDIPPVGALQALRSLNLSSNKLNGQLPIDLGKLKMLEELDVSHNNLSGTLRVLSTIQSLTFINISHNLFSGPVPPSLTKFLNSSPTSFSGNSDLCINCPADGLACPESSILRPCNMQSNTGKGGLSTLGIAMIVLGALLFIICLFLFSAFLFLHCKKSVQEIAISAQEGDGSLLNKVLEATENLNDKYVIGKGAHGTIYKATLSPDKVYAVKKLVFTGIKNGSVSMVREIETIGKVRHRNLIKLEEFWLRKEYGLILYTYMENGSLHDILHETNPPKPLDWSTRHNIAVGTAHGLAYLHFDCDPAIVHRDIKPMNILLDSDLEPHISDFGIAKLLDQSATSIPSNTVQGTIGYMAPENAFTTVKSRESDVYSYGVVLLELITRKKALDPSFNGETDIVGWVRSVWTQTGEIQKIVDPSLLDELIDSSVMEQVTEALSLALRCAEKEVDKRPTMRDVVKQLTRWSIRSYSSSVRNKSK

SEQ ID NO: 58861 - protein, 231 aa, Zea mays
MAGGNDLKVLGVWTSPFVIRVRIVLNLKGLAYEYVEEDLGNKSALLLGSNPVHKSVPVLLHAGRAINESQVILQYIDEVWAGTGPAVLPADPYERAVARFWGAYIDDKVESAWLGMLFRCANEEERAAAVARAREALDALEGAFRDCSRGRPFFGGDDIGFVDAVLGGYLGWFGAVGRIIGSRLIDPARTPLLAAWEDRFRAADVAKGVVPDDLDKMLAFLQTLRAMNYAK

SEQ ID NO: 58862 - protein, 99 aa, Crocosphaera watsonii WH 8501
MVTYQVTLINEAEGINVTIEVPEDEYILDVAEDQGIDLPYSCRAGACSACAGKVTSGSVDQGDQSFLDDEQIEAGYILTCVAYPTSDCTIETNHEESLY

SEQ ID NO: 58863 - protein, 111 aa, Oryza sativa Japonica Group
AIICGKVGQVPVQKILRNGHTVTVFTVGTGGMFDQRTVGAENLPMPAQWHRISVHNEQLGAFAVQKLVKNSAVYVEGDIETRVYNDRINDQVKNIPEICVRRDGMYANLKF

SEQ ID NO: 58864 - protein, 337 aa, Crocosphaera watsonii WH 8501
MIRVAINGFGRIGRNFLRCWLGRENTGLEVVGINDTSDPRTNAHLLRYDSMLGILDADIEADENSITVNGKTIKCVSDRNPLNLPWTEWNVDLVIESTGVFVTEEGASKHIVAGAKKVLITAPGKGGNVGTYVVGVNAQDYEHDKHNVISNASCTTNCLAPVVKVLNDNFGIIKGTMTTTHSYTGDQRILDASHRDLRRARAAAVNIVPTSTGAAKAVALVIPEMKGKLNGIAMRVPTPNVSVVDLVAQVEKSTIAEQVNDIFKTASEGSMKGVLGYNDLPLVSCDYRGTDVSSIVDASLTMVMGGDMVKIVAWYDNEWGYSQRVVDLAEVVANKWK

SEQ ID NO: 58865 - protein, 134 aa, Triticum aestivum
GGDDGQGHRGGATRRGVRGQGLLRPTAGAALRRRGADQVVPVPRGHRRVRGHAALPLPIGFAVFMVHLATIPITGTGINPARSLGAAVIYNNEKAWDDHWIFWVGPFIGAAIAALYHQYVLRASATKFGSSASF

SEQ ID NO: 58866 - protein, 142 aa, Cicer arietinum
FDEILQEADGIILSRGNLGIDLPPEKVFLFQKSALYKCNMAGKPAVLTRVVDSMTDNLRPTRAEATDVANAVLDGSDAILLGAETLRGLYPVETISTVGRICSEAEKVFNQDLYFKKTVKYVGEPMTHLESIASSAVRAAIK

SEQ ID NO: 58867 - protein, 119 aa, Streptococcus thermophilus LMG 18311
MDKIILNGCRFYGYHGAFVEEQTLGQVFVVDLELAVDLTRASQSDNLADTVHYGLVFEAVQRQVEEEKYILIERLAGAICEDLFDQFVPIQSIKIRITKENPPINGHYRSVGIELERSR

SEQ ID NO: 58868 - protein, 410 aa, Burkholderia pseudomallei K96243
MLRSATMMASAFPALAQRVNGAPLAYLDNAATTHVPQPVLAAMRGFDERDRANIHRGVHTLSQRATDAYERARDTLARFVGANGEHLLVFTSGATDALNLVANGLSVAGHTQAVLQEGDEIIVSALEHHANLVPWQMAARRCGAKLRILHPDPQGSLHVLDLERLLGPRTRVFAVTACSNATGERPPYEALLAAARAGGALTVLDAAQAVGHDVPDLSALACDFAAFSGHKMYGPMGTGALVGRRDALERLVPLRFGGDMVSWVGETDATFDALPARLEGGTPNVAGAVGIAAAADYIDAIGRARIDAHVRALRDHAAAGLAALDGVTVLAPRTSSAIVSFVVDGVHPHDIGTLLDERGIAVRTGFHCAQPLLERLGCGPTTRASFALYNTHDEVERLVAGVAQALKVLR

SEQ ID NO: 58869 - protein, 78 aa, Cicer arietinum
STHIEPLGLGQGLSMGVLNLAIVVPQIVVSLGSGPWDQIFGGGNSPAFAVAAVAALMSGLLALLAIPRTGTQKPRSRV

SEQ ID NO: 58870 - protein, 515 aa, Vitis vinifera
MAPAFAAASSTYSPYYHIFFTALAFLISGLIVLLSRKTKSKKLNLPPGPPGWPIVGNLFQFARSGKQFFQYVRELRPKYGPIFTLKMGNRTMIIISSAELAHEALIEKGQSFASRPRENPTRTVFSCNKFTVNAAVYGPVWRSLRRNMVQNMLSASKIREFSNLRDVSMDKLIDRLRSEAEANDGAVWVLKNARFAVFCILLSMCFGVEMDEETIEVMDDLMKTVLITLDPRLDDYLPLLSPFFSKQRKAATEVRKRQIKTVVPFIERRRAALENPGSDKTAASFSYLDTIFDLKIEGRKSSPTNPELVTLCSEFLNGGTDTTGTAVEWAIARMIENPEIQSKLYEEIKTTVGDRKVQEKDMEKMPYLNAVSKELLRKHPPTYFSLTHAVTEPAKLAGYDIPTDANVEFFLPPISEDPKLWKNPEKFDPDRFFLGGEDADITGVTGVKMMPFGVGRRICPGLSMATVHVNLMLARMVQDFEWSAYPENSKIDFSEKLEFTVVMKNPLRAKIKPRV

SEQ ID NO: 58871 - protein, 505 aa, Emericella nidulans
MSATIARAEEQQNGDDTVIVVLGASGDLAKKKTFPALFGLFRNKFLPKGIKIVGYARTQMDHNEYLKRVDTLRPRQRKIEEQLNSFCELCTYISGQYDQDDSFKNLAKHLEEIEKNQKEQNRVFYMALPPSVFITVSEQLKRNCYPKNGVARIIVEKPFGKDLQSSRDLQKALEPNWKEEEIFRIDHYLGKEMVKNILIMRFGNEFFNATWNRHHIDNVQITFKEPFGTEGRGGYFDEFGIIRDVMQNHLLQVLTLLAMERPISFSAEDIRDEKVRVLRAMDPIQPKDVIIGQYGRSLDGSKPAYKEDDTVPQDSRCPTFCALVAHIKNERWDGVPFIMKAGKALPNEQKTEIRIQFKDVTSGIFKDIPRNELVIRVQPNESVYIKMNSKLPGLSMQTVVTELDLTYRRRFSDLKIPEAYESLILDALKGDHSNFVRDDELDASWRMFTPLLHYLDDNKEIIPMEYPYGSRGPSVLDDFTASYGYKFSDAAGYQWPLTHTTPNRL

SEQ ID NO: 58872 - protein, 164 aa, Cicer arietinum
LVAGEAGTGIAELIALEMSKQTKTPIEETRKKIWLVDSKGLIVSSRANSLQHFKKPWAHEHEPVGTLIDAVKVIKPTVLIGSSGVGKTFTKEVIEAMTSNNEKPLILALSNPTSQSECTAEEAYTWSEGRAIFASGSPFDPVEYNGKVYYSGQSNNAYIFPGFG

SEQ ID NO: 58873 - protein, 486 aa, marine gamma proteobacterium HTCC2143
MSTAEYKNVATLHPQNLEALVELQRSKFRAEGEVTYSTRIDRLKRLKALIIENKIEFAETTKREFGGARSYEFSLFSEFASKVEAIDYSMKHLKEWMKPEKRKTNKPMNFLGGKSQVRHFPKGVVGIISPWNLPFGLTVSPLTSALAAGNRALLKPSEFVPETAALFAEIVPKYFPEDEVAVVTGGADISQKFAELPFDHLLFTGSTNVGAKVMQSASKNLVPVTLELGGKSPVIIGRSAKIDLAGTRLTFGKLLNGGQLCLSPDYVVVPNELEEQLIARVVHEAQAMYPNITENEDYAGVINERHFARLQNYIDDAVAKGAKLTIVGADKARASDDNRRMPLHILQNVNEDMLVMHEEIFGPILPVMTYSDAAEVPDMIEPRRNPLAMYYFGKDKQEQEFLLSHVPSGGVCINDITLHYVQEDLPFGGVGASGMGAYHGPEGFRSLSHARAIYSQTMIDVLPIVGARPPFGKKFRKNISKILGAI

SEQ ID NO: 58874 - protein, 472 aa, Glycine max
MEGKKKTTNCLLFLFLSLTLSLSLSAALQLQTQTLPLHSLPHPPAISWPESESEPDPEEEALSLHLHHIDALSSNKTPEQLFQLRLQRDAKRVEGVVALAALNQSHARRSGSSFSSSIISGLAQGSGEYFTRIGVGTPARYVYMVLDTGSDVVWLQCAPCRKCYTQADPVFDPTKSRTYAGIPCGAPLCRRLDSPGCNNKNKVCQYQVSYGDGSFTFGDFSTETLTFRRTRVTRVALGCGHDNEGLFIGAAGLLGLGRGRLSFPVQTGRRFNQKFSYCLVDRSASAKPSSVVFGDSAVSRTARFTPLIKNPKLDTFYYLELLGISVGGSPVRGLSASLFRLDAAGNGGVIIDSGTSVTRLTRPAYIALRDAFRVGASHLKRAAEFSLFDTCFDLSGLTEVKVPTVVLHFRGADVSLPATNYLIPVDNSGSFCFAFAGTMSGLSIIGNIQQQGFRVSFDLAGSRVGFAPRGCV

SEQ ID NO: 58875 - protein, 510 aa, Hyphomonas neptunium ATCC 15444
MHDLIEALEQKRADARIGGGQARIDSQHAKGKLTARERIQVLLDEGSFEEYDMFVEHRCADFGMEEQKIPGDGVVTGHGTINGRLVYVFSKDFTVFGGSLSRAHAEKIVKVQQAAVRNGAPVIGLFDAGGARIQEGVDSLAGYADIFMENVLSSGVIPQISVIMGPCAGGDVYSPAMTDFIFMVKDTSYMYVTGPDVVKTVTNEEVTHETLGGASVHAKKSGVVDGAFENDIEALTQIRRLIDYLPASNRDKPPIRPVHDAFDRAEASLDTLVPPNPNTPYDMKELITKVVDEGDFFEISPQFGGNILCGFGRIEGSTVGVVANQPMTLAGVLDIDASRKAARFVRFCDCFNIPLVTFVDVPGFMPGTKQEYGGLIKHGAKLLFAYAEATVPKVTVITRKAYGGAYDVMSSKHLRGDVNYAWPTAEIAVMGAKGAVEIIFRKEAGDPEKLAARTKEYETNFANPYVAAKRGYIDDIIMPHNTRKRIANSLRTLKNKSLSNPWKKHDNIPL

SEQ ID NO: 58876 - protein, 371 aa, Bacteroides fragilis NCTC 9343
MGIMVGLPTSGGTEKDLQLNFGLTVNDQVEMLAPFLPAEWFLQSGIQLTWPHAGTDWAYMLAEVQECFINIAREIAKRELLLIVTPYPEEVRKQIIGTVNMDNVRFLKCDTNDTWARDHGAITLMDTGGASLLDFTFNGWGEKFEARLDNQITRRAVEVGALKGQYKDCLNFVLEGGSIESDGAGTLLTTSECLLSPHRNSPMNRVDIEEYLCRVFHLQRVLWLDHGYLSGDDTDSHIDTLARFCSPDTIAYVKCTDSEDEHYEALCKMEEQLKTFRTTSGAPYRLLALPMADKIEVEGERLPATYANFLIMNDVVLYPTYNQPENDKLAKEVLCEAFPTYEVVGIDCRALIKQHGSLHCVTMQYPTGVIK

SEQ ID NO: 58877 - protein, 299 aa, Polaromonas sp. JS666
MPKFTLNKAVFPVAGLGTRFLPATKAQPKEMLPVVDKPLIQYAVEEAYAAGIRHMIFVTGRNKRAIEDHFDTAYELENELEVAQKQELLALVRSVQPDDMNFSYVRQPRSLGLGHAVLCAEHLVGDEPFAVLLADDLMVGPPGGLPVLAQMAAQYQELHQSVLAVQEVPLAHTRRYGIVAAEAISPGANPRLMKVQKIVEKPAPEVAPSRMGVAGRYILTPAIFEHIRRQASGVGGEIQLTDGISSLLAEEAVYALQYQGKRYDCGSKEGFLEATVELALQHPEVGQHFRQYLSGLKLD

SEQ ID NO: 58878 - protein, 459 aa, Burkholderia pseudomallei K96243
MTRRFDAIIIGTGQSGPPLAARLSAAGMKVAVVERGRFGGTCVNTGCIPTKTLIASAYAAHLARRADEYGVTLGGPVAVDMKKVKARKDQVAARSNRGVEQWVRGLENGAVYHGHARFESARTVRVDEALLEAERIFIDVGGRALIPPIPGLDQVPYFTNSTMMDVDFLPEHLIVLGGSYVGLEFGQMYRRFGARVTIVEKGPRLIAREDEDVSHAVREILEGEGIDVRLDADCLSVRRDGGGIAVGLDCAAGAREVRGSHLLLAVGRVPNTDDLGLEHAGVETDARGYIRVDEQLRTNVAGIWAMGDCNGRGAFTHTSYNDYEIVAANLLDGDPRKVSDRIPAYAMFIDPPLARVGLTQAEAARSGRRLLVGTRPMTRVGRAVEKGESLGFMKVIVDADSHAILGASILGVTGDEVVHSLLDAMYAKAPYTTISRAMHIHPTVSELVPTLLQDLHPPA

SEQ ID NO: 58879 - protein, 496 aa, Physcomitrella patens subsp. patens
MDGRLFLQGLETVAFVCVSVLLISQLWPKNEERAKINTRLPRGSYGLPLVGETLKYMASMMTSAPAFMAEHRQKYGEMFKSKLMGAFCIITTKADTIKWVLNHEGKQFVTGYPKSFRKVLGEYAALSLHGDQWKSTRRFLVNSLRVELLRERIPTIEQAVLENLNPWAAKESVSIREETKTLAFNVVAQYLLGSRLKSGPVNDSLRNDFYTLTEGLFALPINLPGTNYRKGLEARARIIETLERDVVSQARPVGDEDQYADYMDYMRKENLPGTTEELLLEKTRCHVLGMLFAGHETAASAMLFAVKYIMDNPRVLNELRAEHENIRISKFEGGSLTWDDYKNMRFTQSVITETLRLANPVALLWREATEDVQLNGYVIPKGWKTVCAIREAHHDPALFDRPSEFNPWRHEQEVMNPAKKLPLLGFGGGPRYCPGAELARAEICIFLHHLVTKFDLKSCGEETVSFFPVPKFSNGLQVQVQERDLSTRISHKIRVH

SEQ ID NO: 58880 - protein, 1572 aa, Magnaporthe grisea 70-15
MSQPVEDPSHDQARNDNAQTTTDTGNASMPKTNGHDQESSATGISSSPADTLMDKEKQAAPTPEPSTEKAAVPDPAASVASDTAEDEFFDDNDSEQRRRNEMVQQLARTYTSRSNASAAADEYGNANPFLIASEDPDSPLNPSGNNFKAYAWAKAIAGMVAAEGGSFRTIGICFQNMNVFGFGAATDFQKTVSNVWLEAANMLRTAVGMGKTTRIDILRGFNGVGCRQRKCTNVTEERQSTLQKLLSVGDTLTFAANARAPRRGPPGVSKTLFANHIRDVVMAIFGISHTINTRVGNEYIRGVSGGERKRVTIAEAALSGAPLQCWDNSTRGLDSANAIEFCKTLRLQTRLFQTTACVSIYQAPQSAYDMFDKAVVLYEGYQIYFGPADEAKQYFVNLGFECPARATTPDFLTSMTAPHERIVRPGFEGKAPRTPEEFAIAWENSAEYTALQADIEEYKSSHPINGPDAEAFRKSRAAQQGRGQRPNSPYTLSFYQQTKLCLWRGWKRLLGDPTLTVGALFANTLMALVISSIFFNLQMTTSSFFQRGALLFFACLLNGFAAALEILILFAQRPIVEKHDRYALYHPSAEAVASMLCDMPYKVFNAIVFNLVLYFMANLRREPGAFFFYLLISFATVLAMSMMFRTIASMSRSLSQAMVPAAAIILILIIFTGFVIPLDYMLPWCRWLNYIDILAYSFESLLINEFAGQRYTCTEFVPRAEFPGYGDLSGTNRVCQAVGSVAGQPFVKGEDYLYSSFRYESANKWRNFGILIAFMIFFLFTYMVAAENVREKKSKGEVLVFRRGQRPAAIKDAKTDPEAGPPKVGGAVVAANMTGENAGFIQRQTSTFGWRDVCYEVQIKKETRRILDHVDGWVKPGTLTALMGVSGAGKTTLLDCLADRTSMGVITGEMLVDGHQRDASFQRKTGYVQQQDLHLQTTTVREALNFSALLRQPAHVPRAEKLAYVDEVIRLLDMQEYADAVVGVPGEGLNVEQRKRLTIGVELAAKPPLLLFVDEPTSGLDSQTSWAILDLLEKLTKSGQAILCTIHQPSAMLFQRFDRLLFLAKGGKTVYFGDIGENSKIMTDYFERNGGFPCPHDANPAEWMLEVIGASPGTTSDIDWHQAWRESPECADVHAELDRLKEQVPNTPPPTEDKASYREFAAPFHQQIYAVTHRVFQQYWRTPSYIYAKAALCAVTALFIGFVFYDAPNTQQGLQNQMFAIFNILTVFGQLVQQTMPHFVIQRDLYEVRERPSKVYSWKVFMLSQIIVEIPWNSLMAVIMFFCWYYPVGLERNAILADQVTERGALAFLYLWGFLIFTSTFTDLMIAGFETAEAGGNIANLFFSLCLIFCGVLANPDTMPRFWIFMYRVSPFTYIVSGLLSVAVANSEVRCASNEFLHFDPLNGTCAEFMRNYINGTTIPGLGRIPGAGGYLRPDTESSRSNCAFCPIKDTNIFLQGAHANYNDRWRNFGLIFVYIIFNIIAALFVYWAVRVPKKKLGGKDAAAGVGAGAGAARASASNEKGKMQREKGEVEGLTTAVLGTSVAGSDAPMTTTTEGEGERAKRRTSGDEVVR

SEQ ID NO: 58881 - protein, 549 aa, Pasteurella multocida subsp. multocida str. Pm70
MKNINPTTTNAWKALQQHHKTQSAVTIQQLFAQEKDRFTDYSLSFNNEVLVDFSKNNVTKETLGLLRQLAQECALSEAVDAMFSGAKINKTEDRAVLHTALRNRSNSPVLVDGKDVMPEVNAVLAKMKDFCHRVISGEWKGYTGKAITDVVNIGIGGSDLGPYMVTEALRPYKNHLNLHFVSNVDGTHIAETLKKVNPETTLFLVASKTFTTQETMTNAHSARNWFLATAKDESHVAKHFAALSTNSKAVAEFGIDTNNMFEFWDWVGGRYSLWSAIGLSIALSIGFEHFEALLAGAHEMDKHFRTAPIEQNIPTTLALIGLWNTNFLGAQTEAILPYDQYLHRFAAYFQQGNMESNGKYVDRNGEVIDNYQTGPIIWGEPGTNGQHAFYQLIHQGTTLIPCDFIAPAQTHNPLADHHEKLLSNFFAQTEALAFGKTKEEVEAEFVKAGKSLDEVKEVVPFKVFTGNKPTNSILVQKITPFTLGALIAMYEHKIFVQGVMFNIYSFDQWGVELGKQLANRILPELANRETITTHDSSTNGLINQYKQWR

SEQ ID NO: 58882 - protein, 264 aa, Kineococcus radiotolerans SRS30216
MTTRPRPLVGVSLKMYFSLARTRSYLADVATLGPDVAGSGVDAFVIPDFLNITTGIDLLRGTGIAVGAQDASWEDFGALTGEVSPAALREAGARFVEIGHAERRRMFAEDDIVTARKAAAAARNGLVPLICIGENVRIDVADAARTTISQVLAALEDVPSEAEVVIGYEPNWAIGQTEPAPPEHVVGVTTRLRDALAHRRGLTRILYGGSAGPGMFTDVAEGVDGLFLGRFAHDVANFRSVIQEIADHPLNAHGSTAEPATDRA

SEQ ID NO: 58883 - protein, 279 aa, Triticum aestivum
DKGDLSTANEGSPSEDGDRKRGGGHRRGSKGTRKRMAMEAELSCKLVDFGNACWTYKQFTSDIQTRQYRCPEVLLGSKYSTSADLWSFACICFELASGDVLFDPHSGDNFDRDEDHLALMMELLGMMPRKIALGGRYSRDYFNRYGDLRHIRRLRFWPLSKVLVEKYEFSDIDAIAMSDFLVPILDFVPEKRPTAAQLLQHPWFDAGPLRRQPRVLADTAENPVDGAPENKGKEKDDERDAMAAELGNIAIDGASSSKIVKDPQASSKQKIANGTPSKK

SEQ ID NO: 58884 - protein, 150 aa, delta proteobacterium MLMS-1
MSSKAVVLKTPAEIEIMAEANRLVAETLTLLSTRVAPGVSTADLDGWAEEYARKHGGVPAFKGYRGFPGSLCVSLNEQVVHGIPSRKVILREGDIISMDFGVQWQGFFGDAAVTLPVGKVTPQVGRLLEVTRGSLQRGIEKVQVGNRISD

SEQ ID NO: 58885 - protein, 595 aa, Prochlorococcus marinus str. AS9601
MIKVEKVKKKKDSAKEETVCLANGLEVSKFENFKKSSQFLKEPLATELVNESDHFTNDAVQLLKFHGSYQQDNRENRRPGKSKDWQMMLRLRNPGGEVPGKLFLALDELSDKLGNGTLRATTRQAFQMHGIRKENLKEVIKTIVNSMGSTLAACGDINRNVMAPAAPFDSPDYNIARALAKKVADLLTPMAGQGTFLELWADGDLEYTIKPDKDIEAIRKLQFKDNVFSGIKDEPLYGSTYLPRKFKCAVTVPGDNSVDLLTNDIGIVAFTSKNGNLEGCNFYVGGGMGRTHNNEETFARIADPLGYVEEPDVYELIQSIVAIQRDYGDRKSRKNSRMKYLLHRKGIKWFKKILSDKYFKKEIKKIRKEPDNVLIDYLGWHKQNKTSYFVGLPLLSGRLSGEKKNTITTIVKKYNLDLRLTPNQDILLCNIANENKGEIQKSLSKIGYENLENINEIQRHALACPALPLCGLAMTEAERILPDVLKRIENLLLDLKIQKTILFRMTGCPNGCTRPYMAELALVGSGQNKYQLWLGGSKNLQRLAKPFLQRMELNDLEKTLQPLFNNWKSNLDLDFGDFINTQDENYIFNLLNKNQ

SEQ ID NO: 58886 - protein, 168 aa, delta proteobacterium MLMS-1
MAEYKRDNGDDQLIEKIVFINRTAKVVKGGRRFNFSAIVVVGDGKGQVGFGLGKANQVPEAIRKGVEKARKDMQPVAVSEVSIPHEIVGKFGAGQVLLKPAAAGTGVIAGGPVRAVLEAAGVHNILTKCLGSHNPHNMVKATLDGLRRLRSPRRIAAMRGRSVEEITV

SEQ ID NO: 58887 - protein, 99 aa, Prochlorococcus marinus subsp. marinus str. CCMP1375
MASYKVTLVSESEGLNQTIEVPDDQYILDAAEEQGIDLPYSCRAGACSTCAGKITSGSVDQSDQSFLDDDQLEAGFVLTCVAYPTSDVTITTHAEEELY

SEQ ID NO: 58888 - protein, 264 aa, Planktothrix agardhii NIVA-CYA 126
MDLGLTGKVALVTGASAGIGFAVAERLAQEGCRLIICGRNGEQLEKASQSLLNFNVEVIPVIADVQNESDSQKLVEISLTKLGKIDILINNSEGASFSGESIEDISDAEWRGVFEGKLMGYIRMTNLVLPTMKNQQWGRIINIIGTSGKEPSPRLVKSGVANAGLINFTKAVATEVAKYNVLVTAINPGIIDTPRHRQYLTVNAEKQGVTVDNIRAGIMNNIPLRRIGNSGEVANLVAFLSSECASYITGITIPVDGGLSSGAF

SEQ ID NO: 58889 - protein, 136 aa, Ustilago maydis 521
MSSGGKSGGKAGDASSKAQSRSAKAGLQFPVGRIHRLLRKGNYAQRVGAGAPVYLAAVLEYLAAEILELAGNAARDNKKSRIIPRHLQLAIRNDEELNKLLGGVTISQGGVLPFIQSELLPAKSGKPKKAGGSQDI

SEQ ID NO: 58890 - protein, 308 aa, Crocosphaera watsonii WH 8501
MGIKKENLETIFEPFKQTEKGGENHEGTGLGLSISRQFARLMEGDITVESELGKGSIFTCTLKMMVQTKIEDFVKQPSKQIIGLQPSQTDYRILVVEDVKDNQLLMMKILSSVGFEVRSANNGQEALEMWQKWHPQLIWMDMRMPVMDGYEASRRIRQLEAENPNRQTPVIIIALTATAFDEERKAILEIGCNDFVPKPFKEAVIFEKMKQYLGLEYVYQESTINLSSHGTVNEVDNFEQLNAEMEKMPKAWVEELRKTALSAREKNLIHLIQEIPEQYFFLADSLNQMLEELAFEKIVNLTEGFNHE

SEQ ID NO: 58891 - protein, 220 aa, Methanosarcina acetivorans C2A
MKIEKKSEGIKFPYSEKVLEHFRNPHNVGKIENADGKGLEGSPACGDMVAVYIKVEPETKVIEDVKFESYGCASNIATGSVITDLAKGKTLDEAKKITWKQASEELGGLPPIKAHCSVLAVEGLRAAIRDYEEKHGLVTEKEPTTEDVVRRRLKHVMNPLTGLDIIRTNLILKISVEAGVVRVVVDLPEDHQFAPAIKEDIIEKLGALWDVEKVDVVFTA

SEQ ID NO: 58892 - protein, 540 aa, Triticum aestivum
  misc_feature (282)..(282): Xaa can be any naturally occurring amino acid
  misc_feature (435)..(435): Xaa can be any naturally occurring amino acid
MEAAAELAQRLRAAANDRLAGQEPLLLVAAPLLALLAARAVHAAAADVADRGLRTVLITLAMAAVKLVPGVSGYIAAEKSKVVEQLQSGSASSKKNLRTELPAVGDPDGVIDELQALKDKDVRWQGKCSGTVYIAGSESEGHFSLINKAYSMFSHTNPLHQDVFKSVAQLEAEVVAMTAALLGSKEKASGGQICGNMTSGGTESILLAVKTSRDYMQSKKGITKPEIIIAESAHSAYDKAAQYFNIKVRRVPVNKEFLADVKGFKRCINGNTIMMVGSAPGXPHGLIDPIEELGELASQYGICLHVDLCLGGFVLPFARKLGYPIPPFDFSVKGVTSISTDVHKYGLAPKGTSTVLYRNHEIRKHQFVAVTEWTGGLYISPTMAGSRPGGLVAGAWAAMMSLGLNGYLESTGKIMEVSRKIQKGIDDISGLFVIXGKPDMTVVAFGSDAVDIFEVNDIMSSKGWHLNALQRPNSLHICVTLQHTAIYEEFLKDLEDSVNTVKANPGPISGGMAPIYGAAGKMPDRGTVKELLVEFMDSSC

SEQ ID NO: 58893 - protein, 300 aa, Polaromonas sp. JS666
MNYPTIEDAIGKTPLVALQRIAAAENTERNNVILGKLEGNNPAGSVKDRPALSMIKRAEERGDIKPGDILIEATSGNTGIALAMAAAIKGYRMVLIMPEDLSIERAQTMKAFGAELVLTPKSGGMEHARDLAEQMQNEGKGRVLDQFANQDNPRIHYETTGPEIWTDTSGKVTHFVSAMGTTGTITGVSRYLKEKNPAIRVIGAQPSEGSRIPGIRKWQQEYLPKIYDPSHVDELVLVSQSDAEDMCRRLAREEGIFAGISSAGACWVAQEIAKTVKDAVIVFVVCDRGDRYLSTGVFPA

SEQ ID NO: 58894 - protein, 138 aa, Glycine max
  misc_feature (122)..(122): Xaa can be any naturally occurring amino acid
ALSMISSPADTTINRAGAGLDAPFTGLKYMAGFPTRKTNNDLTSIASNGGRVQCMHVWPPVGKKKYETLSYLPDLDDAHIGKRQSNTLLRNGWIPCLEYALDHGFMYREHNMSPGYYDGRYXTMRKLPMLDCTVASKE

SEQ ID NO: 58895 - protein, 515 aa, Hyphomonas neptunium ATCC 15444
MSWEKSIEELRRRERLAEEMGGEEPVSRQRGRGKLTVRERVAFLADPGSFHEIGKIAGKATYGADEELDGFMPSNSVMGRARLDGHPAVILADDFTVRGGAADAAIWQKMAQAIKMAAEYRMPLVQMIDGTGGGGSVKMLEKDPRTYIPETPGWSEIVHGLTQVPFVSLALGPCAGMGAGRVAASHFSIMVKELSQVFVAGPPVAIALGENVTKEELGGWKIQGQNGTVDNVVDSEADAFIAARRFLSYLPPSVHHLPGRIQPADDPKRKEESLLSIVPKDGRTPYKPRRIVEAVVDKGSFFEIGHDWGRGIVTGLARIDGHAVGIMAGDPFFLDGAWTADVCDKVTRHMDLCSTFHLPVIHFVDCPGFAVGVKAETAGVTRAGVRAMTAVYQASVPVCSVIIRKAYGLAGSAMMNQSKTKWRYCWPSGDWGSLPMAGGIEAAFRKELTEAEDPAALKEQLYKKFEAIRSPFRTAESFFAEEIIDPRETRPLLVDFVQHAQRIVEPGERQTGFRP

SEQ ID NO: 58896 - protein, 492 aa, Gibberella zeae PH-1
MALTVELSTPVTGTYQQPIGLFIDGKWVEGVDKGKFEVINPSTEEVITSVCEGTEKDIDLAVAAARKAFDGEWKNTAPQTRGNLLLKLADLAEKNLDLLAAVESLDNGKSITNARGDVGAVVGCLRYYGGWADKIEGKTIDIAPDMFHYTRSEPIGVCGQIIPWNFPLLMLAWKIGPALATGNTVVMKTAEQTPLSALVFTQFIEQAGFPAGVFNLVSGYGKTAGAALSSHMDVDKIAFTGSTVIGRQIMKAAASSNLKKVTLELGGKSPNIVFEDADIEEAINWVNFGIYYNHGQCCCAGTRIFVQESIYDKFLAAFKKRAEENKVGDPFNEETFQGPQVSQLQYDRIMGYIKAGKDEGATVEIGGERLGDKGYFIKPTIFSNVRPDMKIMQEEIFGPVCAISKFKDEAEVIDLAHDTAYGLAAAVHTKNLNTALRVSNALKAGTVWVNCYNMLHHQLPFGGYKESGIGRELGEAALANYTQNKSVAIKLY

SEQ ID NO: 58897 - protein, 412 aa, Bacillus cereus ATCC 10987
MKIEDILMAHNCMKDIVIKTPLQRDTVLSEKYDCDVYVKREDLQLIRSFKIRGAYNLIQSLPKEQLQNGVVCASAGNHAQGVAFTCNLLKIPSKIFMPTTTPKQKVSQVQFFGGDFAEIVLVGDTFDSSFQEAQRYCEENRMTFVHPFDDPYVVAGQGTVAVEIMHDMEKPVDYIFTAIGGGGLASGVGTYVKGVSPATKVIGVEPMGAASMKEAFLQNDNVALEKIDSFVDGAAVKKVGKLTFETCKDVIDDIVLVPEGKVCTTILELYKKNAIVAEPAGALSIAALDLYKDEIQGKTVVCTLSGGNNDIDRMQEMKERSLIYEGLKHYFIIEFPQRSGALREFLDKGLGPEDDITRFEYIKKHNKENGPALVGVELKHKEDYAQLITRFKENNIQFMELNKNPVLFDLLI

SEQ ID NO: 58898 - protein, 368 aa, Synechococcus sp. CC9605
MSLFQNLRRRFTATPVMQDWPGLIEAYRSWLPVSDATPVISLREGATPLIPVPSVAEQIGKGVKVFVKYDGLNPTGSFKDRGMTMAISKAKEAGCEAVICASTGNTSAAAAAYARRGGMRAFVLIPDGYVAQGKLAQALVYGAEVLAIRGNFDRALDIVREAADKYPVTLVNSVNPYRLQGQKTAAFEIVDALGDAPDWLCIPMGNAGNITAYWMGFQEYQQAGRSRSLPRMMGFQASGSAPLVNNTTVTDPETIATAIRIGNPVNRAKALAAREASNGAFLDVTDAEILAAYKILGGQEGIFCEPASAASVAGLLKRKDEVPAGATVVCVLTGNGLKDPDCAISNNDAAFHTDLNPDLGTVASVMGF

SEQ ID NO: 58899 - protein, 325 aa, Triticum aestivum
MGEASPSIAKDVTELIGNTPLVYLNKVTDGCVGRVAAKLESMEPCSSVKDRIGYSMITDAEEKGLIIPGVSVLIEPTSGNTGIGLAFMAAAKGYKLILTMPASMSMERRIILKAFGAELVLTDPLLGMKGAVKKAEEIQAKTPNSYILQQFENPANPKIHYETTGPEIWKATAGKIDALVSGIGTGGTITGTGRYLREQNPNVKLYGVEPVESAVLNGGKPGPHKIQGIGAGFIPGVLDVDLLDETLQVSSDEAIETAKALALKEGLLVGISSGAAAAAAVRLAKRPENAGKLFVVVFPSFGERYLSSVLFQSIKKEAESMVVEP

SEQ ID NO: 58900 - protein, 114 aa, Zea mays
  misc_feature (26)..(26): Xaa can be any naturally occurring amino acid
  misc_feature (51)..(51): Xaa can be any naturally occurring amino acid
KLFIELESTTIDLVDWHPSELTALPXTLNGASIVRIYKATTAGDLIGELSXGTEVADLITKLHEIKKCSGRGIIATGPAPAGSRYDFFTRFYCPKSAIDEDPRCGNAHWSLSPY

SEQ ID NO: 58901 - protein, 291 aa, Physcomitrella patens subsp. patens
MESMWEHEDQPHWRDYLMAVFFASFFPVARLFLDSIIFEKSARRLLFSGEKKVTKKRLLEVNEKKVSKFTESAWKLTYYMFTTTTLLLSARNEPWFGKTEHFWIEWPNHAIKFKLKVLYAFQCGFYVYSVAALMVWETRRKDFGVMMAHHFITIGLIAFSYVQGSYRAGISTLLLHDISDVFLEIAKLCKYSHFEVGASVCFGLFALSWFVLRLVIFPFWIIWSISVEVMQYLDLGGNKEFKQYYFQSTLLIMLFIFHIYWWILICRMLVKLFRDSGKVSDDVRSDSEGED

SEQ ID NO: 58902 - protein, 187 aa, Cucumis sativus
EPSHATARMLVIGAGKMGKLVIKHLVAKGCTKMVVVNRSEERVTAIREEMKDVEIIYKPLTEMLSCTAEADVIFTSTASESLLFTKEQVKDLPPVGHDVGGLRLFIDISVPRNVGACINNLEDVRVYNVDDLKEVVAANKEDRLRKAMEAQSIITEESKQFEAWRDSLETVPTIKKLRAYAERIRTA

SEQ ID NO: 58903 - protein, 109 aa, Physcomitrella patens subsp. patens
MSSSDRGGIQALLAAEQDAQRIVANARAAKTARLRQAKEEAEREVAQYRAQREAEFRKKLSDSSGDSGANVKRLESETNDKINRLSDDAAKVAAEVTALLMNYVITVKN

SEQ ID NO: 58904 - protein, 576 aa, Thermus thermophilus HB27
MPISRYYDVKRDEKGERYLEPYVTGFLLLRLPLLNKGTAFTEEERRLLGLEGLLPPHVHTLEEQKERVYRRYRLIQSPLEKHIYLRHLQDRNEVLFYALVVDHLEEMLPILYTPTVGEAVREFSHIYRYPRGFTASTKNIDRIDEALQNVPLEDVRLIVATDSSAILGIGDQGYGGMAISIGKLTLYTAAGGVGPDKTLPVELDVGTDREDLLKDPLYLGVRHRRLRGEEYFRFLDRFVEAVRRRYPKALIQWEDFAKETAFQVLERYRKVIPSFNDDIQGTGAVALAGVLSACRLKGERLSDQVVVVYGAGAGGIGVAWALVEGMKREGLSEEEAKARVLVLDSKGLLVEGRSMEDYKRPYAQRPERLWGWRFAGEYPNLLETITNARATVLLGLSGQAGSFTEPVVRAMLANTPRPVIFPLSNPTSATEALPDDLVYWTEGRALVAAGSPFPPVGFKGRTVPIGQGNNAFVFPGLGLGAVLSRAREVTDGMVLEAAYALYDYTREHFPERIYPPVGRLREVSPYVAARVMQRALEEGVAEEARVQGLTLEALLDFVKSRFWEPRYLPYRPAPVI

SEQ ID NO: 58905 - protein, 251 aa, Prochlorococcus marinus str. AS9601
MTESNQENLTGANRPIQIIPSVLPADWANMGACVKELEEAGVDRIQFDVMDGNFVPNLTFGPEMISACRKYCNVPFETQLMVSQYNCETMLESYVKATKGPNGEPGVVIAHAEANIHLHRVLGRIRDLGGSPSVALNPHTPFEMIKNIMDMVDHVLVMTVNPGFGGQAYIPTMLNKIREIRNFIIEKNLDVDIEVDGGIKANWTISQCADAGANCFIAGSGMFAYPTLKEGCDDLRKVAQEAQKGNVLSEP

SEQ ID NO: 58906 - protein, 451 aa, Triticum aestivum
  misc_feature (225)..(225): Xaa can be any naturally occurring amino acid
  misc_feature (308)..(308): Xaa can be any naturally occurring amino acid
  misc_feature (314)..(314): Xaa can be any naturally occurring amino acid
  misc_feature (384)..(384): Xaa can be any naturally occurring amino acid
  misc_feature (402)..(402): Xaa can be any naturally occurring amino acid
MAATIQSVKARQIFDSRGNPTVEVDVCCSDGTFARAAVPSGASTGVYEALELRDGGSDYLGKGVSKAVNNVNSIIAPALVGKDPTAQTELDNFMVQQLDGTKNEWGWCKQKLGANAILAVSLAVCKAGASVKKIPLYQHIANLAGNKQLVLPVPAFNVINGGSHAGNKLAMQEFMILPTGATSFKEAMKMGVEVYHNLKSVIKKKYGQDATNVGDEGGFAPNIQXENKEGLELLKTAIEKAGYTGKVVIGMDVAASEFYNDKDKTYDLNFKEENNDGSQKISGDSLKNVYKSFVSEYPIVSIEDPFDXQDDWVXHYAKMTEECGVEVQIVGDDLLVTNPTRVAKAIQEKSCNALLLKVNQIGSVTESIEAVKMSKHAGWGVMTXSHRSGETEDTFIADLAVXGLSTGQIKTGAPCRSERLAKYNQLLRIEEELGDAAVYAGLKFRAPVEPY

SEQ ID NO: 58907 - protein, 436 aa, Prochlorococcus marinus str. AS9601
MHIVVVGLSHRTAPVEVREKLSIPDQSITESLKALKAFSDVLEVSILSTCNRMEIYALVKDKNTGISSIKEFISEYSGIIFEDLNPHLFCFRQEEAVLHLMKVSAGLDSLVLGEGQILSQVKKMMRLGQENQSTGPILNRLLTQSVSTGKKVRSETNLGTGAVSISSAAVELAQLKIGQEKGFDTLVSLESENVLVVGAGRMSRLLITHLKSKGCHKLILLNRNIDRALNLAQDFPDLEIVCRGLNELEENISLSSIVFTSTASEEPIIDLAKIEKLNLSNRLKFIDIGVPRNISNDVKQHQFVKSFDVDDLQEVVSRNQEFRQKIAKEAESLVEEERIIFLEWWASLEAVPVINKLRSDLELIRKEELQKALSRMGPDFSARERKVVEALTKGIINKILHTPVTKLRSPQSREERQVSLKIVEKLFSLVEEEQNN

SEQ ID NO: 58908 - protein, 431 aa, Prochlorococcus marinus str. AS9601
MKRVLAIILGGGKGSRLYPLTKMRAKPAVPLAGKYRLIDIPISNCINSGIEKMYVLTQFNSASLNRHIGRTYNLNGPFGQGFVEVLAAQQTPDSPKWFEGTADAVRKYQWLFQEWDVDEYLILSGDQLYRMDYSLFVQHHRDNGSDLTVAALPVDEAQAEGFGLMRTDDVGNIKEFSEKPSGEKLKAMAVDTSKFGLSKESAAEKPYLASMGIYVFSRNTLFDLLNKFPNYTDFGKDIIPEALNRGDTLKSYVFDDYWEDIGTIGAFFESNLALTEQPKPPFSFYDEKFPIYTRPRFLPPSKLVDAQITDSIVCEGTILKSCSILHCVLGVRSRIESDSVLEDTLVMGADFFESPEERIELRKGGGTPLGVGEGTTVKRAILDKNTRIGDNVVIINKDRVEEADKPELGFYIRNGIVVVVKNATIANGTVI

SEQ ID NO: 58909 - protein, 298 aa, Bacillus cereus ATCC 10987
MPNIAVVGSISMDLVAVSKKRPKAGETVIGEAFHTIPGGKGANQAVAAARLGANVAMVGAVGDDNYGTVVRKNLENERVFIDYVVPVTDTATGIAHIVLAEEDNSIVVVQGANALVNESVVNRSKDLLTKADMVVLQLEIPLETVKYVLAICEEHKIPVMLNPAPAQVLSEDILEKATYITPNEHECRIVLDDFTSPIEELLAKYPNKLLMTEGSNGVRFHNGTEIVHVPSIAVDVVDTTGAGDTFNGALAVALSEGETLQKAIRFANIAGGLSVTKLGAQGGMPTRDKVREVQVIVG

SEQ ID NO: 58910 - protein, 472 aa, Prochlorococcus marinus str. AS9601
MSKAHFGLIGLGVMGENLVLNAERNGFSSVVFNRTYSKTEEFLQGRGLGKSIEGAETLQEFVNKLERPRRILMMVKAGPATDAVIDNISGYLEEGDLLIDGGNSQFKDTERRVNTLESKSFGYIGMGVSGGAKGALEGPSMMPGGTKASYDAIESLLTKMAAKVEDGPCVAYVGPGGSGHFVKTVHNGIEYGIEQILAEAYDLMKRVKGMNGQQMSEVFGIWNNTDELASYLVEITEICLNTKDEMTGDDVVEKILDKAGQKGTGLWTVVSALELGVSVPTIYASLNARVMSSLKEQRTEIEKTIPSKDIEDFDLGNISDGMKPLFDAVVLATIASYAQGMDILREASAVYNYGLNMPSIAQIWKGGCIIRSKLLSKIQDAYNKDPDLKNLIFDDWFNNEIATRLDNLAKVVSLSTKAGIPVPCLSSTLDYLNSYRTNRLPQNLVQAMRDCFGSHTYERIDREGSFHTEWMK

SEQ ID NO: 58911 - protein, 126 aa, Brassica napus
  misc_feature (48)..(48): Xaa can be any naturally occurring amino acid
FILILDSGVSLSLGFASPLVVGKELRSSFVTDDVRHVTGSLCRGEGLXIIVARFNEVVKKLLLEGAIETFKKHSVREEDIQVIWVPGSFEIGVVAQKFGKSGNFHAILCIGVVLYGVPKLRLELGA

SEQ ID NO: 58912 - protein, 172 aa, Prochlorococcus marinus subsp. marinus str. CCMP1375
MIGSKLKEAIRSYSDFPKKGILFHDISPIFCKPDLYQELIEEMAKSEILNSSDAIISIDARGFLFGSCISLKLSKPLILARKAGKLPGPILSSTYNLEYGENSLSIQKESLNEFKNFAIIDDVLATGGTINCVKSLLTSHNKNISGACVVIELLALKAREKLDFPIYSTLTL

SEQ ID NO: 58913 - protein, 371 aa, Gibberella zeae PH-1
MSPSFHSLLAIATLAGSAALASPIPEPETPQLIPRAVGDFECFNASLPNITIFATGGTIAGSAGSADQTTGYQAGALGIQALIDAVPQLCNVSNVRGVQIANVDSGDVNSTILTTLAHRIQTDLDNPHIQGVVVTHGTDTLEESSFFLDLTVQSEKPVVMVGSMRPATAISADGPINLLSAVRLAGSKSAKGRGTMIVLNDKIASARYTVKSHANAVQTFIAEDQGYLGAFENIQPVFWYPASRPLGHHYFNISASSPKKALPQVDVLYGHQEADPELFQAAVDSGAQGIVLAGLGAGGWPDEAADEIKKVLNETNIPVVVSRRTAWGYVGERPFGIGAGYLNPSKARIQLQLALEKKLSVEEIQDIFEYV

SEQ ID NO: 58914 - protein, 286 aa, Streptococcus thermophilus LMG 18311
MITLKSAREIEAMDRAGDFLASIHIGLRDLLKPGVDMWEVEEYVRRRCKEENVLPLQIGVEGSIMDYPYATCCSLNDEVAHAFPRHYILKDGDLLKVDMVLSEPIDKSVLDVSKLDFDNVAQVKKYTESYAGGLADSCWAYAIGTPSDEVKNLMEVTREAMYLGIEQALVGNRIGDIGAAIQEYAESRGYGVVRDLVGHGVGPTMHEEPMVPNYGVAGRGLRLKEGMVLTIEPMINTGTWEIDTDLETGWAHKTLDGGLSCQYEHQFVITKDGPVILTSQGEERTY

SEQ ID NO: 58915 - protein, 333 aa, Ascophyllum nodosum
MVNVAINGFGRIGRLVLRAAKHNKHINVVAVNDPFVPPDYMNYMFKYDTVHGVYDGTVENDDSSIIVDGKKIKVFGEMDAANVKFGDVGADYVVESTGLFTTTESAAVHLKGGAKKVVISAPSQDAPMFVMGVNQDKYTPDMDVVSNASCTTNCLAPIAKVINDSFGLKEGLMTTVHAVTATQKTVDGPSKKDWRGGRAAGFNIIPSSTGAAKAVGKVIPELNGKLTGMSFRIPTANVSVVDLTCRLEKPASYEEIKAAMKAASEGPMHGILGYTEDSVVSSDFIGDSRSSILDANAGIALSDTFVKLVSWYDNEWGYSCRVLDLITHMDKSS

SEQ ID NO: 58916 - protein, 129 aa, uncultured bacterium
MIQHQGGCHCGRVRFEVLASAVITVSQCNCSICSKSGYLAMIVPRDRFTLKSGKENLAEYTFNTGTAKHLFCKFCGIKSFYIPRSHPDGVSVNARCLDAETVEDINIKQFDGQNWERYYPKGRAGGYSN

SEQ ID NO: 58917 - protein, 736 aa, Ustilago maydis 521
MAPIAKTVCVALAVFALASVGVQPAGAHQLNSRHAAAGGNVYHNLHSHSRRMQRKVRRDDSFSISGAGSLAASASNGDGSSSASISGSGSISGSTSNDGSSSQSNSSAKSSSISDSDPGSQSSSQSSAQSSSNSDSESDSDSNSGSHASAQSSAQSSAQSSAQSSAQSSAQSSSQSSAESSDHASSSSQASSHSDSHSSSNASSGSQSDASSNGSNSQNEGSSKVSGSDSSSASPTSTTSVSASNSLAASSTPCTDSKAGAQAQATSGSSSSTHSGTHSATASNSSTASSTHSATSSSASTASSTHSATSSSASTASSTHSATSSSARTGSASATSTNSAAAAAATASSDDASTATAAEVDTDADANGSSSSNADGNDDEDCDDGDEDEDEDENENDEEVTATSTSGSSSNSNAASGSNSAVVSSSNSSGASSASNTGSNGGSNKGSTGGSKSASSSGADVSSNSSGSASNAGAGPVSASSSSASSGSSSYGGSSDSGDDDDDCDDGETDDANDDEDCDDDDGESVNAADDDDDCDEDAGSASSSNASAAAASSASSGSSAASNQQQEPQQAVATPASSSSAAPTSTSHAAASSSSATSSASSSSSSSASRAASSAAASSSASSSASSSASSLANAITGGFATFFYQGGNAGACGKVNADSSKVAALQTSMYANGANCGKQIKIYRADDPSKSVLVTVADECPTCENKQSIDLSVGAFTAIASEAEGMVSIKWDWA

SEQ ID NO: 58918 - protein, 262 aa, Zea mays
  misc_feature (68)..(68): Xaa can be any naturally occurring amino acid
  misc_feature (95)..(95): Xaa can be any naturally occurring amino acid
  misc_feature (152)..(152): Xaa can be any naturally occurring amino acid
  misc_feature (248)..(248): Xaa can be any naturally occurring amino acid
MATAGKVIKCRAAVAWEAGKPLSIEEVEVAPPQAMEVRIKILYTALCHTDVYFWEAKGQTPVFPRIFXGHEAGGIVESVGEGVTELAPGDHVLPXVFTGECKECAHCKSEESNMCDLLRINVDRGVMIGDGKSRFTISGQPIFHFVGTSTFXSEYTVIHVGCLAKINPEAPLDKVCILSCGISTGLGATLNVAKPAKGSTVAIFGLGAVGLAAMEGARLAGASRIIGVDINPAKYEQAKKFGCTEFVXPPKDHDKPSAKIAD

SEQ ID NO: 58919 - protein, 176 aa, Candida albicans SC5314
MTDGKFPTNIEPKYIPYSKDHASLTACANPIPLDLKSLFPNNTVVVTAVPGAFTPTCTEQHIPDYLKHLKDFKDKGVKKIIVLSANDPFVMAAWAKALGYTDEENYVIFATDPNASISKELGDGFVADLTSAGMGLRLQRYASIVVNGEITYLETEDSLGFSEISSAETILKRIHN

SEQ ID NO: 58920 - protein, 341 aa, Vitis vinifera
  misc_feature (34)..(34): Xaa can be any naturally occurring amino acid
MAFTTALSLPSAARLHHRLPNRSSLNLPRTIRCXSPSISVSPSKSMQFDLRSYWTTLISEINTKLEEAIPVKYPQQIYEAMRYSVLAKGGKRAPPVMCVAVCELFGGDRLAAFPTACALEMVHAASLIHDDLPCMDDDPSRRGQPSNHTVYGVDMAILAGDALFPLGFRHIVSHTPSHLVPEGQLIRVIAEIARSVGSTGMAAGQFLDLEGAPNSVDFVQRKKFGEMAECSAVCGGFLGGAADDDILRLRRYGRAVGMLYQVVDDMLKAKTKSEEDEEKKKKGKSYVDVYGMEKAMEVAEELRAKAKRELSGFDKYGDSVVPLYSFVDFAAERGFTIDTSV

SEQ ID NO: 58921 - protein, 193 aa, Zea mays
MDERPDACAVASSTSSASVSSAEEDASIQDQLGGHGAFAPPAVDAAQPVPPRRRFWAWATLTARAAAPRLHEACGTAARGLVAWTRRGGAPRCLLVVSVGSVALVALSGLLILVFFVVAAATNAIAFSVVVSLAGAGGFLAVLLAFLAAMYVGAVSVAVFVILATTIATVVAITIATGNTVTRLFFCNAIFSH

SEQ ID NO: 58922 - protein, 164 aa, Salmonella enterica subsp. arizonae serovar 62:z4,z23:--
MMRRILSVLLENESGALSRVIGLFSQRGYNIESLTVAPTDDPTLSRMTIQTVGDEKVLEQIEKQLHKLVDVLRVSELGQGAHVEREVMLVKIQASGYGREEVKRNTEIFRGQIIDVTPTLYTVQLAGTSDKLDAFLASLREVAKIVEVARSGVVGLSRGDKIMR

SEQ ID NO: 58923 - protein, 269 aa, Pseudomonas syringae pv. phaseolicola 1448A
MLRLSSLYRFPLKSCKAETLQRASFDQLGLAGDRRWMLVDESNGRFFTQRALSHMSQLTVLWNASGGVTLSAPGFEPLDVAVPLDIESNLRGVTVWRDSLQVPDAGDVAAEWVSRFIGKPTRMVYLPAERARWLPGGYQTINDRVSFADGFPLLLIGQGSLDDLSFRLGRPLEMLRFRPNLVVEGAEAFAEDGWKRIRIGDIEFQLLKPCARCILTTVDPATGERSADREPFATLKTYREVEGNVLFGQNVVNEGFGELEVGMQVEVLE

SEQ ID NO: 58924 - protein, 296 aa, Magnetococcus sp. MC-1
MATLESLIGNTPLVDLDRVVKGCVEGVKLLAKVEGNNPGGSVKDRAAYGMFMGAEQRGVLNRETRIFEATSGNTGIALAMMAARRGYQLTLVMPETMTLERRATMAAYGADFLLVTAEQGMEGAIDLVNAKVANGEGIKLDQFSNADNWGAHYRTTGPEIWRDTQGQITHFVSAMGTTGTIMGVSRALKERNPQIQIIGVQPDEGSQIAGIRRWPQAYMPKIFEPSRVDTILDVNTAEAREMTRRLARDEGLFCGLSAGGAVAAALKVCQGLSQPGTVVVIIPDRGDRYLSTDLFL

SEQ ID NO: 58925 - protein, 363 aa, Azoarcus sp. BH72
MSLKCGIVGLPNVGKSTLFNALTKAGIEAANYPFCTIEPNVGIVEVPDPRLAALSEIVKPQKIQPAIVEFVDIAGLVAGASKGEGLGNQFLANIRETDAIVHVVRCFADDNVVHVSGSVDPIRDIEVIDTELALADMATVEKALNRYKRPAAAGDKDAKVLVAVLEKCFAQLDTGKPVRALDLSREELASIKQFCLITQKPVLYAANVAEDGFENNPHLDAVRAHAAAEGAEVVALCAAIEAEIADLDDADKKDFLESMGLEEPGLDRLIRAGYKLLGLQTYFTAGVKEVRAWTIHVGDTAPQAAGVIHTDFERGFIRAQTIAFDDFIAFKGEAGAKEAGKMRAEGKDYVVKDGDVLNFLFNV

SEQ ID NO: 58926 - protein, 363 aa, Salmonella enterica subsp. arizonae serovar 62:z4,z23:--
MSKNYHIAVLPGDGIGPEVMAQALKVMDAVRSRFDMRITTSRYDVGGIAIDNHGHPLPKATVEGCEQADAVLFGSVGGPKWENLPPESQPERGALLPLRKHFKLFSNLRPAKLYQGLEAFCPLRADIAANGFDILCVRELTGGIYFGQPKGREGSGQYEKAFDTEVYHRFEIERIARIAFESARKRRRKVTSIDKANVLQSSILWREIVNDVAKAYPDVELTHMYIDNATMQLIKDPSQFDVLLCSNLFGDILSDECAMITGSMGMLPSASLNEQGFGLYEPAGGSAPDIAGKNIANPIAQILSLALLLRYSLDADEAATAIEQAINRALEEGIATYDLARGAAAVSTDEMGDIIARYVAEGV

SEQ ID NO: 58927 - protein, 316 aa, Azoarcus sp. BH72
MPYGSLMVFTGNANPKLAADVARRLGISLGSVTVGRFSDGEVNVELLENVRGKDVFILQPTCAPTNENLMELLVLVDALKRASAGRITAAIPYFGYARQDRRPRSARVPITAKVVANMLQAVGVQRVLTMDLHADQIQGFFDIPVDNVYAAPVLLADLDKQKYDDLMVVSPDVGGVVRARAFAKRMECDLAIIDKRRPKANVSEVMNIIGEVDGRTCVIMDDIVDTAGTLCKAASALKEHGAKRVLAYCTHAVLSGAAVSRINDSELDELVVTDTIPLRDDAKASSRIRQVSVASLLADTVLRISNEESVSSLFME

SEQ ID NO: 58928 - protein, 323 aa, Zea mays
  misc_feature (21)..(21): Xaa can be any naturally occurring amino acid
  misc_feature (39)..(39): Xaa can be any naturally occurring amino acid
  misc_feature (201)..(201): Xaa can be any naturally occurring amino acid
  misc_feature (251)..(251): Xaa can be any naturally occurring amino acid
  misc_feature (253)..(253): Xaa can be any naturally occurring amino acid
  misc_feature (260)..(260): Xaa can be any naturally occurring amino acid
  misc_feature (264)..(264): Xaa can be any naturally occurring amino acid
  misc_feature (306)..(306): Xaa can be any naturally occurring amino acid
NPRSGPFPPRPSVRWNLPNLXGRTEVWIKRDDLSGMQLXGNKVRKLEFLMADAVAQGADCVITVGGIQSNHCRATAVAAKYLNLDCYLILRTSKLLVDKDPGLVGNLLVERLVGAHVDLVSKEEYGKIGSALADLLKKRLLEEGRKPYVIPVGGSNSLGTWGYIEAIREIEQQIQQSSDVQFDDIVVACGSGGTIAGLALXSRLSSLNTKVHAFSVCDDPEYFYDYVQSLIDGLNSGLDSHDIVSMENAKXLXYAMNTAXELKXVKDIAASTGIVLDPVYSGKAVYGLLKDMAGHPPKWKVEKSVXMDLEDSVPRKDGTGKMF

SEQ ID NO: 58929 - protein, 492 aa, Melia azedarach
TSGPGISALDKKKLGHIAQIIGPVLDVAFPPGKMPNIYNALVVKGRDTVGQPINVTCEVQQLLGNNRVRAVAMSATDGLTRGMEVIDMGAPLSVPVGGATLGRIFNVLGEPVDNLGPVDTRTTSPIHKPAPAFIQLDTKLSIFETGIKVVDLLAPYRRGGKIGLFGGAGVGKTVLIMELINNIAKAHGGVSVFGGVGERTREGNDLYMEMKESGVINEQNIAESKVALVYGQMNEPPGARMRVGLTALTMAEYFRDVNEQDVLLFIDNIFRFVQAGSEVSALLGRMPSAVGYQPTLSTEMGTLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFKLILSGELDGLPEQAFYLVGNIDEVTAKATNLEMESNLKK

SEQ ID NO: 58930 - protein, 350 aa, Bacillus cereus ATCC 10987
MKALLWHNQRDVRVEEVPEPTVKPGAVKIKVKWCGICGTDLHEYLAGPIFIPKEEHPLTHVKAPVILGHEFSGEVVEIGEGVTSHKVGDRVVVEPIYSCGKCEACKHGHYNVCEQLVFHGLGGEGGGFSEYTVVPEDMVHHIPDEMTYEQGALVEPAAVAVHAVRQSKLKEGEAVAVFGCGPIGLLVIQAAKAAGATPVIAVELSKERQELAKLAGADYVLNPATQDVLAEIRNLTNGLGVNVSFEVTGVEVVLRQAIESTSFEGQTVIVSVWEKDATITPNNLVLKEKEVVGILGYRHIFPAVIKLISSGQIQAEKLITKKITVDQVVEEGFEALVKDKTQVKILVSPK

SEQ ID NO: 58931 - protein, 355 aa, Prochlorococcus marinus str. AS9601
MALNYYKNELKENAQLLASKGKGILAVDESTKTVGKRLAGIGVENTEDNRKAYRGMLFTTQGLGKYISGAILFEETLYQNHQDGESMVKKLNDLGIIPGIKVDKGLNPLPGGGDVETFCSGLDGLVERAAKYYEQGARFAKWRAVLQITNDGCPSKLSIQENAWGLARYARSVQESGLVPIIEPEILMDGDHTIEKTAEVQEEVIKQVYIACQANGVFLEGTLLKPSMTVNGADCPTKADPMKVAEMTIRTMERCVPASVPGIVFLSGGLSEEAASVYLNNMNTLYRKALWNVSFSYGRALQHSCLKAWKGSDVEGGQKALIARAQANSEASKGAYVAGSQPSSDEQLFVAGYTY

SEQ ID NO: 58932 - protein, 435 aa, Ustilago maydis 521
MLSSGAGSSIRKKRNFKGLQLAESPLASPVDASATTPSHKPGEGSAASNASTIGKSSAVTPGGSLALPVKNGLDTEPNSGANYHNKLTQQLANLELGVEYKLDLKNEDLKTLSELGAGNGGTVTKVLHEKSGTVMAKKVVFIDAKPSVRKQILRELQILHECNSPYIVSFYGAYLNEPHICMCMEFMQKDSLDGIYKKYGPISPEICGKIAVAVSHGLTYLYDVHRIIHRDVKPSNILVNGAGQIKICDFGVSGELINSIADTFVGTSTYMSPERIQGDQYSVKSDVWSLGVSIIELALGRFPFAENEEDDDSDADNNYTNEDLAGTLSPTKPAPMISLGQNEKQRRRKSKPAGVSLEGSSHQMSILDLLQHIVNEPPPKLPEGRFPKHMEEFVNLCLLKDPAKRPTPKDLTKHQYVIDADAAKVDLQAWADGMK

SEQ ID NO: 58933 - protein, 293 aa, Mycobacterium smegmatis str. MC2 155
MSTPSIDRGFKADVLASALPWLKQLHGKIVVVKYGGNAMTDDVLKAAFAADMVFLRNCGIHPVVVHGGGPQISAMLKRLGIEGDFKGGFRVTTPEVLDVARMVLFGQVGRELVNLINAHGPYAVGVTGEDAQLFTAVRRNVTVDGVATDIGLVGDVEHVNAGSLLDLIAAGRIPVVSTIAPDADGVVHNINADTAAAALAEALGAEKLVMLTDVEGLYTDWPDRTSLVSEIDTGALTQLLPKLESGMVPKIEACLRAVNGGVPSAHVIDGRVEHCVLVELFTDEGTGTKVVAQ

SEQ ID NO: 58934 - protein, 316 aa, Ustilago maydis 521
MVEHSVAVHAGKDGNFRRQASAFRNTISKDGPHPPEKGRYILYCALICPWASRTLHTRALKQLEDIIDVAIVHYSLTPNGWSFSVTDSVETGDPVYGFENTKQLYLKADPSYTARYTVPILWDKKLGTIVNNESSEIIRILYTAFDDLLPDDSPAKGKTYYPTDNVEAIQKIDELNEWIYSDINNGVYKTGFATAQEVYDKEVDNLFLALDRLEKLLSDGREYLVPEVGLSDADIRLYPTLARFDTAYHNLFRCNVGMIRHDYPHIHRYLRRLYWNEKAFRDYTNFDHIKKGYSSVGGNKGIEPRGPLPHMLPLDA

SEQ ID NO: 58935 - protein, 249 aa, Xylella fastidiosa 9a5c
MRPKIVAGNWKLHGSHAFAQALVAQVAAGLPLLGVSVIILPPLLYLSDLAQRFKGEGLAFGAQNVSHHDKGAYTGEVSAAMVADVGAHYTLVGHSERREYHHEDSELVARKFAAALSAGLRPILCVGESLPQREAGQAEVAIAMQLAPVLALVGPQGVARGLIAYEPVWAIGTGRHADPSQVQAMHAFIRGEIARQDARIGDSLLILYGGGIKPCNAAELFSQQDVDGGLIGGASLVADDFLAIARATV

SEQ ID NO: 58936 - protein, 153 aa, Streptococcus pneumoniae
EHFIRGQYRSGKIDGMKYISYRSEPNVNPESTTETFTSGAFFVDSDRFRGVPFFFRTGKRLTEKGTHVNIVFKQMDSIFGEPLAPNILTIYIQPTEGFSLSLNGKQVGEEFNLAPNSLDYRTDATATGASPEPYEKLIYDVLSNNSTNFSHWD

SEQ ID NO: 58937 - protein, 501 aa, Saccharomyces cerevisiae YJM789
MSHRIAPSKERSSSFISILDDETRDTLKANAVMDGEVDVKKTKGKSSRYIPPWTTPYIIGIGGASGSGKTSVAAKIVSSINVPWTVLISLDNFYNPLGPEDRARAFKNEYDFDEPNAINLDLAYKCILNLKEGKRTNIPVYSFVHHNRVPDKNIVIYGASVVVIEGIYALYDRRLLDLMDLKIYVDADLDVCLARRLSRDIVSRGRDLDGCIQQWEKFVKPNAVKFVKPTMKNADAIIPSMSDNATAVNLIINHIKSKLELKSNEHLRELIKLGSSPSQDVLNRNMIHELPPTNQVLSLHTMLLNKNLNCADFVFYFDRLATILLSWALDDIPVAHTNIITPGEHTMKNVVACQFDQVTAVNIIRSGDCFMKSLRKTIPNITIGKLLIQSDSQTGEPQLHCEFLPPNIEKFGKVFLMEGQIISGAAMIMAIQVLLDHGIDLEKISVVVYLATEVGIRRILNAFDNKVNIFAGMIISREKLQNHQYKWALTRFLDSKYFGCD

SEQ ID NO: 58938 - protein, 616 aa, Ustilago maydis 521
MTRAESSVADRGRRESHIQRANWNGQLTRFLRSVRDGETQSILLALWPFTHNHECDPALSRDRTEDRQDRNDSRESHRLDQLAAFVLFRFSTSSTNPKLVILFFSFIVVVIESTSTSYNHVSALEGLASLQSTEATERLAVVVIAMLSRSIAQSGARAARSLALRSGSVRMVTPAVARRTLLTLSAQRSLALGAQNTLLSAQRGFSSSSSRKEIVKVPQMAESITEGTLKQWNKKVGDFVKADEEVATIETDKIDVSVNAPQSGTIVEVFASEEDTVEVGKDLFKLEPGEAPAEGASSGDKQPEKKEEKKDEDNKKDESKEQKQPEKKSDDKKPAPSADPQSRPSAASSSPPASKTTSSSASSSSSSPASASSSASKGGLGSREENRVKMSRMRLRIAERLKQSQNTAASLTTFNEIDMSNLMAFRARHKDRILKEKGVKLGFMSAFAKASALALKDVPAANASIEGAGLGDTIVYRDFVDLSVAVSTDKGLVTPVVRNLESMSLIEIEQAIAELGKKARDNKLTLEDMSGGTFTISNGGVFGSLFGTPILNLPGSAILGMHAVKDKAWVVNGKVEIRPIMVVALTYDHRLLDGREAVTFLVKLKQYIEDMPSMLL

SEQ ID NO: 58939 - protein, 137 aa, Gossypium barbadense
MAEEHRCQAPQLCANNCGFFGSPTTQNLCSECYRGLQLKEQQSSSAKQAFNHTLVPSSSSLPSSSSARSSFSASLPAKEEPSAGTKETKVVEEEEVQVTPNRCLSCKKRVGLTGFKCRCGMVFCGIHRYPGTTCLCF

SEQ ID NO: 58940 - protein, 520 aa, marine gamma proteobacterium HTCC2143
MSWREEVEELERRRKMARQQGGDESVQRHHQRGKLSIRERIDNFLDHHSFREQGKIAGGATLDDDSKAVSFSPANYVLGVGRVNNRFTAVGGEDFTLKGGSPNGAGLRRSIYAENLAVQHKIPLVRFLEGGGGSVGGTPPDPKQPRTVGTPVYQKNRMKIIGEALGLVPVASAALGPVAGFPAGRLVASHFSVMTKDTAQVMIAGPAVVERALNSPITKDELGGAHVHLRSGVVHNLAVDEYDAFRQIRQFLSYMPQNVGELTPRIPCSDPVDRQDERLLSVIPKDRTQTFEMRDVIHSIVDRGSFFEVSQQFGLGQITGYARINGQSVGVTGNDCRFFAGAMTADGAQKVRRFIEICDTFHLPIINLVDEPGFMIGPDSESQGTIMHGMSTVLAAVQSVVPWASVMVRKSYGVAGAAHYSDQGYVLTWPSVDAGALPIEGGVAVAFRRQIAEADDPEAFRKKMEDEFAKGRNPYISAESFAVHDLIDPRETRPYLCDWVELIQSQLPDLIGPVGFTYRP

SEQ ID NO: 58941 - protein, 366 aa, Crocosphaera watsonii WH 8501
MLNKSAILSILLIFIPLSLGSEYLEWGATLTFIMAALAIVPLAAFMGQATEEIAVVVGPNLGGLLNATFGNATELILALVALKEGLIGVVKATISGSIIGNLLLVVGFSMLLGGLRYKEQEFQSVAARLNASSMNLAVIAILLPTAVQYTSTGIEEQTLQNLSVAVAVVLILVYGLTLLFSMKTHAYLYDVGVAVEDETKKEEGGNINISKWVIILLLVTLGVAVESELLVNSLEAATSSLGLTPLFTGVILLPIVGNAAEHATAVTVALKNKMDLSMSVAVGSSLQIALFVAPVLVIAGWFLGQPMDLDFNPFELVAVAVAVLITNSISSDGRSNWLKGTLLLATYAGLSFGFLFPSSWEMDFKL

SEQ ID NO: 58942 - protein, 257 aa, Zea mays
MEAMPRPSVAPSLQLQARPCPRWPRRKHCPPSSVASRRVACSASAADADVVDLFDAAKLTVDKFVTSGMVVGLGSGPASALAIQYLGTRLRRGSLAGITAVTSSVLSASEAYKAGIRANSYHEGTQIDFAFTDAEAIEEGTLAAVIGRRKTESGEPSFMAEKAMAKSAHKLAFITGNDKYVTTGVEGSIPVLIKSVWRRPSFGTAGPLGGDHPLVTKEGHHVLDVIFTTPIQDLGQVAEKLDKVDGVVDHGIICSNQ

SEQ ID NO: 58943 - protein, 156 aa, Brassica napus
  misc_feature (81)..(81): Xaa can be any naturally occurring amino acid
MAQRTEKEETEFKVLETLTTTPTLCSNNCGVTANPATNNMCQKCFNASVAAAGVDSTSILKRSARSVNLRSTPAKVVIRPXREIDPVKRDQQTINRCSGCRKKVGLTGFRCRCGDLFCAEHRYSDRHDCSYDYKTAGREAIARENPVVKAAKMVKV

SEQ ID NO: 58944 - protein, 522 aa, Pseudomonas syringae pv. phaseolicola 1448A
MRWLNRHKFLPFLAWLPQQNRASVGRDALVGLSGAILALPQSIAYALIAGLPPEYGLYAAIVPVLIACLWGSSWHLICGPTAAISIVLYASVSPLAVPASQDYIMLILLLTFIAGVFQLLLGMMRFGALVNFVSHSVVLGFTLGAAIVIALGQMPNLLGIDLPSQTTALRSLTAVLEHRGEVDLPSLTLGLLTLALGIGLKLLVPRWPTLLIALVSSSLLVWLWPAMFGHVRVVRAFVGHLPPFSPLPLDLELILKLLPTAVAVGMLGLVNSLSIARSLSARSQQMLNANQEVRAQGLSNMVGSLFSGYLSAGSFTRAALSYEAGARSPLAGVFSALWVALFAVAGASLISHIPIPAMAASILLICWGLVDRRGIRALFRVSRAEFFVMALTCLATLLLELQTAIYAGVLASLFFYLKRTSQPCVQQWREGDEDVLRVGGSIFFGASHYLQTRLQRTEGLRVVIDAQQINFIDYSGVEMLHQEARRLGQQGRVLVMRNARPQVIEELHKLEGPQNCPILFED

SEQ ID NO: 58945 - protein, 398 aa, Physcomitrella patens subsp. patens
MGAGTRAASVGQELFLYAVSAAMSCLVLFVGLRHLDPNRAQIKKAQEQKKEIAKRLGRPLIQTNSYEDMIACDVINPEDIDVTFNSIGGLEYVKQSLHELVILPLQRPDLFAHGKLLRPQKGVLLFGPPGTGKTLLAKAIAKESRAVFINVRISNLMSKWFGDAQKLVTAVFTLAYKLQPSIIFIDEVDSFLGQRRVTEHEALTNMKTEFMALWDGFTTDQNARVMVLAATNRPWELDEAILRRLPRAFEVGMPDKTQRASILEVILKDELCESCVDIEQIASLTDGYSGSDLTELCKQAAYLPIRDLLDEEGSHADFHSEDKGPRPLRQTDFLSVLSNARTSKTAAYEYQHNRRSAVGGSPMRSSGGSSDEREDTSVTDLFKLLAAFGAASSAANNR

SEQ ID NO: 58946 - protein, 431 aa, Bacillus cereus ATCC 10987
MNKDISKDEHVPSQSTTVQSAHLALSGQTKGLKRLLPFLGPAFIASVAYIDPGNFATNIAAGSQYGYLLLWVILASNLMAVLIQTLSAKLGIATGRNLPEIARENFPKPVSIGLWIQGELVIMATDLAEFIGAALGLYLLFGIPMLPAALITAAGSFIILEFQRRGFRPLEAIITGMIFIVVIAFGVQVFYAKPELSPLLSGLFIPKFQGVDSILLAAGILGATVMPHAIYLHSALTQRRVVGTNDEQKKKIFRFEFIDIIIAMVIAGAINASMLIVAAALFFKNGLHVEDLDVAFNQFSTLVGPVSAALFGIGLLSAGLSSSSVGTMSGDIIMQGFIRMHIPLYLRRFITMIPPLVIIALGVNPTYALVMSQVVLSFGIAFALVPLIMFTSNKKIMGALVNHRITTLIAWIIAILVIILNIFLLYQTFVG

SEQ ID NO: 58947 - protein, 460 aa, Physcomitrella patens subsp. patens
NALEKEAWDLLREAVVTYCGEPVGTIAAKDPTDPNPLNYDQVFIRDFIPSAVAFLLKGETEIVRNFLLHTLQLQSWEKTVDCYSPGQGLMPASFKVRTVHIDGNEENGTEEILDPDFGEAAIGRVAPVDSGLWWIILLRAYGKCTGDKSVQERVDVQTGIKMILKVCLADGFDMFPTLLVTDGSCMIDRRMGIHGHPLEIQALFYHALRCAREILLPEEGAQDLIRQINSRLAALSFHIQEYYWLDIVKLNEIYRYKTEEYSTEAVNKFNIYPEQVSQWLLDWLPESGGYFIGNLQPAHMDFRWFTLGNMWSICGGLATPKQSENILRLVESKWQDLVATMPIKICFPALTDEEWRIITGADPKNTAWSYHNGGSWPTLLWQFTVACIKMNRADLAERAVEIAEKRLSRDRWPEYYDTKKGRFIGKQARLYQTWSIAGFLTAKLMLKNPNAASWLTCDED

SEQ ID NO: 58948 - protein, 384 aa, Picea sitchensis
MASSTAGEVITCKAGVVWEAGQPISIQQIQVAPPQSKEVRIKITHTSLCQTDIYFWKGKDGGAWFPRILGHEGAGIVESVGSEVTELKAGDHVIPSYMAECKECELCDRGKNNMCEVFIFNYLSGVAYTDKKCRFSLNGKPIHHFFGLSTFSEYTVVHMSCVAKVNREAPLDKICLLGCGVPAGLGAAWNGGKVKPGDSVAIFGLGTIGLAVAEGARIAGASRVLGIDINPAKEETSKRFGVTEFLNPSDFDKPIQEVIREMTKGGVNSSYECVGRVELMLAALQCSHPAWGRTIILGLDEMDKKLSFNPLEILQGRKLKYVAFGGFKNSDIPKLVDKYMNNEFDLDKYITQRMAFSDINAAMEMLVAGKCLRCVLQMDEDCPN

SEQ ID NO: 58949 - protein, 444 aa, Deinococcus radiodurans R1
MPNPNALPGAAHLSGAGAAQTGSPMKTRIAGKTILAIVLAGGRGSRLSPLTDERAKPAVPFLGTYRLIDFTLSNLVHSGINDVWVIEQYLPHGLNDHLSGGRPWDLDRTRGGLVVMPPFASAENEEGEFAQGNAHALAQHAHLIREFGADLVLVLSADHVYRLDYSDVIRQHVERGASVTMVTTELADEQQATRFGNVRAAKNGKVSEFAYKPDEPLGKTVTAEVFVYDAHIMLSTLEALSKEGELGDYGEELLPALVARGDAHAFPMHGYWMDVGTLDAYLQTHRDFLDGKGFALDDPQWPFITSSISRPPTRIEKTARLDEALVCGGAVIAGEVVRSLIAPNAVVEAGAVVRDSVVQPGAVIRAGAQVSRAVVDQDAEVGPGSRVGGQTGNSRPTVVGAHAHLGPGVQVGPGQVVAPRTRVKAGEEGQKVQELDADDKAGKK

SEQ ID NO: 58950 - protein, 651 aa, Pseudomonas syringae pv. phaseolicola 1448A
MIHLFRTKLVDSAAIMIRLQSLTLQRGPQRLLEDAELTLHAGHKAGLIGANGAGKSSLFALLRGELTPDAGDCLLPADWRIAHMRQEVDTLERLGVDYVLDGDERLREVQRLLAEAEAAQDGAAQARLHSELDSADGYTADARARKLLAGLGFTNEQMERQVGSFSGGWRMRLNLAQALMCPSDLLLLDEPTNHLDLDAILWLEDWLKSYPGTLLLISHDRDFLDAVVDHIAHVEQRKITLYRGGYSAFERARAERLAQQQQAYEKQQAQRAHMEKYIARFKAQATKARQAQSRIKALERMEELSAAHVDSPFNFVFRESDKISSPLLDLSDARLGYGDKTILEKVKLQLTPGARIGLLGPNGAGKSTLIKNLAGELEPQSGRLVRGENLTVGYFAQHQLDSLDAKATPLLHLQRLAPTEREQTLRDFLGGFDFRGARLDEPVLNFSGGEKARLALALIAWEKPNLLLLDEPTNHLDLEMRLALTMALQEFGGAVLVVSHDRHLLKSTTDDFLLVADGRVQEFDGDLDDYTRWLADYRLRNAPVSATPVNADKTDKKAQRQQAAALRQQLAPHKREADKLERDLGLVNEKLAKVEEALADSTNYEAANKDKLRDLLAEQAKLKVRESELEDAWMQALELLESMQAELEALS

SEQ ID NO: 58951 - protein, 488 aa, Azoarcus sp. BH72
MRLPGGRVGSALEKRREFYQMQDIPMFRLTFPRTLLFAAVLLGGAVQAASAPDANTFETTLPNGMKVIVKEDRRAPSAVHMVWYRSGSMDEPDGVSGVAHVLEHMMFKGTKKVGPGEFNKRVAELGGRDNAFTSKDYTAYFQQIPPSHLDAVMALEADRMRNLVITDAEFGREVEVVKEERRLRTDDQPRALVHEQLMATAFQAHPYRRPIIGWMSDLDGMTASDARAWYKRWYAPNNAYLVVVGDVSHEAVFRQAREHYGVIPARQLPPRRVPAEPEQRGTRHATVKAPAELPYLALAWHAPALRNPAADRDAYALQVLAAVLDGYDGARLTRRLVRDSRVAVSAGAGYDATGRGPALFYLDGVPAPGKTMDDLEAALRAEIQRIRDEGVGEDELARVKTQAVAAQVYKRDSLVGQAMEIGFLEASNLSWRDDERLLDGLRSVTAEEVRSVAQRYFGDDTLTAARLFPLPMDNNAPRPAAAPAALRH

SEQ ID NO: 58952 - protein, 483 aa, Brucella suis 1330
MLALKDPSLLKSQCLVNGRWIDAADGTTIKVTNPADGSVIGTVPSLSVATIKEAIDASAKALSGWAAKTAKERAGILRKWFDLIIANADDIALIMTSEQGKPLAEARGEVLYAASFIEWFAEEAKRVYGDTIPAPQNGQRLTVIRQPVGVTAAITPWNFPAAMITRKAAPALAAGCTMIVRPADLTPLTALALGVLAEKAGIPAGVLQIVTGKAREIGAELTSNDTVRKLSFTGSTEVGRLLMAQCAPTIKRISLELGGNAPFIVFDDADLDAAVDGAMVSKYRNAGQTCVCANRIYVQRGVYDKFAEKLAAKVKELKVGNGTEPGVVIGPMIEEKAITKVKAHIEDAVSKGAKLITGGKELGGLFFEPGILTGVTSDMLVAKEETFGPLAPLFAFDTEEEVIAQANDTIFGLAAYFYTENFSRAIRVSEALEYGMVGHNTGLISNEVAPFGGVKQSGLGREGSKYGIEEYLETKYICSAYKR

SEQ ID NO: 58953 - protein, 198 aa, Zea mays
KPPGAPFFFYWGGGKTFFFFSFWEKGGGGFPWGGGAPFPKFEEGERCFNLGSPDSGWVGGKLRNKVGLFPSVVRPEILYLGSYDNASRSELLRLRGISRIFNTVPSCQNLYKNSFTYHCLPDDKTLPFDEAIQFLEQCEKDKERVLVHCMSGKSRSPAIVIAYLMKSKGWRLVHSYQWVKERRPSVELTQGGTSSCRS

SEQ ID NO: 58954 - protein, 415 aa, Mycobacterium bovis
LSHLCSRGSKVGELAQDTRTSLKTSWYLLGPAFVAAIAYVDPGNVAANVSSGAQFGYLLLWVIVAANVMAALVQYLSAKLGLVTGRSLPEAIGKRMGRPARLAYWAQAEIVAMATDVAEVIGGAIALRIMFNLPLPIGGIITGVVSLLLLTIQDRRGQRLFERVITALLLVIAIGFTASFFVVTPPPNAVLGGLAPRFQGTESVLLAAAIMGATVMPHAVYLHSGLARDRHGHPDPGPQRRRLLRVTRWDVGLAMLIAGGVNAAMLLVAALNMRGRGDTASIEGAYHAVHDTLGATIAVLFAVGLLASGLASSSVGAYAGAMIMQGLLHWSVPMLVRRLITLGPALAILTLGFDPTRTLVLSQVVLSFGIPFAVLPLVKLTGSPAVMGGDTNHRATTWVGWVVAVMVSLLNVMLI

SEQ ID NO: 58955 - protein, 298 aa, Prochlorococcus marinus str. AS9601
MSKRHPVVAVTGSSGAGTSTVKRAFEHIFAREDIVPAVVEGDSYHRFERMPMKKAMAEALSKGENFSHFGPEANLFDKLEELFKIYGETGGGKKRYYLHSLEEAEEHNTRLGTSLEPGQFTPWEDIPEGTDVLFYEGLHGGVEGDGYNVASYADLLVGVVPITNLEWIQKIHRDNAERGYSAETIVDTILRRMPDYINHICPQFSKTDINFQRIPTIDTSNPFICRNIPTPDESFVIIHFRKGAREKWGIDFQYLLGMINDSFMSSPTSIVVNGGKMGFAMELILTPIIHKMIEEKNK

SEQ ID NO: 58956 - protein, 422 aa, Thermus thermophilus HB27
MLTFSFKPPGGAGKEGSVALVVQKYGGTSVGDLERIHKVAQRIAHYREKGHRLAVVVSAMGHTTDELIALAKRVNPRPPFRELDLLTTTGEQVSVALLSMQLWAMGIPAKGFVQHQIGITTDGRYGDARILEVNPARIREALEQGFVAVIAGFMGTTPEGEITTLGRGGSDTTAVAIAAALGAKECEIYTDTEGVYTTDPHLIPEARKLSVIGYDQMLEMAALGARVLHPRAVYYAKRYGVVLHVRSSFSYNPGTLVKEVAMEMDKAVTGVALDLDHAQIGLIGIPDQPGIAAKVFQALAERGIAVDMIIQGVPGHDPSRQQMAFTVKKDFAQEALEALEPVLAEIGGEAILRPDIAKVSIVGVGLASTPEVPAKMFQAVASTGANIEMIATSEVRISVIIPAEYAEAALRAVHQAFELDKA

SEQ ID NO: 58957 - protein, 357 aa, Prochlorococcus marinus str. AS9601
MKNYKIVLLSGDGIGPEISEVSKKVLKKLSKNHNFDIEIIEKLFGGIAYEKYGTPAPDETLDQCKKSDAVLLACVGDIKYDSLARELRPESGLLKLRSALNLFANIRPVKIRKSLLEASTLKKEIVENVDLIVVRELIGGIYFGKPRGHITNTKIPKAFNTMVYDLTEIERITEIAIKIANQRNKKICSVDKSNVLEVSQLWRDTVLNITSKDKNISLSNMYVDNAAMQLVRDPGQFDVILTSNLFGDILSDLAAMLTGSIGMLPSASLNNNGPGVFEPVHGSAPDIAGKNIANPIAMLLSASMMLKIGLNEEEAAENLETAIDKVLSKGFRTADLADGSTEVLSCSEIGDKIMYEI

SEQ ID NO: 58958 - protein, 391 aa, Thermus thermophilus HB27
MPLTGVARQGRWVLNLHEYQAKEILARYGVPVPPGKVAYTPEEAKRIAEEFGKRVVIKAQVHVGGRGKAGGVKLADTPQEAYEKAQAILGMNLKGLTVKKVLVAEAVDIAKEYYAGLILDRAKKRVVLMLSKEGGVDIEEVAAERPEAIHKFWIDPHKGFRPFEAREMVKRAGLEGNLNKLAQVLVALYRAYEGVDASIAEINPLVVTTDGGIVAADAKIVLDDNALFRHPDLAELREVEAEHPLEVEASNYGFAYVKLDGNIGIIGNGAGLVMYTLDLVNRVGGKPANFLDIGGGAKADVVYNALKVVLKDPDVKGVFINIFGGITRADEVAKGVIRALEEGLLTKPVVMRVAGTAEEEAKKLLEGKPIYMYPTSIEAAKVIVAMVGGAA

SEQ ID NO: 58959 - protein, 178 aa, Prochlorococcus marinus str. AS9601
MKEANSNDNYDAQTLLLNDSNGNELFCYLEQLVSVEGQEYALLTPVDTPVSLFKINEKDEPELIEKIDKNEQILKNAEAVLQEHDLRLIRSAVTLTVSGELEEPIYDELEEDYVDDDSESYELLVNFNLFDQEYGLYIPLDPFFIVGKLKDKGALLVEDDEFDKIQPLIETELEKSSS

SEQ ID NO: 58960 - protein, 315 aa, Phaseolus vulgaris
MSNFPVINFEKLNGEERKDIMEKIKDACENWGFFELVDHGIPHDLLDTVERLTKEHYEKCMEEKFKESMASKGLEAIQTEVKDMDWESTFHLRHLPESNISEVPDLVDEYRKVMKDFALRLEKLAEQLMDLLCENLGLEKGYLKKAFYGSRGPTLPTKVANYPPCPNPRVVKGLRAHTDAGGIILLFQDDKVSGLQLLKDDQWVDVPPMRHSIVVNIGDQLEVITNGKYKSVEHRVIAQTDGARMSIASFYNPGSDAVIYPAPELLEKEAEEKAQLYPKFVFEDYMKLYADLKFQAKEPRFEAFKESNFDPIATA

SEQ ID NO: 58961 - protein, 486 aa, Oryza sativa Japonica Group
MASPPPPPPSAAAPGSPPSAQVVGNAFVHQYYNILHQSPDLVHRFYQDGSRIGRPASPAAAEMDTVTTMEAINAKIVSMDIVRAEIKAVDAQESLGGGVTVLVTGHLTGSDDVRREFSQSFFLAPQEKGYFVLNDILRYVGGEGDQEVEPEPELELSFPPSQQPDSVPAPSANGTSVPREQEAFSQPEQHVADPAPNAQEADLNGEEVYNPPNNTEGPVVEETPIPEVIDEVPNNVAVAMPTPPAPAPAPVPQEEAPKKSYASIVKVMKEIPPQISAIPSRPAPPKQEKQVAPAPVAPVADAPTFSPNPESSNIQEAEVDAHAIYVRNLPLSATPEQLEEAFKKFGAIKPDGIQVRSHKIQGFCYGFVEFEDPSSVQSAIAGSPVTISDRQCYVEEKRTAGSRGGGRGRFAPGRGGNFRGEGMRGRGNYTGGRGYGRGEFNYRSDYGGRGAGRGGSSRGGDVGYQRVDHSAGRAARAPSGTSAVAK

SEQ ID NO: 58962 - protein, 709 aa, Vitis vinifera
MQLFSLSFFLFFFLLNPTPSLSLSSDGLSLLSLKSAVDDAASAFSDWNEDDPNPCRWTGISCMNVSGFSDPRVVGIAISGRNLRGYIPSELGNLFYLRRLNLHGNNFYGSIPVQLFNASSLHSIFLYGNNLSGTLPPAMCQLPRLQNVDFSNNSLSGSIPEGLKKCKQLQRLVVTRNQFSGEIPEGIWPEMENLVQLDLSSNEFNGSIPDDIGELKSLSGTLNLSHNHFTGKIPKSLGNLPETVSFDLRSNNLSGEIPQTGAFANQGPTAFLNNPDLCGFPLQKSCRNPSRSSPEGQSSSPESGTNARKGLSPGLIILISVADAAGVAFIGLIIVYIYWKNRDSQGCSCTGKEKLGSTGRSALCSCLSAHSFQNNDSEMESDKERGGKGAEGDLVAIDKGFSFELDELLRASAYVLGKSGLGIVYKVVLGNGVPVAVRRLGEGGEQRYKEFVAEVQAIGRVKHPNVVKLRAYYWAPDEKLLISDFISNGNLANALRGRSGQPSSSLSWSTRLKIAKGTARGLAYLHECSPRKFVHGDIKPSNILLDNEFQPYISDFGLNRLITITGNNPASSGGFIGGALPYLKSVQPERPNNYKAPEARVANSRPTQKWDVYSFGVVLLELLTGKSPELSSPTTSTSTEVPDLVKWVRKGFEEENPLSDMVDPLLLQEVQAKKEVLAVFHVALACTEGDPELRPRMKTLSENLERIGS

SEQ ID NO: 58963 - protein, 290 aa, Oryza sativa Japonica Group
MASKEEVAVETVEGGAAAAKAPYWDPPPAPLLDTSELGKWSLYRALIAEFMATLIFLYVSIATVIGYKNQRATVDACTGVGYLGVAWSFGATIFVLVYCTGGVSGGHINPAVTLGLFFGRKLSLVRTVLYVVAQCLGAIAGAGIVKGIMKRPYDALGGGANTVSDGYSAAGALGAEIVGTFILVYTVFSATDPKRTARDSFIPVLVPLPIGFAVFVVHLATIPITGTGINPARSLGAAVLYNQHAAWKDHWIFWVGPVIGAFLAAAYHKLVLRGEAAKALSSFRSTSVTA

SEQ ID NO: 58964 - protein, 112 aa, Zea mays
  misc_feature (77)..(77): Xaa can be any naturally occurring amino acid
HTRPEGAPEDLGKFLAPGGEVNMGDPEGGTPLNWVVDRGHLSVVGVLAKLNAALIAKATEGQTELHSAVVGERENIXKLLVKHHASFKIRDEVGTTEQDLCLPSCVLLNRPN

SEQ ID NO: 58965 - protein, 482 aa, Vitis vinifera
MFSIVSMPSTSSVLSAYTTFAASAMVVKTMLHELIPQPLQDKILSGIGRLLGDPSSQMTLVIDEYNGYAMNQIFEASEIYLQTRISPAVSRLRVSRAPREKDLLITINKGEKVIDVFEGIQLKWEMVSSTEKVMGGDKGERRSIELSFLKKYMEKVLSSYLPYVVERSESIKEENKVVKLYSLGNFQGGAMVGGGAWGSINLDHPSTFETLAMDLKLKEDLIKDLDRFVRRRKFYKRVGKAWKRGYLLYGPPGTGKTSLIAAMANYLKFDVYDLELTSLQRNSQLRKLLVSTKNRSILVIEDIDCSTELQDRQAGRYNQPTTQLTLSGLLNFIDGLWSSCGDERIIVFTTNHKDRIDPALLRPGRMDMHIHMSYCTPYGFKTLASNYLGVSNHRLFTEIERLITEVEVTPAEIAEELMKSEEADVALEGLIAFLKRAKSAENKSNCRGKKVDEQGIERQDVVQSGKVVEAKRQKDEWRTRGL

SEQ ID NO: 58966 - protein, 187 aa, Azoarcus sp. BH72
MSLINTQVQPFKAQAYKNGKFIEVTDADLKGKWSVLIFMPAAFTFNCPTEIEDAAEHYAEFEKAGAEVYIVTTDTHFSHKVWHETSPAVGKAKFALVGDPTHALTNAFDVHIAEEGLALRGTFIINPEGVIKTMEVHDNAIARDVTETVRKLKAAQYVASHPNEVCPAKWKEGEKTLAPSIDLVGKI

SEQ ID NO: 58967 - protein, 104 aa, Yarrowia lipolytica CLIB122
MAVTQITSVSDFQNAIKSDKLTVIDFYATWCGPCKMIAPTFDKFSETFTDAQFYRCDVDEASAVAQEVGVTAMPTFAFYKNGEKITTVMGANPSALNAAIKQNV

SEQ ID NO: 58968 - protein, 319 aa, Deinococcus radiodurans R1
MTVLPVPDLLARALDRRAGLPGAGTTFFRAVHITETGGLWTLDVAGDAGILSLYTDLSAEAERDLAAQCGEAAGLSSVYLKRRPPEAKHLANVAREVLSPPDPLWGTARPEVTALEEGVPFLIRPGADLSVGLFSDARPARRWVRGHAAGQRVLNTFAYTCGFGLNAALAGAASVKNVDLSRKVLGWGQQNYALSGLAAPDHDFLYGDVFEWLTRLQRRGDLFDLVILDPPGFARSKAGTWRAEKDYGRLMAQASAVTAPGGEVLALLNHAGVSAGGLTHMVEQGLSTAGRRGHLTETLGPGRDYPGATHLKVQRWSLN

SEQ ID NO: 58969 - protein, 598 aa, Leptospira interrogans serovar Lai str. 56601
MLDHNLLINLIVFLSAAVISVPLFKRIGLGSVVGYLVGGTIIGPWGIGLITDVDSILHLSEFGVVLLLFLIGLELKPQRLWILRRPVFGLGGLQVILTSLTFFILLSLLGLEKRQAIVISISISLSSTAFALQVLGEKNELNTTHGRSAFAILLFQDLAIIPIMATLSFLTESSSNPGSHGSIKEILFPIGTIIAVILAGRFLARPLFKLVASSANHEIFTALSLLIVIGVSILMNQVGLSMALGSFLGGVILADSEYRHELESNLEPFKGLFLGLFFLAVGMSINLGEVLKDPILVILLAFILILVKTIILYFIGIITKHSKEVSLNLSTIISQGGEFAFVILGVGVSLSILPKERADLVIAVVTLSMGLTPILGILKDKTSKWILKEDQNIKEDTIEEQNRVIVAGFGRFGQIIARMLFVHKIGFTALEHNPDQVNLARKFGYKIYYGDASKLSLLRSAGAEHADLFILAIQDIDVSVKIAELIKKNFPNLTIIARARNREHVFKLMELGIQIIRRDTFASALELAGETLSQLGFIDSEVEKKVKKFRAHDELTLKGQFQIRGDEKEFIQFSKNSMRQLEDAFEADRQEKEGKIAG

SEQ ID NO: 58970 - protein, 737 aa, Zea mays
MGVGGSFWDLLKPYTRHEGAGYLRGRRVAVDLSFWVVSHSTVDLSFWVVSHSTAPPPGRRKEHTGEKRPLEQIDAGEKNVVSTAVVKVQPKKVIQPKKSTQPAKQESSDDSSSESSSDDEPSKKPVAGSKKPPASSSSSDDSSDSDDSSSDEEPAKKPTVLSKKPTVLSKKPTVLSKKPVTAVSNGSKQVKPDSSSSDSSSDEDEKPAASLKKPVVASVQKKTQESDSSDSDSDEDESEDDIPAKAQVVAKKKEESSSSSDSDSDSESEDEKPAANLKKPPVPSVQKKTQESDSSDSDSDEDESDDIPAKAQVVAKKKEESGSSSDSDSEFESDDEDSNAKTVQPAKAAAIKKKEDSSESSETDSQSDSEDSEPEKPTVPAKRPLATNKKNEQSSEKSDDSSDESSDESDEEPPQKKTKNSAPSGAAKAATNVSKKKSSSDEDDESSEESSDDEDTEQVETKPKTPAKSQSQATGSKTIFVGNLAYSIEREQVKEFFEEAGEVVDVRLATFDDGSFKGFGHVEFATVEAAQKALEFVGHDLMGRPLRIDMATERGAYTPSSGKDNGSFKKFAPRSGNTVFIKGFDTSGGEDQIRTALEEHFGSCGDITRISIPKDYDTGVSKGMAYMDFKDPDSLNKAYELNGTDLGGYSLYVDEAKPRPDNSGGFSGDRGGGRGRSGGFSGGRGGRSDRGRGGSRGRGFGGRGGRGDRGRGGRGTPFRQTAGTASTGKKTTFGDDD

SEQ ID NO: 58971 - protein, 563 aa, Haemophilus influenzae Rd KW20
MRLKFQLFLMKGNTMKNINPTHTHAWKSLEAHKAELSNITIQDLFKQEKNRFDDYSLTFNNQILIDFSKNNINQTTLSHLRQLAQECALDSAKEAMFTGEKINRTENRAVLHTALRNRTNTPVLVDGKDVMPEVNAVLAKMKDFCQRIISGEWKGYTGKAITDVVNIGIGGSDLGPYMVTEALRPYKNHLNMHFVSNVDGTHIAETLKKVNPETTLFLVASKTFTTQETMTNAQSARDWLLKAAKDESAVAKHFAALSTNAKDVEKFGIDTNNMFEFWDWVGGRYSLWSAIGLSIALSIGFENFEALLNGAHEMDKHFLSTPIEQNIPTTLALVGLWNTNFLGAQTEAILPYDQYLHRFAAYFQQGNMESNGKYVDRDGNVIKNYQTGPIIWGEPGTNGQHAFYQLIHQGTTLIPCDFIAPAQRHNPLADHHNKLLSNFFAQTEALAFGKTKEEVEAEFVKAGKSLDDVKNIVPFKVFTGNKPTNSILVQKITPFTLGALIAMYEHKIFVQGVIFNIFSFDQWGVELGKQLANRILPELTDSEKVASHDSSTNGLINQFKAWR

SEQ ID NO: 58972 - protein, 342 aa, delta proteobacterium MLMS-1
MPRKNKLPMHPDFCDQEQCATEPCPGKEPDSGLGHRARLPEVVERIVATCQDRSCFEHVEAEPLPSRRRAIAILDSCREIIFPGYFGHQGIDRVNLEYRIGLEVSELFDRLATEIANAIRHECTRHGHTCQHCDEAGQEKALHFLQQLPQLRGMLASDVQAAYQGDPAAAGYDEIIFSYPGLHAITIYRIAHALLRLEVPVLPRIMTEHAHSITGIDIHPGASIDQAFFIDHGTGVVIGQTAVLGKRVKIYQGVTLGALAFRRDEQGGLQRDIKRHPTLEDDVTVYAGSTILGGETVIGARSVIGGNIWLTHSVPPDTKVVLNPPELVYKPQKNGQQPAGGK

SEQ ID NO: 58973 - protein, 463 aa, Bacillus cereus ATCC 10987
  misc_feature (244)..(244): Xaa can be any naturally occurring amino acid
  misc_feature (260)..(260): Xaa can be any naturally occurring amino acid
  misc_feature (276)..(276): Xaa can be any naturally occurring amino acid
MQHTNKSGTLNRGLKERHITLMSLGSAIGVGLFLGSASAIKLAGPSILLGYMIAGLVIFFIMRALGEMAIEQPVAGSFSKYAYDYLGPLAGYITGWNYWFLWVVTCMAEITAAGIYMQYWFPDIPRWTWALLALLLMSAFNFLSVKVFGELEFWFALIKIVTIICMIVVGAGIILFGFGNGGIATGISNLWSHGGWFPNGFSGLLLSMQMVLFAYLGVELIGVTAGEAQNPKKTLAKAIDNVFXRILLFYVGALFVMMAXYPWNELGEKGSPFVLXFQQIGIAKAAGIINFVVLTAALSSCNGGLFSTGRMLYTLAQQKKAPERFGRLNKNGIPSQGIVATAIVLLVGVILNYLVPAKVFTWLTSISTFGAIWTWGIILVAQIKFRKSLPTQNKQKLSYKMPLYPLSSYFSLAFLALVLCIMAYSEDTRIALIVGPIWLIGLAVVYYMKGFHKIDETPNSKIS

SEQ ID NO: 58974 - protein, 518 aa, delta proteobacterium MLMS-1
MDIHSEKILILDFGSQYTQLIARRVREAHVYCEIHPYDMDFAEVQAFAPQGIILSGGPWSVYDDGAPALDERLLELGVPVLGICYGMQVMARHFGGEVVDAGKREYGQAEITAQEGAGELFDGFFIEAKSPVWMSHGDHIARLPEGFTVAAATANAPVAAIQDDKRRLYGVQFHPEVNHTPRGEILLDTFIRKICRCHGHWTPGRIIDDAVARIKEQVGDDRVVLGLSGGVDSSVAAALIHRAIGEQLVCVFVDTGLLRLGEGDQVMATFAENMGVKVIRVDAEERFMGALAGVEDPEAKRRVIGNMFITIFEEAAGELANTHWLAQGTIYPDVIESAGGKTGKAQNIKSHHNVGGLPEQMQLKLLEPLRELFKDEVRAIGDELGLPRQMVWRHPFPGPGLGVRILGEVKKEYADILRQADAIYIDELFENGWYDKISQAFAVFLPVRSVGVMGDGRTYENVVALRAVETKDFMTATWSRLPYELLGKIAGRIINEVRGVNRVVYDISSKPPSTIEWE

SEQ ID NO: 58975 - protein, 187 aa, Triticum aestivum
  misc_feature (38)..(38): Xaa can be any naturally occurring amino acid
  misc_feature (72)..(72): Xaa can be any naturally occurring amino acid
  misc_feature (74)..(74): Xaa can be any naturally occurring amino acid
  misc_feature (91)..(91): Xaa can be any naturally occurring amino acid
  misc_feature (94)..(94): Xaa can be any naturally occurring amino acid
  misc_feature (108)..(108): Xaa can be any naturally occurring amino acid
  misc_feature (113)..(113): Xaa can be any naturally occurring amino acid
  misc_feature (117)..(117): Xaa can be any naturally occurring amino acid
  misc_feature (120)..(121): Xaa can be any naturally occurring amino acid
  misc_feature (126)..(126): Xaa can be any naturally occurring amino acid
  misc_feature (131)..(131): Xaa can be any naturally occurring amino acid
  misc_feature (133)..(133): Xaa can be any naturally occurring amino acid
  misc_feature (137)..(138): Xaa can be any naturally occurring amino acid
  misc_feature (141)..(142): Xaa can be any naturally occurring amino acid
  misc_feature (145)..(145): Xaa can be any naturally occurring amino acid
  misc_feature (147)..(147): Xaa can be any naturally occurring amino acid
  misc_feature (153)..(153): Xaa can be any naturally occurring amino acid
  misc_feature (158)..(158): Xaa can be any naturally occurring amino acid
  misc_feature (160)..(160): Xaa can be any naturally occurring amino acid
  misc_feature (163)..(163): Xaa can be any naturally occurring amino acid
  misc_feature (170)..(170): Xaa can be any naturally occurring amino acid
VTKVHARQIFDSRGNPTVEVEVTTAKGVFRAAVPSGAXTGIHEALELRDGDKSQYMGKGVTKAVNNVNSVIXPXLIESKIPVTEQKAIDDXLIXLDGTPNKGKLGANXILGVXFAVXKGXXGDKGXLFYVXFXDLVXXKKXXVFXVXVLNVMXGGFDXGXKFXMQEFMIXFSGAKRFKEVMKIGCEV

SEQ ID NO: 58976 - protein, 609 aa, Bacillus cereus ATCC 10987
MEHHTSVLSLMVVVAIAFFVPLLLQRFKLKALPVVVAEIIAGIFVGKSGFNIIEPDMWLQVLSTLGFIFLMFLSGLEIDFSIFKQKGKKNTTNEPNTFQAASIIFFFIFILSYALSLLFVWLGFVDNAMFMTLIISTISLGVVVPTLKENNLGKTAIGQIILLVAVIADLVTMILLAVFVGLNSESGQSMWLLLLLFGAGIVIYFVAKRFKNIPYLDSLKAGSVQIDTRAVFALILILVGLSESVGAENILGAFLAGVLVSLLSPNEDMVEKLDSIGYGFFIPIFFVMVGVNLEVWSIFKEPSSMLMIPILIVGLFISKLLPSLVLRKWYPRNIVLGSAILLTSTLSLVIAAAQIGEKLGIISPSLSASLILSAVITCIFAPILFKKMFPKVETPKPKVSIIGASRITLPLSLDLKREDYDVTLYMMRQNKINDQEAKSHDFPIVKLDDITIASLTEQTAFHADRVVVATSDDEQNLLLAEHAKELGVEHVIASVEDPLLQEKATQEHIAVFSTINSTRILLRALIDKPSLVRLITTANETVREVELRSNKYNGVALRRLPFLGDVLVIQIYRGNKALIPHGDTRLQHGDTLLVTGSKEHIDTLKNILE

SEQ ID NO: 58977 - protein, 576 aa, Chlamydomonas reinhardtii
MMLSNRTSGRPTVGSRSSSSARRPALFVPVKHVSRVAPLRAQNEDDEPSTFGKNIDSKGAGTSFTSPGWLTQLNMLWGGKSNVPVANAQPDDIKELLGGALFKALYKWMQESGPIYLLPTGPVSSFLVVSDPAAAKHVLRSTDNSQRNIYNKGLVAEVSEFLFGKGFAISGGDAWKARRRAVGPSLHKAYLEAMLDRVFGASSLFAADKLRKAAAEGTPVNMEALFSQLTLDIIGKSVFNYDFNSLTSDSPVIQAVYTALKETEQRATDLLPLWKVRGIGWLIPRQRKALEAVELIRKTTNDLIKQCKEMVDEEEMRAASAAAAAGTEYLNEADPSVLRFLIAAREEVDSTQLRDDLLSMLVAGHETTGSALTWTLYLLVNNPDKMAKAQAEVDAVLGSRLPPTMADYGQLRYVMRCVNESMRLYPHPPVLLRRALVEDELPGGFKVPVGQDVMISVYNIHHSPAVWDDPEAFIPERFGPLDGPVPNEQNTDFRYIPFSGGPRKCVGDQFALMEAVVALTVLLRQYDFQMVPNQQIGMTTGATIHTTNGLYMYVKERGAAASGSSGVAGGKQLAAA

SEQ ID NO: 58978 - protein, 332 aa, Burkholderia sp. 383
MNAIQIDRFGDPSVLRPVVIERPTPAPDEVLVRVTRVGLNFAETLQRAGLYPGPAPTLPAILGSETVGTVEAVGTNVQGFRIGERVAAALFGATSGTGGYAEYVTVRAPLIVAIPDAVSDDDAVAVMLQGLVARVLLRETPVAARSVAITAAAGGVGSMLIQLARLDGARTIVGLAGSMEKLSTVRALGADQAVSYRDEAWVDRLGAATGGTGPDVVFDSIGGTVARTLVSSLAPHGRFVGYGAASGHMLTVDESLMNALIFGCRSLSGFSLHAFLADHVVRQTLGELFGLLATGALKPLIGGSYAFDAIADAHATLESGGTTGKLVLHIDR

SEQ ID NO: 58979 - protein, 142 aa, Zea mays
MASEAVVVHTGGCHCRRLRWQVEAPASVVAWICNCSDCSMRANTHFIVPAAKFKLQAGADEFITTYTFGTHTAKHTFCKTCGITSFYTPRSNPDGVAITVACVDPGTLKHVEYRKFDGRNWEDFFRTSDIAGFSKDDAEAAE

SEQ ID NO: 58980 - protein, 188 aa, Streptococcus thermophilus LMG 18311
MILLVDNYDSFTYNLAQYLGTFTEVKVLRNDDEKLYEEAEKADGLVFSPGPGWPADAGKMEAMIKDFAGKKPMMGICLGHQAIAETFGGKLGLAKNVMHGKQSNITFETPSPIFKDIDNDVPIMRYHSIVVDQMPEGFDVTAITTDDQEIMAIQHKELPIYGLQYHPESIGSPDGLKMVENFVKIVAG

SEQ ID NO: 58981 - protein, 492 aa, Campylobacter lari RM2100
MSQKCILIITDGIGHNENKEFNAFFHAKKPTYDELFKNTPNVLIKTSGLAVGLPEGQMGNSEVGHMCIGSGRIIYQNLVKINKAIENNTLKDNKALKELLQKCNRVHIIGLYSDGGVHSMHTHFNALLKICKEENKEVFAHAISDGRDCSPISGLNFIKSLQEFCEKEKINLASLSGRFYAMDRDKRYDRIKLYYDALFAKAPKSDDFITYIQKSYDENITDEFLTPVINPSFDGIKAEDGVVFINFRNDRMRQLVASLTQENFDEFPRELLVKNAITMSLYDEKFNLSIMFEKEELNNTLASVIANANLSQLHTAETEKYAHVTFFFNGGKEELEVNETRVLIPSSKVKTYDEKPCMSAKEVANEVIKGIKGGIDFIVVNFANGDMVGHTGDFEAAIRAVESVDECLGEVIKVARENDYAFIITSDHGNCEAMKDENNNSLTNHTTFDVFAFVEAKGVEKLKEGMGLSNIAPSVLKILNLPIPKEMDEALF

SEQ ID NO: 58982 - protein, 279 aa, Yarrowia lipolytica CLIB122
MSNTRQPVVAISLKMYFDPAKTLQFVSALAGIEQPDAELEKHGITGPVQDSSSTVATAALNHVELVVMPDFLSIRECTRLKNRLDEPLFNVGAQDCWQADEGAFTGEVSPKHLAQLGVRYVEIGHAERRKQFGETNEWVINKSAACSRNSIIPWICIGEINKGDIEACGDEVWEQIKPVLDNCTGQLVFAYEPVWAIGAPKPAESDHIIGVVSYLRKKIDAEKETNNNDVRIVYGGSAGPGLVESLNGVVDGLFLGRFGHNPDNVKKVVEEVGAVASKR

SEQ ID NO: 58983 - protein, 247 aa, Campylobacter lari RM2100
MKFSGKNVLITGASKGIGAAIAKELASNGLKVWINYRSKPELADALKEEIEKNGGSAAVIKFDASVEEEFVNAIATIVESDGELSYLVNNAGITNDKLALRMSMDDFSSVINANLNSSFLGCREALKTMSKKRFGAVVNIASIVGEMGNAGQTNYSASKGGMIALTKSFAKEGAARNIRYNCITPGFIKSDMTEVLSDEIKQNYINNIPLKRFADASEVAQAVAFLLSDHSSYITGEILKVNGGLYM

SEQ ID NO: 58984 - protein, 182 aa, Physcomitrella patens subsp. patens
MAPANDAFSLQVTNDLMQKLAKENIVPKRPAKKAPAPKPSVKPSEAPLVSKQDLPLPFYPGFLSALPGISKEQGHQQTQKQIHDLGPIYKVVEESENLGEKLQKREKEELEKVKQLARELQDKQFRAPSYTIPCQAEKDRCLQCYRESAKSPLGCTEAVRIYKECAQRAQQSFAQRTATSQH

SEQ ID NO: 58985 - protein, 368 aa, Prochlorococcus marinus str. NATL1A
MSFSKKLKQLFTSTPPKNNWDGLIETYKTWLPVSNKTPIITLKEGATPLIEVNSISNRIGNGVKVFVKYDGLNPTGSFKDRGMTMAISKAKEAGCEAVICASTGNTSASAAAYASKGGMKSFVIIPDGYVAQGKLAQALVYGAEVLAIKGNFDKALDIVRELSNKYPITLVNSVNPYRLQGQKTAAFEIIENLGNAPDWLCIPMGNAGNISAYWMGFQEFFHAGKSKHLPRMMGFQASGSAPLVEGKSISNPETIATAIRIGNPVNREKALLAKESSNGRFSSVSDSEIINAYKILGREEGIFCEPASAASVAGLLKIKEDVPKNSTIVCVLTGNGLKDPDCAIKNNDSMFHTGVEPEISSITKIMGF

SEQ ID NO: 58986 - protein, 620 aa, Salmonella enterica subsp. arizonae serovar 62:z4,z23:--
MDSHTLMQALIYLGSAALIVPIAVRLGLGSVLGYLIAGCIIGPWGLRLVTDAESILHFAEIGVVLMLFVIGLELDPQRLWKLRASVFGGGALQMVICGGLIGFFCMFLGLRWQVAELIGMTLALSSTAIAMQAMNERNLTVSQVGRSAFAVLLFQDIAAIPLVAMIPLLAASGASTTLGAFALSALKVAGALALVVLLGRYVTRPALRFVARSGLREVFSAVALFLVFGFGLLLEEVGLSMAMGAFLAGVLLASSEYRHALESDIEPFKGLLLGLFFIGVGMSIDFGTLVDNPLRILLLLAGFLAIKIVMLWLIARPLGVPAKQRRWFAVLLGQGSEFAFVVFGAAQMADVLEPEWAKALTLAVALSMAATPIFLVLLTRMEKAATGEAREADEIDEEQPRVIVAGFGRFGQIAGRLLLSSGVKMVVLDHDPDHIETLRKFGMKVFYGDATRMDLLESAGAAKAEVLINAIDDPQTNLQLSELVKTHFPHLQIIARARDVDHYIRLRQAGVAMPERETFESALKSGRQALEALGLGRYEARERADLFRHFNTQMVEEMAKGENDPLSRAAAYKRTSAMLSEIITEDREHLSLIQRHGWQGTAEGKHTGDIADEPQVKPST

SEQ ID NO: 58987 - protein, 368 aa, Pseudomonas syringae pv. phaseolicola 1448A
MTTLNSTPRADGFHMPAEWAPQTQVWMVWPERPDNWRLGGKPAQAAHVAIAKAIARFEPVTVAVSAAQYDNARARLDVPNIRVVEMSSNDAWVRDSGPTFVINERGEVRGVNWEFNAWGGFDGGLYAPWNLDSQLGSKVLEIERCPRYVTKGFVLEGGSIHVDGEGTLITTEECLLNRNRNPHLTREQIEAILGDYLAVDKVVWLPDGLFNDETDGHVDNFCCYIRPGEVLLAWTDDPEDPNYSRCHAALGILENTLDAKGRAFIVHKMPIPGPLFATEEECAGVDQVHGSQERNPSVRLAGSYVNFLIVNGGIIAPSFDDPMDEKARELLQTLFPEHEVVMAPGRELLLGGGNIHCLTQQQPAPHKA

SEQ ID NO: 58988 - protein, 393 aa, delta proteobacterium MLMS-1
MSNEKPMDNLDPREMNFLIVDDVDNMRRSTRAMLKLLQYGKKFYEAGNGRDAWKLLQDEDCRIDFIVSDYFMPHMSGTELLNKVRAERATRDIPFLMITAEANMDIVAEAAEHDVDAYLTKPFVTATLEHKINELLNRLRHPDSQTQHLSKSRELEEKGDLAGALAEAKKAAEAGSHSSRPFRELGRLFAKKGDIAKAQSCFEKAIQRNRLDVTSYHALGQIAFKRNNTDKAISYFARAMEISPRHTDRALQFAKLLLKKNQTQEAEKVLKLVLRHKVNDIDFKEQVAEQALAGGLYTLAVKALREVVKADPERSYLNKKIGTALVQVGEYNEGTRLLETAAAKTPQDVELLLELARAYMAMRMPIRADKWAATVIRIDPENAEAREILKETT

SEQ ID NO: 58989 - protein, 372 aa, Archaeoglobus fulgidus DSM 4304
MLLMIPGPVQLHERIIRAMARQMIGHRTADFSAIMEFCVEKLREIFGTKGDICLISGSGTAGMEAAIASFSRVKKIATLENGKFGERLGDIAERYTQVERVKVPWGESFELDAVKEALDNGCEAVAFVHNETSTGILNPAKEIAKLAKEYDALVIMDAITSAGGDYVKMDEWGVDVAIVGSQKCLGAPPGLAAVAVSEKAWDYYNERCPYYLDLAAYRKKLKDMQTPYTPAVPLFFALAEALKIIDEEGLENRIQRHRILSAAVRKWAVEAGLELFPNLNKYSSYSNTVTAIKMPEGVSDSELRGTLKKEYGILVSGGQGELKGKIFRIGTMGNVGKFETVSTLAALEDVLMRKNAIKPALQYAQILLRDLQ

SEQ ID NO: 58990 - protein, 101 aa, Saccharomyces cerevisiae
MTMNGIPVKLLNEAQGHIVSLELTTGATYRGKLVESEDSMNVQLRDVIATEPQGAVTHMDQIFVRGSQIKFIVVPDLLKNAPLFKKNPSRPMPPIRGPKRR

SEQ ID NO: 58991 - protein, 452 aa, Shewanella sp. MR-7
MRNLLDFDFDSAHIWHPYTSMTRALPVFGVHSAQGCELELVDGRKLIDGTSSWWACVHGYGHPAILTAMERQLHQLSHVMFGGITHEPAIELCKKLLAMTCDPLTKVFLCDSGSIAVEVAIKMALQYWQGQDLPFAQKSQKQRILTVKKGYHGDTFAAMSVCDPEGGMHTMFGEAVTKQCFVDAPQTPFGEPLGQDDLAPMQRILREQHQKIAAVIIEPIMQGAGGMRFYSSEYLRGLRALCDEYNVLLILDEIATGFGRTGKLFAYEHADITPDILCLGKALTGGYISLAATLCTDNVARGISQSPAGVFMHGPTFMGNPLACAAACASLDLINQQEWPAQVAAIEQQMQRELADAIDIPSVKEVRVLGAVGVLEMHQAVNTAALQQQFVDLGVWVRPFANLIYIMPPYVISPSQLTQLTQAMKQVAATITPPLAAQAEALASESITISHG

SEQ ID NO: 58992 - protein, 524 aa, Nocardia farcinica IFM 10152
MAETQRPVLVVDFGAQYAQLIARRVREASVYSEVVPHTATVEEIAAKKPLAVILSGGPASVYAEGAPQLDPRLFDLNLPVFGICYGFQAMAQALGGTVAHTGTREYGRTELNIDGGVLHGGLPTIQPVWMSHGDAVTDAPEGFEVTGTTAGAPVAAFEDRARRLAGVQYHPEVLHSPHGQQVLSRFLHELAGIPASWTPSNIADVLVEQVRAQVGDGHAICGLSGGVDSAVAAALVQRAIGDRLTCVFVDHGLLRAGEREQVQQDFVASTGAKLVTVDAVDKFLGELKGVTDPEEKRKIIGREFIRSFEDAVRQIVDEQGAAEGKQPEVEFLVQGTLYPDVVESGGGTGTANIKSHHNVGGLPEDLEFELVEPLRLLFKDEVRAVGRELGLPEEIVARQPFPGPGLAIRIIGEVTADRLATLRQADAIAREELTAAGLDRQIWQCPVVLLADVRSVGVQGDGRTYGHPIVLRPVSSEDAMTADWTRLPYEVLERISTRITNEVAEVNRVVLDVTSKPPGTIEWE

SEQ ID NO: 58993 - protein, 271 aa, Archaeoglobus fulgidus DSM 4304
MKIIPCPSSPLLARRVAEAAGIEIGGAVFKKFPDGELYVRVMEKEGVVVGSINSNEDLIALIFALDVLENAKAVVPYMGYARQDKVFQEGEAVSIKIVAEMLESRADEVVTVNIHSSDAASHFSKLKNLDAMPLVGEYFAGKDVVMISPDKGSMERVKTAAKHAGCEWDYMEKRRIDATTVEITPKTIDVEGRDVVIVDDIISTGGTVAEAARILYGLGAKSVSAACVHAVLAENAAIKLFNAGIKDIIATDTVECAFSRISVAELIAENI

SEQ ID NO: 58994 - protein, 553 aa, Thermus thermophilus HB27
MTALLLPLAYLVGALPLGYWLARRRGVDLRTASPYTLGLESALRRLGLGLLLLSFLLDFLKGYLPLLLGRALGLDLAGLLALGVAVYLGHLYPLFFRDPWPLRAKGAGVLLGILSGLPLPPALGLVPVALGLVLYALTGYASLAALGLPLGLLGATLFGGFGLAERLSALALFLLALWRYKENLGRVLEGTEPKLGDPLPLPSEKQVVCAFLIHPLTVEDFWQSPRFRWLRPLVRLGLLKQEWIERLAERFRPMKVGEVRGVRTADGREVLCHLISAPLLPHQIKAKPELAVRRAIQGARLAKELGATVVGLGAFWSVVGEKGKRVQEAVPGIEVTNGGAYTAGTVRAAIPKILAHFAQSGKDLKGATAAVVGANGVVAFGIARQIAPLVGRLILVGRDLERLKRAAESLRKNLERKGEVPEILATTEIAAIREADLVFTATSDPNPVIYPEHVKPGAWIYDEGVPPDVHPSVREVPGVRVIPGGVVRLPGEARATLDLHFGAPDQVPACLAETMILAAEEAFDRKSLGGEVRAENIQFFVERAEALGFRVVE

SEQ ID NO: 58995 - protein, 471 aa, Bacillus cereus ATCC 10987
MNQQVEQTDLKRTMKSRHLFMIALGGVIGTGLFMGSGQIVHNAGPGGAILAFLVGGFVMYLTMLCLGELSVAMPEAGSFQSYASKFISPGFGFVVGWMYWLNWAVTVGVELTTVSILMKRWFPDVSSWIWCVTFAAALFLVNALSAKAYAEAEFWFASVKVATIVIFIVLGGAVMFGLLDFNGKPAPMLHNFTENGGLFPNGALAVLLTMITVNYSFQGTELIGIASGESENPEKTIPKAIKNTIWRTLFFFVLAISVVVGLLPWQEANLVESPFVLVFDVAGIPYAADIMNFVIITAVLSVANSGLYANSRMLWAMAKQGMASPAFTKLTKKGVPLNALIFSLIFASLSLLTSIFAADTVFLVLTSIAAMAAVVVWMSIAASQFFFRRNFVKNGGDINDLKYRTPLYPLVPIVAFSLNFITFVSLAFIPDQRIALYCGIPFMVICYILYQVKYKKIVTFEQQISLKKEVN

SEQ ID NO: 58996 - protein, 517 aa, Glycine max
MAEVAPPKKENPNLLLGRFELGKLLGHGTFAKVHHARNIKTGEGVAIKIINKEKILKGGLVSHIKREISILRRVRHPNIVQLFEVMATKTKIYFVMEYVRGGELFNKVAKGRLKEEVARNYFQQLVSAVEFCHARGVFHRDLKPENLLLDEDGNLKVSDFGLSAVSDQIRQDGLFHTFCGTPAYVAPEVLSRKGYDGAKVDIWSCGVVLFVLMAGYLPFNDRNVMAMYKKIYKGEFRCPRWFSSELTRLLSRLLDTNPQTRISIPEVMENRWFKKGFKQIKFYVEDDRVCSFDEKLLLHHDDDLATSDSEVEIRRKNSNGSLPRPASLNAFDIISFSQGFDLSGLFEEKGDEARFVSSAPVSKIISKLEEVAQLVSFSVRKKDCRVSLEGCREGVKGPLTIAAEVFELTPSLVVVEVKKKGGDKAEYEKFCNSELRPALENLGMEESASSSSSCHQSTHTQSEFQQHRTLSDSALNRHSDNECLFERELGLADETSISQHGESKFECQQENMAMFTI

SEQ ID NO: 58997 - protein, 191 aa, Triticum aestivum
  misc_feature (35)..(35): Xaa can be any naturally occurring amino acid
  misc_feature (41)..(41): Xaa can be any naturally occurring amino acid
  misc_feature (123)..(123): Xaa can be any naturally occurring amino acid
  misc_feature (174)..(174): Xaa can be any naturally occurring amino acid
MVQKQVADLQPGQLINDEGQVGRQTLTRRASYPCXENYERXNRRALAKRSTDTLGTSVLVDGSSVSSLSSDNPVEESSFRQLQDAVSSLDVRGGLCIRHGLYRSARSAHHKPVYPNAMNRHEXSRDVQDAQNMETSGKCVDHRSIETHTNPIDRSIALLLNHQSSHQVSGAVDXSSPLKSHNENHKAYATN

SEQ ID NO: 58998 - protein, 802 aa, Candida albicans SC5314
MIDLEGSDSDSSSLSIHENILFPSLGNSKNNKTRNTQKSSRDDVNSLETNSDSVNHLRSTFIARDRQLPSSTNDDYALEEVDLSDVSPLASRQHVVSPFSTTSISDTVSLDSSILNKIASNIGGNTDGIDQTGKFKYLRLYEKWKKIKIKTQDQKLTKPGQDIPLQTMSSRASSVFNLSQLDDFTRYVKETSLNDRIFHDLQERLPQRNQGGQSGRQDENFQNYLDLDLDVVDEKDLADKFYPTQEDEEKETDRNKRRLFPKRSKKKSLGMSAESRTATNDFLDSYQSSSSDVVSDDPRFLQRKLSVRHLQMISFGGTIGVGLFLNSGKAIAMAGGFGASLAFTIVGTLVLCTIMSFCEMVTFVSVIDGVSGLSSRFIDDAFGFAAGWLYFLSFSTGVAGEVVAGVIMLSYYPHLNTATNTGSTAGFVTLFLALILGSNLVHIQFFGELEYISSLVKMIWAIIMMIVMVVLNRGGFPNTPVMGFKYWQYSKSDFANNIIFGLFRPAFNLHDDGTSSPSEGIGGDKGRFMSLLTAILVVCYAYSGTEIVCIAACEAKNPRKALPSATRRVFWRIIIFYVLSAFLVSLNVYAGDPRLLRYYSGSTGISPSEFATNPAVIQAGGEHCSIDYKVVAGYGSGAQSPWIVALQSSSLCQFSSITNGFLVFFAVSCGNAQLYVSSRTAYSLALQGKAPKFLTYCNRFGIPYNAVLFAGSFGLLAFACVNESATVVFQNLTSLIASSGIFVWFTMCLTFIRFYYGLKRRPDILDRNDKSYPYKSPFQPYSAIVGCIGTLFILFLWGLWCF

SEQ ID NO: 58999 - protein, 212 aa, Triticum aestivum
MEGLSWTRACVLVLCIMPFLHQAAAIRFVIDREECFSHNVEYEGDTVHVSFVVIKADTPWHYSEDGVDLVVKDSNGAQVRDSRDKTSDKFEFIVQKRGVHRFCFTNKSPYHETIDFDVHVGHYSYFDQHAKDEHFSPLFEQIAKLDEALYNIQFEQHWLEAQTDRQAILNENMSRRAIHKALFESAALIAASVIQVYLLRRLFERKLGTSRV

SEQ ID NO: 59000 - protein, 396 aa, Saccharomyces cerevisiae YJM789
MTVYTASVTAPVNIATLKYWGKRDTKLNLPTNSSISVTLSQDDLRTLTSAATAPEFERDTLWLNGEPHSIDNERTQNCLRDLRQLRKEMESKDASLPTLSQWKLHIVSENNFPTAAGLASSAAGFAALVSAIAKLYQLPQSTSEISRIARKGSGSACRSLFGGYVAWEMGKAEDGHDSMAVQIADSSNWPQMKACVLVVSDIKKDVSSTQGMQLTVATSELFKERIEHVVPKRFEVMRKAIVEKDFATFAKETMMDSNSFHATCLDSFPPIFYMNDTSKRIISWCHTINQFYGETIVAYTFDAGPNAVLYYLAENESKLFAFIYKLFGSVPGWDKKFTAEQLEAFNHQFESSNFTARELDLELQKGVARVILTQVGSGPQETNESLIDAKTGLPKK

SEQ ID NO: 59001 - protein, 185 aa, Glycine max
MSSPSKRREMDVMKLMMSDYTVETINDGLNEFNVEFHGPKESLYEGGVWKIRVELPDAYPYKSPSIGFVNKIFHPNVDELSGSVCLDVINQSWSPMFDLLNVFEAFLPQLLLYPNASDPLNGDAASLMMKDKELYDQKVKEYCERYAKKENICNSTAGEESGDEEDISEEESASSDDEIPGRADP

SEQ ID NO: 59002 - protein, 492 aa, Vitis vinifera
MPSTASVLSTYTTFAASAMLVRTVVSEVETMANQLIPQQLREKIVSKLGGLLGSHSSEMVLVIQEFNGLSVNQIYQASELYLRTKITPSVGRLNVSKGLREKNLSVTVSKGEMVVDVFEGIELRWQLICAETQKPSFDYDSGSMATEKSEQRSIELIFHKKYKEVVLSTYLPYVIERSRAIKEENKVVKLCSLGNFSEDYDGPWGSINLSHPCTFDTLAMDPTLKKELIADLDRFVRRREFYQKVGKAWKRGYLLYGPPGTGKSSLIAAMANYLKFNIYDLELTSLWNNSDLRRLLVSTANRSILVIEDIDCSVELQNRQNGSDNNTDSQLTLSGLLNFIDGLWSSCGDERIIVFTTNHKERLDPALLRPGRMDMHIHMSYCTPSGFKILAANYLNINTHPLFTKIERLMTEVEVTPAEIAEELLKCEEVDVALEGIIKFLERKKMQVEHDEKSNEGVKEVDEQEVSNGIKGDKMGVKRNKMKKTRRAKGRH

SEQ ID NO: 59003 - protein, 393 aa, Saccharomyces cerevisiae YJM789
MGLILRWKEKKQLSSKQNAQKSRKPANTSFRQQRLKAWQPILSPQSVLPLLILMACVFAPIGIGLVVSTISVQRLVVNYTECDALAPAKHFETIPSEYVDYHFSKKVAVQPQWMVFTDPELGNQTCRIQFEVPNHIKKSTYVYYRLTNFNQNYREYVQSLDLDQLKGKALIGNDLDPNCDPLRTVENKTIFPCGLIANSMFNDTFGTTLTGVNDTADYLLTTKGIAWDTDSHRYGKTEYNASDIVPPPNWAKLFPNGYTDDNIPDLQNWEQFKIWMRTAALPNFYKLAMKNETNGLGKGIYIADIELNYPVRSFYGTKSFVLTTNSIIGAGNEALGIVYLIVAGIATLFAILFLIKVIFKPRPMHDHSYLNFENSDTPFDESSVVSIPLREIL

SEQ ID NO: 59004 - protein, 399 aa, Bacillus cereus G9241
MDTLIFEVGTALVLVAIAAVIAGKFKFSVIPFLIVLGMLVGPHAPTIGVIDFKFIESASVISFLGRIGVLFLLFYLGLEFSMKKLIKSGRSIAIGGTIYILINFSLGLLYGFIMGFPLLEILIIAGIITISSSAIVAKVLVDLRRTGNNETELILGIIMFEDIFLAVYLSVVSGLVLGDHASFLGALTSIGIALGYMLLFFIVARKATPLLNKLLNISSDEIFIIVVFASLFFIAGFSETIHVAEAIGALLLGLVFSETEHSDRIEHLVVPFRDFFGAIFFFSFGLSIDPFSLGGAIWLTLGAVLLTIIGNFVAGMIAGRQAGLSHKASTNIGLTIVSRGEFSIIMANIGIAGGLMSVLKPFSALYVLILSILGPLLTKESKNVYKFLNKIFKWDTKTN

SEQ ID NO: 59005 - protein, 499 aa, Glycine max
MDYLLLLPLIITIVWINIHVFISSFKPLKSSKNPPGPRPFPIIGNILELGNQPHQALAKLSQIYGPIMSLKLGKTTTIVISSPQVAKEVLQKHDQIFANRMVPDCVRALDHHILSVAWMPPLPQWRALRRACATKVFSSQQLNFTQVLRQRKMQDLMDYVKERCERGEAMDIGEASFTTVLNSISNTFFSMDLAYYTSDKSQEFKDIIWGIMEEAGRPNVVDFFPIFRLLDPQGARRRMSGYFRKLIAFFDGLVEERLRLRALENGSRECNDVLDSLLELMLEDNSQVTRPHVLHLFLDLFVAGIDTTSSTIEWVMAELLRNPEKLEKVRQELQQVLAKGEQLEESHISNLPYLQAVVKETFRLHPPTPMLLPHKSEVDIELCGFMVPKSAQILVNLWATGRDSSIWTNPDEFTPERFLESDIDFKGHDFELIPFGAGRRICPGLPLASRTLHVVLASLLYNYDWKLTDGQKPEDMDVSEKYGITLHKAQPLLVIPIQA

SEQ ID NO: 59006 - protein, 137 aa, Triticum aestivum
  misc_feature (71)..(71): Xaa can be any naturally occurring amino acid
  misc_feature (89)..(89): Xaa can be any naturally occurring amino acid
  misc_feature (93)..(94): Xaa can be any naturally occurring amino acid
MAPAVMASSATTVAPFQGLKSTAGLPVSRRSSGSLGRVSNGGRIRCMQVWPIEGIKKFETLSYLPPLSTEXLLKQVNYLIRSKWVACLXFNKXXFVFRWQKNSPRVTKNGILGQCWKLPNSGWQNNRLVKRWGRKVP

SEQ ID NO: 59007 - protein, 655 aa, Azoarcus sp. BH72
MLNTLDLVLLLLAAAVVLVAVLRSVNLPPVLGYLLVGAMVGPHAFNLVPDSAGARHLAEFGVVFLMFSIGLEFSLPRLLAMKNIVFGLGAAQVVGSIALTLVLGRLGGLGWAAAFALGGTIAMSSTAILSKLLADRLELDSRHGREIIGVLLFQDLAVVPLLILLPALSRPAEELAVTLGLAGIKAVVLLALVLVFGPRLMRWWFTLVARRRSGELFMLNVLFITLGLAWLSELVGLSLALGAFLAGMLISETEYRYQVEEDIKPFRDVLLGLFFVTVGMFLDVETIVWHLPAVIGLVVALLAAKFLIVFAASRAFRSPPGTAMRSGLWLCAGGEFGFVLLSEIVGLRLMPAGLVQVTVAALVLSMLVAPLIVQVSDKLVMRFVASEWLLRSMELTRVAAQSLNTDKHIIVCGYGRSGQYMARFLEQENLSYVALDLDPERVREAGAAGDTVVYGDAARRETLMAAGIMRASALVISFAEVEAALRVMHHAHALRPGLPIVVRAVDEADMEKLSLGGAAEVVPEAFEGSIMLASHALALIGVPLSRVVKRIRDIRNQRYALMRGFFHGATDIGEVAENSQARLHSVTVPDAAPAVGRTIGELALEEFGVGVSAVRRRGIRGLSPGPETRIVAGDVLVLLGLPQGLEQAEERVLKG

SEQ ID NO: 59008 - protein, 540 aa, Lactococcus lactis
MRAHEILNNPFLNKGTAFTMKERQELGLIGLLPPTVQTIEEQAVQTYEQYLTKPSDLEKRHFLMEIFNTNRTLFYYLFNKHIVEFNPVVYDPTIADTIENYSHLFVDPQYAAYLDINHPENITETLKSAAGDREIRLIVVTDAEGILGIGDWGTQGVDISVGKLMIYTAAAGIDPASVLPVVIDAGTNRKELLEDHLYLGNHQERIYGDQYYSFVDQFVETAESIFPKLYLHWEDFGRSNAATILNNYKTKIPTFNDDIQGTGIVVLGGIFGSLDITGEKLTDQVYLCYGGGSAGAGIAGRVHAEMVSEGLSEEEAYKHFFMIDQQGLLFDDMEDLTPAQKPFAKKRADYKDAGDMTDLLNVVKTVKPTILVGTSTNPGAFTKEVVEAMCANTERPVIFPISNPTKKMETTAEQVIEWSDGKAFVATGVPSGTISYKGVDYQIGQANNSLIHPGLGLGMLASEAKLLTDEMIGAAAHSLSGLVDPGKPGAPVLPPFEFVADVSIKVAEAVAKKAQEQGLTESKETDMAKAVRDLKWYPEY

SEQ ID NO: 59009 - protein, 164 aa, Arabidopsis thaliana
  misc_feature (120)..(120): Xaa can be any naturally occurring amino acid
MAWLSVLLHNTMFDTGSRIELVDHVSASYRWCAGILYWVTFLARDLASSDPEPRLYQAKVRLCGPTFCQIYIFRLRPTDEEIAAVQVDPPPPLYDDDPGGSFYSSLGFSMVTFFEVLFSXLYYLVLAELPTILFTVTGPGSGYMSIPEVFFTRIPAEVEPVSSP

SEQ ID NO: 59010 - protein, 316 aa, Oryza sativa Japonica Group
QLLLGYLPTDHALWAYELEKKRSQYSAFKDELLVNPSEVTRRMEEMTISKGNRHNSEGTGVLPRAEIVHDEHPLSLGKTSVWNQFFQESETIEQIDRDVKRTHPEMQFFNGDSSDALSNQESLKRILTIFAKLNPGIRYVQGMNEVLAPLYYVFKNDPEENNAESAEPDAFFCFVELLSGFRDNFCKQLDNSVVGIRSTISKLSQLLKRHDEELWRHLEVVTKVNPQFYAFRWITLLLTQEFKFRDCIHIWDALLGDPEGPQATLLRICCAMLILVRRRLLAGDFTANLKLLQSYPPTNIDHLLHIANKLRGPIPY

SEQ ID NO: 59011 - protein, 128 aa, Glycine max
MSAALGKCSRIRHIVRLRQMLRRWRSKARTSAHRIPSDVPAGHVAVCVGNNSKRFVVRTTYLNHPVFKRLLVEAEEEYGFSNHGPLAIPCDEAIFEQLLRFVSHSDDCHVPLRNNLDFYLESRPLLLH

SEQ ID NO: 59012 - protein, 139 aa, Bacillus cereus ATCC 10987
MTRVRDLMSTHIVQCTPLDNVYEAAVKMKEESIGLIPVVENEQVVGLVTDRDLVVRGIAEKHPGSNKITNVMTTNIVSVSPDDPIEKATELMAQYQIRRLPVVESGQLVGMLALGDLAIKESADDQAGFALSEISEHTE

SEQ ID NO: 59013 - protein, 175 aa, Oryza sativa Japonica Group
SCLVQILLVKLLPWKHYMHILYVFSEGKMNIERLKQLVDLVGKHRLVLDLSCRKKDGRYAIVTDRWQKFSDVFVDEPTLKHLAAYADEFLVHGVDVEGKRLGIDEELVELLGRYSPIPVTYAGGVSTMDDLERIKRAGNSRVDVTVGSALDIFGGDLPYKDVVLWHKEQNMVSQP

SEQ ID NO: 59014 - protein, 444 aa, Saccharomyces cerevisiae YJM789
MQSMNVQPRVLAVGGEQFFSQRQASEQHQQQNMGPQVYSPQVNRARMFPQGMPVNTINGSVNQEMNNAYLLKQKNEPLLTQQQQQQQQQQQQQQQQQQQQQQPFNIGTPVSVASLPPGLNVLQQQQQQQQQQQQQQQGVGLNRPLASQLPKHLTNQSMPPIFLPPPNYLFVRDVWKSNLYSEFAVIRQLVSQYNHVSISTEFVGTLARPIGTFRSKVDYHYQTMRANVDFLNPIQLGLSLSDANGNKPDNGPSTWQFNFEFDPKKEIMSTESLELLRKSGINFEKHENLGIDVFEFSQLLMDSGLMMDDSVTWITYHAAYDLGFLINILMNDSMPNNKEDFEWWVHQYMPNFYDLNLVYKIIQEFKNPQLQQSSQQQQQQQYSLTTLADELGLPRFSIFTTTGGQSLLMLLSFCQLSKLSMHKFPNGTDFAKYQGVIYGIDGDQ

SEQ ID NO: 59015 - protein, 202 aa, Magnetospirillum magnetotacticum MS-1
MASAADHASFLPPVLTFLSAAVIGVPLVRLLGQSAVLGYLVAGVVIGPAGFSLIAEPETAASVAEIGVVLLLFIVGLELEISRLVSMRRDIFGLGTAQLALCALVIAGAAFAYGLTPAAAGVVGIAIALSATAVALQLLEERGDLGSAYGGRSFAVLLFQDISVVAILAAVALLASGGATRKKGGRRRPPSPARAGWRDPRG

SEQ ID NO: 59016 - protein, 579 aa, Photobacterium profundum SS9
MFIKWRDTMTVGKYLRWKDEAGNDFRPVALTGTELLNDRNLNKSTAFSYEEREAFQLVGLLPPKVQTFDDQLNRVYDGFRNASTDIEKYLFLRALQDRNETLFYALLSRHVEEMTPIIYTPTVGKACQEFSHRYQKARGLYITEDSVDQMGDMARHFTGKDIKIIVVTDSQGILGLGDQGVGGMGIPIGKLSLYTLGAGIHPAHCLPIALDVGTDNQDLLDDPMYLGMPRKRMRGEEYKIFIRKFVKQIQQHFPKAVLQWEDFSKSNAFDNLSDYEDDLPSFNDDIQGTGAVVLAGILGAVKIKEEKLADQTYVVYGAGAGGVGVADQIYAGLLKEGCSHSAAREKIFVLDSQGLVFDDREGLDEYKKRYAKPRELANNWQTKELGKVSLTELIDNHRVTVLLGTSGIGGAFKAEHVQKMMEYTKRPMVFPLSNPTANCEALPEDVYQWSDGQVIVATGSPFSDVNYNGREYRIGQGNNVFIFPGVGLASIVSGTPKITLDMFTMASYALADCISDDDLAAGCVFPRISKLKEVSMVVATRILENMQTTEPNSPLRGKNIQQELAMHMWEPAYLPYRRV

SEQ ID NO: 59017 - protein, 427 aa, Oryza sativa Japonica Group
REEYARLGSVFTVPILSRKITFLIGPEVSAHFFKGNEAEMSQQEVYKFNVPTFGPGVVFDVDYSVRQEQFRFFTEALRANKLRSYVDQMVVEAEEYFSKWGESGTVDLKYELEHLIILTASRCLLGREVREKLFDDVSSLFHDLDNGMQPVSVIFPYLPIPAHRRRDRARQRLKEIFATIIKSRKASGRAEEDMLQCFIDSKYKSGRSTTEGEITGLLIAALFAGQHTSSITSTWTGAYMLRFKQYFAAAEEEQKEVMKRHGDKIDHDILAEMDVLYRCIKEALRLHPPLIMLLRQSHNDFSVTTKDGKEFDIPKGHIVATSPAFANRLPHIFKNPDSYDPDPYAPGREEDKAAGAFSYISFGGGRHGCLGEPFAYLQIKAIWTHLLRNFEFELVSPFPETNWKAMVVGIKDEVMVNFKRRKLVVDN

SEQ ID NO: 59018 - protein, 279 aa, Populus trichocarpa
MSKEVSEVGQTHGKDYVDPPPAPLLDLGELKLWSFYRALIAEFIATLLFLYVTVATVIGHKSNKDPCDGVGLLGIAWAFGGMIFILVYCTAGISGGHINPAVTFGLFLARKVSLIRAVAYMVAQCLGAICGVGLVKAFMKKNYNSLGGGANTVAMGYNTGTALGAEIIGTFVLVYTVFSATDPKRSARDSHVPVLAPLPIGFAVFMVHLATIPITGTGINPARSFGAAVIFNNEKAWDDHWIFWVGPFVGALAAAAYHQYILRAAAIKALGSFRSNPAN

SEQ ID NO: 59019 - protein, 498 aa, Physcomitrella patens subsp. patens
MGFAQVGAMVQLKNMGLFKTQGLINGEWANALDNRTLAVNNPATGDVLANVPFMGKIDAEKAIAAASVAFLPWSKRTAFDRCKLLRKWFDLILENKDDLAKLITLENGKPLTEANGEVVYGGGFVEYYAEEGKRVFGDIIPSPFPTKRMLVMKQAVGVVGAITPWNFPLAMITRKVAPALAAGCTIVLKPAELTPLTALAAAELAVQAGIPSGVLNVVMGDAVEIGAAMMDSNEVRKITFTGSTHVGKLLMAAASKTVKKISLELGGNAPLIIFNDADIEIAVQGALYGKYRNAGQTCVCVNRILVQDGIYDKFSEAFTKAVQKLRVGHGLDPGVTQGPLINEASLKKVEAHVQDAVSKGAKVLVGGKRHSLGGTFYQPTVLCGCNDEMLIFREEVFGPVAPLMRFQTDEEAIKMANDTEYGLAAYAYTENIEHGWRIAEALDYGMVGLNETLISSEVAPFGGTKQSGLGREGSNYGIDEYLELKYLCLGNIKQPFMC

SEQ ID NO: 59020 - protein, 203 aa, Oryza sativa Japonica Group
MAAEAAAALEGSEPVDLAKHPSGIIPTLQNIVSTVNLDCKLDLKAIALQARNAEYNPKRFAAVIMRIREPKTTALIFASGKMVCTGAKSEQQSKLAARKYARIIQKLGFPAKFKDFKIQNIVGSCDVKFPIRLEGLAYSHGAFSSYEPELFPGLIYRMKQPKIVLLIFVSGKIVLTGAKVRDETYTAFENIYPVLTEFRKVQQ

SEQ ID NO: 59021 - protein, 187 aa, Oryza sativa
MAVSEEKKEMQDPRTQAIASTIRVVPNFPKPGIMFQDITTLLLNPPVFKDTIDLFVERYTGKGISVVAGVEARGFIFGPPIALAIGAKFIPLRKPNKLPGEVMSKEYELEYGADCLEMHVDAVQPGERALVVDDLVATGGTLCAAIVLLERAGAEVVECACVIELPELKGRERLNGKPLYVLVESHS

SEQ ID NO: 59022 - protein, 281 aa, Chlamydomonas reinhardtii
MQHRAHHSHGPQPLAAAAPEREALLSEQEQTERSPPASLLSRLNRLRKKPVVSLFQDLKSVKVMGLDPSPELVAISMVYFVQGILGLSRLAAVAGSLQSLCWASAAVGGITSAYFSGSFVQDYGCRFVFGLTAFFPLVVCASALLIEEKPFGAAPAAPSVSGCTARDVPLRRMLVGVMVLGTALNSSQLVLISGLHRQWGLSDQLFVLGDSMVLGQISWMPILVLAARMCPAGVEATLFATLMSVLNCGSITGSALGAGLTNLYGVTSDKYDNLFALRSVN

SEQ ID NO: 59023 - protein, 478 aa, Pseudomonas fluorescens PfO-1
MHTALLIDGELVAGQGFVEPILNPATGEVLTQIAEASTEQVEAAILAAHRAFAEWSRTTPQQRSNLLLEIANAVEKHADHLARLEALNCGKPLHLARQDDLTATIDVFRFFAGAVRCQTGQLSGEYVPGYTSMVRRDPIGVVASIAPWNYPIMMAAWKIAPALAAGNTLVFKPSEHTPLSILALAPALAEILPRGVINIVCGGGEGVGSHLVGHPKVRMVSLTGDIVTGQKILQAAAKTLKRTHLELGGKAPVIVCNDADLKAVVEGVRTYGYYNAGQDCTAACRIYAQAGIHDKLVAELGAAVSSLRFAGKRDADNEIGPLISTRQRDRVASFVERALGQPHIERVTGAAVHSGAGFFYQPTLLAGCKQSDEIVQREVFGPVVTVTRFDELAQAVDWANDSEYGLASSVWTQNLDKAMQVAARLQYGCTWINSHFMLASEMPHGGLKRSGYGKDLSSDSLQDYSVVRHIMARHGQHL

SEQ ID NO: 59024 - protein, 523 aa, Aspergillus nidulans FGSC A4
MATRKVQQQTRQSSSPFWKARSVSQNYERTPNSPDQSLIVGASYSHANIPNGLSQHTRPRTPPRSSPNNSSHASPSTRRPGIWVASPRASYSGIMNQELGPWDHGNPAGKIGDDDDDDVGEDIVFDDDEDEFGLPSIASMRKRQGRQADVSRFKPVETPTFKSDSRPSTLDVNLPNNRQRANSSDIAEERDIPLYPTARKSDGKILRPQYKDILKDPANALNLINHVAPPKGASSKDMDAYTSRISRINKFKRLLQASTVPLQELRNLAWSGVPDEVRAMTWQLLLGYLPTNSERRIATLERKRKEYLDGVRQAFERSNAATTRENSRSTDTGRGRGLDEAIWHQISIDVPRTSPHIQLYSYEATQRSLERILYVWAIRHPASGYVQGINDLVTPLFQVFLGVYVTDLNVEEGMDPGQLPRSVLDAVEADSFWCLTKLLDGIQDNYIYAQPGIHRQVRALRDLTMRIDATLAKHLEQEGVEFMQFSFRWMNCLLMREMSVRNTIRMWDTYMAEEQGFSRFHLK

SEQ ID NO: 59025 - protein, 964 aa, Yarrowia lipolytica CLIB122
MAYRRKKFFGKRTEAGHVARTPSQLQEVYSDDDDGEGEDVEMWDQPEVKDTHNADSGSPASPAAAMPPRMSDSLYQETKAEAEASAGPQGAPGDLYSLIRTFPLFKMAPNAFVIAVSAKLRIQQVSPQEYIVTQGDEAKAMYWILKGQVNVTSRDGESVYAELEAGSFFGEIGILFDRPRTATVLASTKCVLAVLKGDSLNDILPKFPAMERAIRDEAQERLAIIEKTKINQRKSLLTGMVSPTTSIRNLLHEMPLFRHIPETIVHKLALAVEPRTYEPFQYIIKQDTIGQEIYFLTSGIVEVIDEREIGTAAHIIARLTKGSYFGEMAFLSSNPVRTASIRSISMVECLVLTTDTLESLCSQYPDIQQHIEQTASARIEQYHRDPKTHDIINNTTTDTQSAGAGPALPVDMTRRRSVADFGGKKNYSLFTVSRGGATFFSEPKDYHISLPGAENTTVSPMTSNHSHTRRYSTGTVFEPVISRDGRVVFSNSWESNSGVSEEAPLSLGNYQMAQPRKCLSAGSSGATSPSKRPAFDNRDDEPLGKDKREMSPRDSSPSSPGAAPLARSSSTGASVKTISPQRYSSFLLHPRLKKQKTFQRRKSSLFNVGPFSDAIQVKIFAYLDLPDLMVLQRVCQHWRQLLLTCPLPELDLKPYNRSIDDTSIVSIVNFVGARPKLVDISSCFHLTDDGFSYLVNGIGLAKIRVFKMTSVWEVSGMAIMDLTVPSIGADLEEVDLSNCRKVGDSTLARLVGWVQEEGGENSGDRETSPSSSVVGCPKLKRITISYCKHITDRSMHHMAVYAADRLEMLNLTRCTTITDHGFGYWNIRPFTRLRELVLADCTFLSDKAIISIVGAAKNLEFLDLSFCCALSDVSVEVLSLGCPSLKSLNLSFCGSAVSDANLRAVAMHLLDLEHLSVRGCVRVTAVGVDTILAGCLKLKTLDITQCKNAGGWNQGDSKVVVKTT

SEQ ID NO: 59026 - protein, 448 aa, Aspergillus nidulans FGSC A4
MFIGGLNWETTDQSLKEYFSQFGEVQECTVMRDSATGRSRGFGFLTFKDPKTVNTVMVKEHYLDGKIIDPKRAIPRDEQEKTSKIFVGGVSQEATEQDFKQFFMQFGRVIDATLMIDKDTGRPRGFGFVTFDSEAAVEAALSRPLEILGKTIEVKKAQPRGNLRDDGDRGRRGRDFRDGSQGGSDGSQQQAGAQGQGVMPGGLTPQMMAQYWQRMQQYFALMQQQMAVAATQGQGMGAMGMAGMNPALMQQMQMKQLQQMQMGNNQQSPSMSPPAQSPTPQSMQNMMNPAMMQQMQQQMPNQGQANNMGGQMGMGGNGSGNMNMGSNYAGGGRGGPGYNAHEQIAFEQQKYEQQQARRAMENRAFSPYQQGGPTSWEGMYDEVPQPNIPTGPQAMNRSSSVGRGQTPQPQGAAPANAPTGPKNAGKPGANYRGGGRGGHRGFHPYARG

SEQ ID NO: 59027 - protein, 503 aa, Leptospira interrogans serovar Lai str. 56601
MCMLGKHVCQKHPGFESRLLRFHIMAGTHEVLSRKYRPQKFRDVIHQDLAIGALQNALKSGKIGHAYIFFGPRGVGKTTIARILAKRLNCQNPIDNEPCNECNSCSEITRGISSDVLEIDAASNRGIENIRELRDNVKFAPMGGKYKVYIIDEVHMLTDQSFNALLKTLEEPPAHIVFVLATTEFHKIPETILSRCQDFIFKKVPLSVLQDYSEKLCKIENVQYDQEGLFWVAKKGDGSVRDMLSFMEQAIVFTDSKLLGAAIRKMIGYHGIEFLTSFIKSLVDPDNHSKSLEIIESLYQEGQDIYKFLWDSIEFTHTLNLIRDSLADPESVNFPKEDLVKMKSDFENVDSSKLNFLSGKLFEIYERIKTIRLRNSFEIKVFTEIQIKKLVEELTYPSLAGLIDKINHLILMVQGSKNVLSDVNQNTAFALKDTLQPETSKKKDKLSSDVILESQFESNQQDSNLENTKPAELSSRKFDTSTEIKKKFLGTEVDPNQTPKLDS

SEQ ID NO: 59028 - protein, 349 aa, Thermus thermophilus
MKVAVLPGDGIGPEVTEAALKVLRALDEAEGLGLAYEVFPFGGAAIDAFGEPFPEPTRKGVEEAEAVLLGSVGGPKWDGLPRKIRPETGLLSLRKSQDLFANLRPAKVFPGLERLSPLKEEIARGVDVLIVRELTGGIYFGEPRGMSEAEAWNTERYSKPEVERVARVAFELARKRRKHVVSVDKANVLEVGEFWRKTVEEVGRGYPDVALEHQYVDAMAMHLVRSPARFDVVVTGNIFGDILSDLASVLPGSLGLLPSASLGRGTPVFEPVHGSAPDIAGKGIANPTAAILSAAMMLEHAFGLVELARKVEDAVAKALLETPPPDLGGSAGTEAFTATVEAFTATVGI

SEQ ID NO: 59029 - protein, 106 aa, Triticum aestivum
  misc_feature (19)..(19): Xaa can be any naturally occurring amino acid
  misc_feature (47)..(47): Xaa can be any naturally occurring amino acid
FHPCQDDDSRSYVNNTAGXSLTKKARRLSKAPQEPASLLIPLALQRXKRARIAAKKKRIAKKKSEAAEYQKLLAQRLKEQRDRRSESMAKRRSKLSAATKAPAASA

SEQ ID NO: 59030 - protein, 318 aa, Brucella suis 1330
MKAIAAFSDFVGRSFAIWVIVFAALGFVMPATFSIFAPWIVVLLGIIMFGMGLTISGKDFAEVAKRPFDVAIGVLAQFIIMPLLAVLLTRIIPMSPEVAAGVILVGCCPGGTASNVMTYLSKGDVALSVACTSVTTLLAPLVTPFLVWFFASQYLPVDAMSMFISIVKVILVPLALGFVLQKLVPGVVKAAVPMLPLVSVVGIVLIVAAVVAVNKAAIAQSGLLIFAVVVLHNCCGLLLGYFAARFAGLSLAKRKAISIEVGMQNSGLGAALANAHFSPLAAVPSAVFSVWHNISGALVASYYARMEDDASETQTSAQ

SEQ ID NO: 59031 - protein, 336 aa, Yersinia enterocolitica
MTILVTGGAGYIGSHTVLTLLENGEDVVVLDNLSNASAESLLRVSKITGRTPVFYQGDILDRNCLKKIFFEHKIDSVIHFAGLKSVGESVVKPIEYYQNNVTGSIILLEEMVISGVKKLIFSSSATVYGDPEFVPLTEDARIGGTTNPYGSSKVMIEQILKDFAFAYPDFSIRALRYFNPVGAHISGLIGEDPNGKPNNLLPFITQVAIGKLPKLAVYGNDYPTVDGSGVRDYIHVMDLAEGHLCALNNLTHGFKVYNLGSGIGHSVLEMIAEFELISGKKIPYEIVARRPGDIAECWASPELAFKELKWKAKRNLTYMLKHAWNWQQSNPNGYVR

SEQ ID NO: 59032 - protein, 457 aa, Thermococcus hydrothermalis
MARKVLVALLVFLVVLSVSAVPAKAETLENGGVIMQAFYWDVPGGGIWWDTIAQKIPDWASAGISAIWIPPASKGMSGGYSMGYDPYDFFDLGEYYQKGSVETRFGSKEELVNMINTAHAHNMKVIADIVINHRAGGDLEWNPFTNSYTWTDFSKVASGKYTANYLDFHPNELHAGDSGTFGGYPDICHDKSWDQHWLWASNESYAAYLRSIGIDAWRFDYVKGYAPWVVKNWLNRWGGWAVGEYWDTNVDALLSWAYDSGAKVFDFPLYYKMDEAFDNNNIPALVDALKNGGTVVSRDPFKAVTFVANHDTNIIWNKYPAYAFILTYEGQPAIFYRDYEEWLNKDRLRNLIWIHDHLAGGSTDIIYYDSDELIFVRNGYGDKPGLITYINLGSSKAGRWVYVPKFAGSCIHEYTGNLGGWIDKWVDSSGRVYLEAPAHDPANGQYGYSVWSYCGVG

SEQ ID NO: 59033 - protein, 379 aa, Triticum aestivum
  misc_feature (207)..(207): Xaa can be any naturally occurring amino acid
MTLTPRSTRLAPFQSVFSSPSPAATPVAVTPRRSNSHPAARLRLRCCCSAGDPAAMVKAIRVHELGGPEALRWEEVEVGEPGDGEIRIRNTAIGVNFIDVYFRKGVYPAPLPFTPGMEAVGVVTAVGPGLTGRKVGDVVAYAGKPMGSYAEEQIIPADVAVPVPPSVNHKTAAAIMLKGMTVHMLVRRIFKVETGHTVLVHAAAGGXVGSLLCQWANALGATVIGTVSNEEKATHAHFDGCHHMIIYTKEDVATRVKEITGGKGVNVVYDSVGKDTYKASLECLASRGFLVSFGQSSGSPDPISMGDLASKSLFLTRPSVMHYTGTRDELLEAAGEVFANVANGVLHTRVKHTYPLSEAARAHADLEARKTSGSVLLIP

SEQ ID NO: 59034 - protein, 195 aa, Zea mays
MGLLGRRTLLRLLALASAAVAVAVAVEAYEGDADPLYSDTIWTEKLYFSSDAAFLGYSLILAILRTLNLRDEASRVMVAAPILAFVTTHILYLNFYELDKGLNMKVCTVIIIAQCLLWALWAVMTRHPSRLKIIFVAIGGAAAVLLEASDIPPRWGYVDGRVICLAVAIPLSYLWWSFAKEDAEMRTSAILKKAR

SEQ ID NO: 59035 - protein, 453 aa, Dechloromonas aromatica RCB
MSLSSNQDWLARSQAAVWHPCTQMQHHAQTASAAHLPLVPIARGSGAWLYDFDGKRYLDGISSWWTNLFGHANPRINAALKDQLENLEHVMLAGFTHQPVVELSERLSALTGGSLGHAFYASDGASATEIALKMSFHYWRNTGRPEKAEFLCLAGSYHGETVGALAVTDVAIFKDAYAPLVRAATVIPSPDSRLAEAGESPADVARRAAAALEAHLEKHGENIAALIVEPLVQGAAGMVMYDPEYLRLARQLCDRYEVHLICDEIAVGCGRTGTFFAHEQAANDGNPIRPDLMCLSKGISGGYLPLSIVLCSDTIYEAFLDDSVARAFLHSHSYTGNPLACRAALATLNIFESDDILAANRLKSAKISTALAPLADHPQVRHLRQRGMITAFDVETDDPYFSRRFYRATLGREALIRPIGNTVYLMPPYIISDDEIAHLGQSIAGSLQEALAK

SEQ ID NO: 59036 - protein, 487 aa, Burkholderia sp. 383
MHIKQLYIDGAWQPAAAGGQRAIIDPATGEAIARVAYGSAADAGHAIRAARAAFDAGEWPHLPAEERAACLRRLANALRDEAPALARIETANTGKTLAESSSDVHDAASAFDYFASLAVTETGSMNAAKPHVISVTLREPVGVCGLITPWNYPLLQAAWKLAPALVAGNTVVVKPASLTPLSTHRLVELAHDAGLPRGVLNLVTGGADVGDALAASPQVDLISLTGSNAAGASVMRAAAGNFKRVSLELGGKNPNLVFADADVDTALDYALNAAFFNAGQMCSAGSRLLVERTLHDAFVDALAARIAAIRVGRGDDDATRMGPVISAQQRDRVLALIGEAARDGARIVCGGRAPAGDAFATGFWVEPTLIAGVRTTMAIAREEVFGPVLTVEAFDSEDEAVALANDTPFGLAGAVWTRDFARANRVMRRLRAATVWINDYNVTLPGAPWGGYKASGIGRELSRSGLDEYTELKHAYLNFEASPQRWF

SEQ ID NO: 59037 - protein, 270 aa, Populus trichocarpa
MTMLAKALEYADFDKFDRVRVPKIHYAGMLQYDGELKLPSQYLVTPPEIERTSGEYLVHNGVRTFACSETVKFGHVTFFWNGNRSGYFNEEMEEYVEIPSDVGITFNVQPKMNALEIAEKARDAILSGKFDQVRVNLPNGDMVGHTGDIEATVVACKAADGAVQTIIDAIEQVGGIYVITADHGNAEDMVKRDKSGKPLLDKSGKLQILTSHTLEPVPIAIGGPGLKAGVRFRNDVPTGGLANVAATVINLHGFEAPNDYEPTLIEVVDN

SEQ ID NO: 59038 - protein, 128 aa, Arabidopsis thaliana
MTGEVVNPKAYPLADSQLSITILDLVQQATNYKQLKKGANEATKTLNRGISEFVVMAADAEPLEILLHLPLLAEDKNVPYVFVPSKQALGRACGVTRPVIACSVTSNEASQLKSQIQHLKDAIEKLLI

SEQ ID NO: 59039 - protein, 405 aa, Photobacterium profundum SS9
MGGVLGMILAGGEGSRLRPLTDSRTKPAVPFGGSYRLIDFALNNFVNADFLKIYVLTQFKSQSLYVHMKKGWNITGITDRFIDPIPAQMRMGKRWYDGTADAIYQNLSFIELAEPEHVCIFGSDHIYKMDIKQMLNFHKEKEAELTVSALRMPLSEASAFGVIEVDENGCMVGFEEKPTNPKSIPGDPENALVSMGNYIFNKDTLCTELEEDAAKEDSSHDFGKDIIPKLFPLGKVYVYDFTTNIIPGEKNTGYWRDVGTIEAYWQAHMDLLSEDAPFSLYNRQWQLHTHYPPLPPATILDSENSKVDINNCMISAGSYIRGAQIHKSILGFRTNVDHNTMISESVILGDVKIGANCSIRKAIIDKNVHIAPGTVIGENPEEDKKNYHVSDEGIVVIPKGAKIGY

SEQ ID NO: 59040 - protein, 1441 aa, Oryza sativa Japonica Group
MEDKKQQQQQQREEAEAEEEAPVVPSSLRAAATCRSLSSLSSSLRWDHRGDDDEEEAELRWAAIERLPTLDRMRTSVLSSEAVDVRRLGAAQRRVLVERLVADIQRDNLRLLRKQRRRMERVGVRQPTVEVRWRNVRVEADCQVVSGKPLPTLLNTVLATARGLSRRPHARIPILNDVTGILKPSRLTLLLGPPGCGKTTLLLALAGKLDKNLKVTGEVEYNGANLNTFVPEKTSAYISQYDLHVPEMTVRETLDFSARFQGVGTRAEIMKEVIRREKEAGITPDPDIDTYMKAISVEGLERSMQTDYIMKIMGLDICADIIVGDIMRRGISGGEKKRLTTGEMIVGPSRALFMDEISTGLDSSTTFQIVSCLQQVAHISESTILVSLLQPAPETYDLFDDIILMAEGKIVYHGSKSCIMNFFESCGFKCPERKGAADFLQEVLSKKDQQQYWSRTEETYNFVTIDHFCEKFKASQVGQNLVEELANPFDKSEVYNNALSLNIYSLTKWDLLKACFAREILLMRRNAFIYITKVVQLGLLAVITGTVFLRTHMGVDRAHADYYMGSLFYALILLLVNGFPELAIAVSRLPVFYKQRDYYFYPAWAYAIPSFILKIPLSLVESITWTSISYYLIGYTPEASRFFCQLLILFLVHTGALSLFRCVASYCQTMVASSVGGTMSFLVILLFGGFIIPRLSMPNWLKWGFWISPLSYAEIGLTGNEFLAPRWLKTTTSGVTLGRRVLMDRGLDFSSYFYWISASALIGFILLLNVGYAIGLTIKKPTGTSRAIISRDKFSTFDRRGKDMSKDMDNRMPKLQVGNALAPNKTGTMVLPFSPLTISFQDVNYYVDTPVEMREQGYKERKLQLLHNITGAFQPGVLSALMGVTGAGKTTLLDVLAGRKTGGVIEGDIRVGGYPKIQQTFARISGYCEQTDVHSPQITVEESVAYSAWLRLPTEVDSKTRREFVDEVIQTIELDDIRDALVGLPGVSGLSTEQRKRLTIAVELVSNPSVIFMDEPTSGLDARAAAIVMRAVKNVADTGRTVVCTIHQPSIEIFEAFDELMLMKRGGELIYAGPLGLHSCNVIHYFETIPGVPKIKDNYNPSTWMLEVTCASMEAQLGVDFAQIYRESTMCKDKDALVKSLSKPALGTSDLHFPTRFPQKFREQLKACIWKQCLSYWRSPSYNLVRILFITISCIVFGVLFWQQGDINHINDQQGLFTILGCMYGTTLFTGINNCQSVIPFISIERSVVYRERFAGMYSPWAYSLAQVAMEIPYVLVQILLIMFIAYPMIGYAWTAAKFFWFMYTIACTLLYFLYFGMMIVSLTPNIQVASILASMFYTLQNLMSGFIVPAPQIPRWWIWLYYTSPLSWTLNVFFTTQFGDEHQKEISVFGETKSVAAFIKDYFGFRHDLLPLAAIILAMFPILFAILFGLSISKLNFQRR

SEQ ID NO: 59041 - protein, 464 aa, Burkholderia xenovorans LB400
MTETTSVANVIDARPIGWLQLVIAAVGALALLCEGFDLQIISYVMPRIVQEWGIERARQGTILSAGYGGMLIGFLALAPLASRIGAKRLAVYCLLAMGVLNLGTLFATGGWMLIAFRVAVGLTLGGVVPPTLALVAEFFPTRHRSALIAMLYLGTTSGIMIAGVVAWLTLARYGWRGAMVVGGVMPIVAAIAVRLVWFESPVWLLSRGAAGAARVSVMLERLYPRMPSSNPVAAAEASTPDAGSVVHLFTERRLVGTLMLWLGLSCNAVVYFFALSWIPLILVGIGATQQNAILASTLANLGGIAAIVTGFLMDRYGRSRVVIGYFFAGAAFVLLVGAMLSPTVMVIAPTAFCLGYCVSGLQKGVSALAIEFYPSALRSAGVGWVLGVGRSGAILGPMVPGLLMQAGWPPAHVFYLMSVPLVLGGAGIALMQAWYRPRTSRDHALLHAVAPVHDDYPGTKVRTR

SEQ ID NO: 59042 - protein, 174 aa, Zea mays
  misc_feature (10)..(10): Xaa can be any naturally occurring amino acid
  misc_feature (38)..(38): Xaa can be any naturally occurring amino acid
  misc_feature (77)..(77): Xaa can be any naturally occurring amino acid
  misc_feature (153)..(153): Xaa can be any naturally occurring amino acid
NCCSNCWVKXGGAFTGEIIAEMLVNLGVPWVILGHSEXRRALLGESNEFVGDKVAFALSQGLKVIACVAAQTKAIAXKIKDWSNVVLAYEPVWAIGTGKVATPSHAQEVHASLRDWVKINVIPEVFESTRIIYGGSVTAANCKKLAAHSDVYXFLVGGASLNPEFIDLIHALAV

SEQ ID NO: 59043 - protein, 311 aa, Chlamydomonas reinhardtii
MASLNVEDPAPPVHPCKRRLRIYEEWQGNERFFCWGYLVAGPNWKASIGTAMLISAPAGIFLAFVAPYMGLHVHIIILVISCILPVLAVLFLMLTACRDPGIIPRQDPDPEYLNGQKPSGSSDDVVKRTPATCEVYVNNQRVVIRYNDTCHFYQPPRAHHCSVNDNCIERFDHHCPWVGTTIGLRNYRTFLLFVYTSSVLCLYVFGVCYTSLTPFPHAPFPVAAQCIPALVLMGYTFLFFWFVGGLSVFHAYLVATNQTTYENFRYNHDSRPNPYDRGVLLNCAEVWCSPVPPPKVPFRAYVDEFKPPSEF

SEQ ID NO: 59044 - protein, 420 aa, Triticum aestivum
  misc_feature (26)..(26): Xaa can be any naturally occurring amino acid
  misc_feature (52)..(52): Xaa can be any naturally occurring amino acid
AWEKSDVEYKDSWVEKGCYVCIIGYXQGGVSEAIKRTNGTYFSEEKLCKWLXQLLMALDYLHTNHILHRDVKCSNIFIARDQTIRLGDFGLAKILTSDDLASSVVGTPSYMCPELLADIPYGSKSDIWSLGCCIYEMTALRPAFKAFDMQALINKITKSIVSPLPTKYSGPFRGLIKSMLRKSPEHRPSAGELLKHPQLQPYVFQVQLKSSPTRNIHPINESLTDKVKKMTVPDDVPDSARRRMVRRNSLGSHRIVTFSKPSPERNSVSSTRSIKEYTTTQSCKELSIDSSQAEDDEVTSKAMITKTSSILRTPKSNPAKTFTSRNRLETPKTSYNRTNRAEPPSVTPVNKSARLARRVSLPLSTYETPIKRSISILDQLGSPDVSMNAPRIDRIAEFPLASSEDPFHSIHKLSSAHGSC

SEQ ID NO: 59045 - protein, 506 aa, Deinococcus radiodurans R1
MSIVILDFGSQFTRLITRRFRELGAYSVILPGTASLERIQQENPQGIVLSGGPSSVYDEGAPRPAPGVLDLNVPILGVCYGMQYLAHEAGGDVKRAGKREYGKADLTEYGGRLFEGIQGEFVAWMSHSDSVTQLPQGYQVVARTEHTPVTAIENNDTRRYGVQFHPEVVHTPKGGQMLANFLDICGVTRDWNAEHIVDELIEGVRAQVGDTGRVLLGISGGVDSSTLALLLAKAVGERLTAVFIDHGLLRLGEREQVEAALTPLGVNLVTVDAKDEFLGQLAGVSDPEQKRKIIGREFIRAFERETAKLGDFEFLAQGTLYPDVIESAGGEGAANIKSHHNVGGLPDDVQFKLVEPFRTLFKDEVREIARLLGLPDHIRMRHPFPGPGLAIRCLGEVTAEKVDILQRVDDIFISGLREFGLYDGCSQALAVLTPIQSVGVMGDERTYSYTAALRAVTTDDFMTAEWARLPYDFLATMSNRIVNQVHEINRVVYDITGKPPATIEWE

SEQ ID NO: 59046 - protein, 480 aa, Arabidopsis thaliana
MAVSSSSFLSTASLTNSKSNISFASSVSPSLRSVVFRSTTPATSHRRSMTVRSKIREIFMPALSSTMTEGKIVSWIKTEGEKLAKGESVVVVESDKADMDVETFYDGYLAAIVVGEGETAPVGAAIGLLAETEAEIEEAKSKAASKSSSSVAEAVVPSPPPVTSSPAPAIAQPAPVTAVSDGPRKTVATPYAKKLAKQHKVDIESVAGTGPFGRITASDVETAAGIAPSKSSIAPPPPPPPPVTAKATTTNLPPLLPDSSIVPFTAMQSAVSKNMIESLSVPTFRVGYPVNTDALDALYEKVKPKGVTMTALLAKAAGMALAQHPVVNASCKDGKSFSYNSSINIAVAVAINGGLITPVLQDADKLDLYLLSQKWKELVGKARSKQLQPHEYNSGTFTLSNLGMFGVDRFDAILPPGQGAIMAVGASKPTVVADKDGFFSVKNTMLVNVTADHRIVYGADLAAFLQTFAKIIENPDSLTL

SEQ ID NO: 59047 - protein, 98 aa, Zea mays
LDKGLNMKVCTVISIAQCLLWALWAVMSGHRSRLKIISVAVGGAVAVLVEAYDIPPRWGYADGRAICLAVAIPLSYLWWSFAKEDAEMRTSAILKKTR

SEQ ID NO: 59048 - protein, 275 aa, Burkholderia sp. PS12
MKLKGEVALVTGGGAGLGRAIVDRYVAEGARVAVLDKSAAGLEEIRKRHGDAVVGIEGDVRSLDSHREAVARCVETFGKLDCLIGNAGVWDYQTQLADIPDNGISEAFDEMFAIIVKGYILAAKAALPALYKSKGSAIFTVSNAGFYPGGGGVLYTAGKHAVIGLVKQLAHEWGPRIRVNGIAPGGILGSDIRGLKTLGLQDQTIATMPLADMLGPVLPTGRVATAEEYAGAYVFFATRADTVPLTGSVLNIDGGMGVRGLFEASLGAQLDKHFA

SEQ ID NO: 59049 - protein, 528 aa, Kluyveromyces lactis NRRL Y-1140
MLSVRVNLKTRISSGMIRVNAPALKSTMPSVTSLTQLRFSTTVKPAPKLSLDDVNENVLKAKYAVRGRIPMRAEELRDQLKKDPSSLPFSKIISANIGNPQQLDQKPLTFYREVLSLLQHPELLEEADEALQTLYKTDSIKRAKRLLSEVGGSVGAYSQSQGVQGIRETVADFITKRDDGEISYPEDIYLTAGASAAVSYILSILCKGPNTGVLIPIPQYPLYTASLALNNSRPLPYYLREEQNWSTDPEEIEQVVLDAIQKGIKPTCLVVINPGNPTGAILSEQSIQKIFEVAAKYGIVVIADEVYQENVFKGSKFYSMKKVLRNLQKTYHGQYDNIQLASLHSTSKGVSGECGQRGGYMELVGFNHDIRQVFLKLASISLCPVVTGQALVDLMVSPPQPGDESYEQDQQEREDIHDALDERASKLFETFSRLEGIECRKPQGAMYLYPKLDLPYKVIQEAQHLEMEPDEFYCKALLENTGICTVPGSGFGQVPGTYHLRTTFLPPGTEWVETWEKFHKAFFDKYRD

SEQ ID NO: 59050 - protein, 430 aa, Haemophilus influenzae Rd KW20
MVDEQSLLAFDTQHIWHPYSSVSSDMPLYAVERADGVMITLKDGRRLIDGMSSWWAALHGYNHPRLNAAAQNQLAKMSHIMFGGFTHDPAVELAQLLVQILPNGLDKIFFADSGSVAVEVAMKMAIQYQHAKGEVQRQKFATIRSGYHGDTWNAMSVCDPTTGMHHLFHHSLPVQYFLPQPNIPFNESWNDCAIEPLADLLKKKGNEIAALILEPVVQGAGGMYFYSPTYLVKAQALCKQYGILLIFDEIATGFGRTGKLFAAEHAGISPDIMCIGKALTGGYLTLSASITTTEIAQTICSGEAKCFMHGPTFMANPLACAIAAESIRLLLESPWQQNIQRIESSLKQQLSPLSEKDYVKEVRALGAIGVVEMKSAVNMKTLVPRFVEQGVWIRPFGKLVYVMPPFVIKDDELQKLTEGMILALTQEYEH

SEQ ID NO: 59051 - protein, 1576 aa, Aspergillus nidulans FGSC A4
MARSRQPTRFSSEAPSESSSSTSPERAADDDTDFFTLQANDSQSSIGAGNPRDSHIQNDPETVLPPIAYLPPEILISIFSKLSSPRDLLSCLLKIAAAVGEEDSFFLYSSLIKRLNLSALTEDVSDGTVVPFSQCNRIERLTLTNCRKLTDIGVSDLVVGSRHLQALDVSELRSLTDHTLFKVAENCNRLQGLNITGCVKVTDDSLIAVSQNCRLLKRLKLNGVSQVTDKAILSFAQNCPSILEIDLQECKLVTNQSVTALMTTLQNLRELRLAHCTEIDDSAFLDLPRHIQMTSLRILDLTACENIRDEAVERIVSSAPRLRNLVLAKCKFITDRAVWAICKLGKNLHYVHLGHCSNINDSAVIQLVKSCNRIRYIDLACCSRLTDRSVQQLATLPKLRRIGLVKCQLITDASILALARPAQDHSVPCSSLERVHLSYCVNLTMVGIHALLNSCPRLTHLSLTGVAAFLREELTVFCREAPPEFTRQQREVFCVFSGEGVNRLRNHLNREAAPQRDANEATMYDDEEELDEDEGQPEQASPSSTGAFLLSGYCIGSGYTGSPILLIIICQPPIVGVPSGPVRPPLLPASVLSRLLRTLLKLKLSLSRDFVRQAQAPEPGVKTMDQTKPPRRNPLAFTPWPVTLITAVVYLAFVIPLLVIHHVVPSAPTSSPDGLNITEAWNDLQVLTAGYRPYNSRQNDKIHDWLLHRINEILGAAPPATTDEKKPDVFVFDDTRSNLTFARDNLAVYFEGTNILVYIRGEDDDQEQWWELPEGSPKGKGGVLVNAHYDSVSTGYGATDDGVGVVTCLQLVKYFTTPKNAPRKGLVVLFNNGEEDFLNGARVYSQHPLSRFPHTFLNLEGAGAGGRAVLFRSSDAEVAASYMRSKHPFGSVLGSDGFKAGLIRSQTDYVVFEGDMGLRGLDVAFLEPRARYHTDQDDTRHTSKDSLWHMLSTAVATTEDLVSDTSDRFDGPARNDHKIASGTGHQAVWFDLYGSTFVLFRLHTLFALSVTLLVVAPIVLLLTSIILTKVDKMYLFRTSIRPEGSLEVLPLYGDRGVIRYPFLLGIPTAVTIGLAYLLTKFNPYIVHSSQYAVWSMMVSVWIFLAWFVSRVADFARPSAFHRVYTLTWTFVVMWVLQVIATVYQDRWALGGSYFIFFAYAGTFLATWISYLELFALPRKSEYANHLRPVSRHASSHSSRRGLSEEDEEDEDEAPTESTSLLGSRQRTTFANYVRVNADTADLSDSEEHTQDVNVYGLEQRWSASLPKWLWLLQFLLAAPIVLILVGPIALLLTGSLHQTGQDGSSSLFIYIAIVALTTLLLSPMLPFVHRCTYHIPLFMLAVFAGTLIYNLVAFPFSDSNRLKLFFIQEVDLDTGLNTASLTGVQPFVHDVAVGLPSAAGQNVTCGPFGDRFKCSWTGIPPHVLTEDKPVEEWLSFEVSRSIDKPRHAQLQISGQNTRACKVVFDSPIKNFHVAGSAYDPRFPHTYAKGIKEIRLWSRVWDNTWTVDVEWFNPDSSSDHSKTSGSLTGQVVCLWSDYNQPGTIPALDEVRQYGPAWIGVSKLADGLVEGRKSFEIA

SEQ ID NO: 59052 - protein, 226 aa, Methanothermobacter thermautotrophicus str. Delta H
MGEKVYELRKIKKKGRGMPLIGDKFPEMEVQTTHGPMELPDEFEGKWFILFSHPADFTPVCTTEFVAFQEVYPELRELDCELVGLSVDQVFSHIKWIEWIAENLDTEIEFPVIADTGRVADTLGLIHPARPTNTVRAVFVVDPEGIIRAILYYPQELGRNIPEIVRMIRAFRVIDAEGVAAPANWPDNQLIGDHVIVPPASDIETARKRKDEYECYDWWLCTQSRG

SEQ ID NO: 59053 - protein, 403 aa, Brassica napus
MVDLLNSVMNLVAPPATMVVMAFSWPLLCFITFSERLYNSYFVTEDMEDKVVVITGASSAIGEQIAYEYAKRGANLVLVARREQRLRVVSNNARQIGANHVIIIAADVVKEDDCRRFITQAVNYYGRVDHLVNSASLGHTFYFDEVSDTTVFPHLLDINFWGNVYPTYVALPHLQKTNGRIVVNASVENWLPLPRMSLYSAAKAALVNFYETLRFELNGDVGITIATHGWIGSEMSRGKFMLEEGAEMQWKEEREVPANGGPLEEFAKMIVAGACRGDAYVKFPNWYDVFLLYRVFTPNVLRWTFKLLLSSEGSRQSSLVGVGQGLPPEESSSQMKLMLEGGSPRVTASPPRYTPSPSPPHHTASPPRYTPSPSPNWYTESPPRYTPSPSPPRFSRFNIQELP

SEQ ID NO: 59054 - protein, 317 aa, Xylella fastidiosa 9a5c
MHSVVVVGSFSIDHVWRCDTLPTPGATIAGRYSRGPGGKGFNQAVAACRVGARTYFICALGNDTDGNMARDIATKDGFTLIGESSTEPTGTGGIYVDSHGHNTIVTGAGANAVLSTHFITEQRALITSAWIILAQLESPIETLETALSMAREAGRLTILNAAPANATATINLLKLADVLTLNETEFVALLSRHVGERISPDNVATTDGNTLHALCNKLLSDSTVVITLGSAGVFVSHSEENLRGDTQPYYRVAAEQAHTVDTTGAGDAFNGALAASLARQPNTAFIQHIRLANSYAARSTETEGGAVSMPILTTTPD

SEQ ID NO: 59055 - protein, 557 aa, Arabidopsis thaliana
MGKSKSATKVVAEIKATKPLKKGKREPEDDIDTKVSLKKQKKDVIAAVQKEKAVKKVPKKVESSDDSDSESEEEEKAKKVPAKKAASSSDESSDDSSSDDEPAPKKAVAATNGTVAKKSKDDSSSSDDDSSDEEVAVTKKPAAAAKNGSVKAKKESSSEDDSSSEDEPAKKPAAKIAKPAAKDSSSSDDDSDEDSEDEKPATKKAAPAAAKAASSSDSSDEDSDEESEDEKPAQKKADTKASKKSSSDESSESEEDESEDEEETPKKKSSDVEMVDAEKSSAKQPKTPSTPAAGGSKTLFAANLSFNIERADVENFFKEAGEVVDVRFSTNRDDGSFRGFGHVEFASSEEAQKALEFHGRPLLGREIRLDIAQERGERGERPAFTPQSGNFRSGGDGGDEKKIFVKGFDASLSEDDIKNTLREHFSSCGEIKNVSVPIDRDTGNSKGIAYLEFSEGKEKALELNGSDMGGGFYLVVDEPRPRGDSSGGGGFGRGNGRFGSGGGRGRDGGRGRFGSGGGRGRDGGRGRFGSGGGRGSDRGRGRPSFTPQGKKTTFGDE

SEQ ID NO: 59056 - protein, 162 aa, Zea mays
MAPIAVGDVVPEGSISFFDENDQLQTVSVHSLAAGKKVILFGVPGAFTPTCSMKHVPGFIEKAEELKSKGVDEIICFSVNDPFVMKAWGKTYPENKHVKFVADGSGEYTKLLGLELDLKDKGLGVRSRRFALLLDNLKVTVANVESGGEFTVSSADDILKAL

SEQ ID NO: 59057 - protein, 194 aa, Escherichia coli
RADERPGKINLGIGVYKDETGKTPVLTSVKKAEQYLLENETTKNYLGIDGIPEFGRCTQELLFGKGSALINDKRARTAQTPGGTGALRVAADFLAKNTSVKRVWVSNPSWPNHKSVFNSAGLEVREYAYYDAENHTLDFDALINSLNEAQAGDVVLFHGCCHNPTGIDPTLEQWQTLAQLSVEKGWLPLFDFAY

SEQ ID NO: 59058 - protein, 192 aa, Escherichia coli
ADERPGKINLGIGVYKDETGKTPVLTSVKKAEQYLLENETTKNYLGIDGIPEFGRCTQELLFGKGSALINDKRARTAQTPGGTGALRIAADFLAKNTSVKRVWVSNPSWPNHKSVFNSADLEVREYAYYDAENHTLDFDALINSLNEAQAGDVVLFHGCCHNPTGIDPTLEQWQTLAQLSVEKGWLPLFDFA

SEQ ID NO: 59059 - protein, 206 aa, unidentified eubacterium SCB49
MIYSFKGHIPVVHKSSFVHPLAAVTGNVIIGKNCYIGPGAAIRGDWGEIILEDGVNVQENCTVHMFPGKSIVLKEGAHVGHGAVIHGANLGRNCLIGMNSVIMDDAEIGDECIVGAMAFVKAEAVFEKRQLIVGNPAKVIKEVSDVMIAWKTAGTKLYQQLPTDCHESLKEVEPLREIPADRPKQEDFYKTLNKFLRRQESQTDKK

SEQ ID NO: 59060 - protein, 192 aa, Escherichia coli
ADERPGKINLGIGVYKDETGKTPVLTSVKKAEQYLLENETTKNYLGIDGIPEFGRCTQELLFGKGSALINDKRARTAQTPGGTGALRVAADFLAKNTSVKRVWVSNPSWPNHKSVFNSAGLEVREYAYYDAENHTLDFDALINSLNEAQAGDVVLFHGCCHNPTGIDPTLEQWQTLAQLSVEKGWLPLFDFA

SEQ ID NO: 59061 - protein, 192 aa, Escherichia coli
DERPGKINLGIGVYKDETGKTPVLTSVKKAEQYLLENETTKNYLGIDGIPEFGRCTQELLFGKGSALINDKRARTAQTPGGTGALRVAADFLAKNTSVKRVWVSNPSWPNHKSVFNSAGLEVREYAYYDAENHTLDFDALINSLNEAQAGDVVLFHGCCHNPTGIDPTLEQWQTLAQLSVEKGWLPLFDFAY

SEQ ID NO: 59062 - protein, 438 aa, unidentified eubacterium SCB49
MSDEKRFLPTQEFTMPKMGESITEGTILNWLVQEGDTFEEGDILVEVATDKVDNEVPAPAAGTMISHKVSAKDVVAVGAVIAILELSDIASAKMSQAEKMPEKGTSANTKKPALRQTQGDSAAKSKAFKVNENLFISPLVDAVARKNHISYEELARITGTGKDGRLRKSDVTNYLNEGRPFQFAQTVAAPSGFQVPDLKFDKGTGKLVEMDRMREMIADHMVYSKHTSPHVTAYVEADLTDMVVWRNANKLKFQEKHGEKLTFTPLFIEAVANAIKDFPMINSSLDGKNIIVKEDINIGMATALPTGNLIVPVVKNADKKDLKGLASATNELVSKSRSGNLKGDDMKGSTFTISNVGTFGSLMGTPIINQPEAAILATGIIKKRAEVIEKPEGDVIEIRSMMYLSLSFDHRIVDGYLAGSFLKRIADNMESFDVERTF

SEQ ID NO: 59063 - protein, 391 aa, Chlamydomonas reinhardtii
MQAKMQTRAVSGRAAARSRVSTTKVVCRALNSMESPYAEELKKTAAYISQKGKGILASDESNATTGKRLESVGVENTEDNRRAWRELLYTAPGLGQYISGAIMFEETLYQKARDGRQFVDILLAQGIYPGIKVDTGLQILPGDKGETTTQGLDGLADRCKAYRKQGARFAKWRAVVKIGEAGCPSTTAVLENAHGLARYAQICQENGLVPIVEPEVTLGPGDYSIEETAFWSERVYSHTMRLLNEYGVVLEGILLKPNMCLPGLDAPVASPQLVAEVTTRTMMRSIPPAVPGIHFLSGGMSEEESTLNLQALNEACPNAPWALTFSYGRALQSSTLKTWAGKESNWAAAQDILLKLAKANSEASTGSFKGPHPVPGGGRILQALRTGGAGK

SEQ ID NO: 59064 - protein, 552 aa, Rhizobium leguminosarum bv. viciae 3841
MKKTGGELIVEALKANGVQRLSCVPGESFLAVLDALRDSDIDVLVCRQEGGAAMMADCWGRLTGEPGICMVTRGPGATNASAGLHIAKQDSIPMILFIGQVQREAREREAFQEVEFRRAFTEFAKWVGEIDDAARIPEFVTRAFAVATSGRPGPVVLTLPEDMLRDEVEAPRARHYANVEAHPGRRQIDDFYLRLLKAERPMAILGGTRWDADAVADFQSFAERFQLPIGCSFRRQMLFDHLHPCYAGDVGIGINPALAKEIKESDLLILLGSRMSEMPSSSYTLIDIPYPQQSLVHIYPDASELGRIYRPDLAICAAPADFVAALADLEAPAEPHWAERTARLHQAYLAWSKPPLSGPGAVHMGPIMEWLEANTGPETIFTNGAGNYATWVHRFHRFRRFNTQAAPTSGSMGYGLPAAVAAKRLFPEREVICFAGDGCFLMHGQEFATAIRYGLPIIAVVVNNGIYGTIRMHQEREYPGRVSSTDLTNPDFAALARAYGGHGETVETTADFAPAFERARASGKPAIIEIKLDPEAITPTRTLSEIAQTKSR

SEQ ID NO: 59065 - protein, 435 aa, Arabidopsis thaliana
MAYEIFKAHDVNVSSRGIIALDESLMFGASGILNAPYGDYWKFMKKLMATKLLRPQVLERSRGVRVEELHRFYRSILDKATKNESVEIGKEAMKLMNNTLCKLIMGRSFSEDNGESNRVRGLVDETYALSEKIFLAAILRRPLAKLRISLFKKEIMGVSNKFDELLERILQERKENLEEKNNEGMDMMDVLLEAYGDENAEYKITWKHIKAFFVEFFIGGTDTSVQTTQWAMAEMINNANVLERLREEIVSVVGETRLIQETDLPNLPYLQAVVKEVLRLHPPSPVLIRKFQEKCEVKGFYIPEKTTLIVNVYAIMRDSDSWEDPEKFKPERFLTSSRSGEEDEKELKFLPFGSGRRGCPGANLGSIFVGTAIGVMVQCFDWKIKEDKVNMEETFEGMTLKMVHPLTCTPFFEPNLYLLLLISKFPCLILSFGAC

SEQ ID NO: 59066 - protein, 290 aa, Oryza sativa
  misc_feature (183)..(183): Xaa can be any naturally occurring amino acid
  misc_feature (190)..(190): Xaa can be any naturally occurring amino acid
  misc_feature (199)..(199): Xaa can be any naturally occurring amino acid
MKMPGRLLAAGAAALLVAASVMVATLLTAPLPFLPSLMPCLPAVTAPSGSGYSPPGLAALADAAVRYATTPTVPQQSRAEISLSLAVLRRRAPLRLLVFGLGHDSPLWHALNPGGATVFLEEDPSWYSVVRGQSPFLRGHLVAYRTRLDHADRLLATYKDHPSCLPGGGGNGGGDVPRVRGNXAECPLAXLHNLPAEVXYFASAPGRMAAVWTAAAMARGRRGEGDTDVFLHDVDRRVEKAYAEEFLCERFRVGATGRLWHFRIPPASRRGNGTAAAGGAGAGDGRRPFC

SEQ ID NO: 59067 - protein, 81 aa, Zea mays
  misc_feature (27)..(27): Xaa can be any naturally occurring amino acid
GGAWDNAKKYIEAGASEHARTLGPKGXSDCHKAAVIGDTIGDPLKDTSGPSLNILIKLMAVESLVFAPFFATQGGLLFKYL

SEQ ID NO: 59068 - protein, 525 aa, Shewanella sp. MR-7
MINRGFMFDLFRHKTSSHKADILSGLTVALALIPEAVAFAFVANVEPMVGLYAAFIMGLVTALIGGRPGMISGATGAMAVVMVSLVVEHGVQYLFAAVVLAGLIQISAGVFKLGKFIRIVPYPVMIGFVNGLAIVIFLAQLGQFKVKNAAGELVWLPLEPLMLMLGLVALTMAIIYFLPKLTTAVPSSLVAILSVTAIVVGFDLDTRNVLDFLKTMSGDEHATIAGSLPSFAIPQVPFNLETLYIILPYAFILAAVGLIESLLTLTVIDEMTNTRGRSNKECIGQGVGNITSGFFGAMGGCAMIGQSMININSGGRGRLSGITAAIGLLTFILFGASFIEIIPLAALVGVMFIVVLGTFEWASFKFMGKVPKHDAFVIVLVTTVTVFTDLAFAVFVGVVVSALVFAWQHAKHISVKVTSNSLGWKVYELNGPLFFGSVASFLELFDASQDPQDVVIDFKHSRVADHSALDAIDTLAERYVAMGKKLHLVHLSADCKALLHKAGDLVEVNLLDDPHYKVADDKLDS

SEQ ID NO: 59069 - protein, 478 aa, Haemophilus influenzae Rd KW20
MSRRLRRTKIVCTMGPSTDRDNNLEKIIAAGANVVRMNFSHGTPDDHIGRAERVRSIAKKLGKTVAILGDLQGPKIRVSTFKDGKIFLNVGDKFILDAELPKGEGTQESVGLDYKTLPQDVVPGDILLLDDGRVQLKVLSTDGAKVFTEVTVGGPLSNNKGINKLGGGLSADALTEKDKADIITAARIGVDFLAVSFPRSSADLNYARELAQQAGLNAKIVAKVERAETVANDEAMDDIILASDVIMVARGDLGVEIGDPELVGVQKKLIRRSRQLNRAVITATQMMESMISNPMPTRAEVMDVANAVLDGTDAVMLSAETAAGQYPSETVAAMASVCLGAEKMPSINVSRHRMDKEFETIEESVAMSAMYAANHMKGVAAIVTLSSTGRTPLLMSRISSGLPIFALSRNQETLNLCALYRGVTPIYHGEESRTEAGAKAAPQSLKEKGYLSTGDLVLVTQGGQGATQTNVCRTLIVE

SEQ ID NO: 59070 - protein, 263 aa, Brucella suis 1330
MARSALLNVMVQAAMKAGRSLARDFGEVQNLQVSLKGPGDYVSQADRRAEQIVYTELSRARPDFGFLMEESGEVEAKDGQHRWLVDPLDGTTNFLHGIPVFAVSIALERQGQIVAGVIYNPAMNELYTAERGGGAFLNDRRLRVASRNKLVDSVIGTGIPHLGRGHHGHYLVELRNVMAETAGIRRMGAVALDLAYVAGGRLDGFWEEGMHPWDLGAGILMVREAGGFVSDKKGGQDIFSTQSIVAGNEAIHGALLKTLKKPI

SEQ ID NO: 59071 - protein, 577 aa, Chromobacterium violaceum ATCC 12472
MHLNDALAQQPDIAAVHCHHEQACGIAAEAYGRLAERTGVAMVTTGPGATNILTPVAGAWIESLPLLVISGQVKRADLLQGSGLRQKGVQEVDVVSMAKPVTKYAVTVTDPQAIRQHLEEALYLAHSGRPGPVWLDIPLDVQAAPIDPATLPGWQPEGETAPAAQDHVAAIADLLKQAERPLILAGHGVRIAGGADALRRLSETLQVPVAATWNAMDLMPWDSPLCAGRPGVVALRPGNFAVQNCDLLIAIGTRLDNILTAYNPKGFARAARKVVVDVDAAEIAKLEMEIDLPLAMDAKACLEGLLAAVERLPKAKWQSWLDRCADWKRRYPVQDGAPFPTSGQISHYHFVDALSDAAPENTLISTGSSGLAVEVFYTVFRNKPGQRVFLTSGLGSMGYGLPAAIGACLGNGSRPMIALESDGSLQLNLQELATLKALRLPIRLFIMNNNGYASIRNTQRNYFDSRYVGTGPEAGVLIPDLLELAEAYGLPAVRIERVEELAEGLAKVMAHPGPILCDVRLNENETLQPKAAALPQPDGSMLSMPLEDMSPLLPLEQLRAEMLIPLLPASEAAKRGV

SEQ ID NO: 59072 - protein, 418 aa, Bacteroides fragilis YCH46
MKIAVIGLGYVGLPLARLFSTKYQTIGFDMNQKRVESLMGGHDTTLEVTDVLLQAALDSGFKCTSNLEDIRDCNFYVIAVPTPVDRNNRPDLTPLISASETVGKVISKGDIVVYESTVYPGVTEEECLPVVERVSGLKFNLDFFAGYSPERINPGDKEHTVEKIKKVTSGSTPEIADIVDKVYNSVLINGTHKAPSIRVAEASKIIENSQRDVNIAFMNELAKIFNAMDIDTNDVIEAASSKWNFIKLRPGLVGGHCISVDPYYLIQKAQVYGVLPRIMSSARRLNDGMGDYVANQVIKLMNKKGVLVKDSNILLLGITFKENCPDIRNTKVVDIYSTLLEYTKNISVYDPWANAEKVYEEYGIRMIDNVNEKKYDAIILAVGHNEFKTIDIKALGNDISVVFDVKCFLDRAIVDGRL

SEQ ID NO: 59073 - protein, 122 aa, Populus trichocarpa
MALRAAVLRHVRVAVQTRELKSNPWAPSGSIRLMSSHDDHLTKEEVAERVLSVIKSFPKVDPSRVTPEVHFQKDLGLDSLDSVEIVMALEEEFKLEIPDKEADKIDSCNLAIEYIHNHPLAS

SEQ ID NO: 59074 - protein, 487 aa, Alteromonadales bacterium TW-7
MQLKNQNNKNQASTERTMSNNNSEYLAKRQLKSGTAGWLLLAGLGVSYVISGDFAGWNFGIAEAGWGGFAIAAVLMAIMYLTLVLSLAEMSAAIPAAGGGYSFARQAMGPAGGYLTGLAVLIEYALAPAAIVIFIGSAVEALTGFNGPWIYALFYLAFVGIHLAGVGEALKVMMVISGLAVLAIVATAIALVANFDPSNLFDVAVTDAAGASEFLPLGWYGVWAALPFAMWLFLAVEGVPLAAEEAKNPAKDVPKGIIGAMVFLLFTALLVVVLVPGAAGANAMGASAVPLVDALNATGNSSLATTVNILGLAGLVASFFSIIYGYSRLVFALSRAGYLPQSLSITTERKVPARALIVPAIFGFIASLSGEGDLMLAMAVVGATVSYALMALSHIMLRIKQPELVRPYKTPGGVVTSGIALVLSLVALTGVYAFDPRAFLYTVILFAFGAAYYFGYSSKRLVAKTADEEFAMLADAESDLAMAVNEG

SEQ ID NO: 59075 - protein, 182 aa, Populus trichocarpa
MASSSMISSAAVATVNRTPAQANMVAPFNGLKSAAAFPVSTRKANDITSIASNGGRVQCMQVWPPTGLKKFETLSYLPDLTEEELAKEIDYLLRSKWVPCLEFELEKGWVYREHHSSPGYYDGRYWTMWKLPMFGCTEASQVLLELEEAKKAYPNAFIRIIGFDNTRQVQCISFIAAKPKGV

SEQ ID NO: 59076 - protein, 192 aa, Escherichia coli
DERPGKINLGIGVYKDETGKTPVLTSVKKAEQYLLENETTKNYLGIDGIPEFGRCTQELLFGKGSALINDKRARTAQTPGGTGALRIAADFLAKNTSVKRVWVSNPSWPNHKSVFNSADLEVREYAYYDAENHTLDFDALINSLNEAQAGDVVLFHGCCHNPTGIDPTLEQWQTLAQLSVEKGWLPLFDFAY

SEQ ID NO: 59077 - protein, 194 aa, Escherichia coli
DERPGKINLGIGVYKDETGKTPVLTSVKKAEQYLLENETTKNYLGIDGIPEFGRCTQELLFGKGSALINDKRARTAQTPGGTGALRIAADFLAKNTSVKRVWVSNPSWPNHKSVFNSADLEVREYAYYDAENHTLDFDALINSLNEAQAGDVVLFHGCCHNPTGIDPTLEQWQTLAQLSVEKGWLPLFDFAYQG

SEQ ID NO: 59078 - protein, 512 aa, Arabidopsis thaliana
MDIISGQALLLLFCFILSCFLIFTTTRSGRISRGATALPPGPPRLPIIGNIHLVGKHPHRSFAELSKTYGPVMSLKLGSLNTVVIASPEAAREVLRTHDQILSARSPTNAVRSINHQDASLVWLPSSSARWRLLRRLSVTQLLSPQRIEATKALRMNKVKELVSFISESSDREESVDISRVAFITTLNIISNILFSVDLGSYNAKASINGVQDTVISVMDAAGTPDAANYFPFLRFLDLQGNVKTFKVCTERLVRVFRGFIDAKIAEKSSQNNPKDVSKNDFVDNLLDYKGDESELSISDIEHLLLDMFTAGTDTSSSTLEWAMTELLKNPKTMAKAQAEIDCVIGQNGIVEESDISKLPYLQAVVKETFRLHTPVPLLIPRKAESDAEILGFMVLKDTQVLVNVWAIGRDPSVWDNPSQFEPERFLGKDMDVRGRDYELTPFGAGRRICPGMPLAMKTVSLMLASLLYSFDWKLPKGVLSEDLDMDETFGLTLHKTNPLHAVPVKKRANIN

SEQ ID NO: 59079 - protein, 327 aa, unidentified eubacterium SCB49
MCVFLGYNFDPLYFCNTIVFDVENDLKNRIFFMVTTKKILLDTGYQFSLKREDLLFPDISGNKFRKLKYQLEKIKKSPVTTILTFGGAYSNHIAAVATAGKKYNLKTIGVIRGEELATKYLENPTLTYAEKQGMDLVFVSREAYKNKESQAYIESLKATYGAFHLIPEGGTNALAIKGCAEILQPEDANYDYICVPVGTGGTLAGIVTSLLPHQKAIGFSALKGTFQKEIVSSYTSNTNFEILDDYCFGGYAKIDETLVRFINTFKETHGVQLDPVYTGKMLYGIQDLMRKEYFRKNSSILAIHTGGLQGITGMNQRLQRRKLPIII

SEQ ID NO: 59080 - protein, 193 aa, Escherichia coli
DERPGKINLGIGVYKDETGKTPVLTSVKKAEQYLLENETTKNYLGIDGIPEFGRCTQELLFGKGSALINDKRARTAQTPGGTGALRVAADFLAKNTSVKRVWVSNPSWPNHKSVFNSAGLEVREYAYYDAENHTLDFDALINSLNEAQAGDVVLFHGCCHNPTGIDPTLEQWQTLAQLSVEKGWLPLFDFAYQ

SEQ ID NO: 59081 - protein, 457 aa, Campylobacter lari RM2100
MGQCPFHPKPYKNKASTLTTFLLKRRSWLDGLYERSYKMMMGRVKMPGFDLYVVNDPKEVRRIMVDEVREYPKSQLLHELLEPLLGISIFTTNDRVWEKQRELLRPSFEMTRISKVFNLMSEAASDMMARFAKYEDKAIVEVDEAMTFVTADVIFRTIMSSKLDEQKGKLVLDAFVTVQEETVKTAMRRMFRFPTWLSNLLGERKRLKAGGVIRKVLSDIIKPRYDNATNDQGKYEDILSSLLMVVDADTNERFSFNEILDQVAMLFLAGHETTASSLTWTLYILSISPNEQQKAYEEIMQVAGDEEFKIEHIRAMKYLTNVFKESLRLYPPVGFFAREARNDNKMRDKLIKKGSGVVVAPWLIHRHDSFWENPHEFDPSRHEDKSKIKKDTYMPFGMGERVCIGQGFAMQETVLILANILRTYKLELEENFIPDIVGRLTIRSANGMNIRFIKRQK

SEQ ID NO: 59082 - protein, 181 aa, Yarrowia lipolytica CLIB122
MGLYVSKLFQGLIGRKEMRILMVGLDAAGKTTILYKLKLGEIVTTIPTIGFNVETVEYKNVTFTVWDIGGQDRIRPLWRYYYQNTQGVIYVVDSNDRDRIPDAREELQRLLNDDELRDALLLVFANKQDLPNAMDAAEITEKLGLSSLRQRPWYIQATCATSGDGIYEGLEWLVTNLKNTT

SEQ ID NO: 59083 - protein, 191 aa, Escherichia coli
DERPGKINLGIGVYKDETGKTPVLTSVKKAEQYLLENETTKNYLGIDGIPEFGRCTQELLFGKGSALINDKRARTAQTPGGTGALRVAADFLAKNTSVKRVWVSNPSWPNHKSVFNSAGLEVREYAYYDAENHTLDFDALINSLNEAQAGDVVLFHGCCHNPTGIDPTLEQWQTLAQLSVEKGWLPLFDFA

SEQ ID NO: 59084 - protein, 578 aa, Escherichia coli O157:H7 EDL933
  misc_feature (296)..(296): Xaa can be any naturally occurring amino acid
MDATTIISLFILGSILVTSSILLSSFSSRLGIPILVIFLAIGMLAGVDGVGGIPFDNYPFAYMVSNLALAIILLDGGMRTQASSFRVALGPALSLATLGVLITSGLTGMMAAWLFNLDLIEGLLIGAIVGSTDAAAVFSLLGGKGLNERVGSTLEIESGSNDPMAVFLTITLIAMIQQHESSVSWMFVVDILQQFGLGIVIGLGGGYLLLQMINRIALPAGLYPLLALSGGILIFALTTALEGSGILAVYLCGFLLGNRPIRNRYGILQNFDGLAWLAQIAMFLVLGLLVNPSDLXPIAIPALILSAWMIFFARPLSVFAGLLPFRGFNLRERVFISWVGLRGAVPIILAVFPMMAGLENARLFFNVAFFVVLVSLLLQGTSLSWAAKKAKVVVPPVGRPVSRVGLDIHPENPWEQFVYQLSADKWCVGAALRDLHMPKETRIAALFRDNQLLHPTGSTRLREGDVLCVIGRERDLPALGKLFSQSPPVALDQRFFGDFILEASAKYADVALIYGLEDGREYRDKQQTLGEIVQQLLGAAPVVGDQVEFAGMIWTVAEKEDNEVLKIGVRVAEEEAES

SEQ ID NO: 59085 - protein, 386 aa, Coccidioides immitis RS
MVKLRSLRCPQYLPVSHILSMLSSLLRPHQLNLCKPLTSAKAFAIAAMSTESKITNWVDPNDKSGEFKRKPSAFRNWISREAGAQFPPEKGRYHLYVSYACPWAHRTLITRKLKGLEDFISITSVHWHMGEQGWRFVTPDEKLPGETHPDLLHNFSHIRQIYFESDKNYEGRFTVPALYDKKTKRIVSNESSEIIRMLYSEFDSLLPEKYRSIDLFPQNLRKDIEETNEWVYDTVNNGVYKCGFATTQEAYEAAIWPLFSSLDRIESHLASKYDPSDPSSIYFFGNTVTEADIRLYTTIIRFDPVYVQHFKCNVRDIRSGYPAIHRWLRHLYWDIPAFGETTDFEHIRKHYTKSHKQINQFAITPVGPVPDILGKDEEVGAVQKKI

SEQ ID NO: 59086 - protein, 891 aa, Kluyveromyces lactis NRRL Y-1140
MTSPQQTSVSGKEFDSLDGESSNQYSVGPDFDQLEQEYDDLKTSEIIAPHISNGHSISSSPRHHHLYEDRHLDSIIDTNTHGFKKHDNGNGKFADVNIEQIYNYDSLRVPNYEETVVDAKQLYDEKLRPYLTFSAIVEYLTSLFPLLKWVHHYNFNWLYNDLVAGITVGCVLVPQSMSYAQIATLPAQYGLYSSFVGAFIYSFFATSKDVCIGPVAVMSLETAKVIARVLEKVGEDNPEITAPIIATTLSLICGGVALGVGLLRLGFLVEFISLNAVAGFMTGSAINIMSGQVPGLMGYSKNVNTRDSTYKVIINTLKHLPDTKLDAVFGLIPLFILYSWKYFCGTLGPKLVDRYVARSDVKRAAAYKYILFYLQALRNAFVIIIFTLISWGITRHKAKEDLPISLLGTVPSGLKNVGVMKLPDGLVSNLASELPSAIIILVLEHIAISKAFGRVNGYKVVPDQELIAIGVTNLISTFFNAYPATGSFSRSALKAKCNVKTPLSGIFTGACVLLSLYCLTDAFYFIPKAALSAIIIHAVSDLVASYKTTWNFWLMNPLDFVCFIVTVIITIFSSIENGIYFAVCWSCALLLLKVVFPTGQFLGYVEICQVSNAEVDENIDRIVLSEDSQPKTIEDNVTKNNTAVKVGVVANESFGHSQLQYHTKWLPLNNHYQRELNPDVVVQAPPPGVIVYRPSESWTYVNCSRQYDTIFDRVKELTRPGKLLKHVSKHDKMWNDPGEWEPPFLVKKLFKLGNKHDLEGGEVIDERPVLKILAMDWSQVTQIDSTGVQNLVDLRKAINKYANRQVEFHFSGIISPWIKRSLINAGFGTVNEEFSDESIIVGHTSYSLVKNRPDLQDPEAALPEPIALHTALGVNLPFFHLEMPEFHKWHL

SEQ ID NO: 59087 - protein, 322 aa, Pichia angusta
TSVVCCVRFSKDGKFLATGCNKLTQVFSVETGDLVARLSDESSASSNGSYDTDTGDLYIRSVCFSPDGKFLATGAEDKIIRIWDLATRTIVKYLYGLVQDIYSLDFFPDGSKLVSGSGDRTVRIWDVFTGQCSLTLSIEDGVTTVAASPDGKLIAAGSLDRTVRVWDANQGFLVERLDSANESGNGHMDSVYSVAFTHDGKEIASGSLDRTVKLWSLKDLQKQQGSSKSNCEVTYVGHKDFVLSVCCTPDDEFILSGSKDRGVIMWEKATGEPYIMLQGHRNSVISVNVSPVMTQKRGVNGGYFATGSGDCKARIWRWEKVS

SEQ ID NO: 59088 - protein, 318 aa, Coccidioides immitis RS
MAADYWSSTQHQSWLFGREELAEARKVLGDAERPFIQQYPLPDLRLFNIYVNQQLIKLAKRLNVRQQALATAQVYVKRFYTKVEIRRTNPYLVLTTAFYLACKIEECPQHIRLVLGEARGLWPAIMENVATSTLTRSPEFIAPDSAKIGECEFWLISEMNSQLIVHHPYRTLSELQSYLSLTSDEIALAWSVINDHYLTDLLLLHPPHVISVMAIFIAVVFKPNQHQVVSISGGSSATGALRDGSTNILSAFNDKTGAGMPAKVQRIVDWLANSDINIEAVIECTQDIVSLYEVWEQYSEKVCKEQIGRYVKSRGLDK

SEQ ID NO: 59089 - protein, 521 aa, Alteromonadales bacterium TW-7
MNAHNIAFTAPHFSATEAGTFILKQGGTATEAMVAAAAAISVVYPHMNSIGGDSFWLIDNPNQSTPTAIDACGRAPNDISAYSNEQQIPERGGLSALTQAATLRGWQKALELDEHAALSLSTILAPAIKLAREGFTVTKSLQAGCEKLATVTSTNDAFKALYIPNGKPLQAGQHFKNPQLANTFEHLAKHGLNAFYEGELAESFAADLAKAGSIITPNDIANTQADVVSPLNANLSGINCYNLPAPTQGVHSLQIIGTVNKLKHKANTEADWTHLIVEATKQSFTHRPTLWADPKALGDDYKNALTDERLTELANNIDMNTAKKWPFDAQPGDTVWMAARDKNGQLVSFIQSIYWEFGSGILMSEGGFVWNNRGLSFSLNTKDTNALAPNKRPAHTLNPAMAKFDDGRRLAYGTMGGEGQPQTQAAVFAGYAWRNKSINQAVSDPRWLLGRTWGDTSTNLKIEHSLAAQIDNELNKRAHDWVSVEDNNEMMGHAGAILDTPTTLEAATDPRSDGRATVSST

SEQ ID NO: 59090 - protein, 117 aa, Glycine max
  misc_feature (40)..(40): Xaa can be any naturally occurring amino acid
VDIPTPLCSQLTYELLLHEFLRINSCPVESDASIMALHHXGRKLMCPLNSSDTRFKEIRDLNFEGVSHILRQKTTSMMQDYTEMTTSTHTTSKLQDFLKNLNSLSEMTRHINLSHFF

SEQ ID NO: 59091 - protein, 338 aa, Blastopirellula marina DSM 3645
MSHTVCLIEGDGIGAEITAAVQHIIAAAGVTIDWRPCLAGVTALEKTGSPLPPETIAAIKETGVALKGPLATAIGKGFRSVNVGLRQELQLYANFRPARTIPGVKTRYDNVDLIVIRENTEGLYSGLEHIVVPGVVESLRVITEKCSRRIAIFAFETARKYHRKTVTCVHKANILKLSDGLFLDTVRDVAKSYPDIELNDCIVDAAAMKLVMDPTQFEVLVMENLFGDIISDLASGLVGGLGVTPSGNYGDGYAIFEAVHGTAPDIAGKDMANPTALLLSATMMLKHLGETDAADRIESALLSVLQNPATRTGDLGGKLGTSKFAEAVAEACAVGSSG

SEQ ID NO: 59092 - protein, 524 aa, Bifidobacterium longum DJO10A
MSQPDTDTAAQSPSSQQEPQIQTDGRRSHSEQMNQPAQTSQSESSHDGKDEHALHTNLKRGMESRHLQMISLGGVIGTGLFLSSGYTIQQAGPIGTILAYSIGALIVYLVMLTLGELSVAMPVTGSFHVYAEKFIGPGTGFVIAIQYWLTWTVALGSEFTAAGLLMQRWFPDSPTWVWSAACIILIFTLNALSVRLFAEAEFWFASIKVFAICAFIVIGSLAIFGVIPVAGYQHAPMFVNLIKDGVFPNGFMPVFATILTVNFAFSGTELIGVTAGETRDPQTAVPKAIHTTLWRLVLFFIGSITVMCALIPWRKAGVGESPFVLVFNGIGIPYAGDIMNFVVLTAVLSASNSGLYASTRMVWSMGNEGMIPRWFAKTNRRGVPMLALCAAMAGGLLALLSSVIAASTVYLVLVALSGLSAVVVWIAIAYCQIVFRRRWLAAGHSTSELKYRTPGYPYVSWAAFILCTASFVLVIFDVEQRFALVAELVFIVACYGAYFLQQWVRKRKKATEADDLDTLWVARD

SEQ ID NO: 59093 - protein, 163 aa, Haemophilus influenzae Rd KW20
MRRILSVLLENESGALSRVVGLFSQRAFNIESLTVAPTDDPTLSRMTIEAVGDAQALEQIEKQLHKLVDVFKVVNLSEQEHIEREIVLAKVRAVGSSRDEIKRLADIFRGQIVDVTPKSYTIQLSGTNDKVDAFISALKEETTLLEIVRSGLISVSRGEKNIL

SEQ ID NO: 59094 - protein, 573 aa, Haemophilus influenzae Rd KW20
MKKLSGAEMVVQSLRDEGVEYVFGYPGGAVLDIYDAIHTLGGIEHILVRHEQAAVHMADGYARSTGKVGCVLVTSGPGATNAITGILTAYTDSVPMVIISGQVMSNLIGSDAFQECDMLGISRPVVKHSFIVKKAEDIPSTLKKAFYIASTGRPGPVVVDIPKDTVNPNFKYPYEYPEYVELRSYNPTVNGHKGQIKKALKALLVAKKPILFVGGGAITAECSEQLIQFAQRLNLPVTSSLMGLGAYPSTDKQFLGMLGMHGTLEANTAMHESDLILGIGVRFDDRTTNNLEKYCPNAKVIHIDIDPTSISKNVPVAIPIVGNAKNVLEEFLGLLNEEGLKSQTDLESWWQEINQWKAKKCLEFDRTSGVIKPQQVVEAVYRLTKGQAYVASDVGQHQMFAALHYPFDEPRHWINSGGAGTMGFGFPAALGVKLAHPEGTVVCVTGDGSIQMNIQELSTATQYGIPVVIICLNNHFLGMVKQWQDLIYSGRHSQTYMNSLPDFAKLAESYGHVGIKIATPDELESKLQEAFSIKNKLVFVDINVDESEHVYPMQIRGGAMNEMILSKPQEETN

SEQ ID NO: 59095 - protein, 331 aa, Clostridium difficile 630
MSIKKKVAIVFTGGTISMTVDDKVGAAIPTLSGEQILSMVTNIDKVADVEVFNFDEIPGPHITPYRMMELKNYVNDLLARKDITGVVITHGTDSLEETAYFLDLTIDNIKPVIVTGAMRSSSELGYDGSSNLSASVCTAVSKDAMGKGVLVVLNNEVLLASEATKTNTLSLNTFKSLTSGPLGIIDCNELVLTRDIVNRTIIDTDKVESKVALFKAYVGENADFIRFAVDSGYKGIVIEAMGRGNIPPQMLSGVEYAREKGLPVVIVSRCHSGRVFDSYGYFGSGRDLKNLGCIFGGDLPGQKARIKLILALGKTDNLDEIKDFFEKGIYC

SEQ ID NO: 59096 - protein, 340 aa, Xylella fastidiosa 9a5c
MIPVINQEKQGISGDFRLSVAPMMNWTDRYCRVFHRVLAPSARLYTEMVHAKAVIYGDRERLLGFASVEQPVALQLGGSEPALLAKAARIAVDWGYSEINLNCGCPSDRVQAGSFGARLMREPALVADCVAAMAAVVSVPVTVKCRLGVNEDDDYGRFAKFVDWVSRASSSRMIVVHARNAWLQGLSPKENREIPPLRYDWVYRLKRERPELAVVLNGGITSVEAGLDHLLMVDGVMLGRAAYQDPYILHQFDCALSNAPLLPRALLLRALRPYVEVWLEQGLTLRHIVRHLFGLFHGQPGGRVFRQVLTQGGQRSDADWSLVEQALSIIEDQETYAAVV

SEQ ID NO: 59097 - protein, 291 aa, Streptococcus pneumoniae R6
MKKQEKLALVESALEDFYGDQQFASSLRESVLYSIHAGGKRIRPFLLLEVLEALQVAIKPAHAQVATALEMIHTGSLIHDDLPAMDDDDYRRGRLTNHKKFGEAMAILAGDALFLDPYALIAQADLPSQIKVDLIANLSLASGSLGMVAGQVLDMEGEHQHLSLEELQTIHANKTGKLLAYPFQAAAIIAELSPEMQVKLKTVGELIGLAFQVRDDVLDVTASFEEIGKTPQKDLQAEKSTYPALLGLEESIAFCNQTLDQANEKLEEIAQQVPFETESIVSVVESLRING

SEQ ID NO: 59098 - protein, 266 aa, Triticum aestivum
MAATPLDSAWEWLITNFSEFQLATVVTFVLHESVFFLSGFPSLLFERLGLFAKYKIQKKSNTSAYQNRCVMRLILYHVCVNLPVMIFSYPAFKFMGLRSSLPLPHWTVIVSQVLFYFILEDFIFYWGHRALHTKWLYKHVHSVHHEYATPFGLTSEYAHPAEILFLGFATVVGPALTGPHLFTLWLWMVLRVLETVEAHSGYHFPWSPINFLPLYGGSDFHDYHHRVLYTKSGTYASTFVYMDWLFGTNKGYRKTKAIEGEEGKHL

SEQ ID NO: 59099 - protein, 290 aa, Chromobacterium violaceum ATCC 12472
MKKITKAVFPVAGLGTRFLPATKASPKEMLPVVDKPLIQYAVEEAIAAGMTELIFITGRNKRSIEDHFDKAYELETELEYKNKQKLLQLVQEIIPPSVSCIYIRQTEALGLGHAVLCARPVVGDEPFAVILADDLIEGAPGAMEQMVRLFDETHSSILGVETVAPEETGSYGIVKVAANAQGHQRVEHIVEKPRPEEAPSNLAVVGRYILTPRIFDKLVNTAAGAGGEIQLTDGIAALMKNEPVLALPFKGTRYDCGSKLGYLKATVNYGLKHNEVAGDFAAFLRELKLD

SEQ ID NO: 59100 - protein, 451 aa, Brassica napus
MAAATTTAASLACAHFLNQTKVHAFPSKTSVQVSQIIDGRKMRSATLFSAASTDKAITTAQSVSSTACDRVRRHTISVFVGDESGIINRIAGVFARRGYNIESLAVGLNEDKAMFTIVVLGTDKVLQQVVEQLNKLVNVIKVEDLSKEPHVERELMLIKLNADPTTRSEIMWLVDIFRAKVVDTSDHTLTIEVTGDPGKMVALTATLEKFGIKEVARTGKIALRREKMGETAPFWRFSAASYPHLVNQSSHETVAANTKRALTGGNGTASSGGDVYPVEPYNDFKPVLDAHWGVVYDEDSDGLRSHTLSILVANVPGVLNLITGAISRRGYNIQSLAVGPAEKEGLSRITTVIPGTDENIDKLVRQLQKLIDLHEVQNITRMPFAERELMLIKVAAHTSARRDVLDIAQVFRAKAIDVSDHTITLEVTGDIRKMAALQTQLEVYGICEVAR

SEQ ID NO: 59101 - protein, 485 aa, Zea mays
  misc_feature (240)..(240): Xaa can be any naturally occurring amino acid
MAPAPHNGVNNNHPVVPMEVSVEAGNAGAAEWLDDDGRPRRSGTFWTASAHIITAVIGSGVLSLAWAIAQLGWVAGPAAMLLFAFVTYYTATLLAECYRTGDPDTGKRNYTYMDAVRSNLGGAKVAFCGAIQYANLVGVAIGYTIASSISMQAVSRAGCFHKRGHAVPCKSSSNPYMILFGAVQILFSQIPDFDQIWWLSIVAAVMSFTYSAIGLSLGIAQTVANGGFKGSLTGISIGAXVTSTQKVWHSLQAFGDIAFAYSFSNILIEIQDTIKAPPPSESKVMQKATRLSVATTTIFYMLCGCMGYAAFGDKAPDNLLTGFGFFEPFWLIDIANVAIVVHLVGAYQVFCQPIFAFVERRAAAAWPDSAFVSQELRVGPFAVSVFRLTWRSSFVCVTTVVAMLLPFFGNVVGFLGAVSFWPLTVYFPVEMYIKQRRVPRGSTKWICLQTLSVSCLLVSVAAALAGSLEGPDAFAALKVYHPFSS

SEQ ID NO: 59102 - protein, 523 aa, Propionibacterium freudenreichii
AENNNLKLASTMEGRVEQLAEQRQVIEAGGGERRVEKQHSQGKQTARERLNNLLDPHSFDEVGAFRKHRTTLFGMDKAVVPADGVVTGRGTILGRPVHAASQDFTVMGGSAGETQSTKVVETMEQALLTGTPFLFFYDSGGARIQEGIDSLSGYGKMFFANVKLSGVVPQIAIIAGPCAGGASYSPALTDFIIMTKKAHMFITGPQVIKSVTGEDVTADELGGAEAHMAISGNIHFVAEDDDAAELIAKKLLSFLPQNNTEEASFVNPNNDVSPNTELRDIVPIDGKKGYDVRDVIAKIVDWGDYLEVKAGYATNLVTAFARVNGRSVGIVANQPSVMSGCLDINASDKAAEFVNFCDSFNIPLVQLVDVPGFLPGVQQEYGGIIRHGAKMLYAYSEATVPKITVVLRKAYGGSYLAMCNRDLGADAVYAWPSAEIAVMGAEGAANVIFRKEIKAADDPDAMRAEKIEEYQNAFNTPYVAAARGQVDDVIDPADTRRKIASALEMYATKRQTRPAKKHGNFPC

SEQ ID NO: 59103 - protein, 562 aa, Myxococcus xanthus DK 1622
MSHQPKPLSEVEHIKTQSRLLRGSLAESLEDPVTGGLATPDTNLIKFHGSYQQDDRDVREERRQQKLEPDYSFMLRTRLPGGVCTPAQWLVMDALAREHANHTLRITTRQAFQLHGVIKDDLRPTIARINEAMMDTLAACGDVNRNVLCNPNPVDSRVHETVYQWAVRISEHLLPKTRAYYEVWLGKEKVAGGEDEPIYGATYLPRKFKAAVAVPPLNDVDVFAQDLGFIAIIEGDALVGFNVSVGGGMGATHGDAATYPRLADVVGFIPPEQTLAVAEEVVKIHRDFGDRTNRKHARLKYVLEERGVPWFTAELEKRLGFPLQPARPFAFEHNGDRFGWTEGHDGRWHLTLHLDSGRVADRPGAPHLTGLREIARIHTGDFRLTANQNLVIAGVTPEARDAIGALVTAHALDSFRSASPVRRNALACVALPTCGLAMAEAERYLPTFVGRLEDRLRAHGLQDANLLLRITGCPNGCARPYLAEVGLVGKAPGRYNLHLGGDARGQRLSHLYRENIDEDAILAALEPLFEGYARERQPGEGFGDFVVRAGHVPSPAVQPRPS

SEQ ID NO: 59104 - protein, 192 aa, Escherichia coli
ERPGKINLGIGVYKDETGKTPVLTSVKKAEQYLLENETTKNYLGIDGIPEFGRCTQELLFGKGSALINDKRARTAQTPGGTGALRVAADFLAKNTSVKRVWVSNPSWPNHKSVFNSAGLEVREYAYYDAENHTLDFDALINSLNEAQAGDVVLFHGCCHNPTGIDPTLEQWQTLAQLSVEKGWLPLFDFAYQ

SEQ ID NO: 59105 - protein, 536 aa, Myxococcus xanthus DK 1622
MHFELAFVLIFAIATAVAIAARYFKIPYTVALVVAGLLLGTFKAFEPPHLTKELLFAIILPGLLFEAAFHVEFRKFWKNKMAIHALAIPGLLASAGLTAFILTRVVDGLDFVHGFGMLSALVFASVIVSTDPIAVVALFKSLGAPKRLLILVEGESLLNDGSAVVLFTLIVAVATGGQFTVGGALFDFIKVFGMGVLMGSAVGFAVAQVIKRVDDAMVEITLTVIAAYGSFVLAEHFHYSGVIASVVAGMLCGNWATHEGMSPATRIAVESFWEYLAFALNSVVFLLIGLEVQLSSLLASWKPILAAYVAVMVARAVVVYGVSALLRFTKEKMPWTWSAVLTWSGLRGAISMVLVLGLPTDFPHRELLVNMTFGVVVLSIIFQGLTMAPLLRKLRITGLKDAFQEQYELARGRLGAIHAAQAALESMRRAREIPGDVVTQLEKDYQEKEVVAEKELTALKQQSMRFHEEEHQEAVRRVLIVEKAALLKAYQSATIGKEAFARLTADLDERIAAADAAENHVPPEGETPAVAGAASA

SEQ ID NO: 59106 - protein, 190 aa, Escherichia coli
ERPGKINLGIGVYKDETGKTPVLTSVKKAEQYLLENETTKNYLGIDGIPEFGRCTQELLFGKGSALINDKRARTAQTPGGTGALRVAADFLAKNTSVKRVWVSNPSWPNHKSVFNSAGLEVREYAYYDAENHTLDFDALINSLNEAQAGDVVLFHGCCHNPTGIDPTLEQWQTLAQLSVEKGWLPLFDFA

SEQ ID NO: 59107 - protein, 200 aa, Zea mays
MAEPGLEGSQPVDLSKHPSGIVPTLQNIVSTVNLDCKLDLKAIALQARNAEYNPKRFAAVIMRIREPKTTALIFASGKMVCTGAKSEQQSKLAARKYARIIQKLGFPAKFKDFKIQNIVGSCDVKFPIRLEGLAYSHGAFSSYEPELFPGLIYRMKQPKIVLLIFVSGKIVLTGAKVREETYTAFENIYPVLSEFRKIQQ

SEQ ID NO: 59108 - protein, 508 aa, Zea mays
MGRNLPAEQVEAPRSSKMDKKRKKDKKRKLAAEAEEEAAVTATVETVKSSKKKRVENEPGAGAVEAENGAEKTVAVTGKGSEDPKYAPLRSFSAAELPSQVLECCSAFARPSPIQAHAWPFLLDGRDFIGIAATGSGKTIAFGVPALMHIRKKVGGKAGKKAVPRCLVLSPTRELAQQIADVLSEAGAPCGIKSVCLYGGTKKEPQISALKSGVDIVIGTPGRMKDLIEMGVCCLNEVSFVVLDEADRMLDLGFEPEVRAILSQTSSVRQMVMFSATWPLAVHKLAQEFMDPNPIKVVIGSEDLAANHDVMQIVEVLDDRTRDSRLLALLDKYHQAQSNRVLVFVLYKKEAARVETMLQRRGWKAVSVHGDKAQHDRTKALSLFKEGKCPLMIATDVASRGLDIPDVEVVINYSYPLTTEDYVHRIGRTGRAGKKGVAHTFFTQANKALAGELVNVLREADQVVPPALMKFGTHVKKKESKIYGSHFKELTADAPKSTKITFGDSDED

SEQ ID NO: 59109 - protein, 186 aa, Escherichia coli
RRGKINLGIGVYKDETGKTPVLTSVKKAEQYLLENETTKNYLGIDGIPEFGRCTQELLFGKGSALINDKRARTAQTPGGTGALRVAADFLAKNTSVKRVWVSNPSWPNHKSVFNSAGLEVREYAYYDAENHTLDFDALINSLNEAQAGDVVLFHGCCHNPTGIDPTLEQWQTLAQLSVEKGWLPLF

SEQ ID NO: 59110 - protein, 291 aa, Candida glabrata CBS 138
MEKLLHWSIANAQGDKEAIEKAGAPDPKLLEQLFGGGGPDDPTLMKEAMAVIMNPEADLENKLIAYDNFEMLIENLDNANNIENMKLWEPILKTLEDNEADLRASGLSVIGTAVQNNTDSQTNFLKYEGGLKILIAIAKSSEEPSDVRIKAFYALSNLLRNHIEAGKKFQALGGLDVFPVALNDPKATPKLKMRAISALSAFLSSSKIDEQLLDTLRKDGVLVSVIENLGTDNVNVIDRVLSVLSHLISSGIKFNDSELEMLQKEFEKIDSLKDRLNEDDYLAVKYVFSKK

SEQ ID NO: 59111 - protein, 312 aa, Oryza sativa Indica Group
MAAAWAAVVAVMLLLAQVSAAAPVMGPAFLWAPKNYGFSSDEAKEIVHYQTVSPKSLVKSVLEEGGWSNLVCSREDHAKSVDVAVLFLGSKLQSSDISKDKQADSTLVDTLKNSFASSEFSMAFPYIAMSDDDKLEKSLLSGFAENCNNGFGDNHITYTDTCSVSEDLNKHHNMDSIHGLVASQTKKNPSGQTDLIVFCDGGFKDNTKSEGELLSELVTLLKKTGAKYTILYASQPFGLLENPSNLPLGRYLAEKTNTTKPGRGKCDGECLVKSTLLEGSFVGIVLLIILISGLKCMMGIDTPSKFDSPPES

SEQ ID NO: 59112 - protein, 190 aa, Escherichia coli
RPGKINLGIGVYKDETGKTPVLTSVKKAEQYLLENETTKNYLGIDGIPEFGRCTQELLFGKGSALINDKRARTAQTPGGTGALRVAADFLAKNTSVKRVWVSNPSWPNHKSVFNSAGLEVREYAYYDAENHTLDFDALINSLNEAQAGDVVLFHGCCHNPTGIDPTLEQWQTLAQLSVEKGWLPLFDFAY

SEQ ID NO: 59113 - protein, 466 aa, Mesorhizobium loti MAFF303099
MDNAIVTSPSGSSPAEAQAFLDAHPEIEAFDIVLTDANGVGRGKIVRRHELKSIFEGGRHMPISILGLDITGEDVHETGLIWTTGDGDLRAWPIPGTLVPLYGTNPPRGQVLMAMYHLDGQPMSSDPRLALARQVDILAAKGLYPAGAFELEFFLLANERDADGKVQPARAVLDGRVSGKTEVYSVDHLHGMEPLFSDIYAAAKAQGIPAETVISEYAPGQYELTLNYRKDVMRAADDLVMLKRLVRAQARRHGVTACFMAKPIEKYAGSGMHFHVSLQDKAGRNVFAEAGGESWSLPLLQGLGGLIQTMAESMLVFAPHANSWRRFVSQSYAPVAPTWGVNNRSVALRVPAGDAKNRRIEHRPSGVDANPYLIAATVLAGIVKGLDEGLDPGPETTGNGYEAAVTRTTMPADWRAAIEAAKASSFLKGALGEDLHRTFVAIKQSEYLRVARTVSELDYHLYLHEV

SEQ ID NO: 59114 - protein, 331 aa, Pyrobaculum aerophilum str. IM2
MKPVVKIGGSLLRSAADFVQAAHFVAAYSEPPVVVVSAVKGVTDLLLQLEKTRSYLLYEELAHRHISIARGLGVEERIAPLLKELEYALRLPHAPWSADYFASFGERLSATMLHAVLEKMGIEAKLFIAPMLTDSNYGNAEPIALEHKEEMSRPDAVAVVTGFIGRDKEGRFTTVGRGGSDYTATYIGKELGARKVSLVTDSPGVMTADPREVQEAYVLPLLSVQEAVEAAKVGAKNFHPRTFIPVVEAGRMAVEVRSYYSRGTLIAHIYPPPPYKIVVRCGQGSCVVGLAAYELTKLGGTPLGQYSVKLNIPPRQVHEHLILPYIKYINT

SEQ ID NO: 59115 - protein, 231 aa, Kluyveromyces lactis NRRL Y-1140
MKRYSVSYVEVWDGDRVLSSWYDSKDENNSKYGSTDKGRADQKAVFHRLIGDMVIRTVVNLPGNKVTKTSIDLIEGYDCYYTTAENNKVLICFVKEEVPKFLPLRLLSELKCLNNDNDEYLKSNIDNQLDKFHEELLSYRTEGQQTAASTEEELQNIIAIMNDNIDKFLQRQERISLLVDNTNQLNENSFKFQRKSSKIMRKMWWNNVKFYSIVIIVVLAIIVIVSLLLLH

SEQ ID NO: 59116 - protein, 348 aa, Pyrobaculum aerophilum str. IM2
MLEVEVRNKVWAPKGNGIWRYSTMLPLKSGISLGEGRTPLVKSNLAENLYVKFEGANPTGSFKDRGMALGVTVAKESGANKVVVASTGNTAASAAAYAARAGLRCYVVLPKGNVARGKLIQAALHGAELVMINGLFDKALDYVVNYGTKYAYPLNSFNPWRLEGQKTVAFEIYEELGCPDYVIVPVGNAGNISAIWKGFRELAELGLCNKLPKMVGVQAEGAAPLVEAWARGVEEPLFVDEPNTVATAIKIGRPINWPKALRAVKESGGFFVKVSDGEILKAQRLLATRDGIGAEPAGAASIAAAIKLNIGGVAVAVVTGHALKDPDVIEITAKEVRNADELIELLEK

SEQ ID NO: 59117 - protein, 501 aa, Kluyveromyces lactis NRRL Y-1140
MRPTQIRLIKVNPDKIRRVAVIGAGPVGSGLTKALLNEKHFESVKVFEKRSNFGGLWNYTKPLLKDSNVTSSPSVPCEYPHIRIQPQPHPEETHVFQTAVYKYLDTNVPKTLMEYKGHRFPTDTPLFPVREQVLDYIMKYSKPIEKYVTFNSEIVKVSYEDATAEYSVKAQNLLSKEITEEKFDAVAVATGFYDLPFIPSRPGLKEWNVKYPCSVSHAKDFDCPEDFHGVEGEILIVGNSASGADLAFELANELQKPIYKSKRSESKLPAPFDPFIKDVPDIREFNPSTKSITFVDGTELKNVEKVIFCTGYLKSLPFLPQNESGVGNSILNNLIGDGRRVQNLYNHILPISLPTFGIIGLPRFVLPTRLSETQGAWLSRVWSGRIQLPSEELQQKYHDWFIEKSGDGSKYHDLAFPWDVQYSQRLNREIRHAGNGGYFGVEWKGDQIRARSAINAIKEGYVAYYKATGTKAKTLDELLESGYLKWPEDSKSCVQIPTFVP

SEQ ID NO: 59118 - protein, 104 aa, Brassica napus
  misc_feature (67)..(67): Xaa can be any naturally occurring amino acid
GRVGLGAVQLAKISYGANINIIVTGHSMGRSMAAFCGLDLVVNEGEESVQVMTFGQPRVGNAAFASXYSLLVPNTFRITHEHDMVPHLPPYYHIFPQKTYHHFP

SEQ ID NO: 59119 - protein, 799 aa, Burkholderia vietnamiensis G4
MTNAANVAKDQAYVIPFEQLRMTDVEIVGGKNASLGEMISQLSEAGVRVPTGFATTALAFRDFLKHNDLTDRIAKRLESLDIDDVKALAEAGAEIRKWIVDAPLQARLEQEIRAQFEILKSGSPAELSFAVRSSATAEDLPDASFAGQQESYLNVVGIDDVLDRMKHVFASLYNDRAISYRVHKGFTHAEVALSAGVQRMVRSDVGAAGVMFTIDTESGFKDAVFITSSYGLGETVVQGAVNPDEFYVFKTTLAQDKYPIIRRSIGSKLIKMEFTQPGEPGRVKTVDVSHEQRNRYSITDEDVIELAKYAVIIEKHYQRPMDIEWGKDGRDGKIFILQARPETVKSQASGKAEQRFKLKGQSQVLATGRAIGQKIGAGPVRVIQDPSEMERVQPGDVLVADMTDPNWEPVMKRASAIVTNRGGRTCHAAIIARELGVPAVVGCGDATDVLKDGALVTVSCAEGDEGKIYDGLLETEVTEVQRGELPEIPVKIMMNVGNPQLAFDFSQLPNAGVGLARLEFIINNNIGVHPKAILEYPNIDQDLKKAVESVARGHASPRQFYVDKLTEGVATIAAAFYPKPVIVRLSDFKSNEYKKLIGGSRYEPDEENPMLGFRGASRYIAEDFAQAFEMECRALKRVRDEMGLTNVEIMVPFVRTVKQAERVVGLLEKFGLKRGENGLRLVMMCEVPTNAILAEEFLQHFDGFSIGSNDLTQLTLGLDRDSGMELLAVDFDERDPAVKFLLKRAIDTCRKMGKYVGICGQGPSDHPDFAQWLADEGIVSISLNPDTIIDTWQALAKRK

SEQ ID NO: 59120 - protein, 335 aa, Brucella suis 1330
MAVRVAINGFGRIGRNILRAIVESGRTDIQVVAINDLGPVETNAHLLRYDSVHGRFPKEVKVAGDTIDVGYGPIKVHAVRNPAELPWKEENVDIALECTGIFTSRDKAALHLEAGAKRVIVSAPADGADLTVVYGVNNDKLTKDHLVISNASCTTNCLAPVAQVLNDTIGIEKGFMTTIHSYTGDQPTLDTMHKDLYRARAAALSMIPTSTGAAKAVGLVLPELKGKLDGVAIRVPTPNVSVVDLTFIAKRETTVEEVNNAIREAANGRLKGILGYTDEKLVSHDFNHDSHSSVFHTDQTKVMDGTMVRILSWYDNEWGFSSRMSDTAVALGKLI

SEQ ID NO: 59121 - protein, 395 aa, Brucella suis 1330
MFRTLDDANVQSKRVLVRIDLNVPMANGEVTDLTRIERIVPTIAELSRKGAKVILLAHFGRPKGVASDENSLKHVVKPLSKVLDHSVHFAEDCIGDKAKAAVDALKDGDVLLLENTRFHKGEEKNDPEFVQALAANGDLYVNDAFSAAHRAHASTEGLAHVLPAFAGRAMQAELEALEKGLGNPARPVVAIVGGAKVSTKLDLLSNLIEKVDALVIGGGMANTFLAAKGLDVGKSLCEHELASTAREIMAKAETTKCAIILPVDAVVGWHFAADTPHQTYGVDSVPGDAMILDAGELSTDLIASAIDDAATLVWNGPLGAFELRPFDTATVKVARHVAKRTKEGKLVSVGGGGDTVAALNHAGVVDDFTYISTAGGAFLEWMEGKPLPSVDVLKK

SEQ ID NO: 59122 - protein, 75 aa, Triticum aestivum
  misc_feature (32)..(32): Xaa can be any naturally occurring amino acid
  misc_feature (37)..(37): Xaa can be any naturally occurring amino acid
  misc_feature (44)..(44): Xaa can be any naturally occurring amino acid
  misc_feature (55)..(55): Xaa can be any naturally occurring amino acid
  misc_feature (60)..(61): Xaa can be any naturally occurring amino acid
  misc_feature (64)..(64): Xaa can be any naturally occurring amino acid
  misc_feature (71)..(71): Xaa can be any naturally occurring amino acid
MKLNIANPTTGCQKKVEIDDDQKLRNFNDKRXSQEVXGDLPGEXFKGYISRSWGXGCDSXXSPXKQGVLLXGPLV

SEQ ID NO: 59123 - protein, 471 aa, Pseudomonas putida GB-1
MTPDKKVKILATLGPAINGIDDIRQLVEAGVNIFRLNFSHGEHADHALRYQWIREVEQQLNYPLGILMDLQGPKLRVGRFAEGKVQLQRGQALRLDLDKTPGDNRRVNLPHPEIIAALEPGMDLLLDDGKLRLRVTAKHSDAIDTEVLNGGELSDRKGVNVPQAVLDLSPLTEKDRRDLAFGLELGVDWVALSFVQRPEDIVEARQLIGDRAYLMAKIEKPSAVEQLQAIAELADAIMVARGDLGVEVPAESVPQIQKRIIGTCRQLGKPVVVATQMLESMRFSPAPTRAEVTDVANAVAEGADAVMLSAETASGDYPLEAVQMMSKIIRQVENGPDYQAQLDVGRPKAEATVSDAISCAIRRISGILPVAVLVNYSESGASTLRAARERPRAPILNLTPNLNTARRLSVAWGVHSVVNDRLRQVDEVVSTALEIAQAQGMASRGDTLLITAGVPFGKPGSTNTLRIETLI

SEQ ID NO: 59124 - protein, 503 aa, Muscari armeniacum
MSFTDHHYLLLILFLIPILVYTIRRKISSTKSKLPPCPPKLPLIGNLHQMGTLPHQSLHALSVKYGPLMLLKLGQIPTLIVSSADMAREIMKTHDHIFASRPSLMTAGIILYGSMDVVFAPYGEHWRQMRKLCVNHLLSPKAVQSFRRMHEEEVATMVAKISEVSSSSGVVNMSETLNLFASNAMLKAISRKLFRDERRSRVICELNEETAAILGQFSVSDFMPLLAWFDMVFGVGARAKKTARLWDRVLHEIIEDCRNRRDSEVNTDFVNVLLALLEDNDMDFSLNKDIIKAVLQDMIAAGTETSSTAMDWCMAELVRNPEAMKKLQDEVRGIANTKPMITDDDLSKMGYLKAVIKELLRLHPPVPLLIPRESMDHCEVQGFDIPKQTRVIVNAWSIGRDPNVWEAPEEFRPERFLDCAINFRGHDFELIPFGAGRRICPGMQFAVSTLELALANLVRSFDWELPDGMNNEDLGMGDGPGLSARRRQSLLLVAKPFLGLKCM

SEQ ID NO: 59125 - protein, 745 aa, Chlamydomonas reinhardtii
MGVRADELTQAGGTTTDTITTVQWLPSCQLLASRVCAPTLLSVGLAAVEATQAVVAATGATGAEAEAQQEAALLALHAATSEPGRKLLAASLAALRCAAAHPTNASAVADCGRAAIAASPSAAAALVGALGPPPCAGLAATPSACAAAPGCRVVPHGDHSDCEPAATYTALYLTANSTSTAATTTMSTASAASATAAREPTALAAAVQRLADSCASLLPPPADDAAAGSASASGAVALACGRAELRGAVVGPEQLEALELVAEGEHHIHEGEEAGDEEGHDHEGEGQGGAVKEGAADGHAHDDDDHAHEDELHHSQADDAQNLRIASVFIVLTAALLGCTLPWVMRGWAERHPLLGASLRCMSAGVILCLALVHVSTHAIEEMSGLLPLPYAGDLAGLLGLLDLGGLAAGVAAEEAEHHAAELESGHSAHQHPFPIGMCCVMFGFLLMAGAEMLVHAAIEARADKAAAAAAERMYAAEKQKQAAVAGEAADGAKLAAVPDVEAAGAGVAGGGGGMLRHQATSNSAQLGGDGGCDMRLDVLAVGGVAPACSSSGPPVGLVVVGTPARLAGLAALFELGCVFHSFIIGLSLGVLTQRGEVAAMLVALCIHQFAEGISLVSILMAAGLAGWRLAGMAAAYSVMAPAGIAVGIAVSDTYNGESVTARAVQGTINGVSGGVLLYLAAVMITAELAPSATTAGGMAAPAAAAGSSCCGAPPPRRWRGWERALLFAIVCVSAGAFAVLAQWA

SEQ ID NO: 59126 - protein, 191 aa, Escherichia coli
RPGKINLGIGVYKDETGKTPVLTSVKKAEQYLLENETTKNYLGIDGIPEFGRCTQELLFGKGSALINDKRARTAQTPGGTGALRVAADFLAKNTSVKRVWVSNPSWPNHKSVFNSAGLEVREYAYYDAENHTLDFDALINSLNEAQAGDVVLFHGCCHNPTGIDPTLEQWQTLAQLSVEKGWLPLFDFAYQ

SEQ ID NO: 59127 - protein, 228 aa, Triticum aestivum
MVSSCLASPATARGGSALRLQLQPRGCRVTCLADAGGAGSGGRAKAVGGFACGLLAAWAVASAPSPVIAAGQRLPPLSTDPKRCEAAFVGNTIGQANGVYDKVLDLRFCDFTNDKDNLKGKTLSAALMSGAKFDGADLTEVVMSKAYAVGASFKGTNFTNAVIDRANFGKADLEGAIFKNTVLSGSTFDEANMKDVDFEDTLIGYIDLQKLCRNTSINEDTRLELGCR

SEQ ID NO: 59128 - protein, 111 aa, Puccinia coronata var. lolii
CGEEGHYSRDCTQAGGGDGGGDQGYQSYSGSRGRGGGTRTCYTCGGFGHLSRDCTGDQKCFNCGEVGHVSRDCSRPQAKNCYAVRTIRPHQQRLLDPGALGLGPIPLSLTS

SEQ ID NO: 59129 - protein, 180 aa, Escherichia coli
PGKINLGIGVYKDETGKTPVLTSVKKAEQYLLENETTKNYLGIDGIPEFGRCTQELLFGKGSALINDKRARTAQTPGGTGALRVAADFLAKNTSVKRVWVSNPSWPNHKSVFNSAGLEVREYAYYDAENHTLDFDALINSLNEAQAGDVVLFHGCCHNPTGIDPTLEQWQTLAQLSVEKG

SEQ ID NO: 59130 - protein, 380 aa, Clostridium difficile 630
MNKKINYAPGPTETRENVRLARAEKTTNPDIDIDFVEFYKKTCEKFGNIIGTKNDVYILSGEGILGLEAACASLTEKGDRVLVIDNGIYGEGFKDFVTMYGGEYVLFSSEYTKSIDIDELKAFLDEDSNFKYATVVHCDTPTGVLNDVSKICPLLKKYGILTVVDSVAGMVGERLSVDESKIDIILGGSQKAISAPAGLTIVGISQDAKNCIKNRKTDVIGFYCNLNIWEGYYEKKYFPYTMPISDIMGLDKALDNILEEGIENVLNRHEKIAYSVRKSIEEYGLELFLEEGYSNTVTAIKIPESIGALELTDYMLKNYNTLVATSLNQYMDTILRIGHMGENANLNKIEHVLNVLDKSLSALGFKGNGNLLNLFNKYYF

SEQ ID NO: 59131 - protein, 532 aa, Oryza sativa Japonica Group
MPSCAAGRRRSPVSAVAGSAGAGGTTRSERRVPLWNLSNVVGGRARAAKAEKSSLTGRVANVKKGFLAVADVGFYRWGWITDRSIKKEPDIAPSLFVGSAPAFQSPCKPNISDLNGNDNNSAHHDRGGEKDLSVTRVGHHDCSPGLSDNSMSKEDAMSTGDSTESLDIDCLDDGDSEVVSSLQHLADDKLHISDNRDVAGVASKWTKHGCNSVEIDYIVDIDNNHEDPQLCATLAFDIYKHLRVAEQTKKRPSTDFVETIQKNIDTSMRAVLIDWLVEVTEEYRLVPETLYLTVNYIDRKYEEICPPQVEELCYISDNTYTKDEVLKMEASVLKYLKFEMTAPTTKCFLRRFLRAAQVCHEAPVLHLEFLANYIAELSLLEYSLICYVPSLIAASSIFLAKFILKPTENPWNSTLSFYTQYKPSDLCNCAKGLHRLFLVGPGGNLRAVREKYSQHKAQLPRANLMAKAHGSSSTFQFEKWRLRNLSLRKMENERRCARFCHQDGTRQLTPWDVLKAHDNEKLRASRKIVKIE

SEQ ID NO: 59132 - protein, 181 aa, Escherichia coli
IGVYKDETGKTPVLTSVKKAEQYLLENETTKNYLGIDGIPEFGRCTQELLFGKGSALINDKRARTAQTPGGTGALRVAADFLAKNTSVKRVWVSNPSWPNHKSVFNSAGLEVREYAYYDAENHTLDFDALINSLNEAQAGDVVLFHGCCHNPTGIDPTLEQWQTLAQLSVEKGWLPLFDFA

SEQ ID NO: 59133 - protein, 261 aa, Pyrobaculum aerophilum str. IM2
MIVVKIGGSVVCKDASKVIQNLPKYADRAVVIHGGGCLVNELLKRMGIEPKFLTHPGGLVSRYTDWETLKVFVMAMGWINKYIVASLHGLGVQALGLTGADLGVVVAKRKERVLVIDERGRQRVVDGGYVGKIAEIRVDKLTPPPLKVLAPVAVSEKGELLNIDGDQLAFDVAREAKAERLILLSDVEGLILGGKVVPRLTPEEAEKLVKSEEVRGGMKRKLLMASEAAKLGIEVVISSGLVDSPIDAALNGAGTHIIKNI

SEQ ID NO: 59134 - protein, 754 aa, Streptomyces avermitilis MA-4680
MADTRLVQGRYRLLDLIGRGGMGEVWRARDESLGRQVAVKCLKPLSTHHDQSFTRVLRERFRREARVAAALQHRGVTVVHDFGESDGVLFLVMELLEGRNLSQLLEDNKHHPLPVADVVEIAEQVAAALAYTHQQGIVHRDLKPANIMRLADGTVKICDFGIARLGHDIGFTARLTGTGIAMGTPHYMSPEQISGSPVDQRSDLYSFGCVLYEIATGAPPFDLDDAWAILIGHRDTPPDPPRGHRPELPAYFEKIILDLLAKLPDERPHDARELARRIGAGRGTPAYVPTVVTSSPLPDLSAPPAPSRPERRLSREPRLPSWTRGMTTGHKATGTGLGAAPPDAGAGLTGEWVARPDTGRAPAPVRSERPTPSPELVSTLTGRHNAGLSLGRLGRWAEAGEVHRAVAAEREHALGPDHPDTLASRYEVGFTLSRTGRPADALREYAHVAQARERVLGADHPETLAARQEMAYVLGQLGQHFDAHQVYTSVLAARERTMGPDHPDTLRCRHNLAFNLSRLGRLEDSYRMAREVAAARARVLGATHPDTLVTRYEVAYALGQLGRWPEALAAYQEVAEARAQALGPDHADTLAARYEVGISLGRLGRSAEALKLYRDLVEDRTRVHGPAHPETLRARHGLGVNLGRLGRWEEALAESRDVCALRERVLGADHPDTLVSRREVAVGLGWLGRWSDALTEYRHVATAREHVLGPDHPDTLASRNDEAHCLEQLGRGQEAVELYRRVAALRQRRASGGH

SEQ ID NO: 59135 - protein, 382 aa, Mycobacterium tuberculosis H37Rv
MARDYYGLLGVSKNASDADIKRAYRKLARELHPDVNPDEAAQAKFKEISVAYEVLSDPDKRRIVDLGGDPLESAAAGGNGFGGFGGLGDVFEAFFGGGFGGGAASRGPIGRVRPGSDSLLRMRLDLEECATGVTKQVTVDTAVLCDRCQGKGTNGDSVPIPCDTCGGRGEVQTVQRSLLGQMLTSRPCPTCRGVGVVIPDPCQQCMGDGRIRARREISVKIPAGVGDGMRVRLAAQGEVGPGGGPAGDLYVEVHEQAHDVFVREGDHLHCTVSVPMVDAALGVTVTVDAILDGLSEITIPPGTQPGSVITLRGRGMPHLRSNTRGDLHVHVEVVVPTRLDHQDIELLRELKGRRDREVAEVRSTHAAAGGLFSRLRETFTGR

SEQ ID NO: 59136 - protein, 1104 aa, Kluyveromyces lactis NRRL Y-1140
MPSAQDYHVNPHFHMGDREGEHQQPPMAPATPRMMGRRVSESSAPGLMPAANIVNDTTQQPQQQPQLQTVPQSVPVPAQSFNDVVSNKPFHRKSLGDWDFLETVGAGSMGKVKLAKHRLTNEVCAIKIVNRAAKSYMHKQNQLPPPKTEEELMERKKKLEKELSRDRRTIREASLGQILYHPHICRLFEMCTMSNHFYMLFEYVSGGQLLDYIIQHGSLRERHARKFVRGIASALQYLHLNNIVHRDLKIENIMISTSGEIKIIDFGLSNLYDNKKQLHTFCGSLYFAAPELLKANPYIGPEVDIWSFGVVIYVLVCGKVPFDDENASVLHEKIKKGKVEYPQHLSIECISLLSKMLVVDPLKRASLKQVCNHQWMQRGFDFPPPSYIPHRVPLTVEMLDVNVIKEMHRLELVNDVNDALQALRDIIDSHEYKELSREYWYNVQNSNNQEDGTRAFHPLLSIYYLVDEMLKRKLAKRLQKQQQLQQQQQQQLQAGYQSKPFQGQSQPIFPSDQVDTSIPLPDQSQPKTLQQPVSVNNSDYIVRPSSIKEVSPEHTTSPAAYIPSNLERNSTVVASPVRNKELPQIMIPPKLAIPELAHTSPTRKSSDANPELDAVMSPSPAPMDYPSQQEQTKQQQANKYNMGSVKTSTTSSEKPKIGSIFRRLSQRHRHAQTINQGSLQVQEPKSVALQTNAAPKVRKTHTRTVSEHVPSTSRYADPYYSENAPRDMQGDLPALPANADVLVKQQQERLNDLKLNNELDDESETQSTKYDENQPLALLSLPKGKKLHPSARAKSVGHARRESLKYNRPPVLTTSAANTSSDGSTAPGRINTNDDGFLQSSSEGNALQIDDISPWEELTDEQIIERASKAPPGSMPSIDFPRSLFLKGFFSVQTTSSKPLPVVRYKIISTLKKLNIEFTEVKGGFICCHRQSYVSQEQPPNHGRHPSIVINETSSLESNSSTANSHRKQLSIPSRHGSIRRHGSLKQPGIPATPLAAATHERNLSVTSPRTSTGQILEEVSTASFETLNNQEDILTNSKAQDMNKVVIGNKNEAGNKERPPLKFEIHIVKVKLVGLAGVHFKKVSGNTWMYKELATHILKELNL

SEQ ID NO: 59137 - protein, 342 aa, Pichia pastoris
MSMFKIPKLVLSQGFPSLNRKLAQTTKPPRSLISILELSNQELSSLVERAAYHKTQYKSGKISSQVSPSLFGKVAALLFTKRSTRTRISSEGAAVYFGAHPMFLGKDDIQLGVNESFYDTTKVISSMTSCIFARVDKHSQIQELAQHSTVPIINSLCDRFHPLQAITDILTIREAFGFTKGLKLAWVGDSNNVINDLAIAAIRSGINVSIAIPQGIEMDEEIISKGQQIAQETDTVLEVTHDPKKAVKDANVLVTDTFVSMGQEAESKAKLAQFQGFQISSDLASGAAPDWKFMHCLPRHKEEVTDEVFYSDRSLVFPEAENRLYAAIAALEGFVINEGRLV

SEQ ID NO: 59138 - protein, 88 aa, Brassica napus
KRNARDSHVPILAPLPIGFAVFLVHLATIPITGTGINPARSLGAAIIFNKDNAWDDHWVFWVGPFIGAALAALYHVIVIRAIPFKSRS

SEQ ID NO: 59139 - protein, 211 aa, Zea mays
  misc_feature (137)..(137): Xaa can be any naturally occurring amino acid
  misc_feature (159)..(159): Xaa can be any naturally occurring amino acid
MAYYLKDAVLDGGIPFNKAYGMTAFEYHGTDSRFNRVFNEGMKNHSVIITKKLLDFYTGFEGVSTLVDVGGGVGATLHAITSRHPHISGVNFDLPHVISEAPPVPGVRHVGGDMFASVPAGDAILMKWILHDWSDAXCATLLKNCYDALPENGKVIVVXGVFHVDMIMLAHNPGGKERYEREFRELAKGAGFSGFKATYIYANAWAIEFIK

SEQ ID NO: 59140 - protein, 507 aa, unidentified eubacterium SCB49
MSNTETMKGANIEKPQFKSQYDNLIGGKWVAPVNGVYFDSISPVDGNTFTKIARSTKEDIDLAVEAAWKAAPQWNNTSATERSNALLKIADIIEQNLEALAKAETWDNGKPFRETLNADLPLAVDHFRYFAGVIRGEEGGASELDENTLSLNIWEPLGVVGQIIPWNFPLLMATWKLAPALAAGNCVVLKPAEQTPVSIMVLAELIKDVLPDGVINIVNGFGVEAGKPLASHPDINKIAFTGETTTGQLIMQYASKNIIPVTLELGGKSPNIFFKSIMEADDEFFDKAIEGAVMFAFNQGEVCTSPSRILIEESIYDDFIKRVVDRTNAIKIGHPLDPETMQGAQASNDQYEKVLNYIKIGKEEGCEVLAGGDAAYNEGLEGGYYIQPTILKGNNKMRVFQEEIFGPVVCVTTFKDEEEAIEIANDTLYGLGAGVWTRDTHQAYKVARKVQAGRVWVNNYHAYPAHAPFGGYKKSGIGRENHKMMLDHYRQTKNMLISYDKKKLGFF

SEQ ID NO: 59141 - protein, 450 aa, Candida glabrata CBS 138
MSWIQIPWSWVVTLIVTYLSLPLIIYYLVPYIFYGNKSSKKRIIIYVLGDIGHSPRMCYHARSFSEKGWQVELCGYVEEQVPGFIAEDPNIIVHALPTLTLQGNKRSIIFLVKKVLFQVSAIIAQLWELRGSNYMLIQNPPSIPILPIAVFYRLSGCKLIIDWHNLAYSIMQLKFNGNFYHPVVLASYVIEYIFGKFATYNLTVTEAMKEYLVNSFGLNPKRCVVLYDRPATQFKPLTESESRTKLLDSEFIRDMIPEGFNVEKGDKIIVTSTSFTPDEDISILIGALKIYDNSYENLDKSLPKILCFVTGKGPMKERYVKDVEEHDWQHVYVKFVWLKSEDYPRLLQLCDYGVSLHKSSSGLDLPMKILDMYGSGIPVIAYNYPVLGELVKYNENGLKFLDRRELHESLIFAMKDPELYKKLKQGALKESQIRWNSSWQSAMQELKLVA

SEQ ID NO: 59142 - protein, 315 aa, Alteromonadales bacterium TW-7
MTKLLSLGELLIDMLPQDSHNTAYLPIPGGAPANVAVGYAKLGGNAAFCGGMGDDYFAKQLTDALKQYNVGTEYLFTIKNAQTAMVIVSLDETGERSFNFYRHNTADLLLAPEHLQQIQWDEISTLHFCSNTLTSIAIANTTLSALKQAKIHNKLVSFDVNLRYSLWHNIRDIEPNVRACYAHCDIIKLSRDELNFLAEHTSQSSDEYLQSLLELGVSLIFLTDGPEPATVYHKTFNVSEAAPIINAIDTTSAGDAFIAGVLYHLNHFNETLLPSDKLNNKQVIKDALSFGLRCGSKACLSKGAFPALPVLDDVL

SEQ ID NO: 59143 - protein, 301 aa, Streptococcus pyogenes MGAS10394
MLMTKVRKAIIPAAGLGTRFLPATKALAKEMLPIVDKPTIQFIVEEALKSGIEEILIVTGKSKRSIEDHFDSNFELEYNLQAKGKIELLKLVDETTSINLHFIRQSHPRGLGDAVLQAKTFVGNEPFVVMLGDDLMDITNPNVKPLTKQLIDDYEETHAATIAVMRVPHEDVSNYGIIAPQAKAVKGLYSVDTFVEKPQPQDAPSDLAIIGRYLLTPEIFSILEKQEPGAGNEVQLTDAIDTLNKTQRVFAREFKGKRYDVGDKFGFMKTSLDYALKHPQVKDDLKAYIIQLGKALEKTKP

SEQ ID NO: 59144 - protein, 338 aa, Streptococcus pyogenes MGAS10394
MTKQKVAILGPGSWGTALSQVLNDNGHDVRLWGNIPDQIEEINTKHTNRHYFKDIVLDKNITATLDLGQALSDVDAVLFVVPTKVTRLVARQVAAILDHKVVVMHASKGLEPETHERLSTILEEVIPAHFRSEVVVVSGPSHAEETIVRDITLITAASKDIEAAKYVQSLFSNHYFRLYTNTDVIGVETAGALKNIIAVGAGALHGLGYGDNAKAAVITRGLAEITRLGVKLGADPLTYSGLSGVGDLIVTGTSVHSRNWRAGAALGRGEKLEDIERNMGMVIEGIATTKVAYEIAQDLGVYMPITTAIYKSIYEGADIKESILGMMSNEFRSENEWH

SEQ ID NO: 59145 - protein, 463 aa, Arabidopsis thaliana
MVRGLVNFTGLSTRLLNICVDSLCKFRKLEKAESLIIDGIRLGVDPDVVTYNTLISGYCRFVGIEEAYAVTRRMRDAGIRPDVATYNSLIAGAARRLMLDHVLYLFDEMLEWGIYPDLWSYNTLMCCYFKLGKHEEAFRVLYKDLQLAGLNPGPDTYNVLLDALCKCGYIDNALELFKEMQSRFKPELMTYNILINGLCKSRRVGTAKWMLTELKKSGYTPNAVTYTTILKLYFKTRRIRRGLQLFLEMKREGYTYDGYAYFAVVSALIKTGRTKEAYEYMQELVRKGRRHDIVSYNTLLNLYFKDGNLDAVDDLLGEIERRGMKADEYTHTIIVNGLLRTGQTRRAEEHFVSMGEMGIGLNLVTCNCLVDGLCKAGHVDRAMRYFESMEVKDEYTYTSVVHNLCKDMRFVCASKLLLSCYNKGIKIPTSARRAVLSGLRMSGCYGEARKAKAEMKLTLVGNS

SEQ ID NO: 59146 - protein, 425 aa, Aspergillus nidulans FGSC A4
MAFVKRIPWIETPLIESASLSKTAGCRVFLKLDLLQPSGSFKSRGIGNLICNALQDPANRGKELHFFSSSGGNAGLAAVIAARDLGCRCTVVVPYSTKPMMITKLREAGATDVIQHGDSWFEADTYLRETFIENQDQGGDAATKRNIYVPPFDHPQIWKGVGTMIDEIAQQMPPRDVSKGSFPADAVICSVGGGGLFNGVVEGLGRHLATKNGDAPGGKVRVLAVETEGTDSLALSLRKGTLQPLPAITSLATSLGALQVAPQTLKNAQCPPARVDVVSVVGSDAEAAQGVIRLADEHRLQVELACGISVEVGGSVKLRDYMPDLTPDSRIVIVICGGSNVTAEMVVEYRKRLHDGWDSAYAAFASPAVGSVVHAFDAILGSQVPVLFLMYPSICSSCKAASINKKSTMHSSFTWRSRQIQTSTV

SEQ ID NO: 59147 - protein, 92 aa, Zea mays
  misc_feature (72)..(72): Xaa can be any naturally occurring amino acid
NILCVYSIYCFVSQGLALAGSGSIFETLRLGKPLIVVVNEDLMDNHQSELAEELAERKHLFCARPQTLGETXPGDAKPVVALINRFLGFPVA

SEQ ID NO: 59148 - protein, 315 aa, Haemophilus influenzae Rd KW20
MPDIKLFAGNATPELAKRISERLYISLGDATVARFSDGEIQVQINENVRGADVFIIQSTCAPTNDNLMELVVMVDALRRASAGRITAVIPYFGYARQDRRVRSARVPITAKVVADLLSIVGIDRVLTCDLHAEQIQGFFDVPVDNVFGSPVLIHDILKKSDLKNPIVVSPDIGGVVRARAVAKLLNDTDMAIIDKRRPRANVAQVMHIIGDVADRDCILVDDMIDTGGTLCKAAEALKERGAKRVFAYATHAVFSGAAAKNLASDAIDEVVVTDTIPLSEEMKAIGKVRVLTLSSMLAEAIRRISNEESISAMFN

SEQ ID NO: 59149 - protein, 157 aa, Bacteroides fragilis YCH46
MKTTLIVVGRTVEQHYITAINDYIERTKHFISFDMEVIPELKNTKSLTPEQQKEKEGELIAKALQPGDVVVLLDEHGKEMRSVEFARWMEKKLVNVNKRLVFIIGGPYGFSQKVYDAAHEKISMSKMTFSHQMIRLIFVEQIYRAMTILNGGPYHHE

SEQ ID NO: 59150 - protein, 404 aa, Treponema pallidum subsp. pallidum str. Nichols
MSGPNYKADFPLLLRSPRVHYLDSAATTQRPAPVLERVMHYHTHLNGNAGRGSHELAVESALLIENTRKKTAQFINAAPTHDIVFTKSCTESLNIIAHCYALPRLRAGDEIVLAISNHHANIVPWQHVCRCTGATIQWLYPDAEGNLDIQEAQKKIRACTKIVSFSAVVNATGAVNPAQELTALAHQVGAVVVIDGAQAMVHGVPNVADLGCDFFVFSGHKMFSLFGVGVLCAPHTLLESMPPFLYGGGMVDFVTEQESVFKGAPHKYEGGSANTAAVVSLCAAIEYCESLESSAVRASVHALDAALLARLEELPFLETYHARARERLGIIAFNVKNVHSHDTAHILGEEGVMVRSGDHCSKPFMTHLSIQSCCRASFCIYNTMEDVEALTRALHAVGRIFQCS

SEQ ID NO: 59151 - protein, 206 aa, Triticum aestivum
MEVEAGAHGDMAASKFTLPVDSEHKAKSFRLFSFANPHMRTFHLSWISFFTCFVSTFAAAPLVPIIRDNLNLAKADIGNAGVASVSGSIFSRLAMGAICDLLGPRYGCAFLVMLSAPTVFCMAVIDDASGYIAVRFLIGFSLATFVSCQYWMSTMFNSKIIGTVNGLAAGWGNMGGGATQLIMPLVFHAIQKCGATPFVAWRIAYF

SEQ ID NO: 59152 - protein, 254 aa, Treponema pallidum subsp. pallidum str. Nichols
MHERNTTTNTPLDVTAQKLLVAQRSVDTLVQEGVLHAHMSIGLGTGSTAMPAVKRIADHLARGTLSDIAAVPTSFQTALICERYNIPLFSLSSKRIGGKLDVTIDGADEIDTQNFVIKGGGAALLQEKIAAYNSAHFVIIVDETKVVETLGTRAALPIEVVPEARMSVMRTLQDWGLSVHIREAVRKKGPVVTDHGNFILDARWQSLPTRTPQDMERALNALPGVIENGLFTERTVRVFVAHADGSVEERSASF

SEQ ID NO: 59153 - protein, 157 aa, Oryza sativa Japonica Group
MAADKKEVADDTILLISSDGEHFNVPSAAASLSQLVSNMIENDCTTNGVPLPNVASKVLAKVIEYCVKHAAAAEDEEKELKSFDAEFMIDVDKNMLYGLLLASNFLNIKSLLDLCCQHTANLIKGKSPEQIRKEFGIKNDFTPEEEEIRKENTWAFE

SEQ ID NO: 59154 - protein, 742 aa, Pisum sativum
MSERKTIDLDQGWDFMLKGIKKLKNILEGLPEPQFTSDDYMMLYTTIYNMCTQKPPHDYSQPLYDKYKESFEEYIISTVLPSLREKHDEFMLRELVRRWANHKIMVRWLSRFFHYLDRYFIARRSLPPLNEVGLTCFRDLVYKEINGKVRDAVISLIDQEREGEQIDRALLKNVLDIFVEIGMGQMDQYDNDFEAAMLKDTSAYYSRKASNWILEDSCPDYMLKAEECLKREKDRVAHYLHSSSESKLLEKVQHELLSVYANQLLEKEHSGCHSLLTDDKVEDLSRMFRLFSKIPRGLEPVSCIFKQHVTAEGTALVKLAEDAASNRKAEKRDIVGLQEQIFVRKVIELHDKYLAYVSDCFQNHTLFHKALKEAFEIFCNKGVAGSSSAELLATFCDNILKKGGSEKLSDEAIEDTFEKVVKLLAYISDKDLFAEFYRKKLARRLLFDKSANDDHERSILTKLKQQCGGQFTSKMEGMVTDLTLAKENQTSFEEYLSNNPNIDPGIDLTVTVLTTGFGPSYKSFDLNLPAEMVRCVEVFKEFYQTKTKHRKLTWIYSLGTCNVSGKFEPKTMELVVTTYQASALLLFNSSDRLSYSEIMTQLNLTDDDVVRLLHSLSCAKYKILTKEPSTKTISPTDHFEFNSKFTDKMRRIKIPLPPVDEKKKVIEDVDKDRRYAIDASIVRIMKSRKVLSYQQLVMECVEQLGRMFKPDVKAIKKRIEDLISRDYLERDRDNANLFKYLA

SEQ ID NO: 59155 - protein, 144 aa, Chromobacterium violaceum ATCC 12472
MQTVRQLLDSKPTRALVYVTPDSTVFQALQVMAENDIGAVLVMESGDIVGIFSERDYARRIVLQGRTSAGTKVRDIMTSRVVYVTPQQTLDECMGLMTEKRIRHLPVMEDQTVLGILSIGDLVRATIEEQEQVINHLVHYIQSA

SEQ ID NO: 59156 - protein, 289 aa, Chromobacterium violaceum ATCC 12472
MATDAAEKANILAEALPYIREFAGKTIVIKYGGNAMTDDALKEGFAKDVVLLKLVGMNPVVVHGGGPQINDLLARVGKQGEFIQGMRVTDAETMEVVEMVLGGLVNKEIVSLINKHGGKAVGLTGKDGHFIRARKLFLKTDGDEDVDIGQVGEIEAIDPALVSLLDSQDFIPVVAPIGVGVDGEAYNINADLVAGKLAETLRAEKLVLMTNTPGVLDKQGQLLTGLTAQRIDELFADGTISGGMLPKISSALDAARNGVNSVHVIDGRVKHALLLEILTAAGVGTMIRA

SEQ ID NO: 59157 - protein, 500 aa, Festuca arundinacea
MEFFTEYGEASQYQIQEVIGKGSYGVVAAAVDTRTGERVAIKKINDVFGHVSDATRILREVKLLRLLRHPDVVEIKHIMLPPSRREFQDLYVVFELMESDLHQVIRANDDLTAEHYQFFLYQLLRALKYIHAGNVFHRDLKPKNILANSDCKLKICDFGLACVSFNDAPSAIFWTDYVATRWYRAPELCGSFFSKYTPAVDIWSIGCIFAELLTGRPLFPGKNVVHQLDIITDLLGTPSSETLSRIRNEKARRYLSCMRKKHPVPLTQKFPNADPLAVHLLGRLLAFDPKDRPSAEEALADPYFATLSNVEREPSRNPISKLEFEFERRKVTKDDVRELIYREILEYHPQMLQEYMKGGEQLSFLYPSGVDRFKRQFAHLEEHYSKGERGSPLQRKHASLPKRRVGASNDGNNEQHPSDQELGADPGAQSPPRSQDPGQQHPSGGQNGVSPRSYQKSASISASRCVVVNPNKQREYDEEISEETEEAIAELSEKVSKMHP

SEQ ID NO: 59158 - protein, 371 aa, Emericella nidulans
MFRQSVRRFATAALRSAAESPYNVRVSQAQGFVNGLTEKAIGNTPLIRLKRLSEETGSNILAKAEFQNPGGSVKDRAALYVVKDAEERGLLKPGGTVVEGTAGNTGIGLAHVCRSKGYKLVIYMPNTQSQGKIDLLRLLGAEVYPVPAVAFDNPENYNHKARRHAESLDNAVWTNQFDNTANRRAHIETTGPEIWAQTGGKLDAFTCSTGTGGTLAGITYYLKQASGGRVKSFLADPPGSVLHSYIQSGGKLVERSGSSITEGIGQGRITDNLQPDVGTLDGSLNISDEKTIEMIYRCLDEEGLYLGASSALNVVAAKEVAEKLGKGSTVVTILADGAYRYADRLFSKSWLESKGLRNAIPKHLEKYIVLP

SEQ ID NO: 59159 - protein, 312 aa, Synechococcus sp. WH 7803
MTATASSPEGVTPSGEDQAEFDFSSYLAKTRELVEQSLDAALGPERPESLRESMRYSLLAGGKRLRPILCLAACELVGGDASLAMPTAVALEMIHTMSLIHDDLPAMDNDDLRRGRPTNHKVYGDAMAILAGDALLSRAFEMVAVRSEGVPPERLLKVVAELSLVSGAPGLVGGQVVDLESEGREVDLETLEYIHLHKTAALLRACVVTGALIGGADASQVDAMRTYANGIGLAFQIVDDILDVTASSDVLGKTAGKDLIADKTTYPKLLGLEPSRARALELVAQAKAVLEPWKDKAQPLLALADYVASRDR

SEQ ID NO: 59160 - protein, 122 aa, Picea sitchensis
MASKLVQLQNKAAVASQFVTKHGCAYYKQLLEQNKQYIQEPATVEKCSELSKRLFYTRLASIPGRYESFWKEVDLVKQKLKNRQDLKVEEVGVGVLFALECYAWSCVGEIVGRGFTLTGYYV

SEQ ID NO: 59161 - protein, 356 aa, Streptomyces avermitilis MA-4680
MKALVFHGSGESVWEDVADPGIQDAGDAIVRVDTVTICGTDLHILKGDLPEVRPGTVLGHEAVGEIVETGGDVRTVRPGDRVLVSCITACGRCRFCRESAYGQCRGGGGWILGHLINGTQAEYVRVPHADLSVHPLPGAMDSKDAVLLADILPTAYEVGVLNGRVRPGDTVVVVGAGPVGLAAVATSRLYTPEKIIAVDLAPARLDAAKRLGADAVAVAGEEAEPLVADLTLGLGADVVIEAVGVPETFEMCTRMVRPGGHVANVGVHGRPAVLHLEDLWIKNVTITTGLVDTRSTPTLLRMMAAGHLPASSMVTHTFPLDAMEEAYDVFSRAADTGALKVVLGEQQHDVLMVRAA

SEQ ID NO: 59162 - protein, 387 aa, Yarrowia lipolytica CLIB122
MDSDSENERPTHQEPKEKSRRPPNTAFRQQRLKAWQPIFTPKTVLPLLLCITVIFAPLGGALIYGSDQVQEIIIDYSHCHEQASTTEPRTMDDKYITTHFNAKDATSKVQWQLLDGTDEQKSRRSYNGTCRLTFDVPHDMGAPIYMYYRLTNFYQNHRRYVTSYNEDQLNGKNKSAHDLKDKNDCKPLVLDRDGKPYYPCGLIANSMFNDTFHTPVALNPSGNQGNVTYDMTTDGIAWGTDKNRFKKTTYNASQVTPPPFWVEKFPDGYTEENLPNIAEWQEFQNWMRTAALPTFSKLVMRQDHNTLTVGTYSVDVDLYFPVLQYDGTKSLVLTTRSAVGGRNPFLGIAYVVVAGICAVVGLLFLGKHLVKPRRLGDHSYLSWNNEN

SEQ ID NO: 59163 - protein, 90 aa, Glycine max
  misc_feature (21)..(21): Xaa can be any naturally occurring amino acid
  misc_feature (49)..(50): Xaa can be any naturally occurring amino acid
  misc_feature (65)..(65): Xaa can be any naturally occurring amino acid
ISNWALLHVAYEPIGAIGPRXVSTPAHAHEGHADLRKWAHDNVSAVAAXXRMIYRGCCDGRNLQXLARQADVDETLVGGASLKAESVGII

SEQ ID NO: 59164 - protein, 592 aa, Neocallimastix frontalis
MLAPIQTIARPVSSILPATGALAAKRTFFAPSEVYNKKQVIVTKKTGLDILNDPKLNKGSAFTADEKDRLGIRGLVPPRPQSLEAQYKRCKTNLDKISDPLEKFIYLNHLQNRNETLYYKMILENFVELAPIIYTPVVGEACQKFHKIFTQTRGMYFSTADRGQMSAVAANWPYDDVDVIVVTDGSRILGLGDLGAGGMQIPIGKLTLYVCGGGINPRNVLPIVLDVGTNNKELLNDPLYLGMQHPRLQGEEFHAFVDEWVSAITDRFPKAVIQFEDFMMPNALDLLLKYKDQICMFNDDIQSTGAITLASVLATMRARGGTFADIKKETFLCLGAGSSGVGVCETIVDCIVAEGATREEAYAQFYMFDHKGLLGKGRDDLLPSQQVFMRKEIEGGKTPAELLKKIKPTCLLGLSTCPKLFNKEMLSYVASYCEKPGIFPLSNPTSRSECTAEEAVEFTDGNLIFASGSPFDPVEWKGKTIQTNQCNNSYSFPGIGLGLVSSRATRVPFETFQVCARVIASLGTPEMLATGKIFPDLDNLRAVSLEVGIEVAKMAERMNIATQFPPKGMDWREWLKHNMWQPEYPHIVVKNL

SEQ ID NO: 59165 - protein, 108 aa, Picea sitchensis
MASANRLCVLYLVMIGIVVQTYVEAAEIGASKTAGQRNGMKRRLLQTIDCNAACGERCTKASRHNMCLRACGTCCARCNCVPPGTSGNQDLCPCYASLKTHGNRPKCP

SEQ ID NO: 59166 - protein, 263 aa, Pichia pastoris
MTVFRGCIDIHSGKVKQIVGGKLVKDDTESDEVETNFVSEQPSSYYAQLYKQNQVHGTHVIKLGSLKANDDAAREALGAWRGGLQIGGGITDSNAQEWIDQGASHVIVTSWLFPEGQFSIERLQHLSSLIGKEKLVVDLSCRRQEIDGSPQWVVAMNKWQTLTSSVLDREFFQLLSQYCDEFLVHAADVEGLCQGIDQELVRKLSEWSDLPVTYAGGARSIQDLETVKHLSNGKVDLTFGSALNIFGGNLVKFEDCVKWNKTQ

SEQ ID NO: 59167 - protein, 173 aa, Brassica napus
MAASLGLRLRAATSTLRSGAAATLLPRTWSCRGLCSEAENDVPTSGIGRPLAKILKELNKKVPDSAIKTRVEDGFSMKYIPWHTVNRIMNLHAPEWSGEVRSVTYSPDGNTVTVAYRVTLYGTDAEIYRESTGTTSVNDKGYGDPVQKAEAMAFRRACARLGLGLHLYHEDAL

SEQ ID NO: 59168 - protein, 147 aa, Coccidioides immitis RS
MSKLFIGGLAWHTTDETLRQGFSKFGSIEEAIVVKDRDTNRSRGFGFVRFASEGEAEAAMNEMNNQEFDGRTIRVDKAADRPSGPRNDGFNRSNYSRFEGGGAGGYNRGGYGGNNGGGYDQRQGGTGGGWGGYQQNWSNQNQGGSAA

SEQ ID NO: 59169 - protein, 224 aa, Listeria monocytogenes str. 4b F2365
MINQKKIAGEKACEWIKDGMVVGLGTGSTVYYTIEKLGEMVNNGLHITGVATSEETSKQAQNLGIPLKSLNDVAEIDITIDGADEIDTDFQGIKGGGGALLREKMVASASLKNIWVVSEEKLVRNLGKFPLPIEVIPFGWKQIERTLEKEHIQTILRRQSSGEIYVTNNGNYILDIVNQTFRDAEMWQEKLAQIPGIVEHGLFLHYVDIIVCAKANGEIELIKK

SEQ ID NO: 59170 - protein, 606 aa, Triticum aestivum
  misc_feature (401)..(401): Xaa can be any naturally occurring amino acid
MDTHIGSVDGPSPAAVNGAVGCPASAPGCPIMSSHPVVSAGEASLGRHLARRLVQVGVSDVFAVPGDFNLTLLDHLVDEPGLRLVGCCNELNAGYAADGYARARGVGACAVTFTVGGLSVLNAIAGAYSENLPVICIAGGPNSNDYGTNRILHHTIGIPDFSQELRCFQTVTCHQAVVTNLDDAHEQIDTAIATALRESKPVYLSISCNLPGLPHPTFTRDPVPFFLAPRMSNKMGLEAAVEATVEFLNKAVKPVLVAGPKLRVAKAGKAFCDLVDASGYAYAIMPSAKGFVPETHPHFLGTYWGAVSTAFCAEIVESADAYLFAGPIFNDYSSVGYSFLLKKDKAIIVQPERVIVGNGPAFGCVMMKEYLSALAKRVQKNTTAYENYKRIFVPEGHPLKXRPNEPLRVNVLFKHIQDMLTGDSAVLAETGDSWFNCQKLKLPEGCGYEFQMQYGSIGWSVGALLGYAQGASDKRVIACIGDGSFQVTAQDVSTMLRCEQNSIIFLINNGGYTIEVEIHDGPYNVIKNWELHRPWWRPSHNGEGKCWTAKVKCEEELTAAIEMALGEKEDSLCFIEVIAHKDDTSKELLEWGSRVSAANSRPPNPQ

SEQ ID NO: 59171 - protein, 441 aa, Escherichia coli O157:H7 EDL933
MNKYQAVIIGFGKAGKTLAVTLAKAGWRVALIEQSNAMYGGTCINIGCIPTKTLVHDAQQHTDFVRAIQRKNEVVNFLRNKNFHNLADMPNIDVINGQAEFINNHSLRVHRPEGNLEIHGEKIFINTGAQTVVPPIPGITTTPGVYDSTGLLNLKELPGHLGILGGGYIGVEFASMFANFGSKVTILEAASLFLPREERDIADNIATILRDQGVDIILNAHVERISHHENQVQVHSEHAQLAVDALLIASGRQPATASLHPENAGIAVNERGAIVVDKRLHTTADNIWAMGDVTGGLQFTYISLDDYRIVRDELLGEGKRSTDDRKNVPYSVFMTPPLSRVGMTEEQARESGADIQVVTLPVAAIPRARVMNDTRGVLKAIVDNKTQRILGASLLCVDSHEMINIVKMVMDAGLPYSILRDQIFTHPSMSESLNDLFSLVK

SEQ ID NO: 59172 - protein, 563 aa, Mycobacterium tuberculosis H37Rv
MSAKENPQMTTARPAKARNEGQWALGHREPLNANEELKKAGNPLDVRERIENIYAKQGFDSIDKTDLRGRFRWWGLYTQREQGYDGTWTGDDNIDKLEAKYFMMRVRCDGGALSAAALRTLGQISTEFARDTADISDRQNVQYHWIEVENVPEIWRRLDDVGLQTTEACGDCPRVVLGSPLAGESLDEVLDPTWAIEEIVRRYIGKPDFADLPRKYKTAISGLQDVAHEINDVAFIGVNHPEHGPGLDLWVGGGLSTNPMLAQRVGAWVPLGEVPEVWAAVTSVFRDYGYRRLRAKARLKFLIKDWGIAKFREVLETEYLKRPLIDGPAPEPVKHPIDHVGVQRLKNGLNAVGVAPIAGRVSGTILTAVADLMARAGSDRIRFTPYQKLVILDIPDALLDDLIAGLDALGLQSRPSHWRRNLMACSGIEFCKLSFAETRVRAQHLVPELERRLEDINSQLDVPITVNINGCPNSCARIQIADIGFKGQMIDDGHGGSVEGFQVHLGGHLGLDAGFGRKLRQHKVTSDELGDYIDRVVRNFVKHRSEGERFAQWVIRAEEDDLR

SEQ ID NO: 59173 - protein, 452 aa, Zea mays
  misc_feature (19)..(19): Xaa can be any naturally occurring amino acid
  misc_feature (190)..(190): Xaa can be any naturally occurring amino acid
MATHAALAASRIPAGARLXNTAGRRRSSRHGVQRLDFADFSGLRPGSCSVSAAAREASFSDVLGAQLVAKATGENAVRAPAEAKLKVAINGFGRIGRNFLRCWHGREDSPIDVVVVNDSGGVRNASHLLKYDSMLGTFKADVKIVDDTTISVDGKPITVVSSRDPLKLPWGELGIDIVIEGTGVFVDGPXGAGKHIQAGAKKVIITAPAKGADIPTYVVGVNEGDYDHSVADIISNASCTTNCLAPFVKILDEEFGIVKGTMTTTHSYTGDQRLLDASHRDLRRARAAALNIVPTSTGAAKAVALVLPQLKGKLNGIALRVPTPNVSVVDLVINTVKTGITADDVNAAFRKAAAGPLQGILDVCDVPLVSVDFRCSDVSCTIDASLSMVMGDDMVKVVAWYDNEWGYSQRVVDLAHLVAAKWPGAAAAGSGDPLEDFCKDNPETDECKVYEA

SEQ ID NO: 59174 - protein, 251 aa, Leptospira interrogans serovar Lai str. 56601
MSSMKNVIITGASSGIGKELARLYAQTGANVALTARRKDVLKKIVEELKSSGTKGKILFASLDVSDADQNFKVIPKLIKELGGLDLIVLNAGISTTSSFGGRSFEADRAVIETNLIGAMAGVEAVLPVFQKQKSGQIVAISSVASFRGLPGSASYSSSKAGLSVYMEALRGEVKRYGISVSVIHPGFIDTPINNRMKSRPFVISVERGAQKIFKRIENNVLSATVPWFPWVFLGYLMKRIPEFLWSKISLK

SEQ ID NO: 59175 - protein, 271 aa, Burkholderia vietnamiensis G4
MAITLKNEHDIAQMRVACRLASEVLDFITPHVVAGVTTAELDRLCHEFMLNEQGTVPAPLNYQPPGYPPYPKATCISVNDVICHGIPGEKVLKNGDALNIDITVIKNGYFGDTSRMFIVGEGSILAKRLVQTTYECMWLGIDQVKPGAHLGDIGHAIQKHAEAQGYSVVREYCGHGIGTVFHEDPQVVHYGRPGTGIELKAGMIFTIEPMINAGKRDIRTMPDQWTVKTRDRSLSAQWEHTVLVTDTGYEVLTVSAGTPARPVFAQPAAAV

SEQ ID NO: 59176 - protein, 54 aa, Glycine max
MFSGMFMEKPDKAVALKQLRTHVALFGGWVVVVRAVPYILSYFSDSKDELKLDF

SEQ ID NO: 59177 - protein, 220 aa, Coxiella burnetii RSA 493
MSKNELKKAAAMEAIQFVKNVNIVGVGTGSTVNYFIDALAEIKHQIEGAVASSVATENRLKEHRIPVVDLNSVSNVDVYVDGADEFNKHFYLTKGGGGALTREKIIAAAAKRFICIVDESKQVDVLGQFPLPIEVIPMARSFVAREIVKLKGDPVYRQGFTTDNGNVILDIHNLTILNPVELEAILNNIPGVIANGLFAQQPADDLLIGTPAGVQLHHRK

SEQ ID NO: 59178 - protein, 151 aa, Streptococcus peroris
MIQSIFAVRFANMIFENVWNREHIDNVQITFAERLGVEERGGYYDKSGALRDMVQNHTLQLLSLLAMDKPASFTKDDIRAEKIKVFKNLYHPSNEELKEHFIRGQYRSGKVDGMKYISYRSEPNVDPESMTETFASGAFFVDTDRFRDVPF

SEQ ID NO: 59179 - protein, 123 aa, Zea mays
  misc_feature (89)..(89): Xaa can be any naturally occurring amino acid
MADREHRTVFVTVGTTCFDALVMAVDSPEVKKALLQKGYSNLLIQMGRGTYVPLKVSGDATLQVDHFTFSPSIADNMRTASLVISHAGXTLRLGKPLIVVVNEDLMDNHQSELAEELAERKHL

SEQ ID NO: 59180 - protein, 717 aa, Alteromonadales bacterium TW-7
MIKKLLLIVIAAAAIGAFFHFNLHHLLTLDGLKGSMDQFDQYKAQSPLLVIGGFFLLYVVVTALSLPGAAILTLAAGALFGLVEGLLVASFASTVGATLAFLVSRYLLRDTIKQRFPERLDAIDAGVEKEGGFYLFTLRLVPVFPFFLINLLMGVTAIKSWTFYWVSQVGMLAGTFVFVNAGTQLAQIESLSGILSLDLILSFALLGVFPFIAKGILNVFKKRRVYKNYTKPKKFDRNMIVIGAGAGGLVTSYIAAAVKAKVTLIEAGEMGGDCLNYGCVPSKAVIKSAKIAEQIRHGEHYGLENATPQFSFKKVMARVHKVIADVAPHDSVERYTNLGVDVVKGYGKLLDPWTVEIKLNDGGTQTLTARTIVIATGARPFVPPLPGIEETGYVTSDTLWTKFAELEEAPKKLVVLGGGPIGCELAQSFARLGSSVTQIEMSERIIIKEDLEVSTFAHEALTESGVNILTSHQALRCEERDGKKFIMVKHNDTEIDIEYDELLCAVGRSARLKGYGLEELGIETNRTVVTNEYLETLYPNIFAAGDIVGPYQFTHVAAHQGWYAAVNGLFGNLKKFKVDYRVIPWTTFIDPEVARVGLNEQDAIDKGIDYEITRFEFEELDRAITDSATKGFIKVITPKGKDKILGVTVVSEHAGDLIAEFVLAMKHGLGLNKILGTIHSYPTWAEGNKYAAGEWKRAHAPEKVLNMLEKYHTWRRG

SEQ ID NO: 59181 - protein, 151 aa, Streptococcus pneumoniae
MIQSIFAVRFANLIFENVWNKDFIDNVQITFAERLGVEERGGYYDQSGALRDMVQNHTLQLLSLLAMDKPASFTKDEIRAEKIKVFKNLYHPTDEELKEHFIRGQYRSGKIDGMKYISYRSEPNVNPESTTETFTSGAFFVDSDRFRGVPF

SEQ ID NO: 59182 - protein, 189 aa, Guillardia theta
ARGTDLLLACDASRRGLGSPAGSEERERIVQMIEQLEKLNKDKSPLTSESINGEWTLRWTTSDSVLGTKRMRGFRVAQDRPILQVIDAKGLKAKNVEPVTTFRWIMGGIKYNNSVEAELEPMSSSKVRVLFKRFKIGSLLSFDAPSTARGELDTTYLDDGSLSGISLRISRGDKGNLFVLTRAISSSSS

SEQ ID NO: 59183 - protein, 421 aa, Chromobacterium violaceum ATCC 12472
MSQQQLMQRKSDATPRGVGVMCSFFADRAKNAEVWDTEGRRYIDFAGGIGVLNTGHLHPKVEAAVAEQLSRFSHTCYQVVPYESYISLAEKLNALAPGKHAKKTAFFTTGAEAVENAVKIARAATGRPGVIAFGGAFHGRTLMGMALTGKVAPYKLGFGPFPSDVYHAPYPNTLHGVSVQDSLVGLEKLFKFDIDPARVAAIIYEPVQGEGGFYAAPAEWVKALRELCDRHGILLIADEVQSGFARTGKLLASEHFDAVPDLITMAKSLAGGFPLSAVTGRAEVMDAPAPGGLGGTYAGNPLALAAAHAVLDVIDSEKLAERAQRLGDALKEKLNGLKSAVPQIAEVRGLGAMIAVEFNQPGSHQPDPDFAKKVQQHALANGLILLTCGIYANVVRFLFPLTIEDEIFAEALGKLEAALKA

SEQ ID NO: 59184 - protein, 486 aa, Chromobacterium violaceum ATCC 12472
MLNLQDPSLLRQQCYLGGEWLDADGGQHIAVHNPATGEKIGQVPKMGAAEAERAVAAAARAFPAWKAKSAKERAAILRRWFDLIIAHQQDLAIILTSEQGKPLAEAKGEIAYGASYIEWYAEEAKRVYGDIVPGPAGDRRVLVTKEPIGVTAAITPWNFPSAMITRKAAPALAAGCTMVVRPASQTPLSALALAELAERAGIPAGVFSVITGGSSEIGAVLTGSDTVKKFSFTGSTEVGRKLIAQCAGTVKKVSMELGGNAPFIVFDDADLDAAVEGALISKYRNAGQTCVCANRIYVQDGVYDAFAEKFAAAVATLKVGNGLEAGVSQGPLIDHNAVAKVEEHIADALAKGGRLIAGGKRHALGHTFFEPTLIADVTRDMKVAREETFGPLAPLFRFKTEEEAIRLANDTEFGLASYFYARDVGRIFRVAEGLEYGMVAVNSGLLSNEAAPFGGVKQSGLGREGSKYGIEDYLEIKYVLLGGLDR

SEQ ID NO: 59185 - protein, 377 aa, Mycobacterium sp. JLS
MQTQAAVLWERNTPWSIETIDLDPPKATEVLVELHASGMCHSDDHLVTGDMPIRLPCIGGHEGAGVVKAVGDHVSWLAPGDHVVFSFIPSCGRCQSCSTGHQSLCDLGAKIYSGMQIHDNTARHHVNGEDLALACGVGSFAHHTVVHEASCVKIPQHYRLDRACLLGCGFITGWGSSVYAAEVRPGDTVAIAGVGGIGAAAVQGARLAGARTITVIDPSEYKRGEAVKMGATHTAANWDDAKGVVAEATWDRGVDKFICAMGVGDGQLVGQALAMTAKRGRLVVTNIHPMLEREIRANLMDLTLTEKQIIGTLYGSGNPRADIPKILELSSAGQVDLDSMVTRTYPLEKVNDGYADMHAGANIRGVLIYPPAESSLG

SEQ ID NO: 59186 - protein, 448 aa, Oceanicola granulosus HTCC2516
MTETLDLIVIGAGMAGINAAKKCSKAGWSVAIVDELPYGGTCALRGCDPKKMLRAGAEAVEAAQRLTGKGISGETRIDWPALMKHKESFTDPVPENMESGLKEAGVQTLHGRARFIAEDRIEIEGHGEIGFRHALIATGAKPRPLDFPGAEKLVDSTDFLNLAELPRRIVFVGGGYISFEFAHIAARAGAEVTILDRGARQLKMFDPDLVDMLIERSRAAGIEIVAEAAIEQVEDKDVGHRVVYRRGDENHAIEADLLVHGAGRVPAIDHLDLAAGGIETERGGVKVTPWLQSPSNPRIFAAGDAAASPGKPLTPVAVFEGKIAASNMLKDKRTEPDYTGVPSVVFTIPELARVGLLEEEARERGDVDVSFTDTSGWFSQKRLGESHAGAKVITGKDGKVLGAHMFGPDYAELINVFSLAIKLGLTAAQVKSMPAAYPTGASDIGSMF

SEQ ID NO: 59187 - protein, 151 aa, Streptococcus pneumoniae
MIQSIFAVRFANLIFENVWNKDFIDNVQITFAERLGVEERGGYYDQSGALRDMVQNHTLQLLSLLAMDKPASFTKDEIRAEKIKVFKNLYHPTDEELKEHFIRGQYRSGKIDGMKYISYRGEPNVNPESTTETFTSGAFFVDSDRFRGVPF

SEQ ID NO: 59188 - protein, 410 aa, Burkholderia vietnamiensis G4
MAASPVNPRLDSLQPYPFEKLRALFKDVTPTAGLKPISFGIGEPKHPTPALIRDAVVASLDGLASYPATAGSDALRASIARWLERRYGLPAIDAATQVLPVSGSREALFSLAQTVIDARPRADGKKAIVLCPNPFYQIYEGAALLAGAEPYFANSDPARNFACDYAAVPDEVWARTQLLYVCSPGNPTGAVLTLDDWRELFALSDRHGFVIASDECYSEIYFDEAAPPLGGLEAAHRLGRGFERLVMLSSLSKRSNVPGMRSGFVAGDAALLKKFLLYRTYHGAALSPVWQHASIAAWNDEAHVRDNRALYLQKFATVTPMLADVIDVKLPDAAFYLWANVARTGLSDTEFARRLYADYNVTVLPGSYLARDAHGTNPGRDFIRIALVAGTPECVEGAQRIVEFCRALAR

SEQ ID NO: 59189 - protein, 580 aa, Zea mays
METLLAGNPANGVAKPTCNGVGALPVANSHAIIATPPAAATLAPAGATLGRHLARRLVQIGASDVFAVPGDFNLTLLDYLIAEPGLTLVGCCNELNAGYAADGYARSRGVGACAVTFTVGGLSVLNAIAGAYSENLPVVCIVGGPNSNDYGTNRILHHTIGLPDFSQELRCFQTITCYQAIINNLDDAHEQIDTAIATALRESKPVYISVSCNLAGLSHPTFSRDPVPMFISPRLSNKANLEYAVEAAADFLNKAVKPVMVGGPKIRVAKAREAFAAVADASGTTFCAEIVESADAYLFAGPIFNDYSSVGYSLLLKREKAVIVQPDRMVVGDGPAFGCILMPEFLRALAKRLRRNTTAYDNYRRIFVPDREPPNGKPNEPLRVNVLFKHIKGMLSGDSAVVAETGDSWFNCQKLRLPEGCGYEFQMQYGSIGWSVGATLGYAQAAKDKRVIACIGDGSFQVTAQDVSTMLRCGQKSIIFLINNGGYTIEVEIHDGPYNVIKNWDYTGLVNAIHNSEGNCWTMKVRTEEQLKEAIATATGAKKDCLCFIEVIVHKDDTSKELLEWGSRVSAANSRPPNPQ

SEQ ID NO: 59190 - protein, 471 aa, Oceanicola granulosus HTCC2516
MRDCCTPKGGAYDLAVIGAGSAGFSAAITAAEAGARVALIGDGTIGGTCVNVGCVPSKALIRAVEGLHHARAANRFDGIEAGARVTDWAATVAQKQALVEELRAAKYADVLPRHENIDHVEGHARFDDAGQLTVDGDVFPAAKIVIATGARPHVPAIPGIEAVDALDSTSALELTTLPASMLVVGAGYIGVELAQLFVRAGVEVTLISRRGVLPEAEPEISEALEGYLSEEGIRLARVSGYESVARDGGSVRLTGTGGESFDAERLLLATGRVPNSDRLNLGAAGIETDPRGGIVVDAQMRTANPDIWAAGDVTGRDQFVYMAAYGAKLAARNAVAGEARSYDNGTMPWVVFSDPQVAGVGLSEAQARAAGHEVITSVLPLDAVPRALAARDTRGLIKLVAEVGSKRLLGAQILAPEGADSIQTAAMALKAGLTYQELGDTIMPYLTTVEGLKLAAQTFEKDVAALSCCAG

SEQ ID NO: 59191 - protein, 151 aa, Streptococcus pneumoniae
MIQSIFAVRFANLIFENVWNKDFIDNVQITFAERLGVEERGGYYDQSGALRDMVQNHTLQLLSLLAMDKPAIFTKDEIRAEKIKVFKNLYHPTDEELKEHFIRGQYRSGKIDGMKYISYRSEPNVNPESTTETFTSGAFFVDSDRFRSVPF

SEQ ID NO: 59192 - protein, 147 aa, Azoarcus sp. EbN1
MKSVAAILKEKPDPTVHTIGPDASVFDALGRMAEHNVGALLVMEGERLAGIVSERDYARKVILLARSSRDLTVSAIMSSPVMYVSLNQTNEECMALMTEKRLRHLPVVESSRVVGIVSIGDLVKSIVSEQRFIIEQLEHYIAGDRGI

SEQ ID NO: 59193 - protein, 93 aa, Synechococcus sp. WH 7803
MASFTITLEGGKSFSCADDQYILDAAEEQGVDLPYSCRAGACSTCAGKVLSGSVDQADQSFLDDEQMGNGYALLCVSYPLADCTIKAEVEDEL

SEQ ID NO: 59194 - protein, 495 aa, Streptococcus pneumoniae R6
MSSKVIVTIFGASGDLAKRKLYPSLFRLYKSGNLSKHFAVIGTARRPWSKEYFESVVVESILDLADSTEQAQEFASHFYYQSHDVNDSEHYIALRQLQAELNEKYQAEHNKLFFLSMAPQFFGTIAKHLKSENIVDGKGFERLIVEKPFGTDYATANKLNDELLATFDEEQIFRIDHYLGKEMIQSIFAVRFANLIFENVWNKDFIDNVQITFAERLGVEERGGYYDQSGALRDMVQNHTLQLLSLLAMDKPASFTKDEIRAEKIKVFKNLYHPTDEELKEHFIRGQYRSGKIDGMKYISYRSEPNVNPESTTETFTSGAFFVDSDRFRGVPFFFRTGKRLTEKGTHVNIVFKQMDSIFGEPLAPNILTIYIQPTEGFSLSLNGKQVGEEFNLAPNSLDYRTDATATGASPEPYEKLIYDVLNNNSTNFSHWDEVCASWKLIDRIEKLWAENGAPLHDYKAGSMGPQASFDLLEKFGAKWTWQPDITYRQDGRLE

SEQ ID NO: 59195 - protein, 338 aa, Nostoc punctiforme PCC 73102
MKKKILVTGGAGYIGSHVVRQLGEAGYDVVVYDNCSTSSPASVLHGKLIIGDLVDTGHLYQVFAQHEFSAVLHFAASLIVPESVAHPLDYYANNTRNTLNLLRCCSVMGVNKFIFSSTAAVYGEVEENPVTELNPTQPINPYGRSKLMSEWLIQDYAAASSMRYVILRYFNVAGSEPRGLLGQMSPNATHLIRAACDAALKRKPEVRIFGTDFPTPDGTAIRDYIHVEDLATAHLDALDYLEKRGESQIFNCGYGQGYSVRQVIERVKAISGVDFPVIAAPRRPGDPACVEACADKIRRVLGWQPKHNDLDEIIDTTITWEKHKSNLARQKHLNMAYA

SEQ ID NO: 59196 - protein, 348 aa, Kluyveromyces marxianus
MAIPETQKGVIFYEHGGELQYKDIPVPKPKPNELLINVKYSGVCHTDLHAWQGDWPLDTKLPLVGGHEGAGIVVAMGENVTGWEIGDYAGIKWLNGSCMSCEECELSNEPNCPKADLSGYTHDGSFQQYATADAVQAARIPKNVDLAEVAPILCAGVTVYKALKSAHIKAGDWVAISGACGGLGSLAIQYAKAMGYRVLGIDAGDEKAKLFKELGGEYFIDFTKTKDMVAEVIEATNGVAHAVINVSVSEAAISTSVLYTRSNGTVVLVGLPRDAQCKSDVFNQVVKSISIVGSYVGNRADTREALDFFSRGLVKAPIKILGLSELASVYDKMVKGQIVGRIVVDTSK

SEQ ID NO: 59197 - protein, 175 aa, Triticum aestivum
MPPPVMASSATSVAPFQGLKSTPGLPVSRRSYGASIGSVSNGGRITSMQMWPIEGIEKFETLSYLPPLSTEALLKQVDYLIRFKWVPCLEFSKVGFIFREHNASPGYYDGRYWTMWKLPMFGCTDATQVINEVEEVKKEYPDVYVRIIGFDNMRQVQCVSFIAFKPPGCAESGKA

SEQ ID NO: 59198 - protein, 313 aa, Chlamydomonas reinhardtii
MDKYIRGKVLGKGSFGCAILVTNKLDNKNYVIKEIDISRMPKAERDASEQEAKLLMALNHPNIVRCIECFTHMNKLCIVMDWCSEGKWPEGSRGYQELLKRRGQQLSEDTILDWLVQMCLGLKHVHDRKILHRDIKTQNVFMSSGGLLKLGDFGVSKVLNSTFQLATTAVGTPYYLSPEICQNRKYNQKSDIWSLGCVLYELATLKHAFEAPNMRALIQKIIKGSYPPMPATRSKELRDLCDRMLTLDWQKRPSINDILATPVMKARIQKFLSATLVRLIPAPPTHTSHRAPGLGCAGHRSGHEAPRAETSSP

SEQ ID NO: 59199 - protein, 369 aa, Photobacterium damselae subsp. piscicida
MKSRAAVAFGPGLPLEIVEIDVAPPKKGEVLVKISHTGVCHTDAYTLSGDDPEGLFPVVLGHEGAGVVVEVGEGVTSVKPGDHVIPLYTAECGECDFCTSGKTNLCVAVRETQGKGVMPDATSRFFVNGQPLYHYMGCSTFSEYTVVAEVSLAKINPQANAEQVCLLGCGVTTGIGAVHNTAKVQEGDSVAVFGLGGIGLAVVQGARQAKAGRIFAIDTNPSKFELAKQFGATDCINPNDYDKPVQQVLVEMTKWGVDHTFECIGNVNVMRSALESAHRGWGQSVIIGVAGAGKEISTRPFQLVTGRVWKGTAFGGVKGRTQLPGMVEDAMSGKIELAPFVTHTMELDKINEAFDLMHDGKSIRTVIHY

SEQ ID NO: 59200 - protein, 522 aa, Triticum aestivum
MSSMQFSSVLPLEGKACVSPVRREGSACERLKVGDSSSIRHDRASRRMCNGGRGPAATGAQCVLTSDASPADTLVLRTSFRRNYADPNEVAAVILGGGTGTQLFPLTSTRATPAVPIGGCYRLIDIPMSNCFNSGINKIFVMTQFNSASLNRHIHRTYLGGGINFTDGSVEVLAATQMPGEAAGWFRGTADAVRKFIWVLEDYYKNKSIEHILILSGDQLYRMDYMELVQKHVDDNADITLSCAPVGESRASEYGLVKFDSSGRVVQFSEKPKGDDLEAMKVDTSFLNFAIDDPAKYPYIASMGVYVFKRDVLLNLLKSRYAELHDFGSEILPRALHDHNVQAYVFTDYWEDIGQSDPSFDANMALCEQPPKFEFYDPKTPFFTSPRYLPPTKSDKCRIKEAIISHGCFLRECKIEHSIIGVRSRLNSGSELKNAMMMGADSYETEDEISRLMSEGKVPIGVGENTKISNCIIDMNARIGRDVVISNKEGVQEADRPEEGYYIRSGIVVIQKNATIKDGTVV

SEQ ID NO: 59201 - protein, 643 aa, Mycobacterium tuberculosis H37Rv
MSVWLRAGALVAAVMLSLSGCGGFHAGAPSTAGPCEIVPNGTPAPKTPPATVPSSRNLATNPEIATGYRRDMTVVRTAHYAAATANPLATQVACRVLRDGGTAADAVVAAQAVLGLVEPQSSGIGGGGYLVYFDARTGSVQAYDGREVAPAAATENYLRWVSDVDRSAPRPNARASGRSIGVPGILRMLEMVHNEHGRTPWRDLFGPAVTLADGGFDISARMGAAISDAAPQLRDDPEARKYFLNPDGSPKPAGTRLTNPAYSKTLSAIASAGANAFYSGDIAHDIVAAASDTSNGRTPGLLTIEDLAGYLAKRRQPLCTTYRGREICGMPSSGGVAVAATLGILEHFPMSDYAPSKVDLNGGRPTVMGVHLIAEAERLAYADRDQYIADVDFVRLPGGSLTTLVDPGYLAARAALISPQHSMGSARPGDFGAPTAVAPPVPEHGTSHLSVVDSYGNAATLTTTVESSFGSYHLVDGFILNNQLSDFSAEPHATDGSPVANRVEPGKRPRSSMAPTLVFDHSSAGRGALYAVLGSPGGSMIIQFVVKTLVAMLDWGLNPQQAVSLVDFGAANSPHTNLGGENPEINTSDDGDHDPLVQGLRALGHRVNLAEQSSGLSAITRSEAGWAGGADPRREGAVMGDDA

SEQ ID NO: 59202 - protein, 374 aa, Candida glabrata CBS 138
MSTEADTLLIPGPVILSSKVQRALDVPSLSHTSPEFGAIFQRTLKNTRKLFKADEKEGQPFVIAGSGTLGWDIVGANLIDNNDSALVVSTGVFSEFFAECLELYGANVDKLTAEVGDVVPTEKIREKLKEKNYKLITLTHVDTSTAVLLNVKEIAEIVRQISPETYIIVDGVCSIGCEEFEFKKWGIDYCLTASQKALGAPAGLSISFASQRVVDFVKSDKYKPKSYFTSLKKWLPIMEGYENGTPKYFATPAIQSINSLDAALQEILEDGLEARWTKHAKMSTEFKDKLTKELGLKLVSKYPAESAAHGLTAIYVDEPGKVISHLKAHGVVIAGGIMPSIATKYIRVGHMGVTACDPSVDYIPTCYKLISEAK

SEQ ID NO: 59203 - protein, 360 aa, Acidobacteria bacterium Ellin345
MKTGIVGLPQVGKTSLFVMLTKADVSNRSSNPREAHLGIAVVPDERLDKLAALFNPKRLIHARVEYADVAAISQEALKETAFAANLRNVDALAHVIRAFDDPSIPHVGVIDPLRDIKNLDFDLLVNDLGQVEKRLERVEKDLKKMRSADLEKEFELLKRAKTHLETERPLREMEMTADDKKRFRGFMFLSEKPMLYVLNIGESTTLGDDLENAVAKYGLAEVVSRPNTGAVAVCAKVEAELAQMSDEDAAEFLGSYGLRESGLVRLIRKTYELLGVMSFFTVGEDECRAWTVEQGSRAQNAAGAIHTDLEKHFIRAEVIHWDTLLAAGSEAVARSQGTMRLEGKEYIVKDGDIMHIRHSG

SEQ ID NO: 59204 - protein, 303 aa, Gloeobacter violaceus PCC 7421
MSQDAPSCFTAIISPADRVQVLAEALPYIQRFAGKTIVVKYGGAAMVKENLRDLVIRDIVFLATVGIKPVVVHGGGPEINSWLERLNIPVQFVGGLRVTDKITMEVVEMVLAGKVNKSIVQMINQAGGSAVGLCGRDGSIIEARPHQSAQLQPDIGFVGDIQSVNPKLIQSLLKEGHIPVLSSVASDENGQAYNINADTAAGELAAALDAEKLILLTDTPGILLDKDHPRSLIRKLDIYQARKLIAEGVVDGGMIPKVQCCVRALAQGVRAAHIVDGRQMHALLLEVLTDQGIGSMLVASELV

SEQ ID NO: 59205 - protein, 183 aa, Guillardia theta
RMAMTPPMIPGAPISDVGIFNGSLVSNSARGKDQHSWAEMKPEVFDAILDFYASGQSIITAEEDMPQDTKVNEDDSEIVAMIKELLDTRIRPAVQDDGGDISFIGFDEETGRVTVRLQGACSTCSSSKVTLKSGVENMLMHYVPEVTEVVAVEDEEDPNDPVVKKQREFVAEMTGETYKTPAC

SEQ ID NO: 59206 - protein, 324 aa, Pseudomonas fluorescens PfO-1
MSRIFADNAHSIGNTPLVQINRIAPRGVTILAKIEGRNPGYSVKCRIGANMIWDAESSGKLKPGMTIVEPTSGNTGIGLAFVAAARGYKLLLTMPASMSIERRKVLKALGAELVLTEPAKGMKGAIEKANEIVASDAGKYFMPAQFDNPANPAIHEKTTGPEIWNDTDGAIDVLVAGVGTGGTITGVSRYIKNTAGKPILSVAVEPVSSPVITQALAGQEIKPSPHKIQGIGAGFVPKNLDLSMVDRVELVTDDESKAMALRLMQEEGILCGISCGAAMSVAVRLAETPEMQGKTIVVVLPDSGERYLSSMLFSDLFTDQENQQ

SEQ ID NO: 59207 - protein, 401 aa, Bifidobacterium longum DJO10A
MKTLKDLGDLKGKRVLVRADFNVPLDGTTITDDGRIKAALPTIKTLREEGAKVILMAHLGRPKGKVVPELSLAPVAARLGELLGANVPLAKDTYGEDAQAKVAAMNDGDVVLLENVRFNPEETSKDADERAAYAKKIAALGEAFVSDGFGVVHRAQGSNYDVAADLPAAAGLLVEKEVKALSKATENPERPFTVVLGGSKVSDKLGVIENLLDKANRLVIGGGMVFTFLKAKGYEVGTSLLEEDQLEKVKGYIETAEKNGVELVLPTDVVVNAGFPAGDTPVAPEVVAADAIPADKMGLDIGPESQKLFHDKIVDSKTVVWNGPMGVFEVPEFAAGTKAVAQGLVDATAAGAFTIVGGGDSASAVRNLGFPEDGFSHISTGGGASLEFLEGKELPGLKVLE

SEQ ID NO: 59208 - protein, 342 aa, Coccidioides immitis RS
MAPSFEEPTVALGAASKAAPKLVAPEPEHCPGPESEQAGKGDACAGCPNQSICASAPKGPDPDIPIITARLSSIRHKILVLSGKGGVGKSTFTSLLANAFASNPDSTVGVMDTDICGPSIPKMMDVETETIHVSNAGWNPVWVSDNLAVMSVQFMLPNRDDAVIWRGPKKNGLIKQFLKDVEWGELDYLIVDTPPGTSDEHLSVNSFLKESGVDGAVLVTTPQEVSLLDVRKEIDFCRKAGIRILGLVENMSGFVCPKCTHESQIFKPTTGGGGRLAADMGIPFLGSVPLDPRVGMACDYGENFMDRYPESPASMALRKVVRTISRQVGEDPDEVLPETDAV

SEQ ID NO: 59209 - protein, 145 aa, Vitis vinifera
MTLDKSKSPPQAKRLRSSDRASYRDAPYPKDSRVHRQDYLCNKCKRPGHFARDCPNVTVCNNCGLPGHIAAECNSTTICWNCKESRHLASQCPNDPVCHMCGKMGHLARDCSCPGLLAHDARLCNNCYKPGQVYLLMFNHVVHRY

SEQ ID NO: 59210 - protein, 358 aa, Triticum aestivum
  misc_feature (188)..(188): Xaa can be any naturally occurring amino acid
  misc_feature (205)..(205): Xaa can be any naturally occurring amino acid
MGSIAAGADEDACMYALQLVSSSILPMTLKNAIELGLLETLMAAGGKLLTPAEVAAKLPSAANPEAPDMVDRMLRLLASYNVVSCKTEEGKDGRLSRRYGAAPVCKYLTPNEDGVSMSALALMNQDKVLMESWYYLKDAVLDGGIPFNKAYGMSAFKYHGTDPRFNRVFNEGMKNHSIIITKKLLESXYKGFEGLNTLVDVGGGXVGATVAAITAHYPTIKGINFDLPHVISEAPPFPGVTHVGGDMFQKVPSGDAILMKWILHDWSDEHCGTLLKNCYNALPPHGKVVLVECILPVNPEATPKAQGVFHVDMIMLAHNPGGRERYEREFEALAKGAGFATMKTTYIYANAWAIEFTK

SEQ ID NO: 59211 - protein, 151 aa, Streptococcus sanguinis
MIQSIFAIRFANLLVENIWNRDYIDNVQVTFAEKLGVEERGGYYDQSGALRDMVQNHTLQLLSLLAMDKPKSFSKEDIRAEKVKVFERLVQPDKEDLKRFFIRGQYKSGTVKGKKYISYRSEPNVNPDSMTETFASGAFFVNSERFRDVPF

SEQ ID NO: 59212 - protein, 642 aa, Burkholderia vietnamiensis G4
MIRFNQFSLARGTKPLFESASFVLNPGEKAGLIGANGAGKSTLFAVLRGELHSDGGDFAMPPSWRIAHVSQETPAVDRSALDYTLDGDTALREIEARIAAASAAHDGAAEADAHAAFADADGYTAPARAEALLLGLGFTLAQTRESVASFSGGWRMRLNLAQALMCRSDLLLLDEPTNHLDLDAIVWLEDWLHRYAGTLVVISHDREFLDSICNVTLHLENRQVKRYGGNYSQFEVLRAQQLALQQSAYEKQQKTIEHLQSFVDRFKAKATKAKQAQSRMKALEKMELIAPAHVASPFTFEFRTPDAAPNPMLVMEDVRCGYHADDGAEIPIVERVTLSIQNGQRIGLLGANGQGKSTLIKTLAGTLAPLSGHVREGKGLTIGYFAQHQLETLREDDSPLAHLARLAPDTREQELRDFLGGFNFSGDMATSAVGPFSGGEKARLALALIIWQKPNLLLLDEPTNHLDLETRHALTMALAQFEGTLILVSHDRHLLRATTDQFMLVAKHRLQPFDGDLDDYRDWLLQHAAEQRAAAKADSAASATEPGVNRKDQKRQAAEERQRLSQLKKPLQNRISKLEKQMETLHAEKARLDAFVADPASYEAARKTELTDAIRTLGEVTTRLEAVEAEWLAVQEELEQIG

SEQ ID NO: 59213 - protein, 291 aa, Treponema pallidum subsp. pallidum str. Nichols
MLANLQHLSDIQYRVTQQSATETPFKNEFWNSYQPGFYLDVVSGELLFLSEDKFDSGCGWPSFSAPAYARAVIEKEDRTHNMLRTEVRSRNANSHLGHVFKDGPPERGGLRYCINSAALRFVAREEGTALFAAGCFWSTEAYFRRVKGVLRVRVGYTGGTTKSPTYRNVCTGTTGHAEAVEILFDPQVISYEDLLKHFFRMHDPTSLNKQGGDVGTQYRSAIFYLSGTQKQQAETLMGRYAGAGKFTRPLVTTLEEARDFYPAEEYHQDYLTKNPGGYCHVSLHLASEPLE

SEQ ID NO: 59214 - protein, 401 aa, Bacillus sp. SG-1
MWMKWELAERVSALTPSTTLAITAKAKEMKAQGIDVIGLGAGEPDFNTPQHIMSAATASMEEGHTKYTPASGLAGLKNAIIDKFKDDQGISYEPSEVIVTSGAKHGLYTLFQVLLNEGDEVIIPTPYWVSYPEQVKLAGGVPVFIEGKEDNQFKITPEQLKEAVTGNTKAVIINSPSNPTGMLYSKEELEAIGQACLEKNILIISDEIYEKLVYEGNQHVSIAEISPQLKEQTVVINGVSKSHSMTGWRIGYAAGDAKIIKAMTNLASHSTSNPTTTSQYGAIAAYEGTQEPVEEMRKAFEERLNIVFEKLNAIPGFNCIKPQGAFYLFPNVKEAAEMTGYESVDSFVKALLEEAEVAVIPGSGFGTPDNIRLSYATSLDLFEKALERIHSFVNRKIEESK

SEQ ID NO: 59215 - protein, 250 aa, Oryza sativa Japonica Group
MPIRNIAVGSHQEVYHPGALKAALAEFISTLIFVFAGQGSGMAFSKLTGGGATTPAGLIAAAVAHAFALFVAVSVGANISGGHVNPAVTFGAFVGGNITLFRGLLYWIAQLLGSTVACFLLRFSTGGLATGTFGLTGVSVWEALVLEIVMTFGLVYTVYATAVDPKKGSLGTIAPIAIGFIVGANILVGGAFDGASMNPAVSFGPALVSWSWESQWVYWVGPLIGGGLAGVIYEVLFISHTHEQLPTTDY

SEQ ID NO: 59216 - protein, 151 aa, Streptococcus sanguinis
MIQSIFAIRFANMIFENVWNREHIDNVQITFAERLGVEERGGYYDESGALRDMVQNHTLQLLSLLAMDKPASFTKDDIRAEKIKVFKNLYHPTDEELKEHFIRGQYRSGKVDGMKYISYRSEPNVNPESMTETFASGAFFVDTDRFRDVPF

SEQ ID NO: 59217 - protein, 483 aa, Pseudomonas putida
MKTKLFINNAWIDSSDQQTFERIHPVSSDVVTESANATVTDAIKAAQAAEEAFKTWKAVGPSERRRLLLKVADVMESKTPKFIEVMAMEVGASALWAGFNVHASANVFREAASLATQIQGETIPTDKAETLSMTLRQPVGPILSIVPWNGTAVLAARAIAYPLVCGNTVVFKGSEFSPATHALITQCVQEAGLPAGVLNYLNSSPDRSPEIADALISAKEIRRINFTGSTRVGSIIAQKAAQHLKRCLLELGGKSPLIVLDDADIDAAVKAAVFGSFLFQGQICMSTERLIVDEKIADEFVAKFVEKTKRLSAGDPCVTGDCIIGPMVSPNSGERINGLFKDAIDKGAKVVCGGLAQGALMPATILDHVKSDMRIYDEETFGPITVVIRCKGEAEAVRIANDSVYGLSSGVFGRDINRALRVGMSIEYGSVHINGSTVQNEAQAPYGGTKNTGYGRFDGRAVIDEFTEIKWLTIEPFEQQYPF

SEQ ID NO: 59218 - protein, 458 aa, Bacteroides fragilis YCH46
MKQYDAIIIGFGKGGKTLTAELAKRGWKVALIERSAMMYGGTCPNIACVPTKRLIHEAEKVSWLYPTDYEKQAEAYKAAIARKNEMTAASRANMFNKLSSLPNVTIYTGMASFVSKDVVKVTLPDEVIELQGKKIFINTGSTSIIPAIDGLKDSKRVYTSTSLMELDVLPRHLIIVGGGYIGLEFASMYASFGSKVTVLEGGNKFIAREDRDIADAVKETLEKKGIEIRLNARAQSIQDTADGVTLTYTDTADGNPVTIEGDAILVATGRKPMTEGLNLQAAGVEVDSHGAIVVNGYLHTTAPNIWAMGDVKGGLQFTYISLDDYRIIRDDLFGNKERTADDRNPVAYSVFIDPPLSHVGLTEEEAIKRGYSFKVSRLPASALPRARTLQQTDGILKAIVDSHSGRIMGCTLFCAESSEVINVVNMAMKTGQHYTFLRDFIFTHPSMGEGLNDLFSID

SEQ ID NO: 59219 - protein, 412 aa, Shigella flexneri 2a str. 301
MPQQNYLDELTPAFTPLLAIKEASRCLLCHDAPCSQACPAQTDPGKFIRSIYFRNFKGAAETIRENNALGAVCARVCPTEKLCQSGCTRAGVDAPIDIGRLQRFVTDFEQQTGMEIYQPGTKTLGKVAIIGAGPAGLQASVTLTNQGYDVTIYEKEAHPGGWLRNGIPQFRLPQSVLDAEIARIEKMGVTIKCNNEIGKTLTLEQLKAENRAVLVTVGLSSGSGLPLFEHSDVEIAVDFLQRVRQAQGDISIPQSALIIGGGDVAMDVASTLKVLGCQAVTCVAREELDEFPASEKEFASARELGVSIIDGFTPVAVEGNKVTFKHVRLSGELTMAADKIILAVGQHARLDAFAELEQQRNTIKTQNYQTRDPQVFAAGDIVEGDKTVVYAVKTGKEAAEAIHHYLEGACSC

SEQ ID NO: 59220 - protein, 945 aa, Oryza sativa Indica Group
MTTVVVTSPGSVAPAASSRRRRRIDRPRCPLSTPARDRLPHHQLSAPTLDPLAPPFALGRGALGAESAQGSAARGGRATLAAVKVRTGKGRLVVGGSGGGSFLSIDCGLEADDSYPDDLTGITYVPDGRYTDAGENHKVTTIYRDAWWGPDTRTLYTVRSFPSAEGQRNCYSLPTDVRSKYLVRLEFLYGNYDGLDSSSLKFNLTLGVKHWDTVSIGTTDGNDGYNVHEAVFVAWASWAPVCLINIGQGTPFVSTVELRPLGILPYPAVMGNVSLSLYVRSNLGSSPDDDNLVRYPDDQYDRFWFTDTYTEADPLTTNISTQSTIQPSTEFAVPSPVLQKAVVPSGNSTKQVFFSDQLDALLHDHFVILHFADFQNKKSREFTVSIDNGVQSSPYSTPYLKGLSVTGGWSSNSEGKYNFTIAATATSALPPILNAYEVYGRIIHDNPTTFSQDFDAIMAIKYKYGIKKNWMGDPCFPPEYVWDGVKCSDAGDKIMRIISIDLSNSKLNGSISNSFTLFTALKYLNLSCNQLNGTIPDSLLKNNGSIDFSYESDGNMCKTHATPSLSRNTLAVSVVAPVLVLAILVLAYLIWRAKRKLNTSSTDLAMVPELMGAPGHITNHWDHLQKPENRRFTYQELEKFTENFKHLIGHGGFGHVYYGCLEDSTEVAVKMRSELSSHGLNEFLAEVQSLTKVHHRNLVSLVGYCWEKEHLALVYEYMSRGNLCDYLRGKTGMGEILNWKTRVRVALEAAQGLDYLHKGCNLPIIHGDVKTNNILLGQNFKAKIADFGLSKTYHSDSQTHISAAAAGSMGYIDPEYYTTGRLTESSDVYSFGVVLLEITTGEPPIIPENGHIVQRVKQKIVSGNISSVADAHLGGAYNVSSMWKVVNIAMMCTTDIATQRPKMGDVVVQLKESLDLVEVHGDRGDMENLASDTMSSMSTFGPSAR

SEQ ID NO: 59221 - protein, 180 aa, Triticum aestivum
RYSSDWKVNETDEYSRETRPVSGTNRLIDGDKSKFDFNDAETKTDSMIYKLEIMTIELFSMYGKQFMIDPQDFQDSEPDILANSASAIIERIKENSDQCAMPLRSLCRRKKGLTVEEASLIGVDSLGIDVRAFSGLEARTVRISFNAQALSERSAEKKIRRMLFPRSQRKNVKTSTEDVS

SEQ ID NO: 59222 - protein, 441 aa, Oryza sativa
MYVPPSRGGGGGAAGGGEQPRVYQVWRGSNEFFLQGRFIFGPDVRSLFLTIFLILAPVLVFCIFVARHLINDFPDHWGVSVMVVVVVFTIYDLTLLLLTSGRDPGIVPRNTHPPEPESIDGGSDMGNGQTPQQLRLPRTKDVFVNGVIVKVKYCDTCMLYRPPRCSHCSICNNCVERFDHHCPWVGQCIGRRNYRFFYMFVFSTTLLCLYVFGFCWVYIVKIRDAENSTIWKAMLKTPASIVLSIYCFICVWFVGGLSVFHFYLMSTNQTTYENFRYRYDRRANPYNRGMVNNFLEIFCTAIPPSKNNFRARVPVDQGLQQTRTPARGFMSPNMGKPVGDLELGRKPVSWDEPRSAADIRDLEVGLGGLLDEKEGRIAHASPDLSLPGELVEGRAGMHSRRSSWGHRSGTSESMDSIAVQMGTEANWGSISSGHGTTSSTH

SEQ ID NO: 59223 - protein, 359 aa, Salicornia herbacea
MSAFVGKYADELIKTAKYIATPGKGILAADESTGTIGKRLASINVENVESNRQTLRELLFTSPGALPFLSGVILFEETLYQKTSQGKPFAQLLQENGVIPGIKVDKGVVELSGTNGETTTQGFDSLGARCQEYYKAGARFAKWRAVLKIGPTEPSELSIQQNAQGLARYAIICQENGLVPIVEPEVLTDGNHDIKKCAAVTETVHAACYKALNDQHVLLEGTLLKPNMVTPGSDSPKVAAEVIAEYTVTALRRTVPPAVPGIVFLSGGQSEEEATVNLNAMIKLEVLKPWTLSFSFGRALQQSTLKTWGGKKENLSKAQSVFLVRCKANSEATLGKYVAAGNSDNGAASESLFQKDYKY

SEQ ID NO: 59224 - protein, 345 aa, Streptococcus pneumoniae R6
MAKKIVALVGDGIGPEIMEAGLEVLEALAEKTGFDYEIDRRPFGGADIDAAGPPLPDETLKASREADAILLVAIGSPQYDGVAVRPEQGLMALRKELNLYANIRPVKIFDSLKYLSPLKPERISGVDFVVVRELTGEIYFGDHILEERKARDINDYSYEEVERIIRKAFEIARNRRKIVTSIDKQNVLATSKLWRKVAEEVAQDFPDVTLEHQLVDSAAMLMITNPAKFDVIVTENLFGDILSDESSVLSGTLGVMPSASHSENGPSLYEPIHGSAPDIAGQGIANPISMILSVVMMLRDSFGRYEDTERIKRAVETSLAAGILTRDIGGQASTKEMMEAIIARL

SEQ ID NO: 59225 - protein, 487 aa, Burkholderia xenovorans LB400
MQTDSSFTFVLFGGTGDLSMRKILPALFEAHRAGGMLADSGKIVAVARHAADRSEYLQRVNEHVKPHVSKNGVDEAAWASFLKRIEFVKIDLGNPDDFALLRDAIQDLPGIRVFYLATGPSLFVPICHALASVGLNANARIVLEKPLGYDLKSSNAINDAVGEIFAEEQIYRIDHYLGKEPVQNLLALRFGNALFEPLWRREWVESIQITIAEELGVEARGDFYDNTGALRDMVQNHLLQLLSIVAMEPPHSMDSDSVRDEKLRVLRALKPVDSRDIGKVAVRGQYHSGVIRGTSVPAYATEPGVRPDSTTETFVALKVEIENWRWAGVPFFLRTGKRLADRVAEIVVNFRAVPHSALGASALRAGANRLVIRLQPNETIRLYCLAKQPGEGMNLASVHLDLAFDQFFREGQMEAYQRLLLDVINGRLALFVRRDEQEAAWRWVEPILNEWKASNKPPKPYASGTWGPAASSAMLAQHGTCWLEEEN

SEQ ID NO: 59226 - protein, 437 aa, Desulfovibrio vulgaris subsp. vulgaris str. Hildenborough
MSGGPRACLDLLRECAPMQTFGKITKVVGLVAEGSGIKAPLGAVCHMLPDDGGESVAAEVVGFRDGRLLFMPYGELRGVRPGSLIRNSSLPPVFPVGEGLLGRAFDAFGAPLDGGTPVMPEAWAPLYASPPNPLTRPRIDTPLDVGVRCINSLLTLGRGQRVGIMAGSGVGKSTLMGMMARYTEAQVNVIGLIGERGREVVEFMEKDLGPEGMARSVLVVATSDQSPLVRMRAAYAATAVAEFFRDQGKDVLLMMDSVTRFAMAAREVGLAVGEPPTTKGYTPTVFAQLPRLLERAGRSPEGTITGIYTVLVDGDDFNEPIADAVRSILDGHIVLTRELADQGHFPAIDVLKSISRLRTDICPDDIVNAGRILTRHMATFRRVEDMINIGAYATGSNPDIDKAIAMVGPINDFLRQHITDQQPLPGCYEQLLALAAS

SEQ ID NO: 59227 - protein, 607 aa, Aspergillus nidulans FGSC A4
MPLLEPSATAYGTFGDMRPDTEDEGERLLTDGYVSDDDGSAVTSVDSVQEGVRKIEAINITWTTRSLVIAYISIFLMAFCTSLEGQTIMSLSAYATSAFSKHSLISTVLVVQNVVNAVIKPPMAKIADVFGRFEAFCVSILIYVLGYIQMAASTNVQTYASAQIFYAAGSTGLQILQQVFIADSSSLLNRALLALLPELPFLVTVWIGPTIADVVLENSSWRWGYGMWSIILPASFLPLALSLLLNQRKAKRLNLIKERPHHRRGFVAAVRRTWYDLDIFGLALLSAAVTLILVPLTLAANTKNGWKSNSIVAMIVIGVVCLILLPFWETSKKLAPKPLLSLHLLKQRTALAGCCLAFFYFMAFYFSVQPYLYSYLQVVQGYDVATAGRVTQTFAFTSTIAAFGVSILIKYTRRYRVYVTLGCVIYMTGLLLMLLYRKEGSSPLQVLGTQVIVGMGGGLLNVPVQLGVQASASHQEVAAATAMFLTSMEMGGAVGAAISGAVWTHNIPRKLNLYLPDEYKSEAGAIFGKLTKALSYEMGTPVRSAINRSYQETMNKLLVLALLATLPLIPLSLLMSNYKLDKMSESSDHDDASPRNGLGPGERAKRT

SEQ ID NO: 59228 - protein, 369 aa, Synechococcus sp. PCC 7002
MTDSFDLTLQIIITVFAGISAQVCGEFLKIPSIVLLLIFGIALGGDGFGILHPSEFGVGLEVLVALAVAVILFEGGLNLKLKELNEVSGSLRNLVTIGTLITLVGGGLAAHYLAEFPWAIAFLYASLVVVTGPTVVGPLLKQVAVDRKVATLLEGEGVLIDPVGAILAVVVLDTILNVDAGLGEVASGLALRLGIGAVIGAAGGWLMGQFLRLANFLSEDLKNLLVLAGIWGLFGFAQSVRGESGLMTAVVAGIVLRAFSIPEERLLRRFKSQLTVLCVSVLFILLAADLSIASIFALGWGSFFTVAVLMFVVRPISVALCTANSDLDWKQKFFVAWVAPRGIVSASVASLFAIILTEKGFNGGASIKA

SEQ ID NO: 59229 - protein, 317 aa, Pyrobaculum aerophilum str. IM2
MERIRLGRTDMRVSRIGLGAWQFSGDAWGAITYEQAKAVVSKALEVGINFFDTAAVYGRGRSEEFLGRAIRELGARDHVYIATKIHGDWLRRIDILTSVENQRRRLGVDAIDLYQIHWPACWHNTPICETMKTLEELVDRGLVRYIGVSNFPLALLERARSCLSRVDIVTSQNRYNIIEREADKELLPYLRREGIVLIAWSPLAKGVLTGKYTPSNLPTFEDVRRNDPLFTPQNLKLVWPVVEEITRIAKAHGKTPAQVALNWLIRDPWIYPIPGAKTPEQVVENAGAVGWSLSDDEWRTLDRLGWEASQKIIYVTW

SEQ ID NO: 59230 - protein, 353 aa, Pyrobaculum aerophilum str. IM2
MKIPIKMRAALYKAPGQPLELAETEIPTPGEGEILIKVAATGVCHSDLHILDGEIVPPPEGFILGHEVSGWVVDFGPRCENPHGLSPGDPVVISWIIPCGKCYWCVRGQENYCPYAAARMPGLVGLNGGHAEYMSVPETAVFPIPKEVDVHTAAVISCAYGTAYRALKEAAVGPGTSLVVIGVGGVGLAAVELASALGARPIIAVDVRKHVLEKAAELGATHLINATNGDPLSKIRDILPQGADVVYETKPNPDLKLAVEIVRRGGTIVVTGLGTSTIEIPANHIVMNGIRIIGSLGYKPRTDIPELLTLAASGKIKPQRLISHKYAPNEINEAYKNLRIGLHHRAIIIWNTK

SEQ ID NO: 59231 - protein, 142 aa, Mycobacterium tuberculosis H37Rv
MRIADVLRNKGAAVVTINPDATVGELLAGLAEQNIGAMVVVGAEGVVGIVSERDVVRQLHTYGASVLSRPVAKIMSTTVATCTKSDTVDKISVLMTENRVRHVPVLDGKKLIGIVSIGDVVKSRMGELEAEQQQLQSYITQG

SEQ ID NO: 59232 - protein, 422 aa, Methanocaldococcus jannaschii DSM 2661
MNIVLFLGYLSILFAGGAIIAKIAKKIGIPDIPLLLIFGLILSILNVIPKNIVESSFDFIGNFGLIILLFIGSFEMEWNIMKRVLDVIIKLDILALLIVWIISGIVFNFVFHLPILSLIGLLFGAIVSATDPATLIPIFSSMDIDPEVAITLEAESVFNDPLGIVVTLICLSALGLAKAENPILEFFSLAVGGIILGVIAGKFYEIIISKIKFEDYIAPFTLGLAIAFWYFAEGIFPSITGYEISGFMAVAIMGLYIGNVIVHKKEHKKDMEKVAVFMDELSIFIRILIFVLLGASISIPLLEKYALPAFLCALGSILLARPVGVLIATAIPPIRPLTERIYLALEGPRGVVPATLAAMVYTEIMKHPNIVPKNIASLMPPTELAGTILVATFMTIIVSVVLEASWAKPLANILLKRKTSTS

SEQ ID NO: 59233 - protein, 68 aa, Glycine max
VVWVPGSFEIGVVAERLGKSGKYHAIICIGAVVRGDTTHYDAVANSAGVLSAGLNSGGILLMLIVIIF

SEQ ID NO: 59234 - protein, 465 aa, Zea mays
  misc_feature (216)..(216): Xaa can be any naturally occurring amino acid
  misc_feature (230)..(230): Xaa can be any naturally occurring amino acid
MPLGQRSGDKSDSRYCGVEVLDFPAGEGLPAVLNHSLASAFDFILAPLVDPNYRPAPGAVLPVSASDLVLGPSQWSNHVVGKISEWIDLDAEDERLRLDSELTLKQEIAWASHVSLQACVIPAPRRSFCGNYARVVNQILQGLTNMNLWLRLPLEKSEPMDGDLDKIKNNNHTLQSEIADSWELWNSFRLLCEHSNQLCVALDISFGIQKDAFFYXGTLPSMNSLGRWQXETQVTACLFTSQAFLTNARGYPCLSKRHQRLLTGLFNHSVQAIISGRSNHNVFPASEGVLSGDEGNAEDSYVRHALAPYLEYIAYLYQKMDPLPEQERFEINYRDFLQSPLQPVMDNLEAQTYETFEKDVVKYTQYRRAVAKALVDRVADDAVSTTRTVLMVVGAGRGPLVRASLQAAEETGRKLKVYAVEKNPNAVITLHSLIKLEGWESLEIRYQFAMLEHGKEKKVIKKKKK

SEQ ID NO: 59235 - protein, 170 aa, Guillardia theta
GTRSPRRLKKMERRSRSRSKSPPRRRDDRGSYKSGDRPAGADGGTKLYVGNLSFDTRGEDLMQYFSQFGKVDDTTVIMDRDDPGRSRGFGFVTYSTIADAEYAISKTDNVEWMGRNIRVNMSRPRGDGPRGGGGGGGMRSGGFRGDGRRGGGDRYGDGGRRYGHDDRDRY

SEQ ID NO: 59236 - protein, 389 aa, Triticum aestivum
HASAASSAGPGGSSGSFRNFDLRLRLGVMGAPLAPISSNLADPLPLLSIKGTPIESSSAQYILQQYMAASGGYKMLQSVRNAYAMGKVRMVASEWETATRVVKNRGPSGRGAAAVEQGGFVLWTMAPGMWYVELAVGGSKVHAGCNGRLVWRHTPWLGAHAAKGPVRPLRRVLQGLDPLTTAGLFAEARCVGEKKVNGEDCFILKLSADPQTLKLRSEGPAEIIRHVLFGYFSQRTGLIVHIEDSHLTRIQPHSGGDAVYWETTISSCLEDYRAVEGIMIAHAGRSAVTLFRFGEAAMSHTKTRMEEAWSIEEVAFNVPGLSVDCFIPPADIRSGSVGEACELPPHGDRAKSTAVHPALVAAAAERTHAHGVNAGSGGRGEKIVWRVEV

SEQ ID NO: 59237 - protein, 516 aa, Burkholderia vietnamiensis G4
MTSSINTSPLNAIADQALGLDAAAPAAVEPASDEPTFASLGLSPEIVSALEAAGYAKPTPVQQRAIPAGIAGRDLLVSSPTGSGKTAAFMLPAIERFAQLQKSQAQQPRAPREPNQGDRRARRPQPVARPSLLVLTPTRELAMQVTTAATTYGKHLRRLRTVSILGGVAYGQQLMLLAKNPEILVATPGRLLDHLERGRIDLSELKMLVLDEADRMLDMGFIDDIETIVAATPASRQTMLFSATLDGKIGSLTSRLLNNPERIEIVAKIESRANIAQTVHYVDDRDHKDRLLDHLLRDDALDQAIIFTATKIDADQLAGRLADAGFESAALHGDLPQGARNRTIRALRERRVRVLVATDVAARGIDIPGITHVFNYDLPKFAEDYVHRIGRTGRAGRSGTAVSLVHHAEQGALKRIERFVRSPLPVNVIEGFEPRKAPTRTPGSGGRGRPGGGNGGRRFGGKPGGGYGSGNGRSYGGGTGNGNGGGWSGKPGGSRDGGPRRDGQRSGGPRRSNSAS

SEQ ID NO: 59238 - protein, 489 aa, Shigella flexneri 2a str. 301
MGSETKTTEAPGLRRELKARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMIVGFSFQGTELIGIAAGESEDPAKNIPRAVRQVFWRILLFYVFAILIISLIIPYTDPSLLRNDVKDISVSPFTLVFQHAGLLSAAAVMNAVILTAVLSAGNSGMYASTRMLYTLACDGKAPRIFAKLSRGGVPRNALYATTVIAGLCFLTSMFGNQTVYLWLLNTSGMTGFIAWLGIAISHYRFRRGYVLQGHDINDLPYRSGFFPLGPIFAFILCLIITLGQNYEAFLKDTIDWGGVAATYIGIPLFLIIWFGYKLIKGTHFVRYSEMKFPQNDKK

SEQ ID NO: 59239 - protein, 829 aa, Oryza sativa Indica Group
MPFFIPPSVCALGFLSIDCGLEGDDSYPDDQTGITYVPDGPYVDSGENHRVTTVYRNYWGQDYRTLKTLRSFPSASGKRNCYSLPTDVGDKYLVRLEFLYGNYDSMDSSLLKFNLSLGVNHWNTVNLDTTDDQDGYNFYEAVFVAWASWAPVCLINIGQGIPFVSTVELRLLGTLPYPAIIGNQSLSLYVRRSIGSSADDDMRYPDDQYDRYWIMGETTGAADMSNISTPTIIPPSVPFAVPSPILQKAVVPADNSMKLVFHSDQLDAQLRDHLVILHFADFQNNKSREFTVSIDSGVQSGPFSPPYLKVLSITTDWSSDTEGKYNFTLTATSTSSLPPILNAYEVYGRIIHDNPMTFSQDFDAIMAIKYEYGIRKNWMGDLCFPPEFAWDGVECSSDGKTMRIISLDLSNSELHGLISNNFTLLTALKYLNLSCNQLNGAIPDSLRRKNGSMVLSYESGGDMCKKPVSPSSRNRAAALAVSVVVPMLAVAILGLAYLFWRAKRKHNNDPPTVLELTGAPGHKTNHWDRLQKPENRRFTFEELQKFTDNFKRLIGHGGFGHVYYGSLEDSTEVAVKMRSESSLHGLDEFLAEVQSLTTVHHRNLVSLFGYCWDDDHLALVYEYMSSGNLCDYLRGLDYLHKGCNLPIIHGDVKTNNILLGRNLKAKIADFGLSKTYHSDSQTHISASIAAGSMGYIDPEYYTTGRLTESSDVYSFGVVLLEVTTGEPPIIPGNGHVVQRVKQKIVTGNISSIVDTRLGGSYNVSSMWKVLDAAMMCTTNIAAERPTMATVVMQLKESLELEEAHGERGDMENQARDNTYLMSTFGPSAR

SEQ ID NO: 59240 - protein, 331 aa, Trichodesmium erythraeum IMS101
MKAVVMISPGTPEVLQVQQVADPVIENDREVLIRLKAAGVNPIDTKLRTRGTLYPDKMPAILGCDGAGIVEAIGKNVQKFQVGDEVYFCNSGIGAAPGNYAELAVVDERFVENKPSSLSFVEAAAAPLVLITAWESLYDRGKLQAGRKVLIHGGAGGVGHVAIQLAKLQGAEVATTISSKEKSDFVKSLGTDLAIFKNEDFVKVVLDWTNGEGVDLAFDTIGGKVFYDTIPAVKVYGDLVTILEPDTSLGNLKVARQRNLRIGLELMLTPMTKGLMEAQEDQAKILQQCRRLFDQGKLKIHVNRTFALDDAIEAHRILEAGSMLGKIVLTI

SEQ ID NO: 59241 - protein, 389 aa, Azoarcus sp. EbN1
MSHLMNTYARLPVAFTHGEGVWLFDETGKRYLDGLSGIAVSTLGHNHPRLVRAIAGQAAKVLHTSNIYRIPLQEELSDRLAAVSGMDEVFFCNSGCEANEAAIKLARFHGHRKGIEQPAIVVMENAFHGRTLATLSATGNRKTQAGFEPLVSGFLRVPYKDIGAIRTVGEHNHNIVAVMLEMIQGEGGVNIADETFQRDLRALCDERGWLLICDEVQCGMGRTGSWFGFQQGGVTPDVMTLAKGLGSGVPIGACVTSGRAAGLFGPGNHGSTFGGNPLACAAGLETLATIEDDGLMANAVKVGEAIRTGLQEALAGLSGVVDIRGRGLMIGIELDRPCGDLVRQALDAGLLINVTADRVIRLLPALVFTEANAQELVSRLAPLVRKHLE

SEQ ID NO: 59242 - protein, 307 aa, Azoarcus sp. EbN1
MTKPRHYLQFKDFTRDDYRHVFDRTRWIKDKFKRYEPYHPLFDRTLVMIFEKASTRTRLSFEAGMQQLGGSAIYLNTRDSQLGRGEPVEDAAQVISRMSDVVMIRTFEQDIIERFAAHSRVPVINGLTNEYHPCQILADIYTFIEHRGSIQGRTVAWVGDSNNMCNTWLQAAELLDFNVHVSTPPGYEVEPERAGLYGTGHFEQFADPMEACKGADLVTTDVWTSMGFEAENDERMKDFADWCVDAEMMAAARADAVFMHCLPAHRGEEVTADVIDGAQSVVWDEAENRLHVQKALMEYLVLGKVED

SEQ ID NO: 59243 - protein, 319 aa, Oceanicola granulosus HTCC2516
MMDWTDRHCRYFHRLLSREALLYTEMVTAPALVRGGAVHLLEHDPAEHPVALQLGGSDPAELAEAARLGAAAGYDEINLNCGCPSDRVQSGTFGAVLMNAPERVAECCAAMIGAQPREVTVKCRIGVDEQVPEEVLPRFLEAVAAAGVRRVAIHARKAWLQGLSPKENRDVPPLDYDLVVAMKAAFPGLHISINGGIATLDAARALLARGLDGAMVGRAAYHEPAAILLPADAAIFGRASEMTAEDAALAMLPYIERHLAGEGGRLIQVTRHMLGLFAGRPGARAWRRHLSENGTRPGAGPEVVEAALALVRQAGSQAA

SEQ ID NO: 59244 - protein, 313 aa, Shigella flexneri 2a str. 301
MEKRKIILDCEPGHDDAIAMMMAAKHPAIDLLGITIVAGNQTLDKTLINGLNVCQKLEINVPVYAGMPQPIMRKQIVADNIHGETGLDGPVFEPLTRQAESTHAVKYIIDTLMASDGDITLVPVGPLSNIAVAMRMQPAILPKIREIVLMGGAYGTGNFTPSAEFNIFADPEAARVVFTSGVPLVMMGLDLTNQTVCTPDVIARMERVGGPAGELFSDIMNFTLKTQFEYYGLAGGPVHDATCIGYLINPDGIKTQDMYVEVDVNSGPCYGRTVCDELGVLGKPANTKVGITIDTDWFWGLVEECVRGYIKTH

SEQ ID NO: 59245 - protein, 473 aa, Trichodesmium erythraeum IMS101
MGQQKFGVIGLAVMGENLALNVERNGFPISVYNRSDDKTKKFMAERAQGKNVHAAYSLEDFVQSLERPRRILVMVKAGNPVDKVVEQLKPLLDKGDMIIDGGNSLYEDTERRTKDLESTGLGFMGMGVSGGEEGALWGPSLMPGGTEASYKELEAILTKIAAQVDDGPCVDYVGPGGAGHYVKMVHNGIEYGDMQLIAEAYDLLKNAVGVSNEQLHEIFAEWNKTPELESFLIEITADIFTKKDTETSNHLVDMIVDSAGQKGTGRWTVINALELGVAVPTITAAVNARIMSGIKEERVGAAKELTGPSGQYEGDKQAMINKVRDALYCSKICSYAQGMALLAQASRQFDYKLNLGECARIWKGGCIIRAGFLNKIKKAFDENPALPNLLLAPEFKQTILDRQNAWREVVALAGKLGLPVPAFSASLDYFDSYRRVTLPQNLTQAQRDYFGAHTYERIDKSRGQFFHTEWPTK

SEQ ID NO: 59246 - protein, 194 aa, Wolbachia endosymbiont of Onchocerca volvulus
MVSNMFIQIKETPNLNTLKFLPGFMILNEGETVDFSSANETKNSKLAANLFRIEHVIRVFFGHDFISVTKSDDINWNTLKVEVLTTIMDHFASSGKALDREGTNDNDILEEEFFDKSDTEIVSRIRELMESYIKPAVVQDGGDIKFRGYKNGIVYVELQGACSGCPSATITLKQGIQNMLCYHIPEILGIDTIL

SEQ ID NO: 59247 - protein, 128 aa, Zea mays
VTDYTLYTGSLGTALLLFKSFQVTGDRGDLTLAADIVRACDDASRGLPRRFLTFICGRAGVCALGAVIAKHCDDQLRVTQYLSSFDEITITEKVPNELLYGRAGYLWACLFLNKHLSEKTIPLEHIVC

SEQ ID NO: 59248 - protein, 322 aa, Vitis vinifera
MSTTTKLSKDAYGKYVDQKLYRNPHLGLIFCSLILPSVTISRSHVSMHGWLLGHQSGVFDGQPEVDTCPKNLQKAADAGEEKGASEGFIGAAGGGGAVQKGKLVGFVDIGGGLKALTAKQSLTGKGFFQCQRLPGLVLGFVSRSTSLSPTTESKCNEKTEIKDVGTVESKLGMVTADDGRCSGIGAFMLRKGGLAVNAEVATARRVGIFNLMAGGIGGGAFMIVQSSSTSKSEAFGMRETAPLVAPQNMYENNPRAKYLGTLAMGVLKEIAGLRDAGFEHGRLVWRSLFQPAIRLAKYGYMLQMGSCYEQGICAIIWNLATV

SEQ ID NO: 59249 - protein, 341 aa, Desulfovibrio vulgaris subsp. vulgaris str. Hildenborough
MSTFDSVLQDINASPRTWLVTGVAGFIGSNLLETLLRQGQRVVGLDNFLTGYQRNLDMVRDLVGEERWASFRFIEGDIRDLATCHEACKGVDHVLHQAALGSVPRSIDDPILSNECNITGFVNMLVAARDAGAKSFVYAASSSTYGDEPTLPKVEDIIGKPLSPYAVTKYVNELYADVFARCYGFTAIGLRYFNVFGQRQDPFGAYAAVIPQWFASLLRGETVFVNGDGETSRDFCYIDNVVQANILASLAPAEARDKVYNVAFGQRTTLNELFDLIREEVVRHKPEAAGATCVHRDFRAGDVRHSLADITRAQTLLGYAPVYDVREGLRLAGDWYAANLK

SEQ ID NO: 59250 - protein, 449 aa, Haemophilus somnus 2336
MSAIVSLEDFLAKVEQRDGHQPEFLQAVREVFTSIWPFLEKNPKYRSEALLERLVEPERAFQFRVAWTDDKGQVQVNRAFRVQFNSAIGPFKGGMRFHPSVNLSILKFLGFEQIFKNALTTLPMGGGKGGSDFDPKGKSDAEVMRFCQALMSELYRHVGADTDVPAGDIGVGGREVGYLAGYMKKLSNQAACVFTGRGLSFGGSLIRPEATGYGLVYFAQAMLAEKGQSFAGKTVVVSGSGNVAQYAIEKALQLGAKVVTCSDSSGYVYDPEGFTQEKLTALLDIKNVKRGRVKDYAEQFGLQYVEGARPWGVKADIALPCATQNELELSDAQQLIANGVQLVAEGANMPTTIEATDAFLEAGVLFGPGKAANAGGVATSGLEMAQSSQRLYWTAEEVDEKLHRIMLDIHANCKKYGTVEGQKNINYVVGANVAGFVKVADAMLAQGVY

SEQ ID NO: 59251 - protein, 327 aa, Wolbachia endosymbiont of Drosophila simulans
MAISILGAGAWGTAIAISLGSKKDVILWTRNETTFESINGKRESDKLPGCRISDNVSVKLAIEDTINASVTILAVPTQSLRKVCQQLHNCNLKKDVAIILACKGIEKSTLKLPSEIVNEILPNNPIAIFSGPSFAVEVARKLPYSMVLACQNNTLGSKLVSELQQENVKLEFSNDIIGVQICAALKNVFAIACGIVLGSKLGFNAHAALITKSMSEIKALYSAKIGDGSVDINTLLGPACLGDLIMTCTSLNSRNLSFGFKIGNSDNGFNVQQILSEGKSVIEGFSTAESIFNLAGKLKIKMPICEAVYRLLYESASIEDTISVLIS

SEQ ID NO: 59252 - protein, 546 aa, Caulobacter crescentus CB15
MPDRRRFAGRWGNAHMAGNRLFLKKSIASIQKEAAHSQLKRTLGPINLMSLGVGAIIGAGIFVLTGQVASANAGPAIMLSFIVAGIACALAGLCYAELASTMPVSGSAYTYAYGTLGEVFAWIMGWLLVLEYGVAASTVAVGWSGYVVSTLHALGINFPMIQVAGADAPMWATPLIQAVAAPGGGTMFAMTGTLNLVAAIGIAMVSALLVVGVSESANVNNAIVVIKVIVLVTFIAVGAQYINPANWHPFIPEPTGQPGEFGIGGIFRGAAIIFFAYVGFEAVSTAAAEAKNPSRDVPIGILGALIICTLIYMAVAAVMTGVVPFRELASPAPIAVAIDRMGLEWADIPYAAAEGGKLNLLSFAIKIGAITGLSSVMLVLCYGQTRIFYTMARDGLLPKVFAEIHPKFRTPWLGTILLGVVIAIAASFLPISLLGDLVSLGTAVAFSIVCLSVIYLRIKHPDLPRPFKVPGGIFTAAAGIAACLFLPYQNFQPMIVHAMNDNPLPLMILGGYAAVGAIIYIAYGYWHSKLAKGIDITEETDPNSPA

SEQ ID NO: 59253 - protein, 621 aa, Candida glabrata CBS 138
MLFSALLFWLFGCLASAKTHTFHFTVDWVDVKLDNGAHKKMIGFNGQWPMPDIHVMKGDRVELYLTNGFKDGMQTSLHFHGLSHNTSYGNEIQRDGPSMVTQCPIVSGQTYLYNFTVADQVGTYWYHAHEGSQYGDGFRAAFVIHDDDFPYEFDEEMTLSVADLYYKPYYEIKDTFLSRYNPTGAEPIPQMLLFNNSASGRLYFEPGKTYLLRIINMGLFVSQYLSIEDHEMTIVEVDGVYTKKNVTSMLYIATGQRMSVLIKAKTQNPKRNYAFMQLLDETMLDVIDPDLQLNVTNQLIYDKSKPDAKEYFFDSLEQATNEFYLEPYEDIDIFESYDKQITFDVRMKNLGDGVKYAFFNNITYVSPKIPTLTTALTSGKLATDPRIYGDNINVVVLEQNEIVEIVLNNYDTGKHPFHIHGHNFQIVQKSPGFHLDETFDESEQDQKTVRYNESAPLMDFPKHPIMRDTLVLEPNGHAVLRFRADNPGVWIFHCHVDWHLEQGLAAVFVESPLILQERETLSQNYKDVCSAAGMVNVGNAAGKSEDWLDMSGLPRQPKPLPDGFTAKGYFAFIICTLVGLWGLYSISNYGFSEVIPDDKAVFDSLKSVLDSNGISYSLEEH

SEQ ID NO: 59254 - protein, 437 aa, Desulfovibrio vulgaris subsp. vulgaris str. Hildenborough
MSTIVSVWAREILDSRGNPTIEVEVSLESGHSGRAAVPSGASTGTREALELRDGDKGRYKGKGVEKAVDNVMGEIAEAVIGLDALRQVQLDNTLLDLDGTDNKERLGANAMLGVSLATARAASSFLGLPLYQYLGGVNAKVLPVPLMNIINGGAHAPNNLDIQEFMIMPIGAATFRDALRMGAETFHTLKALLAADGHVTSVGDEGGFAPNLKSHDEAFKYITRAIEESGYIPGAEIALAIDAAASEFYRDGKYHLAGEGKTFSNSEMTEWLGEFTAKYPLISIEDGLAEGDWEGWGELTYKLGDTVQLVGDDIFVTNPDILAQGIDEGVANSILIKLNQIGTLTETLDTIEMAKQAAYTTVISHRSGETEDHFIADLAVGLNAGQIKTGSLCRSDRLAKYNQLLRIEEDLDDAGIYFGPMIASHFGYEGDEEFEDA

SEQ ID NO: 59255 - protein, 342 aa, Haemophilus somnus 2336
MKTVVSLGEILLRLSPPQYQTLTLTTSLECQFGGSELNVLSTLAQLGHNVSLISAIPDNDLGRMTKNFLFSRQINQDYILEKGQRLGIYYYQKGFSLRASRVTYDRKHSAFWESQLSDYDLESVFKGADWFHVSGITPALNDNLYSLTHYLMTKAKAEGLTVSFDLNFRASLWNSFQEARELLSPLAALADVCIGIEPLSLSGDGQGDLKDQLGLTRPYEDQELLKSILDKLAKTYSVKSFAFTQREMGHTNEYLLKGYLYQDGHLYQTDKSGIQVLDRVGTGDAFTAGIIHGMLKKESPEKSLAIAMASFKFKHTIEGDINVISQADIDQLLDETSHEIKR

SEQ ID NO: 59256 - protein, 487 aa, Staphylococcus xylosus
MGEFKGFMNYDKQQLHELSLVDRLKSHDAFQQRFTKDEAAQQGARCMDCGTPFCQTGEPFGRETIGCPIGNYIPEWNDLVYRQDFKTAYERLNETNNFPEFTGRVCPAPCEQSCVMKINRESVAIKGIERTIIDEAFENGWVKPTVPEHRKDESVAIVGSGPAGLTAADELNKLGYNVTVYERAHEAGGLLMYGIPNMKLDKDVVRRRIKVMEESGIHFETDTEIGVDISKETLNEQYDAIILCTGSQNARDLPLEGRMGSGIHFAMDYLTEQGQYLNGEIEEPSISAEGKNVVVIGAGDTGADCVATALREDCKSIVQFNKYTKQPEEIEFDENTYWPLAMPVFKMDYAHKEYQSRFGFEPRAYGVQTMRYDVDRIGNVKGVYTQILEETDEGMVVVDGTERHWPADLVLLSIGFVGTETTVPHAFDIQTERNKIVADNKDFRTNQPHIFAAGDARRGQSLVVWAIQEGRAVADSVDSYLKEKTLV

SEQ ID NO: 59257 - protein, 286 aa, Listeria monocytogenes str. 4b F2365
MEKIGFVGTGVMGSSMAGHLLEAGYEVLVYTRTKTKAEDLLEKGALWIKTPGELANKVDILISMVGYPKDVEELYLGENGFLENLAVGTVAIDMTTSSPALAKKMAEFGREKGIGVLDAPVSGGDIGAKNGTLAIMVGGSEDVFLKVKPIFDILGSSVILQGDAGAGQHTKMVNQIAIASNMIGVTEAIIYAEAAGLNPSSVLDSISGGAAGSWSLANLIPRVLKDDFSPGFFIKHFIKDMGIAISEAKQMGLELPGLTLAEKMYQTLAEQGLSEEGTQALIKYYR

SEQ ID NO: 59258 - protein, 510 aa, Coccidioides immitis RS
MSPSQNHNGEHQNPSAKELKDDTVIVVLGASGDLAKKKTFPALFGLFRNKFLPKDIKIIGYARTKMDHAEFIKRVRSYIKVPTKEIEEQLASFCELCTYVAGQYDQDDSFIALNKHLEELEKGKTEQNRVFYMALPPSVFVPVSEHLKKNCYPKKGIARIIVEKPFGKDLESSRELQRALQPNWREDEVFRIDHYLGKEMVKNILILRFGNEFFNATWNRHHIDNVQITFKEPFGTEGRGGYFDEFGIIRDVMQNHLLQVLTLLAMERPVSFSAEDIRDEKVRVLRGIDPIKPKNVIIGQYGRSLDGTKPSYLEDDTVPKDSRCPTFCAMVAYIKNERWDGVPFILKAGKALNEQKTEIRIQFRDVTSGIFKDIPRNELVIRVQPNESVYIKMNSKLPGLSMQTVETELDLTYRRRFSDLKIPEAYESLILDALKGDHSNFVRDDELDASWRIFTPLLHYLDDNTDIIPMEYPYGSRGPPVLDDFTASFGYKFSDAAGYQWPLTTAPNRL

SEQ ID NO: 59259 - protein, 381 aa, Listeria monocytogenes str. 4b F2365
MTKSIRPELRDIQVSGIRTFNTRVTGIPDMIRLTLGEPDFPTPEHVKQAAISAIEENFTNYTPNAGMPELLEAASTYFHEKYDLSYNNKEIIVTVGATEAISVALQTILEPGDEVILPDPIYPGYEPLITLNRAHPVKVDTTETNFKLTPEQLRAHITPKTKALIIPYPSNPTGVTLSKKELFALAEVLKETGIFVIADEIYSELTYHEEHVSIAPLLREQTIVINGLSKSHAMIGWRIGFLLAPEALTQEMLKIHQYSVTCASSISQKAALEALTNGKDDAFQMRTEYKTRANFTQDRLEKMGFTVIPPDGAFYFFVKLPDEITENAFDWAVKLAEEAKVAVVPGNAFSEKGDRYFRLSYATSFNNLAEALDRMAQFIAK

SEQ ID NO: 59260 - protein, 442 aa, Aspergillus nidulans FGSC A4
MAKHTKSHAHPKPPSGAAKGKGSAASVSKTPKSMVIRIGGSRVGSSVSQLVKDVRLMMEPDTAVRLKERKSNRLRDYAVMAGPLGVTHFLLFSKSSTGNTNMRLALTPRGPTLNFKVESYSLCRDVEKALKRPRGGGQDHKTPPLLVMNNFNSPNADENSKVPKRLESLTTTVFQSLFPPINPQATPLKSIRRVMLLNREPASESDKEGSYILNLRHYAITTRKTGIPKRIRRLDPKEVRNREKHKSAVPNLGKLEDAADYLLDPSAAGYTSASETELDTDAEVEVAGTTTRKVLTKREMQRMKTGEKVEKKTTTAEVEKRAVKLVELGPRMRLRLIKVEEGLCEGRVMWHDYIHKSQQEVDALDKTWDQKIKEKEARKKLQRENVERKKQEKAKARAEGKEVEDDEDDEDVDMDDEWISDDEEEQNQEVDEEDEGDESIDE

SEQ ID NO: 59261 - protein, 237 aa, Methanocaldococcus jannaschii DSM 2661
MIIIPAVDLKDKKCVQLIQGDPNKKHLELNNPVEVAKKFVDEGAEYLHIIDLDAAFGTGNNRDVIKNIIKEVNVPVEVGGGIRNLEIAKELISLGVDRVIVGTKAILEPKFIDDLNKEIGKDKIVLAVECKEGKVVIKGWKEKVDKTPIEVIKEFEDKVGYILFTNVDVEGLLKGINVDIIKELIEKTDIPIIYSGGITTLEDIKALKELGIYGVVIGSALYKGLIDLKKALEIVKN

SEQ ID NO: 59262 - protein, 171 aa, Kluyveromyces lactis NRRL Y-1140
MSSDTLPNTRFQYIRIIPSQEGTEACSAPVETSFTEYKGTVVITGAPAAFSPTCSVSHIPGYVQKLNQLVDAGASQVFVVTADNPFANQQWAKTLGVKDTDKIKFITDAGAKFSQSLGFALPIESGVFWASRYLVIAKDGKIVYQAVEENPATDVTVSSVDNALEQLNKIK

SEQ ID NO: 59263 - protein, 444 aa, Kluyveromyces lactis NRRL Y-1140
MSNEEFIRTQIFGTVFEITNRYTNLNPVGMGAFGLVCSATDTLTSQPVAIKKIMKPFSTSVLAKRTYRELKLLKHLRHENLICLEDIFLSPLEDIYFVTELQGTDLHRLLQTRPLEKQFVQYFLYQILRGLKYVHSAGVIHRDLKPSNILINENCDLKICDFGLARIQDPQMTGYVSTRYYRAPEIMLTWQKYNVEVDIWSAGCIFAEMIEGKPLFPGKDHVHQFSIITDLLGSPPKDVIDTICSENTLKFVTSLPHRDPVPFSSRFQNLEPDAIDLLEKMLVFDPKKRITAADALAHPYLSPYHDPTDEPIAEAKFDWNFNDADLPVDTWRVMMYSEILDFHQIGDPQINTNATFDDQVAAATVAAAEAASKQQQQQQHQTEEQTQQTIASTPPQAQVTPQQLESGANSNSNSNPSFSIGPDPANETLTNFANQADQYVSKFK

SEQ ID NO: 59264 - protein, 308 aa, Aspergillus nidulans FGSC A4
MIRSPAVRKVGYCFLFLLLASCVQESSASLGDHLPDFKSCVKICEAENCQDGDSAIHRRLARDPPMLSPVVQFHGKWPFRRILGMQELFSVIFSGLNFLAHWYGMARLREMTPSWHPLQKYYIAFGYSGLAAWTFSMLFHARDFPLTEKLDYFGAGASVLYGLYLATVRIFRLDKEQPRYRPTLRRLWTTVCILLYTIHVCYLSFWSWDYTYNMIANIVVGMIQNTLWICFSVVRYQKTGKTWTLWPALIVVWIILAMSLELLDFPPWYALIDAHSLWHLGTVIPCAWWYLYLVKDIQDDVAGERLKA

SEQ ID NO: 59265 - protein, 152 aa, Guillardia theta
FGMRSLPVLFLAVTAASAFVPPLKNPFPALFGISPCNLPCIASSRPVARFAGLSMQELDPNKCFVSGLPWALTSEDLRDLFAEFGAIQDANVVYDRETGRSRGFGFVTFAESADCEAAITAMDKANIGGRTVLVKQANVREARPDRNRMRSD

SEQ ID NO: 59266 - protein, 900 aa, Oryza sativa Indica Group
MAPMLLFAALMLASLSEAAADDGIGGQSGFVSIDCGREANYSDYKDPKTGIVYVSDEPYIDAGAGENHRISATATATAADSYLLQTLRSFPSGPRNCYALPTVAGTKYLVRLGFLFGNYDGENSSSSSASSLRFDLHLGAQRWATVDDVVVQTGGISRMYEVVFMGWARWAPACLVNVGGGTPFVSSVELRPIDDELYPSVKTSESLSLFKRSDMGADTTTLTRYPADEHDRIWKGTGNPGSTDISTQEKIQSENSFEVPLPVLQTAITTPGGNGTTLTVAWQDTRSSSEYMVFLHFADFQKIQPRQFNVTLNDIPIGSNGRSLMFSPSPLDSSSVYSSDGYRADDGNYNLVLRRTAASALPPMLNAMEIYTVITHDSPRTFHKDFDAIMDIKYEYGIKKNWMGDPCFPSEFIWDGIKCSTAGDDNTSRIISLDLSQSNLQGVVSINFTFLTALNYLNLSGNQLNGPVPDSLCKNIAGLYIFSYTSDGDICNNRTSSSRSTNRSTTILAISIVTPVLAVAILLAFLLWRAKGKHNGLTSFGISLISYNWFMQKPVSTCDPPRVPDPKKAPGSTTDHWSHLPINGSRQFTYEELKNFTLNFQRFIGQGGFGHVYYGCLEDGSEVAVKMRSESSLHGLDEFLAEVQSLTKVHHRNLVSLVGYCWEEHYLALVYEYMPSGSLCDHLRGKRDVGETLNWAKRVRIMLEAAQGLEYLHKGCNLPIIHGDVKTNNVLLGENLKAKLADFGLSKMYISDSQTHISVTAAGTVGYIDPEYYQTGRLTESSDVYSFGVVLLEVVTGELPILAGHGHIVQRVERKVTSGSIGLVADARLNDSYDISSMWKVVDTAMLCTTDVAIQRPTMSTVVLQLKECLALEEAREDRNRAGPTNDAVDVVSTFGPSAR

SEQ ID NO: 59267 - protein, 488 aa, Coptis japonica
MEVLSIAIVSFSFLLFLFFILRDSRPKNLPPGPRPSPIVGNLLQLGDKPHAEFAKLAQKYGELFSLKLGSQTVVVASSPAAAAEILKTHDKILSGRYVFQSFRVKEHVENSIVWSECNDNWKLLRKVCRTELFTPKMIESQSEIREAKAREMVKFLRGKEGEVVKIVEVVFGTLVNIFGNLIFSKDVFDLEDPTGGSVELKEHLWKLLDMGNSTNPADYFPIMGKLDLFGQRRAVAEVLQQIYDVWGVMLKERRGTKGSESKNDFVDVLLNAGLDDQKINALLMELFGAGTETSASTIEWAITELTKKPLVVSKIRLELVNVVGDNTVKESDLPHLPYLQAFVKETLRLHPPTPLLLPRRALETCTVMNYTIPKECQIMVNAWAIGRDPKTWDDPLNFKPERFLSSDVDYKGNDFELIPFGGGRRICPGLPLASQFSNLIVATLVQNFEWSLPQGMSTSELSMDEKFGLTLQKDPPLLIVLKARASNI

SEQ ID NO: 59268 - protein, 153 aa, Brassica napus
VSGGGVVVPYQSYHSGGGSKKSGRSREFYDDDDEEEEEDEEVVRGSGKKMRRDEYASTEKKREGRGKIDREADDQQVLLLEEKDVVSSVATVLSDLCGPGDWMPMEKLHSVVSDCYLLLSCLLLVQDLARVFYCRKTPCFLHVIRSITMYTSS

SEQ ID NO: 59269 - protein, 334 aa, Oryza sativa Japonica Group
MEERYEALKELGAGNFGVARLVRDKRSKELVAVKYIERGKKIDENVQREIINHRSLRHPNIIRFKEVCLTPTHLAIVMEYAAGGELFEQICTAGRFSEDEARYFFQQLISGVSYCHSLEICHRDLKLENTLLDGSPTPRVKICDFGYSKSALLHSKPKSTVGTPAYIAPEVLSRKEYDGKVADVWSCGVTLYVMLVGSYPFEDPGDLRNFRKTISRILGVQYSIPDYVRVSSDCRRLLSQIFVADPSKRITIPEIKKHTWFLKNLPKEISEREKADYKDTDAAPPTQAVEEIMRIIQEGKVPGDMAAADPALLAELAELKSDDEEEAADEYDTY

SEQ ID NO: 59270 - protein, 301 aa, Lactobacillus reuteri
MKKLIKRLFLKQNPRVYEEKDAQLTPSLRTRDLIGLGTGMVVGTAIFTLPGIVAAEHTGPAVPLAFIVAAIGAGLSALAYAETSSVLPFAGSAFSWINVLFGEFFGWIAGWALLAEYFISVAFVASGWSAYMQGFLGSFGIKLPHALTGGFDPHTGSYIDILAAFAILIVGVLISRGVHQVSRIENIIVSVKLLVILMFIVVGVTAIHPQNYVPFLPAHQPGTTFGGWQGILAGTAQIFIAYVGFDAIAANTAETINPQKTMPRGLIGTLLLGTGFFIAVSLVLVGMFKYSRYANNAEPAA

SEQ ID NO: 59271 - protein, 340 aa, Arabidopsis thaliana
  misc_feature (177)..(177): Xaa can be any naturally occurring amino acid
MTSYNNSSGSLALAVALLFAGALYIYFSSRSASDPISGLLQNVNTRLIQYPVDELETVLDKASTGNNKTVIIAMVNKAYVEEDGGGRTMLDLFLESFWEGEGTRPLLNHLMVVAADQTAYDRCLFRRLHCYKMDTEGVDLEGEKVYMSKDFIEMMWRRTRLLLDVLSRGYHIIFTVXDTDVMWLRSPLSRLNVSLDMHISVDRNNVRGQLINTGFYHARSNNKTISLFQKWYDMRLKSLGMKEQDVLKNLLDSGFFNQLGLNVGFLSTAEFSGFCQDSPDMGAVTTVHANCCVHIPAKISDLSLALRDWKRYKASRVNSRWSPHVECRRSWKDVHYVPKL

SEQ ID NO: 59272 - protein, 223 aa, Clostridium difficile 630
MIKLAPSILSADFAKLLEDVRKVESAGCEYLHIDVMDGHFVPNITLGPLVVKSLKKENINMVFDAHLMIENPDQYIEEFVKAGCDIITVHQEACVHLHRTIQNIKSHGIKAGVVLNPATPVDTIKHVLPDLDMVLLMSVNPGFGGQSFIPCVLDKIKELKAIIDSQGLNIDIEVDGGISPKNVAEVVQAGANVIVAGSAIFGSDDIQETVNLFRKNASLEELV

SEQ ID NO: 59273 - protein, 496 aa, Mycobacterium sp. JLS
MTDITTEQLATFELLIGGEPAAAASGATYDSVDPYTGRPWARVPDGGSADVDRAVAAARAALEGPWGTLTATARGKLLWRLGEIIARDAEQLAELEVRDGGKLIREMVSQMRSLPEYYFYYAGLADKLQGEVVPTDKPNYLVYTRHEPVGVVAAITPWNSPLLLLTWKLAAGLAAGCTFVVKPSDHTPASTLAFAKLFAEAGFPPGVINVVTGWGPETGAALASHPGVDKVAFTGSTATGIQVGKAAIENMTRFSLELGGKSAQVVFDDADLDAAANGVIAGVFAATGQTCLAGSRLLVHESVADALVERIVERAATIKLGDPKDPTTEMGPVSNQPQYEKVLSHFASAREQGATVAYGGEPAAELGGLFVKPTVLTGVDPSMRAVAEEIFGPVLAVMTFTDEDEAVAAANASEFGLAGAVWTKDVHRAHRVAAKLRAGTVWVNAYRVVAPHVPFGGVGYSGIGRENGIDAVKDFTETKAVWVELSGATRDPFTLG

SEQ ID NO: 59274 - protein, 669 aa, Clostridium difficile 630
MGDTILGNRYEIIRKIGDGGMAFVYEAKDRLLNRTVALKVLRPEFVDDDEFLTKFKREAEAVASLSHPNIVNVYDVGEDGKVHYIVMEFVDGKNLKEIIQDEGILDEYTALDITKQIAMALSAAHKKGIIHRDIKPHNILISNEGRVVKVADFGIAKAVSNSTMTNIGSIIGSVHYFSPEQAKGKFVTNNADLYSLGIVLYEMLIGKVPFRGDSPISIALQHINDDIDFTSEEKVRIPQSVRTTIKKLTEKSSADRYQTAEELIEDIEYIEKNIDLDFIKEYDDFATKKIDEKEINKVVNPTLAKPAPEKVVKPVEVADLDDDEDYYDDFYEEDDDEEEEEIMRAKKNQRPKSTPSKRTKKKKKKQESPKSRRRLKVIAAVLILILCAQVFLAYKFLFAGGFGNKSLTVPNLVNMTLEEAQSAVEKEGLYLSVKSEEYNSEVDENCIISQTPEGGSTNVKKGDTINVVVSKGSSQASVPNVVGLTLSNAKQLIEENNLKVGTVKYEYSSIYKEGTVLSQSPGAGSSRAQEGDEVNLYVSKGSEKSNTQTPTVPDKKPTTPENNTPTEPGSNSGNSGGNSGGSNSGNSGGNSGNNGSNSGGSNSGNSGGNSGGSNSGDNGGSSGGSNSGDNGGSSGGSNSGDNGDSSGGSNSGDNGGTSSGTGANIGKTE

SEQ ID NO: 59275 - protein, 204 aa, Listeria monocytogenes str. 4b H7858
MDLPLSKRVKGVAPSPTLAITAKAKQMKQEGIDVIGLGAGEPDFNTPQNIIDAAIESMNKGFTKYTPSSGIIELKQAIVDKLQKDQFLNYETNQIFVGTGAKHVLYSAFQTILDPGDEVIIPVPYWVTYPEQVKLAGGIPVFVETGFDADFKISAANFEKAITKKTKAIVLNSPNNPSGMCYTKEELIAIGEVAEKHQIYILSD

SEQ ID NO: 59276 - protein, 356 aa, Triticum aestivum
MGSIAAGADEDACMYALQLVSSSILPMTLKNAIELGLLETLMAAGGKFLTPAEVAAKLPSAANPEAPDMVDRMLRLLASYNVVSCRTEDGKDGRLSRRYGAAPVCKYLTPNEDGVSMSALALMNQDKVLMESWYYLKDAVLDGGIPFNKAYGMSAFEYHGTDPRFNRVFNEGMKNHSIIITKKLLESYKGFEGLGTLVDVGGGVGATVAAITAHYPTIKGINFDLPHVISEAPPFPGVTHVGGDMFQKVPSGDAILMKWILHDWSDEHCATLLKNCYDALPAHGKVVLVECILPVNPEATPKAQGVFHVDMIMLAHNPGGRERYEREFEALAKGAGFAAMKTTYIYANAWAIEFTK

SEQ ID NO: 59277 - protein, 486 aa, Pseudomonas putida
MKEIKHFINGAFVGSASGRTFEDINPVNGQVIGRVHEAGRAEVDAAVKAARAALKGPWGKMTVAERADILHRVADGITARFDEFLEAECLDTGKPKSLASHIDIPRGAANFKVFADLLKNVANEAFEMATPDGAGALNYGVRRPKGVIGVISPWNLPLLLMTWKVGPALACGNCVVVKPSEETPLTATLLGEVMQAAGVPAGVYNVVHGFGGDSAGAFLTEHSDVDAYTFTGETGTGETIMRAAAKGVRQVSLELGGKNAGIVFADCDMDKAIEGTLRSAFANCGQVCLGTERLYIERPIFDAFVARLKAGAESLVIGPPDDASSNFGPLVSLKHREKVLSYYQQAVDDGATVVTGGGVPEMPAHLAGGAWVQPTIWTGLSDNSAVVTEEIFGPCCHIRPFDTEEEAIELANSLPYGLASAIWTESSSRAHRVAGQIEAGIVWVNSWFLRDLRTAFGGSKQSGIGREGGVHSLEFYTELKNICVKL

SEQ ID NO: 59278 - protein, 350 aa, Glycine max
  misc_feature (106)..(106): Xaa can be any naturally occurring amino acid
MGRGLGVVLVLLAVYCGLDPFQHSPIAHFPDFEVKRVDMPAWSEVPTDQDKHNLLQKSEIKFANQVQGPESIAFDPLGRGPYTGLADGTIVFWNGHSWLHFAYTSXTDAYFGLLKVGPEGGLATSLVTEAEGIPLRFTNDVDVDTEGNVYFTESSALYPRRNFLQLVFSGDDSGRVLKYNLATKETTVLVRNIQFPNGISLSKDGSFFVFCEGVVGRLRKYWLKGEKAGTSEILAILPGYPDNVRVNEDGDFWVALHSRRYMYAYYNGIYPKMRKIILKLPIPIKIHYLLQIGGRQHAAVIRYSPEGKLLQILEDSEGKVVKAVSEVEEKDGKLWMGSVLMPFVAVYNLK

SEQ ID NO: 59279 - protein, 318 aa, Zea mays
  misc_feature (270)..(270): Xaa can be any naturally occurring amino acid
  misc_feature (283)..(283): Xaa can be any naturally occurring amino acid
MGKSSKKSAAPTVVAPAAVLTKGKAGKRREADDEIEKAVSAKKQKAAPAKAVPGPKEAAKKAKKQPPPKKVESSSSEEESSESEEEEVPKKTAKPVKHESSDDSSDDSSFDEEPAKKPSAKPVTPAASNGSKKGKPESSSSSSEDESDDDEKPAALVKRTPVIESDSSESDSDDSSDEDVPAKTPAAAAKKVDSSDSSESESESEDEEKSKKAAQATKIAPAAAKRKEEPSDSSDSDESDEEPPQKKLKDAAKVTPKSAKKDSSSDDDSXDESSDDEPKKKVXTASNPRKEKPKTPANNQGSGNRGQKPFGWGNLSSI

SEQ ID NO: 59280 - protein, 604 aa, Cucumis sativus
MEIESLRVSVDEKVLKDEEKNEKEEMKMKMKMKRKLGGVKTMPFILGNEVCDRFASSGFHSNIITYLTQDLNMPLVPASNILTNFAATSSFTSLIGALIADSFAGRFWTITIASIIYELGMVTITISAILPSLHPPPCPTQINCTQASGTQLMILYLALLLTSLGAGGIRPCVVAFAADQFDMTKVGIAGRTWNFFNWYYFCMGMATLTALTVVVYIQDNVGWGWGFGLPTIAMALSVVAFVVGSPLYNKLKPSGSPLVRLAQVVVAAFKNRKAVLPDDSKLLYRNHELDAAIAIQGRLVHTDQFKWLDKAAVITSPDSTANPPNLWRLATVHRVEELKSIIRMLPIWAAGILLVTASSHQHSFTIQQARTMNRHLTPTFQIPPATLSIFGILSMLTGLVLYDRLLVPFAKKLTHNPSGITCLQRMGVGFAINILATLVSSIVEIKRKKVAANHGLLDNPTATIPFSVFWLVPQFWLHGIAEVFMSVGHLEFMYDQSPESLRSTATALYWLAISVGNYIGTLMVYLVHKYTGEEHNWLPDRNLNRGRLEYYYWLVSGIQVMNLVYYVICAWFYTYKPLEEEKINIENKDGDQEWERCEDTIKIA

SEQ ID NO: 59281 - protein, 225 aa, Oryza sativa Japonica Group
MAPSAMVLIVLLVLVVLPSSTLCSRAGPSSKHGHGGGHAKRVPPPASVPPPPPPPPAPAALVRATCNSTSYYDLCVAELSADPSSATADVRGLSSIAVSAAAANASGAAQAASALANATDAGTTACVTGDCSSAFVQRLLATCAAKYGDARDGVAAAKGSIAQQDYDMASVHVRAAAEYPQVCRTLFGRQSPGDYPPELAATEVALRQLCSVALDIIALLSSSSN

SEQ ID NO: 59282 - protein, 192 aa, Helicobacter pylori
MKRLEVSNQAKLPTQFGEFYIQCFREKGSNGSKDHLVIFTPNFPQNPLVRLHSECLTGDALGSQKCDCGGAFQMPLERISKEGGLVIYLRQEGRGIGYLTKSNAYALQDKGYDTIQANEMIGFKDDERDYSVAGEILEYYHIKKMRLLTNNPKKIAALEKYAEVTRESLIVCANEHNQGYLEVKKLKMGHLL

SEQ ID NO: 59283 - protein, 172 aa, Trichodesmium erythraeum IMS101
MKHTLSVLVEDEAGVLTRIAGLFARRGFNIESLAVGPAEQTGVSRITMVVPGDNGIIEQLTKQLYKLVNVLKVHDITAAPCVERELMLLKINATTSMRSEVIEIATIFRARVVDVGEDSLTIEVVGDPGKMVAIVQMLSKYGIREIARTGKIALTRESGVNTEFLKLQTSEV

SEQ ID NO: 59284 - protein, 375 aa, Picea sitchensis
MLLKSRFNKLCTWRESDQLSLLSVSLRLVSTNFHPQSKPIRFFKAFATMVKAITVHELGGPEVLKWEDVEVGEPGEGEILVKHKAIGVNFIDVYYRKGVYKAEKLPFIPGREAVGVVTAVGQGLTGRKVGDLVAYAGNPMGSYAEEQILPANQVVPFPSTLDPILGAAVMMKGMTVQYLLRSCFKVEPGHTILVHAAAGGVGSLLCQWGEALGATVIGTVSNEQKAAQAAEDGCHHPIIYTQENFVERVKEITKGQGVHVVYDSVGKDTFQGSLECLASRGYMVSFGQSSGMVDPVPMSVLAPKSLFLTRPHLMHYTTTRDELLRCAGEVFTAVANGVLKVRVTKTYPLSEAAKAHADLEARKTTGSIVLIPDNS

SEQ ID NO: 59285 - protein, 77 aa, Zea mays
NITKRGSVPETAGGESNDYPVGPMVLGFLIFVVIGSSLFLMIWTVTSGGLACIYCAYTRNLSVLELGGCICVVLQTG

SEQ ID NO: 59286 - protein, 313 aa, Streptomyces avermitilis MA-4680
MVIMSASWSSHAFQPVLERIADEIERTPGRGRPADYIPALAACDPRRFGMAVAELDGTVYGVGDWRQPFSTQSITKVFTLALDLAREGDALWEHVGREPSGNPFNSLVQLEYESGIPRNPFINAGALVVTDRLQTQTGDAAGSLLEFLRAESGNPRLTFDQDVAASEAAHGDRNAALGHFMASYGNIDNSVPVLLDQYFRQCSIEASCADLALATGFLARHGIRADGSRLLTQSQAKQVNAVMLTCGTYDAAGDFAYRVGLPGKSGVGGGIIAVVPGRCTLCVWSPGLDERGNSVAGVAALDRFTTLTGVSVF

SEQ ID NO: 59287 - protein, 343 aa, Bifidobacterium longum DJO10A
MAKTYKIAVIPGDGIGKEVTPWAQKALEKAAEGVADFEYENFDLGAERYLRDGAILPEDEEERIKANDAILLGAVGDPRIKAGILERGLLLKLRFDLDQYVNLRPSKLYKGVTSPLANPGDIDFVVVREGTEGLYCGAGGAVRRNTPQEVATEVSINTAYGVERVVRYAFKLAMKRKKHVTLVHKKNVLVNAGDMWQRIVDKVGEEYPEVTHDYQHIDAATIFLVSDPSRFDVILTDNLFGDILTDEAGSVVGGVGYSASGCINASDEFPSMFEPIHGSAPDIAGQNKANPTAAILSAAMLLEHLGFDDAAKKIHTAVEADIEELGSTVRSTDQVGKDILARM

SEQ ID NO: 59288 - protein, 463 aa, Acidobacteria bacterium Ellin345
MPNGYDYDLVVLGSGPAGQKGAICAAKLHKRVAIVENRWALGGVCVHSGTIPSKTLREAVLYLSGFREKTFYGRSYQVKDRVVMADLTFRVDAVIKRETEVIRAQLQRNQVVPLDGYGRFVDAHTVEVESAEGTRRVTSENFLVSTGTRPASDQHYQLDGTHIFNSDQLLSLSEVPRELIVVGAGVIGLEYASMIAALGVKITILDARPTILDFIDREIMDSLQFQLRQLNVIFRLGEKVTTCVYDAERGRVIATLESGKRVHGDGLLFTVGRQANTDKLNLESAGLKTGDRGKLEVNEQFQTAVPNIYAAGDVIGFPALASTSMEQGRIASCNMFGVPSKMRPQFFPYGIYTIPEISIVGQTEEQLTHDKVPYEVGIARYSELAKGQMLGDEHGLLKLLFHSESLKLLGVHIIGERAAEIIHIGQAVLSFGGSIEYFRDTVFNYPTMAEAYKVAALDGLNKL

SEQ ID NO: 59289 - protein, 391 aa, Wolbachia endosymbiont of Drosophila simulans
MTISPILPVYSPININFSYGKDIYLYDIDGKRYVDFHSGIAVSSLGHTNSRLISALKLQGEKLWHISNTYNIPAANNFAEKLINNSFADTVFFSNSGSEAVECGLKIARIYQNGKGNKNRHRILTFHGAFHGRTFLTCATNDKQKFSELLNPYIDWCDNIEPNIESVKKAISSGIGVILIEPIQGQGGIKVMNEVFMKELRRLCDENDILLFFDCVQCGAGRTGKLFAYEHIGVEPDICALAKGIGGGFPLGACLATEKAAKYMAVGMHGSTFGGNPLATSVGNAVLEELLSPGFLKNVEIRGKYLKNKLEDLASKFPIIEEVRGKGLMLGIKVKADNQKFAEELSHRGLLTVGVTSDNVVRILPPLIITEKEIDEGIEILTQYLSEKSSD

SEQ ID NO: 59290 - protein, 486 aa, Streptomyces avermitilis MA-4680
MSEQSLKGEAQGAIRTGTQPSRHVDAGDAGYAKSLKSRHVNMIAIGGAIGTGLFLGAGGRLADAGPSLFVAYAVCGIFAFLVVRALGELVLYRPSSGAFVSYAREFLGEKGAYTAGWMYFLNWATTGIADITAVAVYTHYWGMFSDIPQWVIALIALAVVLTVNLISVRMFGELEFWFAIIKVSALVVFMLIGIFLLVTQHPVDGHHPGPSLITDHGGIFPHGLLPMLLIIQGVVFAYASVELVGVAAGETENPEKIMPKAINSIMWRVGLFYVGSVVLLSMLLPWNKYTAGQSPFVTVLSNIGVPAAGGVMNLVVLTAAMSSLNSGLYSTGRILRSMAMSGSAPKFTGVMSRSQVPYGGILLTSGICILGVGLNFVVPADAFEIVLNFAAIGILATWGMIMLCHLMFWRKTRTGELSRPSYRLPGSPWTEIVTIGFLVSVLVLMYADGGAGRTTVLCLPLIAAALVAGWYGVRGRVARKASGADA

SEQ ID NO: 59291 - protein, 557 aa, Coccidioides immitis RS
MRQGASWMGTPSIKGRTESQRMALLTFSLVGLQFTWGIEMTYCTPYLLQLGLTKSRTSLVWIAGPLSGLIMQPLVGVIADRSTSKWGRRRPFMIGGSLVVALCLFVLGWTTEIVSIFISDTQLRKSVTIMVAVLSIYATDFAINVVQACCRSLIVDTLPIPQQQLGSAWASRMTAVGSLIGYAIGSVDMLSRFGTTLGNTQFKQMTVIAALSLITAVSVTSYAVKERVLLSVRRYAGRNSGLGLVCTPQKTLRETLANAFLVPKSAVEQSKDTLGEVGRLGSLSLVIFSMITLVSSVVLPFGVLSPENKRGRFTPRPPRGVVRLLKKIAFVRPDLQTAWMMSHIIFAATMIFAPLAKSVRFATFLVAICGIPWAVTSWAPFAFMGVEINRLALSSTSRNSTVTMITSAGASNRHSAYLPLETTDGNNSDLEFDNASVLRLNHRHDGDSDFESDVEDDESASTGELAGIYLGVLNVYTTLPQFVGTFISWIVFSILEPNRSSTQSEPELKAKETTNSKEDQWMNLNAEGPNGIAMCLFIGAICAMVATEATRRLKHVR

SEQ ID NO: 59292 - protein, 183 aa, unidentified eubacterium SCB49
MSTEKKQKVQDRIENQQLDDRTIFLWGQVDDRSAKHVVDRLMYLDSISNEEIKLYINSPGGYVTSGFSMYDTIKSIKSPVSTICTGLAASMGSILLSVGEKGRRFIQPHARVMIHQPSGGARGQASDIEITAQEILKTKEISAKILADNCGQDFDKVMKDFQRDHWMSAEESVAYGIVDGIME

SEQ ID NO: 59293 - protein, 349 aa, Oryza sativa Japonica Group
MGNREVLVVAFFIRSIYGGVQIVTKIAFNRGMSTTVFVFYRHAIAILFLVPVAFVVERKTAPPLSYKILLKLFVHALYGIAGSVNIYGLGLSYSSATSSSAISNLLPVLAFFLAVLMGMESLNLKRIHGIAKVFGVLFSIVGVIILAFYQGPELKSLNLQHLSSRNVVPTGSTAYTTKAWTSGIFLTVLSTTSWALWTVLQIVLPQGLMLEVYPSKLLNTTIQMVFATIQCFFIALAVERDFSRWKLGLDAGLIAVIYSGALVSGLAYYMQVWVIDKSGPVFLAMTMPITLIVTIVLSSFVLGEAVTLGSIISGVVMVGGLYCVLWAKKAEQAIASKEEATLPVQATQV

SEQ ID NO: 59294 - protein, 214 aa, Paeonia sinjiangensis
IVESVGEGVTDLKPGDHVLPVFTGECKECRHCKSEESNMCDLLRINTDRGVMLNDGKSRFSINGQPIFHFVGTSTFSEYTVVHVGCVAKINPEAPLDKVCVLSCGISTGLGATLNVAKPKKGSSIAIFGLGAVGLAAVEGARIAGASRIIGVDLNPKRFEEAKKFGVTEFVNPKDYNKHVQEVIAEMTDGGVDRSVECTGSIMAIISAFECVHD

SEQ ID NO: 59295 - protein, 685 aa, Zea mays
VAVTRPAERKGRTCCRRCGKSKWESKESCIVCDARYCGHCLLRAMGSMPEGRKCVTCIGQPIDEAKRSRLGKGSRILSRLLSPLEVRQILKVEKECQANQLRPEQLLVNGFPLDDEEMTDLLSCQRPPGNLKPGRYWYDKESGLWGKEGEKPDSIISTNLNFNGKLQPDASNGTAQVFINGREITKIELRILKIAKVQCPRDTHFWVYHDGGYEEEGQNNIKGKIWESPLTRFACALVSLPVPPTNFDATKDEAPYSSKTVPDYLDHKRIQKLLILGSPGAGTSTIFKQAKLLYGNRFTDEELENIKLMIQSNMFKYLGILLEGRERFEEEALAVPNHPSSVGDDPQQDESKSSSSNSCIYSINAKLKKFSDWLLDIIATGDLDTFFPAATREYAPVVDELWKDPAIQATYKRKDELHFLPDAAEYFLSRAVEVSSNEYEPSEKDVIYAEGVTQGNGLAFIDFTLDDRSPMSESFGDNHDAYPQQPVNKYQLIRVSAKGMNEGCKWVEMFEDVSMVIFSVALSDYDQLGAPASGSSRTLVNKMIQSRDLFEATIRQPCFRDTPFLLLLNKYDAFEEKIGRSPLSSCEWFGDFCPLRTHHNSQSLAQQAFYYVAIKFKDLYAASTGRKLFVWQTRARDRPTVDEAFRYVREVLRWEDERGVAGYCPDESFYSTTELSSSRLIAAAQ

SEQ ID NO: 59296 - protein, 195 aa, Mycobacterium tuberculosis H37Rv
MPLLTIGDQFPAYQLTALIGGDLSKVDAKQPGDYFTTITSDEHPGKWRVVFFWPKDFTFVCPTEIAAFSKLNDEFEDRDAQILGVSIDSEFAHFQWRAQHNDLKTLPFPMLSDIKRELSQAAGVLNADGVADRVTFIVDPNNEIQFVSATAGSVGRNVDEVLRVLDALQSDELCACNWRKGDPTLDAGELLKASA

SEQ ID NO: 59297 - protein, 214 aa, Paeonia sinjiangensis
IAESVGEGVTDLKPGDHVLPVFTGECKECRHCKSEESNMCDLLRINTDRGVMLNDGTSRFSINGQPIFHFVGTSTFSEYTVVHVGCVAKINPEAPLDKVCVLSCGISTGLGATLNVAKPKKGSSIAIFGLGAVGLAAAEGARIAGASRIIGVDLNPKRFEEAKKFGVTEFVNPKDYNKPVQEVIAEMTDGGVDRSVECTGSIMAMISAFECVHD

SEQ ID NO: 59298 - protein, 359 aa, Glycine max
MDSRDSSPRSRDPDADNNNNHHHHRRQPSLDDAPPKVKLMCSFGGSIQPRPHDNHLTYVSGDTKILAVDRHVKFPSLIAKLSSLANNTPSNLSFFKYQLPGEDLDALISVTNDDDLHQMMIEYDRLSRASPRPARLRLFLFPLHNNCNFAPTESKSERQWFVDALNSVHVPEDSPPPPPATANPDFLFGLDKPAAEDALAKDSECFPEDREAEPQIENENNSKQLLQRKMKIEEDDNNNKGRVYGVNGGGDCYAQKNAEKMTPLVAHAHAHAHAQFVHPGSVTGTVSFMQERNNNNAGYSLAFATTGNEIYLIQTPSGMFQAVRPVTGPVGQPVYLVHAPGPVSHSKVGAAVHGGDGRI

SEQ ID NO: 59299 - protein, 214 aa, Paeonia arietina
IVESVGEGVTDLKPGDHVLPVFTGECKECRHCKSEESNMCDLLRINTDRGVMLNDGKSRFSINGQPIFHFVGTSTFSEYTVVHVGCVAKINPEAPLDKVCVLSCGISTGLGATLNVAKPKKGSSVAIFGLGAVGLAAAEGARIAGASRIIGVDLNPKRFEEAKKFGVTEFVNPKDYNKPVQEVIAEMTDGGVDRSVECTGSIMAMISAFECVHD

SEQ ID NO: 59300 - protein, 445 aa, Flavobacteria bacterium BBFL7
MLVLKFGGTSVGSVENMTHVKNIINDGTKKVVVLSAMSGTTNALVEISEHIRLKERDSAHVLIQQLASSYQNTIEQLLNDSALINESQEYVNKVFAGLIELVNSEHTTLIYNQIVAQGELLSTFLFSRFLMQEGINAALLPALDFMRIDNNDEPDSFYIKQSLNRILNENSEADIYITQGFICLDVQGNISNLQRGGSDYTASIVGAAIEANEVQIWTDIDGFHNNDPRFVENTTAISNISFDEAAELAYFGAKILHPQTVIPVKDLNIPVRLKNTMSPDSYGTLITHHVHGEGIKAIAAKDGIYAIKIKSARMLQAHGFLKKVFEIFEKYETSIDMITTSEIAVSLTIDNPLHLDVIVEELEKVASVDVDQGMSIVCLVGNNIIYHQDTPHLFQVLQDVPVRMISYGGSNNNISLLINTDQKLNTLQKLQGYVFESQLEKAVAY

SEQ ID NO: 59301 - protein, 815 aa, Oryza sativa Indica Group
MEVLAFFAVLVLATAVVPAVGQQGYLSIDCGLEANSSYQDDNRILYVPDGPYVDGGENHKVAAEYASSFQRPDQTLRSFPSGVRNCYTLPTAAGSKYLVRLVFVYGNYDGKNISSSSSSAAAALRFDLYLGLSRWVTVQGGTGSGGEVHEAVFVAWASWAPVCLVNTGSGTPFVSTVELRPLVDSLYPAVMANQSLAMLRRRNMAANNFIRYPDDPYDRYWWPMNADPAWANLSTTSTIKTGSTFAVPSSVLQTAVTPSENSTSSKLREFDAYPDANQVVYNYTPHYLLSSSVYTPLFRAIAGEYNITLAATANSVLPPMLNAFEIYFLITYDGTTTFSKDFDAIMAIKLEYGVKKNWMGDPCFPPEFAWDGIKCRNTSGNIMRIISLDLSNSNLFGVISNNFTLLTALENLNLSGNQLNGPIPDSLCKNNAGQFVFRYVAKTNPELLVLYNYYSYGSDGNMCNKTIVPAYVSPQVPDIKTSTERKTNPFDPLQITESRQFTYEELKKFTNNFQQFIGRGGFGNVYYGCLENKTEVAVKMLSEFSENGLDQFLAEVQSLTKVHHKNLVSLVGYCWEKDHLALAYEYMARGNLCDHLRGKFGVGDTFNWVTRVRVVLDAAQGLEYLHKGCNLPIIHGDVKTNNVLLGENLKAKISDFGLSKTYISETQTHISTSNAAGTMGYINPEYYHTGRLTESSDVYSFGIVLLEIATGEAPILPGSGHIIQRVKQKVASGNINLVADARLKDSYDISSMWKVVDTAMLCISEVATQRPTMSTVVLQLKESLALEEARDGRDITTSSVSDAMDVLSKFGPSAR

SEQ ID NO: 59302 - protein, 1213 aa, Oryza sativa
MADIKLGLDPVPKPTDSVAASAGAAAANAAAAASASSAEAPPDQLDTVVCVVAARGVAEQRVEPNIEAMAEAGLLVLERKKVELTPEVAAVFTVDPSARRAPASDTRKGQTEEAVARADGKRGPGLELAVELANIPEAKHLAVELFVSATGAGGANSARAKSIATQTETVTGNANPKFQTHLFVPYQPFHDSVAPTALGDEKDVKTAPALGVEYELRVLNRASAASPAATDLLAVVPLDSKQLTATTGSLAFPLSNHSDAAVDAKLKQSGAVLTIRAAPSKTSIRPDRVLIHVTARNLPVAPPPPKPKAKPEIGPDGEPLPPKPTATGLPEAILPEPLGHSVVCVLVPKRPTQDNGEQLTEAIVGNSNPTFTVPFSVPRPTDSEVEPDSVMSPANQYDLQIWAASTDAPQTPAALAAAASNPRGDLLATIQVNVSKLIDSPGGYQSFVLADSATSELNPHDQTVRIAKAAAAGKGWGEKLLAADASVTIVGVTTQPSEEGQLHLNKDELASVRAFTSGPVVCLLVRGANAFIKLKHLTLIRELDFMYFSAETWSALRDSLLLFPQRHGRGLSQQRVERTLAVLKPGTTAPELEAVLRAVDDVDMVVVARDKRVIDAKVAKQLWPTADAEELAYLSSDVSEVLVLEAPGAVDQWQLLLGPADPTEATKRAPQSLRGRFARSRVRNLAYGSLTPTQAKADIALLFRDPFPLQRTLAIIKPDAVAAGSTDAILSVVTEQYGFAVLATERTRLSKPRAEQFYAEHQGKPFFNSLVDFMSSGPIVALCLAKPAAITSWRKLIGPTRRHEALSKKPHSLRARFGHSDTQNACHGSEHDKAAEREIQFFFPQLPAESLPTEVEQLKAIFNAKPFAPRGPNAKAPKSLNDVLVDGLTALCRERPLKLDAVKWLGQWLLKNNPNQPTVEVADPSDAHTAPGKGADSKIKFIGSADRDEKVATVAAPVTPVVSGPVAAPPAPRKMVWVVGPPGVGKNTLCARLAKEFGYEHVNVGNLCRSAIRAGSDYADLLTDCALNGRVVPSSVVVRLLQQAMRASPSANNRWLISDFPASLDQAFDFESATGGAVSFIVHLTCASDVTLKQRIEQRTATTPAFARRSEDNPASVDKRLALFREDILPQVLSQFAQFPGKVRAVNVDGDVSDAYARLKALFEPKVLAAPDAAAGAGAGAAPAVASPKKGKKTVGAPAPAPPAVEYMKINGV

SEQ ID NO: 59303 - protein, 413 aa, Oryza sativa Japonica Group
MALHVLASMGDLWRRYAPHNLMILSQLCYTLMYFITEAAFNKGLNPFIYVTYRHLVVAVFLAPFAYYQEKKLRPRMTLMLFLEIFVLSLLGVSLTLNMYFASLMYTSPTFVTSVVNTVASITFVIAIVVRCPTFSRISRRTHAESDRLYCSLSAWLTLARDQINLDAVRMEIVDVRSIRGLAKVAGTVVSFAGVTTMTLYKGTAISSPWKAPISIHGGGGGGGVHESWLKGSFLAVASCICWSIWYILQASSLKRYPAQLSLTAWMCTVGGIQSAVFTAFMQHKPEDWRIGFGLKFWCIVYSGFACNGFTVFAQLWCTEKKGPVFVTMFNPLSTIMVAILAYFMFGENLYVGSIIGGVVVILGLYMLLWGKDKDQEYNANKQQESDLDCEKQARITEFSAAQNDQEEPRRTKK

SEQ ID NO: 59304 - protein, 417 aa, Burkholderia vietnamiensis G4
MALIVHKYGGTSMGSVERIKNVAKRVAKWHQAGHQMVVVPSAMSGETNRLLGLAKEISSQPSPRELDMIASTGEQVSVGLLSIALQEIGVEAVSYAGWQVPIKTDSAFTKARIHSIDDERVKADLNAGKVVIITGFQGVDPDGHITTLGRGGSDTSAVAVAAALGAEECLIYTDVDGVYTTDPRVVEEARRLDRVTFEEMLEMASLGSKVLQIRSVEFAGKYQVKTRVLSSLTDPLIALDEEMRSGTLITFEEDETMEKAVISGIAFQRDEARIAVMGVPDKPGIAYQILGPVADANVDVDMIIQNQSVEGKTDFTFTVGRGDYQKAMDILTNQVKGHVNAERVQGDPKVSKVSVVGVGMRSHVGVASKMFRTLSEEGINIQMISTSEIKISVLIDEKYMELAVRALHKAFELDQAP

SEQ ID NO: 59305 - protein, 363 aa, Synechococcus sp. WH 7803
MLKAGIVGLPNVGKSTLFNALVANAQAQAANFPFCTIEPNVGTVAVPDSRLELLSDLSSSAETIPTRMEFVDIAGLVKGASQGEGLGNKFLANIREVDAIVHVIRCFEDDDVIHVSGAVGPARDAEVINLELGLADLAQLEKRRERLKKQMRTSKEAQIEDAALERIQAVLEQGGAARSVELSEEEALMLKPLGLLTAKPIIYATNVSEDDLAGGNGFCEEIVALAAKEGAETVRISAQVEAELIELGDEERQDYLDGLGVNEGGLQSLIRATYQLLGLRTYFTTGEKETRAWTFKAGMTAPQAAGVIHTDFERGFIRAQTISTDKLLEAGSLVEARNKGWLRSEGKEYVVEEGDVMEFLFNV

SEQ ID NO: 59306 - protein, 248 aa, Listeria monocytogenes str. 4b H7858
MPKLGESVTEGTISSWLVKPGDTVEKYDAIAEVLTDKVTAEIPSSFSGTIKEILAEEDETLEVGEVICTIETADAGSSEPVAEVEQTETKAPEKQETKQVKLADAPASGRFSPAVLRIAGENNIDLSTVEGTGKGGRITRKDLLQVIENGPVAKREEMKSAPQEKAAMPTPPVRSAAGDKEIPINGVRKAIAKHMSVSKQEIPHAWMMVEVDATGLVRYRNAVKDSFKKEEGYSLTYFAFFIKAVAQA

SEQ ID NO: 59307 - protein, 349 aa, Trichodesmium erythraeum IMS101
MIPVILAGGKGERFWPLSRKHRPKQFLSLDGSGKSLLQTTAQRLLPLSNDWGGLWVVTSAMLAAGVAQQLPQIPQENILAEPEGRDTAPAVAWTTIEAAHRYGEDIVVGFFPADHWIGEPEIFHKTLEAAAELATNQEAIVTLGVKPSFPSTGYGYIEQGKKAGNFGGFDVYQVARFTEKPNREKAEEFLATGRFSWNGGIFVFRVGVMLAELRKYVPTMMTVLETMGPGGYSQLEKKSIDYAVMEKTDKAFVLPVAFGWDDLGDWNGLERLVKGDSVNVELANHLGLDTKRSIFFATDDDDTIVTIGLEDVVVVRDGNVTLIVKKERSQDIKKVLKSLANHPKFKDLL

SEQ ID NO: 59308 - protein, 230 aa, Triticum aestivum
NLTSRMGAFVDRIVVGAAAMRRDRPELAHQSFNARARTYIQESGVVELVKWFKHNSLTYPQIAKVVCSCSGDLRAAARARKWLRSIYVKGVFLGRVLAKGESLMSRSFEELEEITGYLECCGVRRDWIGHVVSRCPQLLNLSLDELETRVRFYTDMGMNENDFGTMVYDYPKVLGFFSLEEMNSKVQYLKEFGLSTEELGKMLAYKPQLMACSIEQRWEPLVKYLGRDHA

SEQ ID NO: 59309 - protein, 499 aa, Ginkgo biloba
MRTNLIALGVSTLVEKNVGRIAQIIGPVLDVTFPPGNMPNIFNSLIVKGQDTAGQEIHVTCEVQQLLGNNRVRAVAMNATDGLMRGMKVIDTGAPLSVPVGGATLGRIFNVLGEPVDNLGPVDARTTSPIHRPAPAFTQLDTKLSIFETGIKVVDLLAPYRRGGKIGLFGGAGVGKTVLIMELINNIAKAHGGVSVFGGVGERTREGNDLYVEMKESGVINEQNISESKVALVYGQMNEPPGARMRVGLTALTMAEYSRDVNEQDVLLFIDNIFRFVQAGSEVSALLGRMPSAVGYQPTLSTEMGSLQERITSTKEGSITSIQAVYVPADDLTDPAPATTFAHLDATTVLSRGLASKGIYPAVDPLDSTSTMLQPWIVGEEHYETAQGVKQTSQRYKELQDIIAILGLDELSEEDRLTVARARKIERFLSQPFFVAEVFTGSPGKYVSLVETIRGFKMILSGELDGLPEQAFYLPEQAFYLVGTIQEVPAKVMNFKVES

SEQ ID NO: 59310 - protein, 416 aa, Bifidobacterium longum DJO10A
MTAVEFIEPLTHEEGVSQATKLFVDTYGAAPEGVWAAPGRVNLIGEHTDYNAGLCLPIALPHRTFIALKPREDTKVRVVSDVAPDKVAEADLDGLKARGVDGWSAYPTGVAWALRQAGFDKVKGFDAAFVSCVPLGSGLSSSAAMTCSTALALDDVYGLGYGDSDAGRVTLINAAIKSENEMAGASTGGLDQNASMRCTAGHALLLDCRPELTPLENVSQQEFDLDKYNLELLVVDTQAPHQLNDGQYAQRRATCEEAAKILGVANLRVTADGISKADDQFQALKETLDALPDETMKKRVRHVVTEIERVRSFVRAFAQGDIKAAGRLFNASHDSLAADYEVTVPELDIAVDVARKNGAYGARMTGGGFGGSIIALVDKGRSQEVAQKIADEFEKQGFHAPRALAAYAAPSASREA

SEQ ID NO: 59311 - protein, 639 aa, Haemophilus somnus 2336
MILFTNLTLKRGNTLLLENTCATINPGQKVGLVGKNGCGKSSLFALLKKEMSAEEGDITFPNHWAMAWVNQETPALEISALDYVIKGDREYCKLQKALATATENNHGNDIARIHAQLDTIDAWTIQARAASLLHGLGFSQEDLTRTVKSFSGGWRMRLNLAQALLCRSDLLLLDEPTNHLDLDAVIWLERWLIQYQGTLILISHDRDFLDPIVNKIIHIEQHKLHEYSVNYSSFEVQRATKLAQQTALYRQQQQKINHLQKYIDRFKAKATKAKQAQSRVKALERMELIAPAYVDNPFTFKFREPLALPNPLVSIEKASAGYDNGESTVEILQKIKLNLVPGSRIGLLGKNGAGKSTLIKLLAGELTALSGHVQLAKGVKLGYFAQHQLDTLRSEENALWHMQKIAPQQTEQQLRDYLGSFAFHGDKVTQAVSSFSGGEKARLVLAIIVWQRPNLLLLDEPTNHLDLDMRQALTEALIDYQGSLVVVSHDRHLLRNTVEEFYLVHDKQVEEFTGDLEDYQKWLNEINSTPKHNEKIINNNENTGNHRKEQKRKEAELRQRSAPLRKEIADIERKMQIYQQKLQEIELLLSDTVLYQTENKAKLTALLNEQVQLKKALEDIEISWFTMQEALENLINNIE

SEQ ID NO: 59312 - protein, 449 aa, Mycobacterium avium 104
MAGTSQLRQGLSQRQLSMIALGGVIGAGLFVGSGVVIKDTGPAAFLTYALCGLLIVLVMRMLGEMAAANPSTGSFADYAAAALGRWAGFSVAWLYWYFWVIVVGFEAVAGGKVLNYWFHAPLWVLSLGLMLLMTATNLFSVSSFGEFEFWFAGIKVATIVIFLVVGAAYVIGLVPGHHDGLTNLVSHGGFFPRGVGAVFAAIVVVIFSMVGAEIVTVAAAESRDPRRAVQKATRSVVTRIGIFFVGSVFLLVAILPWDSVELGASPYVAALKHLGLAGADQVMNAVVLTAVLSCLNSGLYTASRMLFVLAERGEAPARLVRLSGRGVPHIAILCSSAVGFLCVVMARVAPNTVFLFLLNSSGAIILFVYWLIALSQIVLRRRTPAERLSVKMWFFPVLSVLTLAGITAVLVQMAFDATARSQLWLSLLSWAVVVALYFVARSRGRVAAR

SEQ ID NO: 59313 - protein, 304 aa, Mycobacterium tuberculosis H37Rv
MANASETNVGPMAPRVCVVGSVNMDLTFVVDALPRPGETVLAASLTRTPGGKGANQAVAAARAGAQVQFSGAFGDDPAAAQLRAHLRANAVGLDRTVTVPGPSGTAIIVVDASAENTVLVAPGANAHLTPVPSAVANCDVLLTQLEIPVATALAAARAAQSADAVVMVNASPAGQDRSSLQDLAAIADVVIANEHEANDWPSPPTHFVITLGVRGARYVGADGVFEVPAPTVTPVDTAGAGDVFAGVLAANWPRNPGSPAERLRALRRACAAGALATLVSGVGDCAPAAAAIDAALRANRHNGS

SEQ ID NO: 59314 - protein, 526 aa, Zea mays
MGTRGVALVAAALGVVVVTRLWTVLVVRLVWRPYTVARAFTRQGIRGPPYRLFTGNSKEAMAMRAATSGDTLDLSSHDFIPLVMPQYRAWMSLYGKVFLTWSGLTTPALFVGRYDMVKRVLFDKTGLYGKTDPGPIILSLLGRGLVFSDGEYWSRHRRVVHPAFAMDKLKSMTGSMVACAAEVIRAWEALAVARGEEEVTVEVAQQFTELTADVISHTAFGSSYRQGKAAFLAQRELQSIAFASLNCARVPGMQYLPTKANARRWQLERTVRGTLMAIIDERLAAAQEARGYGSDLLGLMLEANNGGGDGKSPQQAMSMDEIIEECKTFFFAGHNTTSQLLAWATFLLGTHPEWQQRLREEVIRECGGAEVLLHGDALNKLKLVTMVLYETVRLYGGATIIARQATADADLCGVKVPKATILLIPIAMLHRDEEVWGADAGDFNPLRFRDGVGRVAAHPNALLSFSLGPRSCIGQDFAMLEAKATLALILRRFAFEVAPEYVHAPADFLTLQPSKGLPVVLKLLDL

SEQ ID NO: 59315 - protein, 378 aa, Acidobacteria bacterium Ellin345
MTRMASTATNAKRDYYEVLQVTRTATDQEIKSSYRKLALQFHPDRNPDNKDAEEKFKECSEAYGVLSDSEKRAAYDRFGHAGLGGNGGSGGFDPNMVDFSEIFTDMFGMGDLFGRGRGRSRAQRGADLREDITLEFEQAVFGIETESRVRRHETCETCHGSGAAPGKAPVSCRKCGGRGQERFQQGFFSVSRTCGTCGGLGQVITDPCAGCRGQGAVVRERTIAVKVPAGVEDGTRIRYNGQGEAGTHGGPAGDLYIVLHVKEHKFFEREGKDLFCTVPVSFAQAALGTDIMIPTLEGEHKLHIPEGTQTGTQIKLRGKGVPVLNGHGKGDIFVEIKVQTPSKLNKRQRELLQELEAGASVENSPEKSLMSKMKDMFS

SEQ ID NO: 59316 - protein, 762 aa, Zea mays
MAILSALATEVLIPVAAVIGIAFAVVQWVVVSRVKLSPAASGGSGGKAGYADSLIEEEEGLNDHNVVVKCAEIQNAISEGATSFLFTEYQYVGIFMAIFAVVIFLFLGSVEGFSTKSQPCTYSKDKYCKPALFTALFSTVSFLLGAITSLVSGFLGMKIATYANARTTLEARKGVGKAFITAFRSGAVMGFLLASSGLVVLYITINVFKLYYGDDWEGLFESITGYGLGGSSMALFGRVGGGIYTKAADVGADLVGKVERNIPEDDPRNPAVIADNVGDNVGDIAGMGSDLFGSYAESSCAALVVASISSFGIDHDFTGMCYPLLVSSVGIIVCLITTLFATDFFEVKAVKEIEPALKKQLIISTVLMTFGIALISWLALPAKFTIYNFGTQKEVSNWGLFFCVSIGLWAGLIIGFVTEYYTSNAYSPVQDVADSCRTGAATNVIFGLALGYKSVIIPIFAIAVSIYVSFSIAAMYGIAVAALGMLSTIATGLAIDAYGPISDNAGGIAEMAGMSHRIRERTDALDAAGNTTAAIGKGFAIGSAALVSLALFGAFVSRAGVKVVDVLSPKVFIGLIVGAMLPYWFSAMTMKSVGSAALKMVEEVRRQFNTIPGLMEGTAKPDYATCVKISTDASIKEMIPPGALVMLTPLIVGTLFGVETLSGVLAGALVSGVQIAISASNTGGAWDNAKKYIEAGASEHARTLGPKGSDCHKAAVIGDTIGDPLKDTSGPSLNILIKLMAVESLVFAPFFATQGGLLFKYL

SEQ ID NO: 59317 - protein, 240 aa, Physcomitrella patens subsp. patens
MATAAESATVQALRDVMQRIQQASERANRPVSSVRLVAVSKTKPVKMIREVYDAGHRHFGENYVQELIDKAPQFPEDTKWHFIGHLQSNKAKALVTGVPNLYMVEGVDSEKVADHLDKAVSGLGRPPLKVLVQVNTSGEASKSGVEPSNCVELAKHIEEKCPNLHFSGFMTIGNLDYTSTPENFKTLASCQEKTCRELGIPMEEFELSMGMSSDFELAIEMGSTNVRVGSTIFGAREYAT

SEQ ID NO: 59318 - protein, 257 aa, Vitis vinifera
MDRYQRVEKPREETPIDENEIRITSQGRMRSYITYAMSLLQEKGSNEIVFKAMGRAINKTVTIVELIKRRIVGLHQNTSIGSTDITDTWEPLEEGLLPLETTRHVSMITITLSKKELNTSSIGYQPPLPAEQVKAWTEFDYEGEGSPSGRGRGRGGRGRGRTRGVSGNGFVSAEYEDGGWDRNRGYARGRGRGRGRGFRGRGRGGYNGPQVDAQQDMGGYNQEPPFQGRGRGRGRGNRGRGRGARSNGPIHATAGGA

SEQ ID NO: 59319 - protein, 310 aa, Thermobifida fusca YX
MTSRITVSRQVPTTFDVHLAVQRTAPYLRRTPLLRTRLRGRPLLLKLEHLQLTGAFKLRGALNALLTGDRGERVVTASGGNHGLGVATAAHLLGGTATVYVPETVPAVKERRLRDAGADVVRAGTEYAAAEAAARAYADTEGLRYIHAYNDPDVVAGQGTLGHEIVADAPDCDAVAVAVGGGGLAAGVSLGIGDERLTVAVEPRGCASLHAAFAAGEPVDTPVDSVAASALGASRVGDIPFAVLRDRNVTSTLVSDPEILAARDLLWEEFRIAVEPAAATPMAAWLAGHVPGELPCVVICGANADWRPLD

SEQ ID NO: 59320 - protein, 1664 aa, Arabidopsis thaliana
  misc_feature (15)..(15): Xaa can be any naturally occurring amino acid
MESKFSQFHGRKLQXKHIYSFVSLTQDILPCCQRLGLFLGFIYLYAVFLSNSGIGAFAIIGCVQAQDQQEFISLDCGLPMTEPSSYTESVTGLRFSSDAEFIQTGESGKIQASMENDYLKPYTRLRYFPEERRNCYSLSVDKNRKYLIRARFIYGNYDGRNSNPIFELHLGPNLWATIDLQKFVNGTMEEILHTPTSNSLNVCLVKTGTTTPLISALELRPLGNNSYLTDGSLNLFVRIYLNKTDGFLRYPDDIYDRRWHNYFMVDDWTQIFTTLEVTNDNNYEPPKKALAAAATPSNASAPLTISWPPDNPGDQYYLYSHFSEIQDLQTNDTREFDILWDGAVVEEGFIPPKLGVTTIHNLSPVTCKGENCIYQLIKTSRSTLPSLLNALEIYTVIQFPRSETNENDVVAVKNIEAAYKLSRIRWQGDPCVPQKYAWDGLNCSNNTDVSKPPRVLSLNLSSSGLTGIIAAAIQNLTHLEKLDLSNNTLTGVVPEFLAQMKSLVIINLSGNNLSGPLPQGLRREGLELLVQGNPRLCLSGSCTEKNSKKKFPVVIVASVASVAIIVAVLVIIFVLSKKKSSTVGALQPPLSMPMVHDNSPEPSIETKKRRFTYSEVIKMTNNFQRVVGEGGFGVVCHGTINGSEQVAVKVLSQSSSQGYKHFKAEVDLLLRVHHTNLVSLVGYCDERDHLALIYEFLPKGDLRQHLSGKSGGSFINWGNRLRIALEAALGLEYLHSGCTPPIVHRDIKTTNILLDEQLKAKLADFGLSRSFPIGGETHISTVVAGTPGYLDPEYYQTTRLGEKSDVYSFGIVLLEIITNQPVIDQSRSKSHISQWVGFELTRGDITKIMDPNLNGDYESRSVWRVLELAMSCANPSSVNRPNMSQVANELKECLVSENLRENMNMDSQNSLKDSSVWIADSLRMNCLLMKRVSLDCGSLRMKSSYVVEKTVESEKILRDTLSRTLRYFPDGIRNCYNLNVEKGRTHLIVARFVYGNYDGFDLKPKFDLYLGPNLWATVDLQTEVNDWGNYTANIGFGIMGNGSYITKSGSLNLLSRTYLSKSGSDLRYMKDVYDRTWVSYGASFRTGWTQIYTALEVNNSNNYAPPKDALRNAATPTNASAPLTIEWPSGSPSQEVPGTNITFFSDPIIPKKLDITSVQSVTPKTCQEGKCSLQLTRTNRSTLPPLLNALEIYAVIQFPQSETNEIDVIAIKKIEAMYESSRINWQGDPCVPQHFIWDGLNCSNTDISTPPRITSLNLSSSGLTGNIAAAIQNLTQLEKLDLSNNNLTGGVPEFLGNMKSLSFINLSGNNLSGSIPQTLQKKRLELFVEGNPRLCLSDSCRKPPKKKIHVAIVASVASAAIVVAVLILFLILRKRKSTIVQGQHLPPSTSTVDVTFANKKSKRFTYLEVIKMTNNFQRVLGKGGFGMVYHGTVKGSDQVAVKVLSQSSTQGYKQFKAEVCGKSFDIAGSIAGLEYLHIGCIPPMVHRDVKTANILLDENFKAKLADFGLSRSFQVRGESYDSTFVAGTPGYLDPEYYPTSRLAAKSDVYSYGIVLLEMITNQPVISEKYHITEWVGSKLNRGDIIEIMDPNLGGVYDSNSAWRALELAMSCADPSSSKRPTMSQVINELKECLVCENSRMSKTRGMEYQEMNISLDTSVVPGAR

SEQ ID NO: 59321 - protein, 367 aa, Glycyrrhiza echinata
MSDSYSTKDNNLFSTSSEQTEDGACLSAMRLVTNLVYPAVLNAAIDLNLFEIIAKATPPGAFMSASEIASKLPLPTQHSDLPNRLDRMLRLLASYSVLTCATRSTERVYGLSQVGKYLVPDGSRGYLASFTTFLCYPALMNVWLNFKEAVVDEDIDLFKKLHGVSKYEYMETDPKMNHIFNKSMADVCATEMKRILQIYKGFEGISTLVDVGGGNGQNLKMIISKYPLIKGINFDLPQVIENAPPIPGIELVGGDMFASVPQGDAMILKAVCHNWSDEKCLEFLSNCHKALSPNGKVIVVEFILPEEPEPTEESQLASTLDNIMFITVGGRERTQKQYENMCKLAGFSKFQVACRAFSSLGVMEFYK

SEQ ID NO: 59322 - protein, 129 aa, Triticum aestivum
MLPAAMAAGFSVVAAEVEANDRTNPRLQAHEEREREISRVATMAMRALYNEIRAMKVREVPAYLKPRLTWSNVKKSTDQAVDRYIEKYIETSSVDPLFHVCFGGMAFSYLVGLPQERRHLEHLEKHGGH

SEQ ID NO: 59323 - protein, 257 aa, Burkholderia vietnamiensis G4
MFTRLREDVATIRERDPAARSAWEVLTCYPGLHALVLHRFAHACWRAKRYWLARFASQLGRFLTGIEIHPGATLGRRVFIDHGMGVVIGETAIVGDDCTIYQGVTLGGTSLTRGAKRHPTLEAGVIVGAGAKVLGGFTVGAGAKIGSNAVVVKPVPAGGTAVGNPARIVMPAQPKPQPERAAFCAYGITPNADDPMSLAIHGLIDHAAKESRRVDEIVAALEQLGTHLETLQGADAARLDLRRLSAVLEGKSVERQT

SEQ ID NO: 59324 - protein, 463 aa, Pseudomonas putida GB-1
MSTASSLAQVPPASVPQSLYEFTDSPLLQRQQQQESNARSYPRRIPLALKRARGIYVEDVEGRQFIDCLAGAGTLALGHNHPVVVEAIQRVLADELPLHTLDLTTPVKDRFVQDLFAILPEALRREAKVQFCGPTGTDAVEAALKLVRTATGRSTVLAFHGAYHGMSQGALALMGSHGPKQPLGALLGNGVQFMPYPYDYRCPFGLGGEAGVKANLHYLENLLLDPESGVPLPAAVILEVVQGEGGVIPADIEWLKGVRRITEQAGVALIIDEIQSGFARTGRMFAFEHAGIVPDVVTLSKAIGGSLPLAVVVYRDWLDTWKPGAHAGTFRGNQMAMAAGSAVINYLVEHRLAEHAEAMGLRLRQHLLQLQREYPQLGDVRGRGLMLGVELVDPQGKLDALGYPVANRELAAKVQRECLKRGLILELGGRHGAVVRFLPPLIISDEQVDDVAQRFAQALIASV

SEQ ID NO: 59325 - protein, 258 aa, Sinorhizobium meliloti
MADERVSARGGMETSFGFREVGTGEKQPLVNDVFHKVAKRYDIMNDVMSAGLHRVWKDAMIAALNPPGREDYRVLDVAGGTGDIAFRIVERSGRKAHATVLDINGSMLSVGAERARKKGIEANLDFVEANAEDLPFAANSFDAYTIAFGIRNVPRIEVALKEAYRVLKRGGRLLVLEFSEVEMPLLDRFYDAWSFNAIPKFGKLITGDDAPYQYLVESIRKFPNQRDFAAMIRDAGFARVSFTNYTGGIAALHSGWKI

SEQ ID NO: 59326 - protein, 89 aa, Trichodesmium erythraeum IMS101
MSVYVGNLSYDATDEDLKTAFAKYGNVKRVQVPNDRETGRPRGFAFVEMESEDEETAAIEGLDGSELMGRILKVNKARPREERGSGGRR

SEQ ID NO: 59327 - protein, 58 aa, Sonneratia alba
ESWTEHIQKSNEPGKLVVVDFTASWCGPCRFIAPFLAELARRFPIVLFLKVDVDELKT

SEQ ID NO: 59328 - protein, 365 aa, Ashbya gossypii ATCC 10895
MEFSVEGTQFSPPVKRIFDTAGTHDFQKSLTMYRLQSHLERYLKLVQGQKIPKSSQNRAVVRFVCILERLDALMDETPPRTGSARRFGDLACRDWHDRMQGELDGLLETLLPEAARRSAAELRYYLGSAFGSRERLDYGTGHELAFLAVVVALDMLGLWTEDKFTGEDMLYVWARYYALVHRLILTYNLEPAGSHGVWGLDDHLHLAYILGASQWAQDRNVPMQPSDILDPKAVARYSETNLYCNSIAFLLRVKTGHFAQHSPMLHDIAQTVPTWSKVTTGLIKMYRVEVLNKFPVVQHFWFGTGFFPWVDMAHGMSLPNYEAPSETSEKPAAGTAHTTTTTMPPPRMTANCGYGPLGRLVTPRR

SEQ ID NO: 59329 - protein, 477 aa, Oceanicola granulosus HTCC2516
MTKFSDLNLNPKVLKAIEEAGYETPTPIQEGAIPPALEGRDVLGIAQTGTGKTASFTLPMITLLHRGRARARMPRSLVLCPTRELAAQVAENFDIYAKHTKLTKALLIGGVSFKEQDQLIDKGVDVLIATPGRLLDHFERGKLLLTGVQIMVVDEADRMLDMGFIPDIERIFGLTPFTRQTLFFSATMAPEIERITNTFLSNPERVEVARQASASETIAQHVVVFRPSRKDREGSEKRAVLRAMIESEGENCRNGIIFCNRKVDVDVVAKSMKKNGYDAAPIHGDLDQSTRMRTLDGFRDGTLRFLVASDVAARGLDIPNVSHVFNYDVPSHAEDYVHRIGRTGRAGREGRAMMISVPRDDKNLEAIERLIQTEIPRMDNPAKVGAAPNAPEPAAEEAKPARTRTRTRREKPAAAPAETVEQPQPQTPAAAEESRGKSRSRPRGGERRKGEREAEVVGMGDDMPSFIALSFAERRTG

SEQ ID NO: 59330 - protein, 631 aa, Ashbya gossypii ATCC 10895
MFRHTSRRLLPWACGAVAAAAAVGAVSRPSLVNEVPTELKLERRAPAPPSRSELLEKLQKTNQFDVLVIGGGASGAGSALDASTRGLNVALLEMNDFASGTSSKSTKMAHGGVRYLEKAVWELSKAQLDLVIEALNERAHLLYTAPHLCKVLPIMIPVYKWWQVPYFYVGTKMYDFFAGSQNLKSSYLLSASAAGEVAPMLDASKLKAGLVYHDGSFNDSRMNATIAVTAIENGATVLNYMEVKRLIKNPEDGKVEGAVAMDRETGKEYAVRAKVVVNATGPFSDRLLQMDNHPEGLPDDKILDAINKDSTIATEVAVANPKMVVPSSGVHIILPSYYCPKNMGLLDAETSDGRVMFFLPWQGKVLAGTTDIPMKQVPANPTATEADIQDILKELQHYIKFPVKREDVQSAWAGIRPLVKDPRKNLSDTQGLVRSHLVFTSKNGMVTISGGKWTTYREMAEETVNEVVKVGKFVNAKPCITRKLKLSGAEHWDANLPALLSHQYNIPPLLAEHLSQNYGTKAAQVCELFEDDRANMLPVSLAADKPTSIDYNAFRYPYTIGELKFTMTHEYARTPLDFLMRRTRYAFLDAKQALKAVDGTVKVMGDALGWDSAKRVAETKYAIEYIKTFGV

SEQ ID NO: 59331 - protein, 315 aa, Listeria monocytogenes str. 4b F2365
MNKIANRQVMCEVLMKEATRNDSNLVVLTSDSRGSASLGAFAEKFPERLVETGIAEQNIVGIAAGLAHSGKRAFVASPACFLSMRSIEQVKVDVAYSDTNVKLIGISGGVSYGALGMSHHSLQDIAVTRAIPNLEVILPADRLETEAVFDYLLQSNRPAYVRLGRNAVEDCYAEKPVFQIGKAGTLRKGNDVSILATGEMVRVALDAREELKLKGISARVLNFSTIKPFDQGAVEAALAETKLLISIEEHSIYGGLGAAVSEVVSSSPTSIRHLILGIPDEPAIAGTSQEIFDYYGLSATGIVATVMKNLGDERR

SEQ ID NO: 59332 - protein, 136 aa, Mycobacterium tuberculosis H37Rv
MTERTLVLIKPDGIERQLIGEIISRIERKGLTIAALQLRTVSAELASQHYAEHEGKPFFGSLLEFITSGPVVAAIVEGTRAIAAVRQLAGGTDPVQAAAPGTIRGDFALETQFNLVHGSDSAESAQREIALWFPGA

SEQ ID NO: 59333 - protein, 305 aa, Lactobacillus reuteri
MSNNVVVLGSINVDTTYHVDRFPQPGETISAVSKSSAPGGKGANQAVAAARSGAKTAFIGAVGSDKEGAYMLESLADDHIDTRHIMTDKLHGTGSAAITLDANGQNDIMVYGGANQAMTTDVLAGIDDVLEDADFLISQFETPQEVALDAFKQAKKYGVTTLLNPAPAHEILPELLKYTDVITPNESECALLTGIEITDEESMLKSADYFRERGVKHLLITLGSKGVFYSTPTAHGLVPAFKVKAVDTTAAGDTFLGALSSQLEKDLSNVDKALVYAQRASSLTVQQMGAMPSIPNHDAVIKALA

SEQ ID NO: 59334 - protein, 209 aa, Porphyromonas gingivalis W83
MVMNTTIIGVAGGSASGKSTLVKKLCEAFVEEDVLVLCHDYYYKANDHLSLEERKKLNYDHPNAFDTDMFVRDILSLKAGKTIERPVYSFVEHNRLQEKVTVRPAKVIVLDGILIFENKELRDLMNVKVFVDTDADIRLARRLVRDVQERGRNMDSVLAQYFSTVRPMHEDFVEPSKRYADLIIPEGGFNSVALSLLVEKIRSVIRKEE

SEQ ID NO: 59335 - protein, 248 aa, Oryza sativa
  misc_feature (177)..(177): Xaa can be any naturally occurring amino acid
  misc_feature (208)..(208): Xaa can be any naturally occurring amino acid
MDSEHWISSLAAAKRFYAAQLGHVDDMAGIGMEEVEMEMEDDGEGMELELEMQLEEATWPDVACPYCYEDHDIASLCAHLEEDHPYEPHTSPCPICFEKITRDMLNHITMQHGYLFKSGRRMRRFDIPESQALSLLSRDLRDAQLQALLGGGHRQRRSNTTATNISADPLLSSFGLXGFSTLDSEERSKAPVPIPDDTSIHKDTPAQXPWESRIDSSLTSEEREQKRKQATDRATFVQGLVLSTLFED

SEQ ID NO: 59336 - protein, 99 aa, Glycine max
  misc_feature (76)..(76): Xaa can be any naturally occurring amino acid
MATIDSMRARQMFHRRGNPTGEADSTRSDGTLARAACPSGAPTGRAEARESRDGRPDHQGKGASKAVDNVNTAIGXPALNATDPTEQTAPDNGTDQQQD

SEQ ID NO: 59337 - protein, 401 aa, Lactobacillus reuteri
MAKLTVEDLPLEGKKVLMRVDFNVPIKDGVVGDDNRIVAALPTIKYVIDHGGRAILFSHLGRIKKEEDKPGLSLRPVAERLSNLLNKPVTFVPVTEGKQLEDAIDNMKNGDVLLVQNTRYEDVKDGEYVKRESGNDPELGKYWASLGDVFVNDAFGTAHRKHASNVGIATNMSGKAAAGYLMEKEIKFLGDAVDNPERPFVAILGGAKVSDKIGVIDNLLDKADKIIIGGGMAYTFYAAKGIKVGNSLVEKDKIDVAKQILDKAGDKLVLPIDNVVADKFNNDADTKVVEGDIDDGWMALDIGPKSVEEFKNVLKDAKTVVWNGPMGVFEMPNFAKGTLEIGKFLGTLTDATTIVGGGDSTAAVKELGVADKLTHISTGGGASLTYLEGKELPGIAAISDK

SEQ ID NO: 59338 - protein, 503 aa, Oryza sativa Japonica Group
MALAILARRRAAEALLRRPLGAAGVSALRASYAAVAGEESDVVVVGGGPGGYVAAIKAAQLGLKTTCIEKRGTLGGTCLNVGCIPSKALLHSSHMYHEAKSSFAHHGVKFSNLEVDLPAMMAQKDKAVAGLTKGIEGLFKKNKVTYVKGFGKLASPSEVSVDLSDGGSTVVKGKNIIIATGSDVKSLPGVTIDEKKIVSSTGALCLSEIPKKLVVIGAGYIGLEMGSVWNRLGSEVTVVEFAPDIVPSMDGEVRKQFQRMLEKQKMKFMLKTKVVGVDTSGDGVKLTLEPAAGGEQSVIEADIVLVSAGRVPYTAGIGLESVGVETDKAGRILVDKRFMTNVNGVYAIGDAIPGPMLAHKAEEDGVACVEFIAGKEGHVDYDTVPGVVYTHPEVASVGKTEEQVKALGIPYRVGKFPLLANSRAKAIDDAEGLVKVVAEKETDKILGVHIMAPGAGEIIHEAVLALQYGASSEDIARTCHAHPTVSEALKEACLQTFTKAIHI

SEQ ID NO: 59339 - protein, 267 aa, Burkholderia vietnamiensis G4
MHPMLNIAVKAARRAGQIINRASLDLDLIEIRKKQQNDFVTEVDKAAEEAIIETLKTAYPDHAILAEESGESENESEFKWIIDPLDGTTNFIHGFPYYCVSIALEHKGVVTQAVVYDPNRNDLFTATRGRGAYLNDRRIRVGRRDRLADALVGTGFPFREKDGLDAYARLFTEMTQACTGLRRPGAAALDLANVAAGRLDAFFEQGINVWDMAAGSLLITEAGGLVGNYTGDADFLHRHEIVAANPKIYAQMIPILNRYSRMHPAAE

SEQ ID NO: 59340 - protein, 133 aa, Glycine max
MATIIAGTPTTSITRTGHVLKRPVGASSSTVLGLPAMAKAGRVRCSMEEKPSSSSNLGMGASLLAAAAAATMSSPAAMALVDERLSTEGTGLPFGLSNNLLGWILFGVFGLIWALFFVYTSTLEEDEESGLSL

SEQ ID NO: 59341 - protein, 307 aa, Lactobacillus reuteri
MTNHVTIVGSLNVDTTMKVKRMPLPGETIAALSKTNAAGGKGANQAVAAARSGAETAFVGQVGDDAGGKMMINDLKNNNVDTTGIHVDDQAGTGSAAILLDESGQNSILVYGGANQQLSVKGVEDARDQIAATDFVIAQFETPQEATLRAFQIAKENGVKTILNPAPAHEINPDLLKLTDLIIPNETDSAALTGIIVTDETSMLMSSAKFAQMGVPNLIITVGAKGAFYCTQDGYNFIPAFKVNAVDTTAAGDTFIGALSSQLKPDMSNIEKAIVYAQRASSLAVQKLGALPSIPTYDEVVAASKNN

SEQ ID NO: 59342 - protein, 227 aa, Lactobacillus reuteri
MDQNALKEQTGKESVKYIKSGMIVGLGTGSTVKYMVDELGKQVQEGKIKDIIGVTTSNRTAKQARDLGITIKDIDDVDHIDLTIDGADEISDDFQGIKGGGGALLWEKIVANASNKVMWIVDESKLVHKLGAFPLPVEVIPFGSQHVFDRLEKKGYKPTWRMDGDKKFRTDENNYIIDLHLGEIDDPKALADELIHMVGIVETGLFLNRVNDVIVGTSEGPKVLHAR

SEQ ID NO: 59343 - protein, 543 aa, Mycobacterium sp. JLS
MLRTVTQVMGENVPPYLRPPVVLLDGHCPLPREVLGNKGHGLNLMRRLGLPVPPAFCLTTDVCAQFLAGDDHVLDRIWPDVLDNLRWLEHETARTFGQGPRPLLVSVRSGAAQSMPGMLDTVLDLGIDDDVESALAQEATPQFAADTRNRFRAMYQRIVLDDDESEPVPDNPFLQLRGAIAAVFRSWHSARAGAYRRHHGLGDGGGTAVVVQAMVFGNLSRDSGTGVLFTRNPMTGANEPFGEWLPRGQGEDVVSGGYDCEPLSALREQQPGVYADLMTAAETLEDLGRDVQDIEFTVEEGRLWLLQTRVAKRSAQAAVRLALTLLDEGLIEEDEALRRVTPVHVQTLLSPSLQPETRLAAPLLAKGLPACPGVASGRAYTDVDAALDAADNDEDVILVRTSTSPDDVAGMLAARAIVTQIGGATSHAAVVSREIGRPAVVGCGAGVTAALDGRLITVDGNAGEVREGVLPLTAWSEADSPDLRRLADIARRRSPLRAHRAGDYPVLPAGSDGAVRDALAAGHADVVSTTPLITMLTALRLVG

SEQ ID NO: 59344 - protein, 309 aa, Glycine max
MAATSTSLASQLYIGLRRPCLKLDSFNSQSFSVFDPNLRLSLSPPRPSRAIVAMAGTGKFFVGGNWKCNGTKDSISKLVADLNSAKLEPDVDVVVAPPFLYIDQVKNSLTERIEISAQNSWVGKGGAFTGEISAEQLKDLGCKWVVLGHSERRHIIGENDEFIGKKAAYALSQGLGVIACIGELLEEREAGKTFDVCFQQLKAYADAVPSWDNIVIAYEPVWAIGTGKVATPQQAQEVHVAVRDWLKKNVPDEVASKTRIIYGGSVNGGNSAELAKQEDIDGFLVGGASLKGPEFATIVNSVTSKKVAA

SEQ ID NO: 59345 - protein, 467 aa, Oceanicola granulosus HTCC2516
MTLTIPFDNSYARLPAQLFTALPPTPVAAPRLIEFNEALAEELGLDVDVKDEDRIASIFSGNDIPEGATPIAQAYAGHQFGNWNPQLGDGRAILLGEVTTPRGRFDIQLKGSGPTPYSRMGDGRAGLGPVLREYVMSEAMHALGVPTTRALAAVLTGERVQRETAQPGAVFTRVAASHIRVGTFQFFAVRDDREALEALARHVMARHYPDAKSVTQLLEAVMERQARLIAKWMSIGFIHGVMNTDNMSVSGETIDYGPCAFMDVYHPETVFSSIDQFGRYAYANQPQIAVWNVAQFATALLPLMDDQEAAVAEFTEIVHRFPEIYQAEWLRLFGEKLGLPGLEERGLVEDLLTLMAKDGADFTNTFRALPGDAARDQFLDREAFDAWAARWRALGPDEALMARVNPVVIPRLHRIEAAIRAGSAGDMEVFRSLLKIVTQPYEETEENAPYRRPPAEEERVTRTFCGT

SEQ ID NO: 59346 - protein, 403 aa, Thermobifida fusca YX
MRAVVWHGVGDIRVEDVDEPTIQDPQDAIVQLTTSAICGTDLHLLRGTIPGMRPGTIMGHEGVGVVTEVGPGVRNFRPGDRVVISPTIGCGACSYCRAGYFSQCDNANPAGRRSGTAFLGGPEANGAFHGTQAERVRVPYANVGLIGLPERVSDEEGILLADMFPTGWFGARLAEVTPGDTVAVFGCGPVGLFTILSAWQQGAGRVLAVDGVESRLEQARGLHAEVINYNVEDPVAALVELTGGIGPDRVIDAVGVDAQRPESGPAVAAEDDVHRLEKEHAATVPSARPGETAQILSDERAQVLQWAVEAVAKAGTLAIIGNYPLNARIFPIGLAMNKNLTLNAGSCHHRKYIPKLLDMITSQQLDITSVLTQEEPITGDVLRAYEAFGQHKPGWTKVALTTV

SEQ ID NO: 59347 - protein, 407 aa, Symbiobacterium thermophilum IAM 14863
MADVSGSRSAALMARADAHTMKTYGRYPIALVRGEGVRCWDADGKEYLDFLGGIAVNVLGHAHPALVSAIADQAARLIHCSNLYYSEPMAELAELLTQHGGLDRVFFCNSGAEANEGAIKLARKYQWRKGLKAKNRIVSLTHSFHGRTLATVTATAKPAIQEGFGPLPEGFDYVEAGDVAALRAAVTDRTAAVIVEPVQGEGGVRPLAREFLEAARAICDERGALLIFDEIQCGMGRVGHLFAYQAFGVKPDILTLAKGLGGGVPIGAVCATEEAARGFAPGDHGTTFGGSPLACAAALATVKTLLSEDLPARAAAMGEYLLAGLRRLQAKHPGLVKEVRGMGLMLGIELTRPARPVLEKCHELGLLVNVTADTVVRLLPPYIITAADCDRALEILDQALAAVGSAG

SEQ ID NO: 59348 - protein, 293 aa, Symbiobacterium thermophilum IAM 14863
MDQQALDKAAVLAEALPYIREFSGKTVVIKYGGAAMAAADLKAAVMQDIALMKYVGMHPIVVHGGGPEVSELARRMGIEPQFVDGLRVTDAATMEIAQMVLVGKTNREIVTHLCAQGVKAVGLSGQDAGLIRAARHLHRSRETGEMVDLGFVGDVAAVDTEVLTTLTTAGYVPVIAPIGVGPGGQPYNINADTVAGAIAAAMKAEKLVLLTDVEGVRADKDDPSSLLSRVTAQEVKSWIARGRLQGGMIPKLQCCLTALEGGVNRVHIIDGRVPHSLLLEIFTDEGVGTMVVK

SEQ ID NO: 59349 - protein, 354 aa, Hypocrea virens
MCFGARNKNEDGEARSRELDKGIRQEEKRMAKEVKLLLLGAGESGKSTILKQMKLIYAQGFNKSERLDFKPVIFSNIVQSFKTISEAMAEMGFEYDSPDNEKYMAHILVDNEISPDSGMPEDYLEPIKALWQDSGVLAAVSKGNEYALHDNLTYFVTDIDRIWADGYVPNDQDLLRSRLRTTGITETVFDLGQLTYRMFDVGGQRSERKKWIHCFENVNCLLFLVAISGYDQCLVEDKDGNQMNEALMLWESIANSHWFTMTSLILFLNKIDLFKEKLPKSPISKYGFTDYHGPDDDYKAASKYFLDKFRALSRNPEKEIYGHFTNATDTNLLKITMGSVQDMIIQRNLKKLIL

SEQ ID NO: 59350 - protein, 280 aa, Trichodesmium erythraeum IMS101
MKSQQQSLQTLILAIVLSLILLIGFNSFVIINPGQAGVLSVLGKAKDGALLEGIHFKPPLISEVDVYDVTVQKFEVPGQSSTKDLQQLSASFAINFRLDPLLVVKIRREQGTLQNLVAKVIAPQTQESFKIAAARRTVEEAITKREELKSDFDNALGSRLDKYGIIVLDTSVIDLTFSPEFARAVEDKQIAEQRAQRAVYIAEEAEQEAEAEINRAKGKAEAQKLLAETLKAQGGQLVLQKEAIEAWKKGGSQMPKVLVMGSEKSQGVPFIFNLSQMDEN

SEQ ID NO: 59351 - protein, 91 aa, Glycine max
  misc_feature (26)..(26): Xaa can be any naturally occurring amino acid
TDAKRNARDSHVPILAPLPIGFAVFXVHLATIPITGTGINPARSLGAAIIYNKDHAWNDHWIFWVGPFVGAALAAIYHQVIIRAIPFKSRS

SEQ ID NO: 59352 - protein, 196 aa, Zea mays
MASSLLRSGHRLFLRRHRLPAAFSTATAEELIDVRKLPTNYDPSTFDPSSPSRPPPSDRVWRLVEDVSSLTLAETAALSSLLLRRLDIPSAPPIAILNSAAGLGGAATAGAAGEKAGAAAAAAAEKTVFELRLEGYDAASKIKVIKEIRSFTDLGLKEAKELVEKAPAVIKGGLSKDEAKAIIERMKAVGAKVVMD

SEQ ID NO: 59353 - protein, 352 aa, Oryza sativa Japonica Group
MGKPGKLALPSHESTIGKFLTQSGTFKDGDLLVNKDGLRIVSQSEEGEAPPIEPLDHNQLSLDDLDAIKVIGKGSSGIVQLVRHKWTGQFFALKVIQLNIQENIRRQIAQELKISLSTQCQYVVACCQCFYVNGVISIVLEYMDSGSLSDFLKTVKTIPEPYLAAICKQVLKGLMYLHHEKHIIHRDLKPSNILINHMGEVKISDFGVSAIIASSSAQRDTFTGTYNYMAPERISGQKHGYMSDIWSLGLVMLELATGEFPYPPRESFYELLEAVVDHPPPSAPSDQFSEEFCSFVSACIQKNASDRSSAQILLNHPFLSMYDDLNIDLASYFTTDGSPLATFNTSNRYDDR

SEQ ID NO: 59354 - protein, 128 aa, Brassica napus
MTVEAVNPKAYPLADSQLAIIILDLVQQATNYKQLKKGANEATKTLNRGISEFVVMAADAEPLEILLHLPLLAEDKNVPYVFVPSKQALGRACGVTRPVIACSVTSNEASQLKSQIQQLKDAIEKLLI

SEQ ID NO: 59355 - protein, 519 aa, Ipomoea quamoclit
MATLTLILCTLLFAIFLYFLILRVKQRYPLPLPPGPKPWPVLGNLPHLGEKPHQSIAAMAQKYGPLMHLRLGFVDVVVAASAAVAAQFLKVHDANFSSRPPNSGAEHIAYNYQDLVFAPYGPRWRMLRKITSVHLFSAKALDDFSHVRQEEVATLTRSLASAGKTPVKLGQLLNVCTTNALARVMLGRKVFNDGSSKSDPKAEEFKSMVEEMMVLAGSFNLGDFIPVLGWFDLQGIVGKMKKLHARFDAFLNAILEEHKFVNNQHTTSSKDVDFLSTLLRLRDSGADMDGEEGKLTDTEIKALLLNLFTAGTDTSSSTVEWAFAELLRNPKILSQAQQELDLVVGTNRLVTESDLTQLPFLQAIVKETFRLHPSTPLSLPRIGAESCEINGYFIPKGATLLVNVWAIARDPNAWTNPLQFNPNRFLPGGEKTNVDIKGNDFEVIPFGAGRRICSGMSLGIRMVHLLIATLVHAFDWDLVNGQSVETLNMEESYGLTLQRAVPLMLHPKPRLQPHLYTLN

SEQ ID NO: 59356 - protein, 546 aa, Phytophthora nemorosa
QELVGMLNTARIPANVEVVVAPSQVHAATVKAALRADVRVSGQDVWQQGNGAFTGETSAEMLKDLGAEFTLVGHSERREKGETNEVVAKKAAYALEKGLGVIACIGETKEHREANQTVAYITEQLDAYAAEIKDWTDVVIAYEPIWAIGTGLTASPEQAQEVHASIRAWLKAKVSPEDAEKTRVIYGGSVGAKNAPELSQKEDIDGFLVGGASLKPDFLQIINAQNPTTNVGGAVNVAINGFGRIGRLVLRAAATNPLINVVAINDPFISTTYMEYMLEYDTVHGKFAGSLSHDEQNIYVNGKPIRVHNEMNPANIKWGEQQVQYVVESTGAFTAIETASAHMKNGVEKVVISAPSNDAPMFVMGVNHELYEKSMHVVSNASCTTNCLAPLAKVVNDKFGIKEGLMTTVHAVTATQKTVDGPSKKDWRGGRGACFNIIPSSTGAAKAVGKVIPSLNGKLTGMSFRVPTADVSVVDLTARLVNPASYDEIKAAIKSASENEMKGILGYTEKAVVSSDFIGDSHSSIFDASAGIALTDDFVKLVSWYD

SEQ ID NO: 59357 - protein, 536 aa, Phytophthora europaea
QELVGMLNTAKIPANVEVVVAPSQVHAATVKAALRPDVRVSGQDVWKQGNGAFTGETSAEMLKDLGAEYTLVGHSERREKGETNEVVAKKAAYALEKGLGVIACIGETKELREANQTVAYITEQLDAYAAEINDWTNVVIAYEPIWAIGTGLTASPDQAQEVHASIRAWLKEKVSPEAAEKTRVIYGGSVGAKNAPELSQKADIDGFLVGGASLKPDFLQIINAQNPTTNVGGAVNVAINGFGRIGRLVLRAAAKNPLINVVAINDPFISTTYMEYMLEYDTVHGKFDGTLSHDEQHIFVNGKPIRVFNEMNPANIKWGEEQVRYVVESTGAFTTTEKASTHLQNGVEKVVISAPSSDAPMFVMGVNHELYEKNMHVVSNASCTTNCLAPLAKVVNDKFGIKEGLMTTVHAVTATQKTVDGPSKKDWRGGRGACFNIIPSSTGAAKAVGKVIPSLNGKLTGMSFRVPTADVSVVDLTARLVNPASYDEIKAAIKSASENEMKGILGYTEKAVVSSDFIGDSHSSIFDASAGIALTD

SEQ ID NO: 59358 - protein, 214 aa, Mycobacterium tuberculosis H37Rv
MNSQNSQIQPQARYILPSFIEHSSFGVKESNPYNKLFEERIIFLGVQVDDASANDIMAQLLVLESLDPDRDITMYINSPGGGFTSLMAIYDTMQYVRADIQTVCLGQAASAAAVLLAAGTPGKRMALPNARVLIHQPSLSGVIQGQFSDLEIQAAEIERMRTLMETTLARHTGKDAGVIRKDTDRDKILTAEEAKDYGIIDTVLEYRKLSAQTA

SEQ ID NO: 59359 - protein, 340 aa, Xanthomonas axonopodis pv. citri str. 306
MSRASILCFGELLLRLGAPGHELLLQQPRLDVHCGGAEANVGVSLAHFGHDVAMVSTVADNPLGAAVLGELRRHDVDTRHVRRVDGRMGLYFLTTGAIHRPSEVIYDRADSAFALAPADAYDWPRLLEGVQWLHLSGVSPALGAEVAQATLAAARAARAAGVKVSFDGNYRPKLWQRWQGDARGILHQLFACADVVFADYRDIGVVLGGEFAQDTLEARVEAAAQHAFAAFPQLQLMACTQRVAHHVDHHSLGAMLVPRQGAVARAPSEELTPIIDRIGGGDAFAAGVLHGLIEGWSLEDTVRFGLAAGCLKHSIPGDFNPLSVADVQACVGDARFDVRR

SEQ ID NO: 59360 - protein, 767 aa, Porphyromonas gingivalis W83
MKQSGTAAHKLTIFYVGMLLLFLIGLWLFATIGKELETNVVDKAMSLRGRGGLVGAFDSFSESVHHHFTDTIGVLLLQIIVILTVARLVAWFFGKIGQPTVIGEIVAGILLGPSLLGAVWPEAYEVLFPLSALANLELLSQFGLILFMFVIGMELNINDIKPRFSQSMIISHAGIFIPFLLGLLISYMTYKDYAADTTTFLPYGLFIGISMSITAFPVLARIIQERQLGKSHLGMLSISTAAAGDISAWLMLAGVMAITQSGSFLSAIYNFLFLILYLLVIFGLVRPFFKVIGRLYDNQEVVSKTMIGFIFVLLLASAYATELLSMHALFGAFMLGLVMPENVQFRKILTEKVEDVSLTLFLPLFFVSSGLQTKLGLLDSASLWLLTGAFTLIAIIGKFGGTYVAARFCGERKKASLYLGAFMNTRGLMELVVLAIGRELGILPPVIFTILVMMTLITTFMTTPLLRLIDLFFKRETELENAALQKENSGAVLLSFGRASSGAHLLHATDLLMHRGDEKPSVTALHITVGSDTNLTSSEVYEERAFAPIREESDRRRLPIRTLHHHTFEHPEAEVVRTVNAGGYSFLLVGAGINLSDRKSDRELLYFRKKLQRKLGPISIATPEALLNAHEMLRDKMHYFIEQTQCSVGIFIHRGFKHAGKVLLLMENEGDEELLAYARSLARNNGSVLDVLPETDGLPPTLSMGENRLKAGLPSTINISSYHFMLVSYRYWLRFAGECPSVIEHLPSTIIIHHRNDRSSTLKAAMI

SEQ ID NO: 59361 - protein, 545 aa, Phytophthora multivesiculata
QELVGMLNTAKIPANVEVVVAPSQVHAATVKASLRPDVRVSGQDVWKQGNGAFTGETSAEMLKDLGAEYTLVGHSERREKGETNEVVAKKAAYALEKGLGVIACIGETKKHREANQTVAYITEQLDAYAAEIKDWTDVVIAYEPIWAIGTGLTASPEQAQEVHASIRSWLKEKVSPEAAEKTRVIYGGSVSAKNAPELSQKEDIDGFLVGGASLKPDFLQIINAQSPTTNVGGAVNVAINGFGRIGRLVLRAAATNPLINIVAINDPFISTTYMEYMLKYDTVHGKFAGSLSHDEKHIYVNGKPIRVFNEMNPANIKWSEEQVQYVVESTGAFKTIETASAHMKNGVEKVVISAPSSDAPMFVMGVNHELYEKNMHVVSNASCTTNCLAPLAKVVNDKFGIKEGLMTTVHAVTATQKTVDGPSKKDWRGGRGACFNIIPSSTGAAKAVGKVIPSLNGKLTGMSFRVPTADVSVVDLTARLVNPASYDEIKAAIKSASENEMKGILGYTEEAVVSSDFIGDSHSSIFDAEAGIALTDDFVKLVSWY

SEQ ID NO: 59362 - protein, 537 aa, Vitis vinifera
  misc_feature (32)..(32): Xaa can be any naturally occurring amino acid
  misc_feature (40)..(40): Xaa can be any naturally occurring amino acid
  misc_feature (56)..(56): Xaa can be any naturally occurring amino acid
MISYHLNKATETICSLWSWWWAGSNKKLDVVXGAVLTVSXAVLAILWYLRTSRKGXAPWPPGPRGLPVVGYLPFLGSNLHHSFAELAHLYGPIFKLWLGNKLCVVLSSPSLAKQVVRDQDIIFANRDPPVAAFAYTYGGLDIAWSPYGSYWRNLRKVFVREMLSNTSLEACYPLQRSEVRKAITNAYSKIGTPMDIGQLSFQTVVNVTLSSLWGNTPEAHNDGKIGAEFREAASEITELLGKPNISDFFPTLAGFDIQGVERQMKRAFLSAEQVIDSIIDRKMKKSTAKEEGASDNGEKKDFLQFLLDLKVQEDTETPITMTQIKALLMDILVGGTDTTATMVEWVMAEMIRNPVIMTRAQEELTNVVGMGSIVEESHLPKLQYMDAVIKESLRLHPALPLLVPKCPSQDCTVGGYTIAKGTKVFLNVWAIHRDPQIWDSPSEFKPERFLSEPGRWDYTGNNFQYLPFGSGRRICAGIPLAERMIIYLLASLLHSFNWQLPEGEDLDLSEKFGIVLKKRTPLVAIPTKRLSSSDLYL

SEQ ID NO: 59363 - protein, 546 aa, Phytophthora drechsleri
QELVGMLNTARIPADVEVVVAPSQVHAATVKASLRADVRVSGQDVWKQGNGAFTGETSAEMLKDLGAEYTLVGHSERREKGETNEIVAKKAAYALEKGLAVIACIGESKETREANETVAYITEQLNAYAAEIKDWTNVVIAYEPIWAIGTGLTASPEQAQDVHASIRAWLKEKVSPEAAEKTRVIYGGSVGAKNAPELSQKEDIDGFLVGGASLKPDFLQIINAQNPTENVGGAVNVAINGFGRIGRLVLRAAAKNPLINIVAINDPFISTTYMEYMLEYDTVHGKFDGALSHDEQHIFVNGKPIRVFNEMNPSNIKWGEEQVQYVVESTGAFTTLEKASTHLQNGVEKVVISAPSSDAPMFVMGVNHELYEKNMHVVSNASCTTNCLAPLAKVVNDKFGIKEGLMTTVHAVTATQKTVDGPSKKDWRGGRGACFNIIPSSTGAAKAVGKVIPSLNGKLTGMSFRVPTADVSVVDLTARLVNPASYDEIKAAIKDASENEMKGILGYTEKAVVSSDFIGDSHSSIFDASAGIALTDDFVKLVSWYD

SEQ ID NO: 59364 - protein, 134 aa, Triticum aestivum
RQQQNLQKFRDDNNSCRNFEQRSQRRKSTPCKNDNTTPVKDSAKNRKTKKQVRSRIQLSEDDVVAIFFSFDEAGKGYIAPWDLEKMANINDFIWTDFELSKMIHCFDSDKDGKISLEEFRTIVSRCNMLQEPEE

SEQ ID NO: 59365 - protein, 533 aa, Phytophthora hibernalis
ELVGMLNTAKIPAGVEVVVAPSQVHAATVKASLRADVRVSGQDVWKQGNGAFTGETSAEMLKDLGAEYTLVGHSERRQKGETNEVVAKKAAYALEKGLAVIACIGETKELREANRTVSYITEQLDAYAAEINDWTNVVIAYEPIWAIGTGLTASPEQAQDVHASIRAWLKEKVSPEAADKTRVIYGGSVGAKNAPELSQKEDIDGFLVGGASLKPDFLQIINAQNPTENVGGPVNVAINGFGRIGRLVLRAAAKNPLINIVAINDPFISTTYMEYMLEYDTVHGKFDGSLSHDEQHIFVNGKPIRVFNEMNPTNIKWGEEQVQYVVESTGAFTTLEKASTHLQNGVEKVVISAPSSDAPMFVMGVNHELYEKNMHVVSNASCTTNCLAPLAKVVNDKFGIKEGLMTTVHAVTATQKTVDGPSKKDWRGGRGACFNIIPSSTGAAKAVGKVIPSLNGKLTGMSFRVPTADVSVVDLTARLVNPASYDEIKAAIKSASENEMKGILGYTEKAVVSSDFIGDSHSSIFDAGAGIAL

SEQ ID NO: 59366 - protein, 396 aa, Yarrowia lipolytica
MTFHSLVNKVSGQPPSYNKKADYKFGKTLGSRYFGIVKYAKQHSTGEEVAVKIIVKKNLKGNDHVVIEELSLLKECHHPHIIAFKDWFESKEKFYIVTQLATGGELFDRICDYGKFTEKDARQSVKDILEAVDYLHSKDIVHRDLKPENLLFVTPDPHASLVLTDFGIAKHLKSPDEVLHSMAGSFGYAAPEVLKGTGHGKPCDIWSLGVITFTILSGYSPFRSETVRDFLEEIEGPNALVFHKKYWQDVSEDAKDFIKSCLALDPALRPTSAELLKHEWITGDTTKSIDLLPNIREGFNARSKFRQAIEAVRLHNRIKSLNMVDSDDEDEEEEAVADTEKPSLLSVASSMRPRAHSRSKSGTGAAAFQEVVLAAKRNKELLEKEKASKQDAAEEK

SEQ ID NO: 59367 - protein, 478 aa, Lactobacillus reuteri
MSDQKAQIGVVGLAVMGKNLALNIESRGFTVGVYNRHRNRTDDMMRDHSDKKLVPSYTVKEFVDSLEKPRRILMMVKAGKPTDALIDELLPLLDKGDVLIDGGNTNFHDTMARNAKLDKSGINFIGMGVSGGELGALHGPSLMPGGQKEAYDLVAPILTKIAAKAEEDGKPCVAYIGPNGAGHYVKMVHNGIEYGDEELIDESYNIMRNVLKMPVDDIAKTFAEWNKGELSSYLVDITADILTRKDDLGDDKNKPIVDMILDRGANKGTGKWSSMTALDGGAPQSVITEAVYARYISMMKDERVQASKELPVETEAISIDDKKEMIEKVRQALYFGKLMSYAQGFEQMRIDSERYDWNLKYGELAQIWRAGCIIRAQFLQNITDAFTKNPDLKNLLLDDYFKDIAKKYQKATRDVVTLAVKAGIPVPSLSAAISYYDSYRSEVLPANLLQAQRDYFGAHTYERTDRPGNFHYSWYEEQ

SEQ ID NO: 59368 - protein, 176 aa, Synechococcus sp. WH 7803
MKHTLSVLVEDESGALSRIAGLFARRGFNIDSLAVGPAEADGRSRLTMVVEGDQQTLQQMTKQLDKLVNVLQVLDLSQRPAVERELMLMKVSAPASQRSAILELVQVFRAKVVDVADDALTLEVVGDPGKLVALERLMAPYGIQEIARTGKVALERASGVNTELLKASISGGRVPA

SEQ ID NO: 59369 - protein, 408 aa, uncultured bacterium
MKTVYVDNNATTAIAPEVLAVMQTYLTSDYFNPSSMYDAARSSAEAIESARRTVASCLGGIDPDQIIFTGSATESNNAALFGTVQANPERRHVITTTIEHPSVLEIGKELERRGQEVTFLSVDHNGELMLDDYIRALRSDTLVVSIMMANNETGVCYPVDVLARIAKETDPEIVVHTDATQALGKLPVDLQDDLQHVDLLSFSGHKIHAPKGVGCLFVRRGTRWRPFILGGHQEKGRRAGTENVPYIVGLAKACELAIAGVSDEQGRVRNLRDRLQKALIERIPAVEVNGKEAAVRLPNTLNLAFHGIEGEAILFELSRNGICASSGSACTSGTLDPSHVLKAMQVPFTAIHGSVRISLSRYNNEEDVERIIEVLPDIIARLARNSRLTGMMSATAWRYNQGESEEAI

SEQ ID NO: 59370 - protein, 297 aa, Physcomitrella patens subsp. patens
MASGLAGNEVLTPAHPDWEPFAEGFTYVCRSLAQAIARDGEGATKLVEVSVTGAVSDLSARAIAKTVIGSSLVKSAVFGADANWGRIIAAVGRAGEPVNPETVDIRLGDISVLEQSRPVAFDEDEALAYLKGDTVRIVVDLHGGAGQATAWGCDLTYDYGSHIGADDQQTFVMKCGGSTLAALPDSFFEDLKQLQQQGVQPVIVHGGGPAISDNLAKLGIETEFVNGLRKTTEDVLDVVEMVLAGTINKQIVRRIQSTGGRALGLSGVDGGLIQAEPVANAAEVGHVGDVTYVESAI

SEQ ID NO: 59371 - protein, 262 aa, Triticum aestivum
MAASLLLLSPSPHCHCITTPTRGTGTPLPSPRCHPPAPRRRPRPRGAGLVARGAAVPPEQSLAPHYKTLGDAKSALYQALEGIDRGIFGITSAKRSEIHALVELLESRNPTPNPTDKLHDKVDGCWRLIYSTISILGKRRTKLGLRDFISLGDFFQIIDVKEEKAVSVIKFSARALKIFSGQLAIEASYTITTKTRVGIKLESSTITPDQLMNIFQKNYDMLLAIFNPEGWLEITYVDESLRIGRDDKANIFVLEKTDPSQV

SEQ ID NO: 59372 - protein, 188 aa, Methanocaldococcus jannaschii DSM 2661
MIVILDNGGQYVHRIHRSLKYIGVSSKIVPNTTPLEEIESNKEVKGIILSGGPDIEKAKNCIDIALNAKLPILGICLGHQLIALAYGGEVGRAEAEEYALTKVYVDKENDLFKNVPREFNAWASHKDEVKKVPEGFEILAHSDICQVEAMKHKTKPIYGVQFHPEVAHTEYGNEILKNFCKVCGYKFE

SEQ ID NO: 59373 - protein, 496 aa, Glycine max
MGGNNSKEDNNNWRQNSSVRSSSSASSWGSYPDPQSGYGHGGYAYEPQQPSYPTQQPYYAQPPPPPPNYGNEPQPHASGRVAGHRNEKRLDRKYSRITDNYNSIDEVTEALARAGLESSNLILGIDFTKSNEWTGKHSFNRKSLHHIGNGPNPYEQAISIIGKTLAAFDEDNLIPCFGFGDASTHDQDVFSFYPDERICNGFEEVLSRYREIVPIIRLAGPTSFAPIVEMAMTIVEQTGGQYHVLVIVADGQVTRSIDTERGRLSPQEQSTVDAIVEASKFPLSIILVGVGDGPWDMMKEFDDNIPARAFDNFQFVNFTEIMSKNIPPSRKEAAFALAALMEIPSQYKAAIELNLLGGRNANAPQRVALPTPSYGSASMGTSKPYGSASFGASKPYGSASFDAPKPFGSASFSSSKPSHAASFEQSAPSYYDNTDPVGTAPPAPSSSYDNQLCPICLTNSKDMAFGCGHQTCCECGQDLQSCPICRSPINTRIKLY

SEQ ID NO: 59374 - protein, 523 aa, Haemophilus somnus 2336
MTNIHHHKILILDFGSQYTQLIARRVREIGVYCELWAWDVTEEQIREFNPTGIILSGGPESTTEANSPRATEYVFNAGVPVLGICYGMQTMAMQLGGLTETSTHREFGYAEVSLQNPTALFADLNDDLTACDPKLDVWMSHGDKVTRLPDNFQITGMTSTCPIAAMSDESRRFYCVQFHPEVTHTKCGQKLLQNFVVDICGCETNWTAENIIEDAVARIKAQVGDDEVILGLSGGVDSSVTALLLHRAIGKNLHCVFVDNGLLRLNEGDQVMEMFGDKFGLNIIRVEAEDRFLEALKGIDEPEAKRKTIGKVFVDVFDDEAKKLTDVKWLAQGTIYPDVIESAASKTGKAHVIKSHHNVGGLPDYMKLGLVEPLRELFKDEVRKIGLALGLPAEMLNRHPFPGPGLGVRVLGEIKKEYCDLLRKADAIFIEELHKADWYYKVSQAFGVFLPVKSVGVMGDGRKYDWVISLRAVETIDFMTAHWANLPYDLLGKISNRIINEVNGISRVVYDISGKPPATIEWE

SEQ ID NO: 59375 - protein, 255 aa, Zea mays
  misc_feature (224)..(224): Xaa can be any naturally occurring amino acid
MAAPGRAALLAAALLFGTFFPSASSASSYPAKTNRPSSFVPRRVAGIAGRLLSTTASAVAKQLWSLKSAATKTATTAVTGRSMVRYEGGYAVDTVFDGSKLGIEPHAVEITPAGNLLVLDSINSNIYRVQLPLSPYSRPKLLAGSPKGLSGHVDGRLREARMNHPKGFTVDDRGNIYVADGMNMAIQKISDTGVTTIAGGKSIRGGHIDGPSDDAKFSTDFEIXYISSTCSLLGIERGNQAIPEIHSTMMTGLIV

SEQ ID NO: 59376 - protein, 372 aa, Acidobacteria bacterium Ellin345
MRKRILVTGGAGFVGSHLVDALLRAGHSVRVFDNLSPQVHPHGLPSYLATDIEFIQGDMRDLDAVRRSLENIDVIFHKAAAVGVGQSMYEISHYMSANTQGTANLLQAMLDSRRDFEKLVVASSMSIYGEGKYRCAEHGDIAPEPRPIDQLRKKEWEALCPVCNAKLAPIPTDESKRLQCTSIYALSKKDQEEMCLLYGRTYGAPVVALRYFNIYGTRQALSNPYTGVAAIFASRLLNHRSPMIFEDGEQQRDFVSVHDIVQANLLAMDREEANGLAINIGSGAPISISQVADILGAALGLHVEPEITGKYRAGDIRHCFADIGLAQKVLGYRPKHRFADGIGELVAWLRNQSATDKVSDATQQLTAYGLTA

SEQ ID NO: 59377 - protein, 119 aa, Triticum aestivum
PGAFTPTCSNQHVPGFITQAEQLKAKGVDEILLISVNDPFVMKAWAKTYPENKHVKFLADGSGAYTKALDLELDLTEKGLGVRSKRFALLADDLKVTVANIEEGGQFTISGAEEILKAL

SEQ ID NO: 59378 - protein, 544 aa, Listeria monocytogenes str. 4b F2365
MAYSFKLPDIGEGIHEGEIVKWFVQPGDKIEEDESLFEVQNDKSVEEITSPVSGTIKEIKVAEGTVATVGQVLVTFDGVEGHEDDAEEESAAPKAESTESTPAPAQASGKGIFEFKLPDIGEGIHEGEIVKWFIQPGDKVEEDQSIFEVQNDKSVEEITSPVDGTVKDILVSEGTVATVGQVLVTFEGDFEGEASHESTPESPAEEAELTNNDATSAPVTGGNGTPSSKKDPNGLVIAMPSVRKYAREKGVNIAEVAGSGKNNRVVKADIDAFLNGEQPAASTTTAQTEEKAAAPKAEKAAAKQPVASSDAYPETREKLTPTRRAIAKAMVNSKHTAPHVTLMDEIEVTALMAHRKRFKEVAAEKGIKLTFLPYMVKALVATLRDFPVLNTTLDDATEELVYKHYFNVGIAADTDHGLYVPVIKNADKKSVFQISDEINELAGKARDGKLTADEMRHGSATISNIGSAGGQWFTPVINYPEVAILGVGRIAQKPIVKDGEIVAAPVLALSLSFDHRVIDGATAQKAMNNIKRLLNDPELLLMEV

SEQ ID NO: 59379 - protein, 277 aa, Brassica napus
MAIFNTQNTWAFAFGLLGNIISFAVFLSPVPTFYRIWKKKTTEDFQSLPYVVALFSAMLWLYYATQKKDVFLLVTINSFGCFIETIYIAIFVAFATKKARMLTVKLLLLMNFGGFCLILLLCQFLAKGSTRAKIIGGICVGFSVCVFAAPLSIIRTVIKTKSVEYMPFSLSLTLTISAVVWLLYGLALKDIYVAFPNVIGFVLGALQMILYVVFKYCKTPSDLVEKELEAAKLPEVSIDMLKLGTLVGSPELAVNTVVRPVSMCVCNDKKAEAENGV

SEQ ID NO: 59380 - protein, 467 aa, Listeria monocytogenes str. 4b F2365
MVVGDFPEERDTIVIGAGPGGYVAAIRAAQLGQKVTIIEKEYYGGVCLNVGCIPSKALITIGHRFKEAGHSDNMGITADNVNLDFTKAQEWKGGVVNKLTSGVKGLLKKNKVEMLEGEAFFVDDHSLRVIHPDSAQTYTFNNVIIATGSRPIEIPGFKYGKRVLSSTGALALTEVPKKLVVIGGGYIGTELGGAFANLGTELTILEGGPEILPTYEKDMVSLVKRNLKSKNVEMVTKALAKSAEETENGVKVTYEANGETKTIEADYVLVTVGRRPNTDEIGLEQAGVKVTERGLVEVDKQGRSNVPNIFAIGDIVPGVPLAHKASYEAKIAAEAIAGEKAENDYTALPAVVFSDPELATVGLTEKEAKEKGFDVKAAKFPFGGNGRALSLDAPEGFVRLVTRKEDGLVIGAQVAGMNASDIISEIGLAIESGITAEDIALTIHAHPSLGELTMEAAELALGRPIHM

SEQ ID NO: 59381 - protein, 220 aa, Oceanicola granulosus HTCC2516
MRWTLPNILTIGRLIAAPGIAIIFLYFNRPFADWFALILFGSVALTDWIDGRLARAWGMETRFGAAMDPIADKAMVLVALLVIAGYSAMSPWIVMPATLIVFREVFVSGLREYVGPGAKLAVTNLAKYKTTAQMLAIAVLFSQGIFLHHLIDRTVGMSPELVESILAGTAPDEVGLRAFEAGHLWSGRIGVALLWIAAILTLVTGWDYFRKSLPALREPE

SEQ ID NO: 59382 - protein, 442 aa, Rhodopirellula baltica SH 1
MNTDSRPNNPSEPAKLRRDVGLFGAMMMGLGSIVGTGVFVSIGIAAGITGPSVVLAILVAGLVATFNGLSSAQLAAAHPVSGGTYEYGYRWLTPSMGFTAGWMFLCAKSASAATAALGFAGYALQLFQFDHDDWIVPLAIGAVVATTLLLLGGIRRSNWTNIAIVSMTLIALASFVIAGLPFAWREGSSNLTPFFASDSPAIATRQFLEACALMFVAYTGYGRIATLGEEVHNPRRTIPRAIIVILLVSSLLYAIVGGIAVAAAGIDVWSSTSQQTAPLQLVANHLNSPLVAKLVAIGAVTAMLGVLLNLILGLSRVVFAMGRRGDLPRGLATVSTQNSNPSGAVIAVGIGVGTLALIGDVETTWSFSAFTVLVYYALTNLAATRLTADERLFSPIVPWLGLASCLGLAFWVQPKIWIIGLSLIAVGLVFQQCMKRSDTSAS

SEQ ID NO: 59383 - protein, 537 aa, Phytophthora capsici
  misc_feature (143)..(143): Xaa can be any naturally occurring amino acid
QELVGMLNTAKIPANVEVVVAPSQVHAATVKASLRSDVRVSGQDVWKQGNGAFTGETSAEMLKDLGAEYTLVGHSERREKGETNEVVAKKAAYALEKGLGVIACIGETKELREANQTVAYITEQLDAYAAEIKDWTNVVIAYXPIWAIGTGLTASPDQAQEVHASIRAWLKEKVSSDAAQKTRVIYGGSVGAKNAPELSQKEDIDGFLVGGASLKPDFLQIINAQNPTDNVGGAVNVAINGFGRIGRLVLRAAATNPLINIVAINDPFISTTYMEYMLEYDTVHGKFAGSLSHDEQHIFVNGKPIRVFNEMNPANIKWGEEQVQYVVESTGAFTTTEKASAHLQNGVEKVVISAPSSDAPMFVMGVNHELYEKNMHVVSNASCTTNCLAPLAKVVNDKFGIKEGLMTTVHAVTATQKTVDGPSKKDWRGGRGACFNIIPSSTGAAKAVGKVIPSLNGKLTGMSFRVPTADVSVVDLTARLVNPASYDEIKAAIKSASENEMKGILGYTEEAVVSSDFIGDSHSSIFDAEAGIALTDD

SEQ ID NO: 59384 - protein, 533 aa, Phytophthora nicotianae
  misc_feature (480)..(480): Xaa can be any naturally occurring amino acid
ELVGMLNTAKIPADVEVVVAPSQVHAATVKASLRADVRVSGQDVWKQGNGAFTGETSAEMLKDLGAEYTLVGHSERREKGETNEIVAKKAAYALEKGLGVIACIGETKEHREANQTVTYITEQLDAYAAEIKDWTNVVIAYEPIWAIGTGLTASPEQAQEVHASIRAWLKEKVSPDAADKTRVIYGGSVGAKNAPELSQKEDIDGFLVGGASLKPDFLHIINAQNPTTNVGGAVNVAINGFGRIGRLVLRAAAKNPLINIVAINDPFISTTYMEYMLEYDTVHGKFDGSLSHDEKHIFVNGKPIRVFNEMNPANIKWGEEQVQYVVESTGAFTTLEKASAHMKNGVEKVVISAPSSDAPMFVMGVNHELYEKNMHVVSNASCTTNCLAPLAKVVNDKFGIKEGLMTTVHAVTATQKTVDGPSKKDWRGGRGACFNIIPSSTGAAKAVGKVIPSLNGKLTGMSFRVPTADVSVVDLTARLXNPASYDEIKAAIKSASENEMKGILGYTEKAVVSSDFIGDSHSSIFDAEAGIAL

SEQ ID NO: 59385 - protein, 122 aa, Zea mays
MAARLAQLRAQAVQAAEFASKHGGSYYKELMEKNKQYVVQPPTIEKCQELSKQLFYTRLASLPGRYESFWKELDGVKQVWKNRKDLKVEDLGIATLFGVELYAWFCVGEIVGRGFTLTGYKV

SEQ ID NO: 59386 - protein, 295 aa, Borrelia burgdorferi
MKKDYYEILGLSKGASKDEIKKAYRKIAIKYHPDRNQGNEEAASIFKEATQAYEILIDDNKKAKYDRFGHSAFEGGGFEGFSGGFSGFSDIFEDFGDIFDSFFTGNKGQERNRKHAKGEDLGYNIEISLENAYFGYKNNINITRQMLCDSCLGKKSEKGTSPSICNMCNGSGRVVQGGGFFRVTTTCSKCYGEGKIISNPCKSCKGKGSLTKQETIQLNIPPGIDNNQQIKMKGKGNVNPDNQEYGDLYVKILIRSHKVFKRNGKDLYAMLPISFTQAALGKEVKIKTIASKEIK

SEQ ID NO: 59387 - protein, 546 aa, Phytophthora pseudosyringae
QELVGMLNTAKIPADVEVVVAPSQVHAATVKASLRADVRVSGQDVWKQGNGAFTGETSAEMLKDLGAEFTLVGHSERREKGETNEVVAKKAAYALEKGLGVIACIGETMEHREANQTVAYITEQLDAYAAEIKDWSDVVIAYEPIWAIGTGLTASPEQAQEVHASIRAWLKAKVSPEDAEKTRVIYGGSVGAKNAPELSQKEDIDGFLVGGASLKPDFLQIINAQNPTTNVGGAVNVAINGFGRIGRLVLRAAATNPLINVVAINDPFISTTYMEYMLEYDTVHGKFAGSLSHDEQNIYVNGKPIRVHNEMNPANIKWGEQQVQYVVESTGAFTAIETASAHMKNGVEKVVISAPSSDAPMFVMGVNHELYEKNMHVVSNASCTTNCLAPLAKVVNDKFGIKEGLMTTVHAVTATQKTVDGPSKKDWRGGRGACFNIIPSSTGAAKAVGKVIPSLNGKLTGMSFRVPTADVSVVDLTARLVNPASYDEIKAAIKSASENEMKGILGYTEKAVVSSDFIGDSHSSIFDASAGIALTDDFVKLVSWYD

SEQ ID NO: 59388 - protein, 324 aa, Ehrlichia canis str. Jake
MVKIIVIDKTGGTEVFKYVDHNIGEPKDDEVLIQHTVIGLNRYDLECRNGMRKTRKLPTVLGIEAVGVVERLGKDVEVFNVGDRVGYCTVSGGAYSEKRIVNQKYLVRIPDDVTDQVAAAVLFKGMTAHYLTHIVYAIRPKTFALVHGATGGVGQILCQWASYKGCKVIGVISSDDRANIALRSGCSYIVNCNSKNFVEQVMEITQGTGVNVVYDSVGALTSKESFASLGMFGIYVSYGQISGAVSNVSASMLSSRSLFFTAPSVFHYKRSSFDLAMTSMELFEVIRRNHIKVSINKIYKFDDIVTAHQDLENRKLTGSNIIVL

SEQ ID NO: 59389 - protein, 546 aa, Phytophthora kelmania
  misc_feature (83)..(83): Xaa can be any naturally occurring amino acid
  misc_feature (131)..(131): Xaa can be any naturally occurring amino acid
  misc_feature (319)..(319): Xaa can be any naturally occurring amino acid
  misc_feature (346)..(346): Xaa can be any naturally occurring amino acid
QELVGMLNTARIPADVEVVVAPSQVHAATVKASLRADVRVSGQDVWKQGNGAFTGETSAEMLKDLGAEYTLVGHSERREKGEXNEIVAKKAAYALEKGLAVIACIGESKETREANETVAYITEQLNAYAAXIKDWTNVVIAYEPIWAIGTGLTASPEQAQDVHASIRAWLKEKVSPEAAEKTRVIYGGSVGAKNAPELSQKEDIDGFLVGGASLKPDFLQIINAQNPTENVGGAVNVAINGFGRIGRLVLRAAAKNPLINIVAINDPFISTTYMEYMLEYDTVHGKFDGALSHDEQHIFVNGKPIRVFNEMNPSNIKWXEEQVQYVVESTGAFTTLEKASTHLQNXVEKVVISAPSSDAPMFVMGVNHELYEKNMHVVSNASCTTNCLAPLAKVVNDKFGIKEGLMTTVHAVTATQKTVDGPSKKDWRGGRGACFNIIPSSTGAAKAVGKVIPSLNGKLTGMSFRVPTADVSVVDLTARLVNPASYDEIKAAIKDASENEMKGILGYTEKAVVSSDFIGDSHSSIFDASAGIALTDDFVKLVSWYD

SEQ ID NO: 59390 - protein, 759 aa, Oryza sativa Japonica Group
MAEAATTTPLLTSHEAEPSIDDVIEAYIGATGARQLLKAMLLAFAWAFDAQQVFMSVFTDAEPPWHCTGVVDAAAAAAADSGSSCSPPAASASPCALPPGTWEWDRPAETSVVSDWALNCGPALVSLPASSFFAGNLAGGFLLATLADTHLGRRKMLLLSLVTMSVAAALTAFSPNVWVYSALRFVSGFGRSMVGTSAMVLSTELDGKRWRNTVSAAGFVFFSVGFVSLPALAYTFREASWRNMYVWTSLPSLCYAVLLYLLVQESPRWLLVRGRKQEAIEAVRQIASLNGGGGGITTSSFSMLDACAVELGDGGEGMFATLHSIWERRRALRRLAAITAASFGVGMVYYGMPLNVGSLSPSNLYLSVAYNAVAELPSSILAWLLMGRWFNRRGSVVALTTASGLCSLAACVPAVVLPDGARMAAEVASFFASCTAYDMMLMYTIELFPTSVRNSAVGLVRQAVALGGVVAPVLVALGRETTSYWSSSFGVFGLAVGCLGLLVTCLPETRGRRLSDTMEEEEAAVLSSSGASDMDNNGELADGGCGVGWEVAVWDAAATAWNAVVAAWDAETAAAWEVGCRGGGDCSVGCGGGGVEHRGGGGSGGGHVGCGGGGGMGRVGGGASAFVAASTPRLLLQAHLCAKNHPTLPPPPPSPQHPTPQPPHPEPLPPPPIPRRSRRLPCSPSEGERERDLSLHHLSSSGHDGGVWRSGVAARRSAVGRRRKGGGGGGQAETVAGGGDTGMAGSEDGGIRRWLPWIG

SEQ ID NO: 59391 - protein, 426 aa, Fulvimarina pelagi HTCC2506
MTAIIDIIGREILDSRGNPTVEVDVVLEDGSMGRAAVPSGASTGAYEAVELRDADERYMGKGVQKAVYAVNNEIAEEIVGMEAEDQLMVDAALSDLDGTDNKSRIGANAILGVSLAIAKAAAESAGLPLYRYVGGPSAHVLPVPMMNIINGGAHADNPIDFQEFMIMPVGAERFSDALRMGAETFHVLKKMLKDAGHNTNVGDEGGFAPSLGSPKEALDFIMKAVEKAGYKAGDDMFIALDCAATEFFKDGTYDLAGEGRKLSSDDMGGYLKELSDAYPIISIEDGLDEDDWDGWTKLTKTIGSKVQLVGDDLFVTNSRRLKKGIEMGAANSILVKVNQIGSLSETLDAVSVAHRAGYTAVMSHRSGETEDSTIADLAVATNCGQIKTGSLARSDRVAKYNQLLRIEEELGSQADYAGRSILRLGR

SEQ ID NO: 59392 - protein, 542 aa, Phytophthora capsici
  misc_feature (509)..(509): Xaa can be any naturally occurring amino acid
ELVGMLNTAKIPANVEVVVAPSQVHAATVKASLRSDVRVSGQDVWKQGNGAFTGETSAEMLKDLGAEYTLVGHSERREKGETNEVVAKKAAYALEKGLGVIACIGETKELREANQTVAYITEQLDAYAAEIKDWTNVVIAYEPIWAIGTGLTASPEQAQEVHASIRAWLKEKVSSDAAQKTRVIYGGSVGAKNAPELSQKEDIDGFLVGGASLKPDFLQIINAQNPTDNVGGAVNVAINGFGRIGRLVLRAAATNPLINIVAINDPFISTTYMEYMLEYDTVHGKFAGSLSHDEQHIFVNGKPIRVFNEMNPANIKWGEEQVQYVVESTGAFTTTEKASAHLQNGVEKVVISAPSSDAPMFVMGVNHELYEKNMHVVSNASCTTNCLAPLAKVVNDKFGIKEGLMTTVHAVTATQKTVDGPSKKDWRGGRGACFNIIPSSTGAAKAVGKVIPSLNGKLTGMSFRVPTADVSVVDLTARLVNPASYDEIKAAIKSASENEMKGILGYTEXAVVSSDFIGDSRSSIFDAEAGIALTDDFVKLVS

SEQ ID NO: 59393 - protein, 394 aa, Physcomitrella patens subsp. patens
MGAGTRAASVGQELFLYAVSAALSCLVLFVGLRHLDPNRAQIKKAQEQKKEIAKRLGRPLIQTNSYEDMIACDVINPEDIDVTFNSIGGLEYVKQSLHELVILPLQRPDLFSHGKLLRPQKGVLLFGPPGTGKTLLAKAIAKESSAVFINVRIANLMSKWFGDAQKLVTAVFTLAYKLQPSIIFIDEVDSFLGQRRVTEHEALTNMKTEFMALWDGFTTDQNARVMVLAATNRPWELDEAILRRLPRAFEVGMPDKSQRASILKVILKDEICENCLDIDQLASLTDGYSGSDLTELCKQAAYMPIRDLLDEERANGDGLGPRPLKQSDFLSVLSTARTSKTAAYEYQHNRRSAAGGAQTRSSGGSSDGREDTSVTDLVKLLAAFGAASSAANNR

SEQ ID NO: 59394 - protein, 354 aa, Glycine max
MALESQPQKNKYGHGVFGDVSSIIKEMEIDHPNSTFDFQFQFPPIAFQNFLGSREVREFISGALAGAMAKAILAPLETIRTRMVVGVGSKNIAGSFIDVIEQQGWQGLWAGNMINMLRIVPTQAIELGTFECVKRAMTSLHEKWEHNEYPKLQIGSINFNLSLSWISPVAIAGAAAGIASTVVCHPLEVLKDRLTVSPETYPNLGIAIRNIYKDGGVGAFYAGISPTLVGMLPYSTCFYFMYDTIKESYCRTKSKKSLSRPEMLLIGALAGFTASTISFPLEVARKRLMVGALQGKCPPNMAAALSEVIREEGLKGLYRGWGASCLKVMPSSGITWMFYEAWKDILLVQNGNPL

SEQ ID NO: 59395 - protein, 269 aa, Fulvimarina pelagi HTCC2506
MTTPLIAGNWKMNGTLRSLTELKGIADAIKDGRTEGTDVVVCPPATMLSASRGILHNAAKVGGQDCHAEASGAHTGDVAAEMLKDVGATYVIVGHSERRADHGESDEMVRAKVEAAWRAKLTAIVCIGESQEERDEGRTLDRLGEQLAGSLPDGATADNLVVAYEPIWAIGTGRTATSDDVAEAHGFIRKTLSERFGGDTGSAIRILYGGSVKPDNAFDLLHTENVDGALVGGASLKAEDFIAICEAAARPNGRDPFEPDFSDLEMGLE

SEQ ID NO: 59396 - protein, 361 aa, Thermobifida fusca YX
MPTTLAAVVRAPGEPVRIEEVALPELGPGLVRVRMAAAGVCHSDLSLASGKLAHPMPAVLGHEGVGHVVDVGAGVSDLSVGDTVLLNWNPPCRSCWHCTHGEPYLCANAADASRRVWGTLADGTDVHPCLGVAAFAQETVVPASACVAIPADIPPTEAALLGCAVLTGVGAVRNAAQVRPGQSVAVIGLGGVGLAAVQGARLAGAAMVIAVDPVEEKEELARSLGATHFLTPSDDLSRRIRALADGRGVDHAIECVGRAATIRAAWSCTRRGGTATVVGFGAATDTLTLNALEIPHFARTLQGCLYGSSDPATDVPELLKLYRDGELDLSSLVSRTIGLDDVPDALAELHAGRGARSLVEF

SEQ ID NO: 59397 - protein, 472 aa, Thermobifida fusca YX
MITTDRIYIDGQWIAPQTSDRMAVENPYTCQDIATIPLCGTEEVDHAVHAARRAFPAWSTTDLEERLAHLDALRRELAVRATEMSALITSEMGAPKVIADRIQVGLPLTVLGDTVATARDFAWTEKIGNSLILREPIGVVGAITPWNYPLHQIVAKIAPALAAGCTVVLKPSEIAPLSALLLAEIIDSVGFPPGVFNLVTGTGPVVGEALAAHPDVDMISFTGSTRAGSRVSEVASATVKKVALELGGKSAGVVLDDADLPTAVKAVVSDCLLNSGQTCTALTRLLVPHDRYEEAVALAVDAARSKPMGDPADPATRIGPLASADAHRRVLGHLEQARKDGAVFATGGPDADVPEQGYFVAPTVLAGLDRDAAAAREEIFGPVLTVLGYRDVDDAVELANATDYGLSGAVWSADTDRALAVARRMRTGQVAINGGRFNPSAPFGGYRKSGNGRELGRFGLEEFCEVKAVQLP

SEQ ID NO: 59398 - protein, 380 aa, Citrus x paradisi
MSGTAGQVIRCKAAVAWEAGKPLVIEEVEVAPPQKNEVRLKILFTSLCHTDVYFWEAKGQNPLFPRIFGHEAGGIVESVGEGVTDLQPGDHVLPVFTGECKECPHCHSEESNMCDLLRINTDRGVMINDGQSRFSIKGKPIYHFVGTSTFSEYTVTHVGCVAKINPLAPLDKVCVLSCGISTGFGATVNVAKPEEGPTVAIFGLGAVGLAAAEGARVSGASRIIGVDLNPSRFNEAKKFGVTEFVNPKDYDKPVQQVIAEMTNGGVDRSVECTGSVQAMISAFECVHDGWGVAVLVGVPHKDAVFKTHPMNLLNERTLKGTFFGNYKPRSDLPSVVEKYMSKELEVEKFITHTVPFSEINKAFEYMLRGEGLRCIIRMEE

SEQ ID NO: 59399 - protein, 75 aa, Glycine max
SGPICYQRNRAGAGMVAPFTVLKSMAGFPTRNTNNDITSIASIVGRVQCMHVCPPIVKKKFETLSYLSDLDYAQL

SEQ ID NO: 59400 - protein, 269 aa, Triticum aestivum
NPDTGADFGAAPDIDHLNPRVQKELVEWLNWLRTNVGFDGWRFDFTKGYSADVAKIYIDRSGASFAVAEIWTSLAYGGDGKPNLNQDPHRQELLVNWVNKVGGSGTGTTFDFTTKGILNVAVEGELWRLRGTDGKAPGMIGWWPAKAVTFVDNHDTGSMQHMWPFPSDSVMQGYAYILTHPGTPCIFYDHFFDWGMKDEIYRLVSIRTRQGIHSESKLQIMEADADLYLAEIDGKVIVKLGPRYDVGHLIPGGFKVAAHGKDYAVWEKI

SEQ ID NO: 59401 - protein, 563 aa, Oryza sativa Indica Group
MERENSWLRRTKFSHTVYTRLDHQRAPIAPLGRDVEQKLQRFISMGKSVSMPVNRDEDAAAAFKHSVSLPTARSLLQIDKEKANKQKADFDIPSSPPVNSVNSKGLKARSLVKSPSSAMLLSYLNKAHPNRDSNLKKTDRPQHKLRSKSPLPNVAPSDVFREARASSRRFTSPPPKRRGSERSIYGKSFDRQLSDMSQSPDLCSTPVSSDKHKSLKDSSWTRRYFDNGGRRRVSAVDATEVRRNRGVSMAQAVQTTVDWTLDPSKLLVGHKFASGAYSRLYKGLYDDKPVAIKFIRQPDDDDNGKMAAKLEKQYNSEVNALSHLYHKNVIKLVAAYKCPPVFYIITEFLPGGSLRSYLNSTEHHPIPLEKIISIALDVARGLEYIHSQGVVHRDIKPENILFDENFCVKIADFGIACEESMCDVLVEDEGTYRWMAPEMIKRKAYNRKVDVYSFGLLLWEMISGRIPFDDLTPLQAAYAVATRHARPVIPPECPMALRPLIEQCCSLQPEKRPDFWQIVKILEEFHSVLSQGGCLDSLKSSNSQDQKKRLLHWIQKLKPSHST

SEQ ID NO: 59402 - protein, 486 aa, Bordetella petrii
MTILDEAGARFGALGMLIDGEWLTRGAAGMQPVIDPATLRVLGELPLAAAGELDRAAQAAHDAFKTWSRTPAIERSRVLAQAAQLMRERAELIAHILTLEQGKPLAESRGEVTGAAEIFEWYAQESRRLYGRVIPARQAQTRQWVLHEPVGPVAAFTPWNFPALTPARKIAGALAAGCTCVIKPAEETPATALELARACMDAGLPAGVLNVVFGQPAEVSGHLIRAREIRKITFTGSTAVGKQLAALAALHGAKRCTMELGGLAPAIVFDDADIDEAVAVCAASRFRNAGQVCVAASRFYVQRQALGRFMEQFQAHVASLKVGNGLAADTRMGPLANARRLEAMPGFIDDAMQHGARVAAGGRRHAGAGYFWQPTILAGMPDAARAMSEETFGPIAPVAAFDTVDEVIGRANDVPYGLAAYAFTRSAATAMAVADGLQAGMVGINTPAISLAEAPFGGVKESGYGSEGGIEGLQAYLCTKFVAHRA

SEQ ID NO: 59403 - protein, 414 aa, Bartonella quintana str. Toulouse
MENNVQTLNYNVEKIRRDFPLLHRNIYGKRLAYLDSGASAQKPQSVLNAMNDCYRYSYANVHRGIYFLANAATQSYENARETVRAFLNAQLTKEIVFTKNATEAINTVAYGWAMSKLKEGDEIVLTIMEHHSNIIPWHFLRERKGVKLIFVPIDESGVLHIEDFEKALSDRTKLVAITHMSNVLGTVPPMKEVINLAHQNAIPVLVDGSQGVVHLTVDVQDLDCDWYVFTGHKLYGPTGVGVLYGKKHRLEEMHPFQGGGEMVESVTTDYVSYNVLPYRFEAGTPPIVEAIGLAAAIDYIKEKDQNTIYAHEMALLTYAHEKLKTVESLHIYGLSPNKGAILSFAIEGIHAHDIAMFVDRKGVAIRAGTHCAQPLLQRFGLTSICRASLAMYNTYEDIDQLVEALKEARIFFNG

SEQ ID NO: 59404 - protein, 521 aa, Zea mays
  misc_feature (475)..(475): Xaa can be any naturally occurring amino acid
MRIPRRKGGAGPLAVGVPSRRAQVAAVFALAALLGVSVLYDNAHIAASLRRHGGPRTYAKLSSFEGATAVPSIAKEEAAAAVARATESVPVHGADRADSPPHERQEEIEERASKPGATAGSSLQDAPLIEEVVQGGSGGHDGDGDGDGGAQAQEQPPAPGTCDLYKGRWVYDESRAPLYKESDCSFLTEQVTCMRNGRRDDDYQKWRWQPDGCDLPRFEAKLLLEKLRNKRLMFVGDSLNRNQWESMVCLVQSEAPWDKKSLVKNGSLNVFHLQEYNATVEFYWSPFLVESNSDDPDIHSISDRMIKPTSIAKHAANWEGVDYLIFNTYIWWMNTPQMKTLHGGSFSRKHVKYDEIERVEAYRKVLKTWSRWVEAHVDPKRTTVLFMSVSPVHMQGEGWGSPNAVKCFSETQPAISYNKKLEVGTDWDLFATAQRVTRSMKKVPVHFVNITALSEIRKDAHTSVHTLRQGKLLTXSRRRTRGSSRTASTGASPVCRTRGTSLFMAISCRAPRRRSSSSSRR

SEQ ID NO: 59405 - protein, 221 aa, Brassica napus
DDSSPFAREHTLHQISMKISFTCDACGLCSTGYPYICHQCCFIIHRSCIFLPRVICFCHHDHRISHVFSLGLGKFICGVCDEPVNVDCGAYSCLTCSSVFHSKCATDPMFWDEKELEGIPEEEESKPLEVIDQNLIIHFNHEHNLMKLSVSSLRHGEVILPHEEGKHCCACTLPLYSKLCCKCTQCDVILHDTCANLPRSKWFFLIYEKLTCPPKAETIFL

SEQ ID NO: 59406 - protein, 511 aa, Triticum aestivum
MEPTPLSACISLLCIALLCIALLCLLWHKSTKPPAGAPAPPRPPGPTPFLVIGNIPDLVRGGELHRALARLSVSYGPVMSMRLGMASLVVLSSPATAHEALHKKEGAVSSRWVPDSASVMGHSGISMVWLPSSSPLWKHLRTVASTLLFTSRRLGASRAIQERKARELVDHLHASSGRPVRVALPVFSAVLNMLSSVLFSEDVVELGSVTGQEFMELIADSVAETAKPNISDFFPFLSSLDLSRRRRAVAANLSRFYQFFDAVIDRRLNSAEKPGDLLESLLELPAKSQLERPVIRALLTDLFIAGSHTTTTTVEWAMAELLRNPTKMAKARAELREAFGSGNAEEGDLANLPYLQAVMKETMRLHPPAPLLLPHEVSETGVTLGGCSVPKGARVLINVWAIGRDPEVWAEPEVFMPERFLDREVDFRGRALEFIPFGSGRRACPGMPLAVTVVPMVLASLLHEFEWRLPDGMAPGDVDLSDRFGAALELAVPLRAVPVWTKGAEDLSFSS

SEQ ID NO: 59407 - protein, 378 aa, Oryza sativa Japonica Group
MGGDKENLDLSDLNASLPAAAAALSAEDRAGLVNALKDKLQSLAGQHTDVLEALSPNVRKRVEYLREIQGQHDEIELKFFEERAALEAKYQKLYEPLYTKRYNIVNGVVEVDGGNDEPASENAAEGKDADAKGVPDFWLTAMKTNEVLSEEIQERDEPALKYLKDIKWARIDDPKGFKLDFFFDTNPFFKNSVLTKTYHMVDEDEPILEKAIGTEIEWYPGKNLTQKILKKKPKKGSKNAKPITKTEVCESFFNFFSPPQVPDDDEDIDEDTADELQGQMEHDYDIGTTIRDKIIPHAVSWFTGEAVQAEDFDDMEDDEEDDEDDDEDEEEEEEDEDEDEDDEEEKSKPKKKSAGKPKLPSKGGAQGGADQPADCKQQ

SEQ ID NO: 59408 - protein, 141 aa, Neurospora crassa
MKGTKKEAIPITTMKAILRLVLNQANHPLLIHCNHGKHRTGCVVGIVRRTLGWDVSNILEEYRSYAEPKVRETDVNYIQGFEMAQISNLFSKDMNLQRWRFGSPKFAHSTVVAMIFLLFWYHFSGIPLPTSDAVDRKLLTQ

SEQ ID NO: 59409 - protein, 475 aa, Gibberella zeae PH-1
MGVPVKRVAVIGAGPAGAIAVDALAQEKTFDLIRVFERREGPGGCWIGDTTQPPTISNLEKLANRTADEQLPIPKQLPAILPKSTQPRHEESSIYPYLETNVDTSTMEYTQEPIPAIRSERSISMHGPSTPFRHWKVMRDYVAGILERNHYEDLVSYNTTVEHVEKEGDEWKVVLRKGGKKQDYWWTETFDAVVVASGHYWVPYVPAIEGLEQFEKTRPGSVVHSKHFRGRDSFHDKTVVVVGASVSAADIAVDLVSTAKAPVHCITIGHTSNVFFGDTAFDHPNIRQHPSIAKVTGRTVHLIDGTSIPDVDHIVFGTGYSWTLPFLPSLPVRNNRVPNLYQHVVYQKDPTLLFVGAVGAGLTFKIFEWQAVYAARILAGRGTVPSAEEMQKWEDDRIQERGDGPKFSVVFPDFEDYFDTVRELAGEGEPGVGRKLPKFRREWFRNFIEGTELRKGLWRRWNAIAREEVGVKARL

SEQ ID NO: 59410 - protein, 205 aa, Oryza sativa Japonica Group
MAAEAETKAMITLRSCEGQVFEVAEAVAMESQTIRHMIEDKCADTGIPLPNVSAKILSKVIEYCSKHVEARGGAAAAADGDAPAPAAVEANKAVEDELKTFDAEFVKVDQSTLFDLILWRIFIGILSLALHVFLPLTSVHCADQTWYRAANYLNIKGLLDLTCQTVADMIKGKTPEEIRKTFNIKNDFTPEEEEEVRRENQWAFE

SEQ ID NO: 59411 - protein, 257 aa, Listeria monocytogenes str. 4b F2365
MDSEKIDYLARLWIMEAAAKIKQSFKETLDIDVKSGRNDLVTNMDKETEAFFVQQIKDHFPDHRLFGEEGMASDVTDLDGVVWILDPIDGTLNFVEQQRDFAISLAVYEDGIGQLAYIYDVARDELYFGEKGKGATVNGRTIPKLDPAIDLKDTLLIANLSVTRKFPTMWEAVKASRGLRLHGAASLEYMDVATGRAGAYLSANLAPWDIAAGKIIVEELGGKVTRINGEKINMLEKGSSIVASPKIHQTLLDNYLP

SEQ ID NO: 59412 - protein, 629 aa, Solanum tuberosum
  misc_feature (403)..(403): Xaa can be any naturally occurring amino acid
  misc_feature (406)..(406): Xaa can be any naturally occurring amino acid
MVKVMEKDAVVVSLVVWLILVVHHLKLIYANMEGDALHSLRVNLQDPNNVLQSWDPTLVNPCTWFHVTCNNDNSVIRVDLGNAALSGLLVPQLGLLKNLQYLELYSNNISGLIPSDLGNLTNLVSLDLYLNNFVGPIPDSLGKLSKLRFLRLNNNSLTGNIPMSLTNISSLQVLDLSNNRLSGVVPDNGSFSLFTPISFANNLDLCGPVTGRPCPGSPPFSPPPPFVPPPPISAPGGNGATGAIAGGVAAGAALLFAAPAIAFAWWRRRKPQEYFFDVPAEEDPEVHLGQLKRFSLRELQVATDSFSNKNILGRGGFGKVYKGRLADGSLVAVKRLKEERTPGGELQFQTEVEMISMAVHRNLLRLRGFCMTPTERLLVYPYMANGSVASCLRERPPSEPPLXWPXRKRIALGSARGLSYLHDHCDPKIIHRDVKAANILLDEEFEAVVGDFGLAKLMDYKDTHVTTAVRGTIGHIAPEYLSTGKSSEKTDVFGYGIMLLELITGQRAFDLARLANDDDVMLLDWVKGLLKEKKLEMLVDPDLQNKYVEAEVEQLIQVALLCTQSNPMDRPKMSEVVRMLEGDGLAERWDEWQKVEVLRQEVELAPHPGSDWLVDSTENLHAVELSGPR

SEQ ID NO: 59413 - protein, 513 aa, Ashbya gossypii ATCC 10895
MAYVLTETAAGYALLKASDKKIYKSSSLVQDLKSSENVLKQFKVAAFSKFASAANALEEANSVIEGKVSSQLEKLLAEAKSDKKSTLVVSETKLANAINKLGLNFNVVCDAVTLDIYRAVKEYLPELLPGMTDGDLSKMSLGLAHSIGRHKLKFSADKVDVMIIQAIALLDDLDKELNTYAMRCKEWYGWHFPELAKIVTDSVAFARIILTMGVRSNAAETDMSEILPEEIEERVKSAAEVSMGTEITQVDLDNIKSLAEQIVEFAAYREQLSNYLSSRMKAIAPNLTQLVGELVGARLIAHAGSLVSLAKAPASTIQILGAEKALFRALKTKHDTPKYGLLYHASLVGQATGKNKGKIARVLAAKAAVSLRYDALAEDRDDSGDIGLEARAKVESRLSQLEGRDLRTTPKVSRDAKKIEISEARAYNADADAATAPADSTPADSDDEEEEEKKVKKDKKDKKRKREEDAEEEDSKKSKKEKKEKKEKKEKKEKKEKKEKKEKKEKKGKKEKK

SEQ ID NO: 59414 - protein, 546 aa, Phytophthora infestans
  misc_feature (131)..(131): Xaa can be any naturally occurring amino acid
  misc_feature (162)..(162): Xaa can be any naturally occurring amino acid
  misc_feature (319)..(319): Xaa can be any naturally occurring amino acid
  misc_feature (510)..(510): Xaa can be any naturally occurring amino acid
QELVGMLNTAKIPVNVEVVVAPSQVHAATVKASLRSDVRVSGQDVWKQGNGAFTGETSAEMLKDLGAEYTLVGHSERREKGETNEVVAKKAAYALEKGLGVIACIGETKDHREANQTVAYITEQLDAYAAXINDWTNVVIAYEPIWAIGTGLTASPEQAQEXHASIRAWLKEKVSPEAAEQTRVIYGGSVGAKNAPELSQKEDIDGFLVGGASLKPDFLQIINAQNPTANVGGAVNVAINGFGRIGRLVLRAAAKNPLINIVAINDPFVSTTYMEYMLEYDTVHGKFDGSLSHDETHIFVNGKPIRVFNEMNPENIKWXEEQVQYVVESTGAFTTLEKASTHLKNGVEKVVISAPSSDAPMFVMGVNHELYEKNMHVVSNASCTTNCLAPLAKVVNDKFGIKEGLMTTVHAVTATQKTVDGPSKKDWRGGRGACFNIIPSSTGAAKAVGKVIPSLNGKLTGMSFRVPTADVSVVDLTARLVNPASYDEIKAAIKSASENEMKGILGYTEXAVVSSDFIGDSHSSIFDAEAGIALTDDFVKLVSWYD

SEQ ID NO: 59415 - protein, 629 aa, Solanum tuberosum
MVKVMEKDAVVVSLVVWLILVVHHLKLIYANMEGDALHSLRVNLQDPNNVLQSWDPTLVNPCTWFHVTCNNDNSVIRVDLGNAALSGLLVPQLGLMKNLQYLELYSNNISGLIPSDLGNLTNLVSLDLYLNNFVGPIPDSLGKLSKLRFLRLNNNSLTGNIPMSLTNISSLQVLDLSNNRLSGVVPDNGSFSLFTPISFANNLDLCGPVTGRPCPGSPPFSPPPPFVPPPPISAPGGNGATGAIAGGVAAGAALLFAAPAIAFAWWRRRKPQEYFFDVPAEEDPEVHLGQLKRFSLRELQVATDSFSNKNILGRGGFGKVYKGRLADGSLVAVKRLKEERTPGGELQFQTEVEMISMAVHRNLLRLRGFCMTPTERLLVYPYMANGSVASCLRERPPSEPPLEWPKRKRIALGSARGLSYLHDHCDPKIIHRDVKAANILLDEEFEAVVGDFGLAKLMDYKDTHVTTAVRGTIGHIAPEYLSTGKSSEKTDVFGYGILLLELITGQRAFDLARLANDDDVMLLDWVKGLLKEKKLEMLVDPDLQNKYVEAEVEQLIQVALLCTQSNPMDRPKMSEVVRMLEGDGLAERWDEWQKVEVLRQEVELAPHPGSDWLVDSTENLHAVELSGPR

SEQ ID NO: 59416 - protein, 302 aa, Neurospora crassa
MTTSTVGLIDNWYPPTRENYDLILSLWKWFPVAASLQWGISWYGMGKTSVTSRLNLPGRIGWLTMEAPGFMTLVYMMRTLPAQHGFTLSDLPWQNKVLAGLFVFHYSYRALAFPFLQPSMAPIHIAIWLSALSFQIINGTLIGAWLAAYGPTSHAAWDRQLFSSFPTLQFTCGIALFYVGLMANFYHDDELREIRRRENRRQERLAKQNGQKGQPGKKVGKHYEIPKAGLFKVMLYPHYFCEWVEWLGFYMAAGWGCLPARCFLLNEVAAMLPRAVKGKQWYMEKFGEEKISKKWAVIPGGW

SEQ ID NO: 59417 - protein, 546 aa, Phytophthora infestans
  misc_feature (17)..(17): Xaa can be any naturally occurring amino acid
  misc_feature (31)..(31): Xaa can be any naturally occurring amino acid
  misc_feature (508)..(508): Xaa can be any naturally occurring amino acid
LVGMLNTAKIPVNVEVXVAPSQVHAATVKAXLRSDVRVSGQDVWKQGNGAFTGETSAEMLKDLGAEYTLVGHSERREKGETNEVVAKKAAYALEKGLGVIACIGETKDHREANQTVAYITEQLDAYAAGINDWTNVVIAYEPIWAIGTGLTASPEQAQEVHASIRAWLKEKVSPEAAEQTRVIYGGSVGAKNAPELSQKEDIDGFLVGGASLKPDFLQIINAQNPTANVGGAVNVAINGFGRIGRLVLRAAAKNPLINIVAINDPFVSTTYMEYMLEYDTVHGKFDGSLSHDETHIFVNGKPIRVFNEMNPENIKWSEEQVQYVVESTGAFTTLEKASTHLKNGVEKVVISAPSSDAPMFVMGVNHELYEKNMHVVSNASCTTNCLAPLAKVVNDKFGIKEGLMTTVHAVTATQKTVDGPSKKDWRGGRGACFNIIPSSTGAAKAVGKVIPSLNGKLTGMSFRVPTADVSVVDLTARLVNPASYDEIKAAIKSASENEMKGILGYTEXAVVSSDFIGDSHSSIFDAEAGIALTDDFVKLVSWYDNE

SEQ ID NO: 59418 - protein, 261 aa, Psidium guajava
NWGFFELVNHGIPPEMMDTIERMTKGHYKKCMEQRFRELVVSKGLEYVQKEVHDLDWESTFHLKHLPESNISQISDLDDDYRKVMKEFAVKLEKLAEQLLDLLCENLGLEKGYLKKAFYGSNGPTFGTKVSNYPPCPKPDLIKGLRAHTDAGGIILLFQDDKVSGLQLLKDGQWVDVPPMHHSIVVNLGDQLEVITNGKYKSVLHRVVAQTDGNRMSIASFYNPSTDAVIYPAPALVEREEEEAGKGTYPKFVFEDYMKLR

SEQ ID NO: 59419 - protein, 532 aa, Synechocystis sp. PCC 6803
MAEAPIAPVVLVILDGWGYRPDTRANAIAQANTPIMDSLIAAYPNTLVNTSGKDVGLPKGQMGNSEVGHLNLGAGRVVPQELVRISDAIEDGTFFDNQALIEVCQRVRDRRGKLHLIGLCSDGGVHSHIDHLLGLIDLAKLQGISQLCIHAITDGRDTPTNEGAHFVQQIQAHLEKIGLGRIVSVSGRYYALDRDRRWDRVEKAYRVMTEDGVGDGRSAAQVIKDYYASDITDEFIPPTRIGAGAIASGDGVIFYNFRPDRARQLCYALVNPSFDGFPRERIQPLDFVTFTQYDPALPVVVAFEPQNLNNILGEIISRQGMKQFRTAETEKYPHVTYFFNGGLEQPFAGEDRELIQSPMVSTYDKAPQMSAKAVTDAVCRAMEKGIYSLVVVNYANPDMVGHTGKLKEAIQAIETVDLNLGRLLASAAKVGGTVLITADHGNAEYMSDESGNPWTAHTTNPVPFILVEGEGRKIPGHGGEVKLREGGKLADIAPTILDILQLPVPAEMTGKTLIDQPLVEIKANRTPVNLSR

SEQ ID NO: 59420 - protein, 99 aa, Prochlorococcus marinus str. MIT 9312
MASYKVTLISEGEGLNSTIEVPDDQYILDAAEEQGIDLPYSCRAGACSTCAGKVTSGSVDQSDQSFLDDDQLEAGFVLTCVAYPTSDVTITTHAEEELY

SEQ ID NO: 59421 - protein, 416 aa, Methanococcoides burtonii DSM 6242
MAEQNPFENARKQLQKCADILELDEGIHDILKNPMREMHVSLPIRMDDGSIKVFQGFRVQYNDAKGPTKGGIRFHPDETVDTVKALAAWMTWKCAVMDIPLGGGKGGVICNPKEMSQSELERLSRKYISSISMIVGPDKDVPAPDVYTNPQMMAWMMDEFSKFAGKNQFGVITGKPLSVGGSLGRGDATARGGLYAVREAAAEIGLELKDATVAIQGYGNAGYFAGTLCEELFGCKVVAVSDSRGGAVNMNGISAEAAQEHKKATGSVVGLAGTEPISNEDILELDVDILIPAALEHVITHENADNIKAKIVAELANGPTTPEADEMLFQKGVHLIPDFLCNGGGVTVSYFEMVQNFYMYRWSIERVHNRLDAKMTNAYHAVLEASKQYNVNMRTAAYVVAVNRVVEAMADRGWLY

SEQ ID NO: 59422 - protein, 185 aa, Oryza sativa Japonica Group
VEEEEVVNGEEEVEEEAVDGEEGDGDEEGDGEEEGDDEEEDAEEGEKGAAGHTVVEISDEEDEEDGEEGDGGDDDDDDDDDDDDDDDDEEEEEEVEGDEQEELGTEYLVKPLGDAEDEEHSSDFEPDENGEGAEDEEIDEDDDGDDDSAKAQSSSKRKRSGGDDEDDDDDDDDGDDDDDGRPSKR

SEQ ID NO: 59423 - protein, 433 aa, Synechocystis sp. PCC 6803
MIYDIFMPALSSTMTEGKIVSWTKSPGDKVEKGETVLVVESDKADMDVESFNEGYLAAILVPAGEEAPVGATLGLVVETEAEIAEAQAKAGSGGGSSAAPTATPAPQQPEPVAIASATAIETTPAPSSNGNGKGSGRIIASPRAKKLAKELKVDLATIAGTGPHGRIVAADIESAAGKPVTASIAAPSAPAPKTSPAPTPRVTSTPSVPVGQTVPLTTFQKALVQNMVAAMAAPTFRVGYTITTDGLDQLYKQIKGKGVTMTALLAKAVALALKKHPIVNASYTDQGIIYHKDVNIALAVAMPDGGLITPVLQNADQVDIYSLSRRWKELVERARAKQLQPEEYSTGTFTISNLGMFGVDRFDAILPPGQGGILAVGASRPQVVANEEGLIGTKRQMAVNVTCDHRVIYGAHAAAFLKDLAVIIEENAQSLTM

SEQ ID NO: 59424 - protein, 199 aa, Citrus sinensis
TRVNVLFKHIQDMLSGDTAVIAETGDSWFNCQKLRLPENCGYEFQMQYGSIGWSVGATLGYAQAAKDKRVIACIGDGSFQVTAQEISTMIRCGQRSIIFLINNGGYTIEVEIHDGPYNVIKNWDYTGLVNAIHNGEGKCWTAKVRSEDELTEAMKTATGEQKDSLCFIEVFVHKDDTSKELLEWGSRVSAANSRPPNPQ

SEQ ID NO: 59425 - protein, 559 aa, Azoarcus sp. EbN1
MEVANNSKHSVFIAVTEPFTPPHRLSAWSTLENHAARLRTMRIAELFEHDAARFATLSFGHRGLLLDLSKQSIDAPALAALVDLAGQARLPDGIEALFAGEHLNFTEDRAVLHMALRGACAAPLEDAATLAQSQQRMRAFTVALRSGTMTGATGKPIRLVVNLGIGGSDLGPRMAAQALVPTGLRATPEVRFVANIDRRELDEALADADPASTLFVVSSKSFATAETLANAQAARAWLQAGLGAGCDPALHFTAVSNATDAAAAFGIPAERVFPLPEWVGGRYSVWSTIGLPLMIAIGASEFDAFLAGARAMDEHFRTAPPGENLPVLMGLAGLWNTDFLGIESLALLPYAHGLRSFAAWLQQLEMESNGKRCLRDGSGSVIHTSPIVWGGVGTVGQHAFHQLFYQGTRRVALDFIVPVAAADDVSQRSLVENAFAQSAALMSGRDLDTALASLRAKGLAESEAAVLAPHLVCPGNQPSTTVLLPALDAFSLGQLMALYEHKVFVQGWIWGINSFDQYGVELGKEMARSLSAGSGENHDASTAGLMAAAEAMRRTPDRS

SEQ ID NO: 59426 - protein, 240 aa, Bacillus cereus ATCC 14579
MRTPLSFDKDTAILLASCCELTYEQYKQNGIFEIPDGFQYVQGFQGKAIQTTEWFGFILESEDTIIVAFRGTQTDPDWIIDSLVNQKPYPYALNGGNVHNGFLSIYESCRDSIMDMLVSLPAHKKLLATGHSLGGALATLHILDARINTAFAQYGLYTFASPKVGDIAFRNYYKLQVASSFRFVNLFDVVPLLPPRNINFNDHDWEYAHVHHNMTFTKNTKSITNNHSITTYKTCLTSHF

SEQ ID NO: 59427 - protein, 469 aa, Methanococcoides burtonii DSM 6242
MRYVMKFGGTSIADGKKIRHVAQLLIGYKEGGDQVVAITSALGGVTDGILTNAAEASQKGKVSQVKEFMAELAKKHYDAISDAIDNERIADEVIETIDIRIDELEKALIGICYLGELTPRSIDYISSYGERLAVPIISGSIRSMGIDSKPFTGGEAGINTTENYGNARPLKKSYAQIKEVVGPLVENSIPVVTGFIAEDKNGIITTLGRGGSDFTASLIGAAIQADEIWLWKEVHGIMTTDPKIVPEASTISQISYIEAMELSYFGAKVLHPRAIEPAIIHGIPVRVKNTFDTQFPGTLIVADQNCSEEVAKAVTLIRNVAAINICGAGMVGAIGTAAKIFTTLANAGVNIIMISQSSSEANMSLVIEQSHLKRAIKSLEHAFNEGVVGEVAYDEDVCVVAVVGAGMDGSPGVAGKIFGALGKEKINVIMISQGSSQHNISFVVKEEDAEEAVKVLHREFGLGKKNGCN

SEQ ID NO: 59428 - protein, 376 aa, Bacillus cereus ATCC 14579
MAQKQKCVAMLLAGGKGSRLSALTKNLAKPAVPFGGKYRIIDFTLSNCANSGIETVGILTQYQPLELHNYIGIGNAWDLDRVSGGVTVLPPYAESSGVKWYTGTASAIYQNLNYLSQYEPEYVLILSGDHIYKMDYSKMLDYHIEKESDVSISVIEVPWDEASRFGIMNTNEEMEIVEFEEKPQFPRSNLASMGIYIFNWSILKEYLEMDARNPESSNDFGKDVLPLLLDEGKKLMAYPFEGYWKDVGTVKSLWEANMDLLRDETSLNLNDRNWRIYSVNPNEPPQYIAEKAKVEESLINEGCVIEGDVKHSVLFQGVTVEEGSMVIDSVVMPGAKIGKNVVIERAIVGSEMVIEDGTIIRPEKNVDDVVLIAEGK

SEQ ID NO: 59429 - protein, 1407 aa, Bacillus cereus ATCC 14579
MKKKNRFVTGIVTAGVLFSTAIPFNVLAESPINQIESSNAHSILSKLSKEQRLALQTVDANPGFTISPDINTSSSEPVNIIVEFQTAPVKINELKQKEKGLQSAPENIKARIDQEHEEFEKGLKRLYQFSPSVKSGNFQSVQIKRSYKHAINGVAMTLPANTVEELLRIGVVKRIWKDYEVKLNLPKQAEQKAPQKLTDSIPQIGVDKLHSEGITGKGIKVGVLDTGIDYNHPDLKDVYKGYRAKPGEDSSKVDPNSVKGWDFINNDADPMETTYSEWQQSGAPEFDNRGSSFYTAHGTHVAGIVSAQKKNQSDSAVKGVAPDIELYNYRVLGPYGSGDSSGIIAAIDKSISDGMNVINLSLGDDSNNPLDPTSIAVNNAMLSGVVTVVAAGNSGPNPSTLGSPGASPFAITVGASDSSISLPKLSGHAGQLQFPNLILFGKNFTDKIEDFKGQTLPIEYVGIGTPDEFSKKDVKGKIALVARGTLSFDEKIANAKQAGAKAVIIYNNVDGEIPFYVGESTKYIPAFRLTKEEGEKLKAQIEQGSTSLTLDEINYIQTEGDHLADFSSRGPVTANDDIKPDITAPGVAILSTVPEYINDPQEGENYAVSYERMQGTSMASPHIAGVAALILQEHPDYSPFDVKASLMNTANDLKEKYSVYEVGAGRVDAYNAVRTETSFKVLDTTQTVVNDEVIEVPEETGSIAFGKFYQKDGEALEQKRNIKVTNHNKQEKKEFKTEISYTPASSTINDAVANGVKISAPETITLDAGKTGEIKAKINVPAGVKQGRYEGYIHITNTKNKEETYQIPFSIRVSEPGIENAILSRKAISTDTSKFNPYGESYVHGAFQLNSELETLDLIVKDSKTNKALGFIGTLNTSGLKTDVYYYLDSFFNGKVYPFTNDPAKPIGDEKINLPEGDYTIEFVGYDKAGKARVKGDYVVIDNTPPEVKLTGLKPGIYELNEENYTVEDGKKALWIKGNVYDSNVDYLKGKGLNITQEANGVMYYDYSPYLHKFLPINANGDFKVGITPDSFRTEGPMNTGVYIFDYATAGPDYPNGVNNYWFIPQGAQYAKTSYDKKELYKNDEFTVTLNAKHVKQFVAGQFNVNFLEKNFKFANAKFNPAFEKLLSQKGVTAKVNEPKLEAGSVTVGGAIDDKNFAGLDGDFPFIDVTFKVENDEFYEANAQLESPIFVYWKQGESEPNRMRVLQDQTFSVMSLNSLVEGNIKPGAFLNERGYLDEKFDYTKLDVKVYATDSYRHKFEGSLDKYGYFKLNGLPVNKRDYNLYVEVPGHLTSRLTTKLGTEKDGKLLGQYYYAKPDENLAGDVNGDKVIDIKDAEIIASNYRKKGLTVKDGDLNKDGIVDEKDIRFVEKNFLKKGPDASKSQTPVEKSKSGTLADILKKLGLTPKK

SEQ ID NO: 59430 - protein, 673 aa, Rhodopseudomonas palustris CGA009
MRAVPWGGVEMTQVVYGVWDGVAYDSRAAEARAADYALANFDEFDEGNAIRAFIADRGFFVFDPTVSLVDALFHYLKAAAEQSCGACTPCRIGTVLVRDALDQMRRGLDAALTLDDIVMLGEQIRQTSLCGLGQTCAVALLAVLRDFRERIEQELAQHRPIPAQHGMAYVTAPCIEACPSKVNVPRYIDYIRDGKPENSLGVLLQKYPMAATCGRVCVRYCEQACRRKFVDEAVGIKTLKRYVADQQSGPHALKFTRDMIRKPLADGMRVAVVGAGPAGISCAYHLLLRGYHVDVFDKAGQAGGMAQIGIPSYRLPKDTLALETDIIVDLGGRFLFDQRLGRDFSVDDLFARGYRAVFLGLGCQQGARLGVDGEDAAHGGYFSGIDFLLKVHDHVDGIAPLVLQGEVVVVGGGNVAMDCVRSAIRLGAEKVHVVYRRTLADMPADPAEIEAARAEGVEFHVLTAPAEIVTDHGKVTGVVLTRMQASEPDAGGRRSVKPVPGSETSMRCDVLIAAIGQQVEDGPLIESDGIAFDRWRCVATDRVLATSRPGVFAGGDCVTGPSTLVYAMAAGLKAARNIDDWIQRGSVRFFKRSRMRKLIADNHMLANEIVAAPVRNAYRVHNPEIDPELRKHMFGEVEQTIDARAAYAETQRCMRCYRVYSVVTKHPIPEGAA

SEQ ID NO: 59431 - protein, 153 aa, Campylobacter coli RM2228
MENNLQVNIFHIQKNDEFKIWGEKYAKLISKFADLKEHNLFNKKIAAAQNLNAQAAKLSYEEAFAPYTKGFCIVLDERGKELTSVEFAKLIADKNNLNFFIGGAYGLRDEFSQSLDFRLSLSKLTLAHQFVKILLLEQIYRAFCINSNHPYHK

SEQ ID NO: 59432 - protein, 178 aa, Sonneratia alba
LSSATMAVNRTAPAQASMVAPFTGLKSSSAFPTTRKTADITSLASNGGRVQCMQVWPPEGLKKFETLSYLPDLTREQLIKEIEYLIRNGWFPCLEFSCPAFAYPYRENHRSPGYYDGRYWTMWKLPMYGCTDPIQVIKELDEGIKAYPTYFFRIAGFSARRQVQCISFIAYKPPLLSM

SEQ ID NO: 59433 - protein, 564 aa, Oryza sativa Japonica Group
MEGADEERPLIHHLPPQEQCSQYTCDGTVDIDRRPALKHSTGNWRACFFILGAEFTQCLCFSAVVKNLVRYLTSVLQESNVNAARSVSTWIGTCFFTPLIGAFLADTFWGRYRTIVICLSVYSIGMLILTTSASLPFLLHDSYNNGDDIRRVVAYLGLYLIALGAGGIKPCMSALGADQFDGADPVERVTKGSFFNYYYFSNNMGTLLSTTVLVWVQDNIGWGIGFATPMLLMGFGLSMFVAGRRVYRYRKLGRSPLTRVSQVVVAAARNHRLKLPDDSSLLHELPSLTEGGYRIQHTTRFRFLDKAAIPSDSDDNSPVQPDPWRLCTVSQVEELKMLLRVFPVWASLLVFFVVTAQMSSTLIEQSAAMDGRVGPFTVPPASLATFNVVAVLIWVPVYDAVLVPLARRATGNDRGLSHLQRIGVGLALSAVAMAYSAQVERRRRRPAAEEEAMSIMWQAPCYLVLGMAEVFTSIGMLEFFYERSPGSMKSLGTSLAHLAVATANYLNSGVLGVVVAATTRGGGAGWIPDNLDEGHLDYFFWMMALVSVLNLLQFLHCSIRDRGQ

SEQ ID NO: 59434 - protein, 347 aa, Methanocaldococcus jannaschii DSM 2661
MMKVCVIEGDGIGKEVIPEAIKILNELGEFEIIKGEAGLECLKKYGNALPEDTIEKAKEADIILFGAITSPKPGEVQNYKSPIITLRKMFHLYANVRPINNFGIGQLIGKIADYEFLNAKNIDIVIIRENTEDLYVGRERLENDTAIAERVITRKGSERIIRFAFEYAIKNNRKKVSCIHKANVLRITDGLFLEVFNEIKKHYNIEADDYLVDSTAMNLIKHPEKFDVIVTTNMFGDILSDEASALIGGLGLAPSANIGDDKALFEPVHGSAPDIAGKGIANPMASILSIAMLFDYIGEKEKGDLIREAVKYCLINKKVTPDLGGDLKTKDVGDEILNYIRKKLKGY

SEQ ID NO: 59435 - protein, 723 aa, Vibrio parahaemolyticus RIMD 2210633
MIYQADTLQVKEIQDGIAELSFCSPKSVNKLDLATLESLDKALDALTSHQGLKGLMLTSDKDAFIVGADITEFLGLFAKTDAELDQWLQFANSIFNKLEDLPVPTISVLKGHTLGGGCECVLATDMRIGDKTTSIGLPETKLGIMPGFGGCVRLPRVIGADSAMEIITQGKACRADEALKIGLLDAVVETDALYESALQTLTSAINEKIDWQARRKQKTSPLTLSKLESMMSFTMAKGLVAQVAGPHYPAPMTAVITIEEGARFARNEALDIERKYFVKLAKSEEAKALVGLFLNDQYIKGIAKKAAKSASKDTERAAVLGAGIMGGGIAYQSALKGVPVLMKDIAQPSLDLGMTEASKLLNKRLAQGRIDGFKMAGILASITPSLHYAGIENSDVIVEAVVENPKVKATVLSEVESHVGEDTVITSNTSTIPINLLAQSLKRPENFCGMHFFNPVHRMPLVEIIRGEKTSDETINRVVAYAAKMGKSPIVVNDCPGFFVNRVLFPYFGGFSMLLRDGADFTKVDKVMERKFGWPMGPAYLLDVVGIDTAHHAQAVMAEGFPERMGKQGRDAIDALFEANKYGQKNGNGFYSYTIDKKGKPKKTFTEDILPVLADVCADKQEFDEQTIIQRMMIPMINEVVLCLQEGIIATPQEADMALVYGLGFPPFRGGVFRYLDSVGIAEFVEMAKQHADLGAMYHVPQMLIDMAAKGESFYGAQQQGSI

SEQ ID NO: 59436 - protein, 58 aa, Zea mays
MTTSRRLADRKIARFEKNITKRGSVPETVKKANDYPVGPILLGFFVFVVVGSCKSLCF

SEQ ID NO: 59437 - protein, 178 aa, Sonneratia apetala
LSSATMAVNRTAPAQASMVAPFTGLKSSSAFPTTRKTADITSLASNGGRVQCMQVWPPEGLKKFETLSYLPDLSREQLIKEIEYLIRNGWFPCLEFSCPAFAYPYRENHRSPGYYDGRYWTMWKLPMFGCTDPIQVIKELDEGIKAYPTYFFRIAGFSARRQVQCISFIAYKPPLLSM

SEQ ID NO: 59438 - protein, 377 aa, Gibberella zeae PH-1
MPVGTVLVTGGTGYIGSFTSLTLLEHGYDVVIVDSLYNSSEVALDRIELICGRRPAFYKLDITDEKAIDEVFAKHPAIDSVIHFAALKASRISAVGESGEIPLEYYRVNVGGSISLLRSMERNNVNNIVFSSSATVYGDATRFPNMIPIPEHCPIGPTNTYGRTKSMIEDVITDFVNAQRNNLEKAGKEYKQWNGALLRYFNPCGAHPTGIMGEDPQGIPFNLLPLLGQVATGEREKLLVFGDDYSSRDGTAIRDYIHVVDLARGHLMALNYLRENQPGVKAWNLGSGRGSTVFEIINAFSKVVGRDLAYEVRPRRQGDVLDLTANPTLANKELNWKTELTMEEACNDLWRWVENNPKGYRQDPPAKLLEAVKSSKA

SEQ ID NO: 59439 - protein, 276 aa, Bartonella quintana str. Toulouse
MIDYIDYNKIPLKFNGQIRIFDDHAFAKMREVGRIAAECLDALTDIIKPGVTTQEIDDFVFTFGAERGALPADLNYHGYSHSCCTSINHVVCHGIPNKRPLQEGDIVNVDVTFILDSWHGDSSRMYPVGKIRRAAERLLKITYESLMKGIAIVKPGATTGDIGAAIQRYAESERCSIVRDFCGHGIGQLFHDAPNILHYGNPGEGIELKQGMMFTIEPMINLGKPQVKILSDGWTAVTRDRSLTAQYEHTIGVTNDGCEIFTQSPKNIFYIPNSHA

SEQ ID NO: 59440 - protein, 509 aa, Zea mays
MGLNNSTYSIPNLPVVCIMGGPNSDDYDSNYALHHTIGLPDFSQELWCFQMVTCYQAFIHNLDDAHERIGTSIATMLRVRGMRVADTRTRAGLGRRARLASAAAVLNACDPDEAAIEAGLQSALPEPPSEQDAVIVLNMAIATRPEIVVLARRWFLGNAEVQKKVILYNVELKLLRKKQHWCETEAPWAKMLRHGMQPDNTIFSTINSCACAYGLLSKVVKWFDKMSGFGCSPDWLTYSAVIDTYDHTGNFEAALRRARAEKWQLDPVLCCTVNEVHSTSGNFNRALNLFKEMKATGVNPNLVMCNTRLYVMGHALQPWVVKSIHREMIDKQVQHNKVTYCCLLHAYTRAHYDEDAMAVYRLMKDEAMDVMLYNMLLSRYVDIGYVDEAEEIFRDMKASMDDRSKPDKWSYSSMLRQYSSTANVLGVEGILNEMVEELGKVISCVETDNHQLGSIVKPLVHDLADLAGLAHSGGFKQPWPPPMEFECLDCAWFPATWRSWSAAWGQAAF

SEQ ID NO: 59441 - protein, 359 aa, Salmonella typhimurium
MSKNYHIAVLPGDGIGPEVMAQALKVMDAVRVLICVYHSHYDVGGIAIDSSGIPLPKATVEGCEQADAILFGSVGGPKMGKFAPGKPAGARRLLPLRKHFKLFSNLRPAKLYQGLEAFCPLRADIAANGFDILCVRELTGGIYFGQPKGREGSGQYEKAFDTEVYHRFEIERIARIAFESARKRRCKVTSIDKANVLQSSILWREIVNDVAKTYPDVELAHMYIDNATMQLIKDPSQFDVLLCSNLFGDILSDECAMITGSMGMLPSASLNEQGFGLYEPAGGSAPDIAGKNIANPIAQILSLALLLRTADANDAATAIEQAINRALEEGVRTGDLARGAAVSTDEMGDIIARYVAEGV

SEQ ID NO: 59442 - protein, 329 aa, Gibberella zeae PH-1
MAPVPSTMKAVQINKNGGVEVLEHNDVPVPKVGEGQILVRNQIAGLNFIDTYFRSGLYKAPQFPLTLGREAAGTIVDIHSSVKGFENGSRVVFMGTVGAYAQYSVVNASDAVKIPDDVPTEQAVAAYLQGLTAWTFIREAGQVKEGQWVLVHAASGGVGTLLVQLLRTVGAKIIGTASTDEKLELAKKNGAEWVISSHDDVVAKVKEITGGHGADVIFDGVGKVTFDADLELIAPKGTLISFGNASGAVDPVSLFRLTPKNVRLMRPVVNGYVAQRADLEKYTSELFDLIKSKKLELTIHKVYPLADVAKAHEDIESRKTIGKLLIKVD

SEQ ID NO: 59443 - protein, 546 aa, Phytophthora porri
QELVGMLNTAKIPANVEVVVAPSQVHAATVKSALRADVRVSGQDVWQQGNGAFTGETSAEMLKDLGAEYTLVGHSERREKGETNEVVAKKAAYALEKGLAVIACIGESKETREANKTVAYITEQLDAYAAEIKDWTNVVIAYEPIWAIGTGLTASPEQAQDVHASIRAWLKEKVSSDAAEKTRVIYGGSVGAMNAPELSQKEDIDGFLVGGASLKPDFLHIINAQNPTENVGGPVNVAINGFGRIGRLVLRAAAKNPFINIVAINDPFISTTYMEYMLEYDTVHGTFDGSLSHDEKHIFVNGKPVRVFNEMNPANIKWGEEQVQYVVESTGAFTTLEKASAHLQNGVEKVVISAPSSDAPMFVMGVNHELYKKNMHVVSNASCTTNCLAPLAKVVNDKFGIKEGLMTTVHAVTATQKTVDGPSNKDWRGGRGACFNIIPSSTGAAKAVGKVIPSLNGKLTGMSFRVPTADVSVVDLTARLVNPASYDEIKAAIKDASENEMKGILGYTEKAVVSSDFIGDSRSSIFDASAGIALTDDFVKLVSWYD

SEQ ID NO: 59444 - protein, 438 aa, Magnaporthe grisea 70-15
MAITKIHARSVYDSRGNPTVEVDVVTDTGLNRAIVPSGASTGQHEACELRDGDKSKWGGKGVTKAVENVNNIIGPALIKENIDVKDQSKVDEFLIQLDGTPNKTKLGANAILGVSLAVAKAGAAAKGVPLFAHVSDLAGTKKPYVLPVPFMNVLNGGSHAGGRLAFQEFMIVPSAAPSFTEAMRQGAEVYQQLKGLAKKKYGQSAGNVGDEGGVAPDIQSAEEALELITAAIEAAGYTGKMNIAMDVASTEFYKEDEKKYDLDFKNPDSDKSKWITYEELAAMYSDLCKKYPIVSIEDPFAEDDWEAWSYFYKTQDIQIVADDLTVTNPLRIKKAIDQKAANALLLKVNQIGTLTESIQAAKDSFADGWGVMVSHRSGETEDVTIADIAVGLRAGQIKTGAPARSERLAKLNQILRIEEELGSNAVFAGESFRKAINM

SEQ ID NO: 59445 - protein, 230 aa, Ashbya gossypii ATCC 10895
MPAPDPARRDVLISKSLSYLLRHGALKEQLPIDSDGYVPVSAVLAHNRLKSHRCSFSDLQRIVENNEKKRFHMRPGPDGQEYICATQGHTIEQVLPSADVLTQLIDPGELPAQLIHGTNLRNAVLILDSGCIKRMQRNHVHLSHGVTGKDCVISGMRLSSTVHIYLNTEGILDHLRLYKSRNDVYLTPSDIPVSMFKKVVVRTSRNTKADDVTTLTQRLEQLDVPFEISD

SEQ ID NO: 59446 - protein, 167 aa, Triticum aestivum
  misc_feature (133)..(133): Xaa can be any naturally occurring amino acid
MEKEKANWDAHHITIFYEICKDEVDAGNRPKGCLNRRGYTHLEDKFFDRTRKRCSQNQFKNKRDMLKRQYVQFMLLKNAATGLGWDDVNKTIIADDDWWKIHLKKNPKHAKYKKKGLANLEEIHVMFANAHVXGATSSIPGEMSDNTNDDDMPDVGEESEEDGNALK

SEQ ID NO: 59447 - protein, 425 aa, Porphyromonas gingivalis W83
MEIAKIIGREILDSRGNPTVEVDVHLACGIIGRAAVPSGASTGENEAIELRDQDKARYCGKGVLKAVKNVNEVIDPALCGMSVLEQTAIDRKLIELDGTKTKSNLGANAMLGVSLAVAKAAAAYLDIPLYRYIGGSNTYVLPVPMMNIINGGSHSDAPIAFQEFMIRPVGACCFREGLRMGAEVFHALKKVLHDRGLSTAVGDEGGFAPALNGTEDAIESILKAVEAAGYVPGKDITIAMDCASSEFFKDGIYDYTKFEGEKGKKRSIDEQVAYLTELVGKYPIDSIEDGMSENDWEGWKKLTVALGDKVQLVGDDLFVTNVEFLRRGIAEKCGNSILIKVNQIGTLTETLNAIEMAHRHGFTSVTSHRSGETEDTTIADIAVATNSGQIKTGSLSRTDRMAKYNQLLRIEEELGPCAVYGYKKV

SEQ ID NO: 59448 - protein, 226 aa, Methanocaldococcus jannaschii DSM 2661
MSNEDLKLKVAKEAVKLVKDGMVIGLGTGSTAALFIRELGNRIREEELTVFGIPTSFEAKMLAMQYEIPLVTLDEYDVDIAFDGADEVEETTLFLIKGGGGCHTQEKIVDYNANEFVVLVDESKLVKKLGEKFPIPVEVIPSAYRVVIRALSEMGGEAVIRLGDRKRGPVITDNGNMIIDVFMNIDDAIELEKEINNIPGVVENGIFTKVDKVLVGTKKGVKTLKK

SEQ ID NO: 59449 - protein, 547 aa, Phytophthora uliginosa
AQELVGMLNTAKIPANVEVVVAPSQVHAATVKAALRPDVRVSGQDVWKQGNGAFTGETSAEMLKDLGAEYTLVGHSERREKGETNEVVAKKAAYALEKGLGVIACIGETKELREANQTVAYITEQLDAYAAEINDWTNVVIAYEPIWAIGTGLTASPDQAQEVHASIRAWLKEKVSPEAAEKTRVIYGGSVGAKNAPELSQKADIDGFLVGGASLKPDFLQIINAQDPTTNVGGAVNVAINGFGRIGRLVLRAAAKNPLINVVAINDPFISTTYMEYMLEYDTVHGKFDGTLSHDEQHIFVDGKPIRVFNEMNPANIKWGEEQVRYVVESTGAFTTTEKASAHLQNGVEKVVISAPSSDAPMFVMGVNHELYEKNMHVVSNASCTTNCLAPLAKVVNDKFGIKEGLMTTVHAVTATQKTVDGPSKKDWRGGRGACFNIIPSSTGAAKAVGKVIPSLNGKLTGMSFRVPTADVSVVDLTARLVNPASYDEIKAAIKSASENEMKGILGYTEKAVVSSDFIGDSHSSIFDASAGIALTDDFVKLVSWYD

SEQ ID NO: 59450 - protein, 139 aa, Flavobacteria bacterium BBFL7
MATNRTFTMIKPDGVENGHIGAILEKITASGFRIVALKKTQMTKADAESFYAVHNERPFFGELVEFMTRGPIVAAILEKENAVVDFRTLIGATNPADAAEGTIRQLYATSMGENAVHGSDSDENAAIEGAFHFSGREMF

SEQ ID NO: 59451 - protein, 167 aa, Oryza sativa Japonica Group
MEDLQGWSGHRRFIRVMPNTPSAVGQAASVMCLGEMATENDENRVRSLFSAIGKVWTAEEKYFDAVTGLSGSGPAYIFLAIEAMADGGVAAGLPRDLALGLASQTVLGAATMVNKTGKHPGQLKDMVTSPAGTTITGIQELEKGAFRGTLINAVVAATKRCRELSQS

SEQ ID NO: 59452 - protein, 554 aa, Suaeda corniculata
MLSQLSSFFASKMDMVSTSDHSSVVSMNLFVALLCGCIVIGHLLEKNRWMNESITALLIGLSTGIIILLISGGKSSHLLVFSEDLFFIYLLPPIIFNAGFQVKKKQFFRNFITIILFGAVGTLVSFIIISLGSIAIFQKMDIGSLELGDLLAIGAIFAATDSVCTLQVLNQDETPLLYSLVFGEGVVNDATSVVLFNAIQNFDLTHIDHRIAFQFGGNFLYLFFASTLLGAVTGLLSAYVIKKLYFGRHSTDREVALMMLMAYLSYMLAELFYLSGILTVFFCGIVMSHYTWHNVTESSRVTTKHAFATLSFVAEIFIFLYVGMDALDIEKWRFVSDSPGTSVAVSSILLGLLMVGRAAFVFPLSFLMNLSKKSNSEKVTFNQQIVIWWAGLMRGAVSVALAYNQFSRSGHTQLRGNAIMITSTITVVLFSTMVFGLLAKPLILFMLPQPKHFTSASTVSDLGSPKSFSLPLLEDRQDSEADLGNDDKEAYPRGTIARPTSLRMLLNAPTHTVHHYWRRFDDYFMRPVFGGPGFVPFVPGSPTEQSTANLTQRT

SEQ ID NO: 59453 - protein, 546 aa, Phytophthora melonis
QELVGMLNTAKIPANVEVVVAPSQVHAATVKAALRPDVRVSGQDVWKQGNGAFTGETSAEMLKDLGAEYTLVGHSERREKGETNEVVAKKAAYALEKGLAVIACIGETKELREANQTVAFITEQLDAYAAEIKDWTNVVIAYEPIWAIGTGLTASPDQAQEVHASIRAWLKEKVSPEAAEKTRIIYGGSVGAKNAPELSQKADIDGFLVGGASLKPDFLQIINAQNPTDNVGGAVNVAINGFGRIGRLVLRAAAKNPLINIVAINDPFISTTYMEYMLEYDTVHGKFDGTLSHDEQHIFVNGKPIRVFNEMNPANIKWGEEQVQYVVESTGAFTTTEKASAHLQNGVEKVVISAPSSDAPMFVMGVNHELYEKNMHVVSNASCTTNCLAPLAKVVHDKFGIKEGLMTTVHAVTATQKTVDGPSKKDWRGGRGACFNIIPSSTGAAKAVGKVIPDLNGKLTGMSFRVPTADVSVVDLTARLVNPASYDEIKAAIKSASENEMKGILGYTEKAVVSSDFIGDSHSSIFDASAGIALTDDFVKLVSWYD

SEQ ID NO: 59454 - protein, 773 aa, Oryza sativa Japonica Group
MVSAADAVIPACAAVGIAFAVWQWLLVSRVKVSPYSAAAAAARNGGAGRAVFRPEGEVDDDDGGCGDDEEADGDGGVAAMARCAEIQSAIRVGANSFLFTQYKYLAAFTAVFAVVIFLFLGSVHRFSTESQPCQYTRGKACKPALANAVFSTIAFLLGAATSVASGFLGMRIATAANARTTVEARRGIGPAFAAAFRSGAVMGFLLASLGLLVLYVAIKVFGLYYGDDWEGLYESITGYGLGGSSMALFGRVGGGIYTKAADVGADLVGKVERNIPEDDPRNPAVIADNVGDNVGDIAGMGSDLFGSYAESTCAALFVGSISSFGADHNFAAVSYPLLISSAGLIVCLITTLFATDLYRVKTVDGVAPALKLQLLISTVLMTVGVLVVTFTALPHEFTMFDFGEVKRVKNWHLFFCVTIGLWAGLAIGFTTEYFTSNAYSPVRDVADSCRTGAATNVIFGLALGYKSVIVPVFAIAVSIYVSFTLASIYGIAVAALGMLSTVATGLAIDAYGPISDNAGGIAEMAGMSHRIRQRTDALDAAGNTTAAIGKGFAIGSAALVSLALFGAFVSRAGMAVINVLSPKVFVGLVVGAMLPYWFSAMTMKSVGSAALKMVEEVRRQFAAIPGLMEGRATPDYASCVRISTDASLREMMPPGALVLLAPLVAGTFFGVQTLAGLLAGALVSGVQVAISASNSGGAWDNAKKYIEAGASDHAKALGPKGSDAHKAAVIGDTIGDPLKDTSGPSLNILIKLMAVESLVFAPFFAAHGGLIFK

SEQ ID NO: 59455 - protein, 309 aa, Prochlorococcus marinus str. MIT 9312
MTATISRPTISNWETSDIPNLNGKTALITGANSGLGYYTAKALAEKNAHVILACRSLEKANKSIQKLRASNPEGIFSPLELDLSDLNNVVEIQPKIFDDFENLDLLINNAGIMHPPKTLSAQGYEIQFAVNHLAHMLLTLKLLPIIEKKEESRIVTVTSGAQFFGKVGWKNLKAENYYNKWESYSNSKLANVMFALELNENLKPKNILSLAAHPGIAKTNLFTAQKPKPSPIETFSMELFSPIFQSAEMGALPQLFAATSPEARGGDHYGPKFNFRGYPKLSPTSPVAINKKERKNLWEKSLQILSNFL

SEQ ID NO: 59456 - protein, 414 aa, Phytophthora capsici
  misc_feature (48)..(48): Xaa can be any naturally occurring amino acid
QDWTNVVIAYEPIWAIGTGLTASPEQAQEVHASIRAWLKEKVSSDAAXKTRVIYGGSVGAKNAPELSQKEDIDGFLVGGASLKPDFLQIINAQNPTDNVGGAVNVAINGFGRIGRLVLRAAATNPLINIVAINDPFISTTYMEYMLEYDTVHGKFAGSLSHDEQHIFVNGKPIRVFNEMNPANIKWGEEQVQYVVESTGAFTTTEKASAHLQNGVEKVVISAPSSDAPMFVMGVNHELYEKNMHVVSNASCTTNCLAPLAKVVNDKFGIKEGLMTTVHAVTATQKTVDGPSKKDWRGGRGACFNIIPSSTGAAKAVGKVIPSLNGKLTGMSFRVPTADVSVVDLTARLVNPASYDEIKAAIKSASENEMKGILGYTEKAVVSSDFIGDSRSSIFDAEAGIALTDDFVKLVSWYD

SEQ ID NO: 59457 - protein, 645 aa, Xylella fastidiosa Ann-1
MISLRHFAMRRGGRLLLSNVDITLHAGDRVGVVGRNGVGKSSLFAAIRGELEADKGNVELPGKLRIASVAQETPSLSDLALDFVLSGDDVVAEVLRVEAEANAREDWEAVAAAHQRLAEIGGYDAEARAGKLLHGLGFLTQTQRRAVSTFSGGWRVRLNLARALMMPSDLLLLDEPTNHLDMDAVFWLEQWLQKYPGTLLLISHDREFLDNVATHILHLHDGNAKLYVGGYTDFERQRAEQLRQQQIAFEKEQAERVHLQSFIDRFKAKASKAKQAQSRIKRLEKLAGTEAVRMEREFRITFAPPTKQPHSLITLRQVNCGYSVLSPSTPSDPPPVDIHAAAPSQPAVILHRVDFGLEAGDRIGLLGPNGAGKSTLVKTLVSDLAPLTGERIAHPDVRIGYFAQHTVESLHEGQSPIDHFRTLAPQAPIQSIRDFLGKWNFPGDRAFEPVDGFSGGERARLALSLIAWRQPNVLLLDEPTNHLDLEMREALAEALSDFDGAIVMVSHDRHLIGLVCDTFWRVADGVVEPFAGDLDQYAAWLRTRPAARGVRAKTEEVNQPQASLTAKSLASQLPVKKSVNSQKLLVAEKHVSELETLLAELDRKLADPVNYANGEVMRRLGDEREHAARRLAEAEQAWFLLMDGG

SEQ ID NO: 59458 - protein, 720 aa, Arabidopsis thaliana
MNANEEGEGSRYPITDRKTGETKFDRVESRTEKHSEEEKTNGITMDVRNGSSGGLQIPLSQQTAATVCWERFLHVRTIRVLLVENDDCTRYIVTALLRNCSYEVVEASNGIQAWKVLEDLNNHIDIVLTEVIMPYLSGIGLLCKILNHKSRRNIPVIMMSSHDSMGLVFKCLSKGAVDFLVKPIRKNELKILWQHSSGSGSESGTHQTQKSVKSKSIKKSDQDSGSSDENENGSIGLNASDGSSDGSGAQSSWTKKAVDVDDSPRAVSLWDRVDSTCAQVVHSNPEFPSNQLVAPPAEKETQEHDDKFEDVTMGRDLEISIRRNCDLALEPKDEPLSKTTGIMRQDNSFEKSSSKWKMKVGKGPLDLSSESPSSKQMHEDGGSSFKAMSSHLQDNREPEAPNTHLKTLDTNEASVKISEELMHVEHSSKRHRGTKDDGTLVRDDRNVLRRSEGSAFSRYNPASNANKISGGNLGSTSLQDNNSQDLIKKTEAAYDCHSNMNESLPHNHRSHVGSNNFDMSSTTENNAFTKPGAPKVSSAGSSSVKHSSFQPLPCDHHNNHASYNLVHVAERKKLPPQCGSSNVYNETIEGNNNTVNYSVNGSVSGSGHGSNGPYGSSNGMNAGGMNMGSDNGAGKNGNGDGSGSGSGSGSGNLADENKISQREAALTKFRQKRKERCFRKKVRYQSRKKLAEQRPRVRGQFVRKTAAATDDNDIKNIEDS

SEQ ID NO: 59459 - protein, 341 aa, Methanococcoides burtonii DSM 6242
MNDLWTVKYRPQKLEDIVGNGESVNSLVHLVGSGNLPHLVFHGPVNSGKSSTAFALAYELYGEYYENNFTYFNASDFFDQGKRYLVRDKRFVHIIGTDDPKKIYSSVISIFKEVINEFAGMGSLDADYKIIFIDNVESLETGAQHALRRIMEKYTRTCRFILSTTQPSKLIAPLRSRGLELFFTYVPDDALRSFVISVAEKEAISISDDGYDALLYYAGGNVSKALLTLQFAVMNHPGKTITGEILYEEALGDVSKNVTELHNAAIEHDVLKARKLIDTLLIEEGFTGDEVLQQLHSVVVESGRVEGEVAKAICRIADTDAMVIDSANPRIHLEKLVTELY

SEQ ID NO: 59460 - protein, 106 aa, Zea mays
FFVFGKERREPWFFWVQLFFEEVGGGGVLVEERKPAMIFFIPKFFFRNFFSLFVLEVVGQGVSGGFPRVFGVILIPFGGPPGRGKFAGFPPVWASSLGVCLFSSSP

SEQ ID NO: 59461 - protein, 405 aa, Saccharomyces cerevisiae
MNIGGGKFLLGRISNNPTSGIVGLANVGKSTFFQAITNSKLGNPANYPFATIDAECAKVNIPTVPLSNLLRIYQSAKCVPGTLTIYDIAGLTRGASQGHGLGNKFLNDIRHVEGIFQVVRGFLKEDITHIEGNVDPVRDLSVVQDELIFKDLEFLENIRERLSKKMRMVSKNSKEHQEMKIETELLDALEEHLFNGKKIRHFKDHWNLDEVKILNKHNFLTSKPTLILLNVSPQDYVRNENKFVRNIIEWINEFSPGDKFLLFSAEFESQLMECKGIASEYFDKIKEDTNVSDQQLVSAIPQIILEMRKLLNLISFFTCGPQAVHQWNIREGTTAQEAAGVIHSDLRETFISADVIKYDDLKKMEPPLNESLLKSKGLIKRAGKQYIMQDNDIALFKAAGGKIKK

SEQ ID NO: 59462 - protein, 193 aa, Triticum aestivum
  misc_feature (66)..(66): Xaa can be any naturally occurring amino acid
MYRAAGSHLRSLKNHGASRFASTSVVKQSSGGPGKGMHSRLYLRVLNKYDQIESFSAFNSIYNDSXLFGIHAATSPDFASTAVDLAAGELLEVATPGKVTQEQLDRAKEATKAAVLMNLESRIVASEDIGRQVLTYGQRKPVEYFVRAVEATTLNDISTVAQKIISSPLTLASWGDVIHVPSYESVSRKFLSK

SEQ ID NO: 59463 - protein, 510 aa, Citrus sinensis
MANIDIEGLLRDVPNDKRLPKTKIVCTLGPASRSVPMLEKLLRAGMNVARFNFSHGTHEYQQETLNNLRAAMHNTQILCAVMLDTKGPEIRTGFLKDGKPIQLKEGQEITVSTDYDFKGNEEMITMSYKKLPVDVKPGNTILCADGTITLTVLSCDPKSGTVRCRCENTAMLGERKNVNLPGVVVDLPTLTEKDKEDILRWGVPNNIDMIALSFVRKGSDLVTVRKVLGPHAKNIQLMSKVENQEGVVNFDDILRETDSFMVARGDLGMEIPVEKIFLAQKMMIYKCNLVGKPVVTATQMLESMIKSPRPTRAEATDVANAVLDGTDCVMLSGESAAGAYPEIAVKIMRRICIEAESSLDYRAVFKEMIRSTPLPMSPLESLASSAVRTANKARAKLIVVLTRGGTTAKLVAKYRPAVPILSVVVPVLTTDSFDWTCSDETPARHSLIYRGLIPILAEGSAKATDAESTEVILEGALKSAIEKGLCSPGDAVVALHRIGVASVIKICIVK

SEQ ID NO: 59464 - protein, 296 aa, Photobacterium profundum SS9
MYCSNTEDAMWQAISHQLSDVLGKPFKISEREALEGGDVNQCYCIGDGDERFFIKLNDKEQLAMFKSEAESLRILNEANCVQVPQLLHLGTCREKSFLILNYLPTKTIDNESAFKLGQQLAELHQWGEQAEYGFDFDNYVGITPQPNKWRRRWCRFFAEQRIAWQLQLCEEKGIKFGNIDTITGNVISLLMHHQPTPSLLHGDLWHGNTALTVTGPIIFDPATYWGDRECDIAMTELFGGFPASFYEGYQSIFPLDDGYQERRDLYNLYHILNHCNLFGGEYLAQAAHIIEKLKLA

SEQ ID NO: 59465 - protein, 379 aa, Vibrio vulnificus YJ016
MSKSALLVLEDGTVFRGVSIGADGISVGEVVFNTSMTGYQEILTDPSYSQQIVTLTYPHIGNTGTTSEDEESSSIHAQGLVIRDLPLIASNFRSEQSLSDYLKSQNIVGIADIDTRKLTRILREKGAQNGCIVAGNNLDEALALAKAKEFPGLKGMDLAKEVTTKEAYQWKQGSWTLEGGLPEAKDDSELPYHVVAYDFGAKRNILRMLVDRGCRLTVVPAETSAEDVLALNPDGVFLSNGPGDPAPCTYAIEATKVFLEKGLPVFGICLGHQILALASGAKTVKMKFGHHGANHPVKDLDRNVVMITSQNHGFAADEATLPDNLRATHVSLFDGSLQGIHRTDKPAFSFQGHPEASPGPHDAAPLFDHFIELIKQHSA

SEQ ID NO: 59466 - protein, 396 aa, Bacillus cereus ATCC 14579
MKQFELSRSAESLKPSGIRKFFDLAANMKGVISLGVGEPDFVTPWNVRQACIRSLEQGYTSYTANAGLLELRQEIAKYLKKQFAVSYDPSDEIIVTVGASQALDVAMRAIINPDDEVLIVEPSFVSYAPLVTLAGGVPVPVETKLENEFKVQPEQIEAAITAKTKAILLCSPNNPTGAMLNKSELEEIAVIVEKYNLIVLSDEIYAELVYDEAYTSFASIKNMREHTILISGFSKGFAMTGWRLGMIAAPVQFSELMLKIHQYSMMCAPTMSQFAALEALRAGNDEVIRMRDSYKKRRNFMTTSFNEMGLTCHVPGGAFYVFPSISSTGLSSAEFAEQLLLEEKVAVVPGSVFGESGEGFIRCSYATSLEQLMEAMKRMERFVENKKRTKRNTFCP

SEQ ID NO: 59467 - protein, 516 aa, Oryza sativa Indica Group
MAAAAAHHPLPHQQKAANLARTFTKLLRRKRADAVAAATAVGEPGVPDAAAASMVGDEYECSVEAAAAGVPSLSKLKLSGNLGAAYSLDAFFRNAAEKKAAGVAGVAVAQTSPQVAPDVAKDSLLANLFAGVSAVKAAYAQLQLAQFPYDAEAIQAADAALVAELSRLSDTKRRYLRDPAAAAKNAAAAGHTALYAHAEEQRHLLKTYQITARKLEGELRAKEAEADRARSSLTAELRAERAMEARLHPGRTLASLDELHLSGLNPTHFLTALRHTVKSIRSFSKSMLNSMQSAGWDLAAAAAAVHPGVQLRRAGDTKFVFESYVAMKMFANFHRRDFNLSFLDEREFYDRRRFFEEFTELKAAPASAFLDARNARWGGFGKFLRAKYLSLVHARMETAFFGRLEQRGIVSAGPGFPESSWFADFAEMARRVWLLHCLFYAFDGGAEEDGASIFQVRTGARFSEVYMESVSDGRSDEAAAAAAEERVVGFTVVPGFRVGRTMIQCRVYLSRPGRRP

SEQ ID NO: 59468 - protein, 278 aa, Zea mays
MSWCTIESDPGVFTELIQQMQVKGVQVITNACATQAILSVLMNRPEIDIGPELSQLKEFTGAFTPDLKGLAISNSESIRTAHNSFARPEPFISDEQRAATKDDDVYHFISYLPFEGVLYELDGLKEGPVNLGQCDGADDLDWLRMVQPVIQERIERYSQSEIRFNLMAIIKNRKEVYSAELEELEKRREQILQEMNNASSTESLSSSLTEVISAIETVTEKVIMEEEKFKKWKKENIRRKHNYIPFLFNLLKMLAEKQQLKPLVEKAKQQKSASPSTS

SEQ ID NO: 59469 - protein, 365 aa, Zea mays
MESSSPSVPFPLLQAPVESTYRACTIPYRFPSDNPRKATPVEIQWIDLFLNSVPSFKQRAENDPTVPDAPAKAEKFAQRYTSMLEELKKNPESHGGPPDCILLCRLRELVLRELGFRDIFKKVKDEENAKAMSLFEGVIKRNDEIEDDGKRIENLVRGILAGNIFDLGSAQLAEVFAKDGMSFLASCQNLVSRPWVIDDLDAFKSKWTKKSWEKAVIFVDNSGADIILGILPFARELLRRGTKVILAANDMPSINDVTYPELVEIINKLKDADGKLSNVDASGLLVANSGNDLPVIDLSSVSPELAFMANDADLVVLEGMGRAIETNLYAQMKCDSIKIGMVKHPEVAQFLGGRLYDCVFKFNEA

SEQ ID NO: 59470 - protein, 366 aa, Triticum aestivum
  misc_feature (183)..(183): Xaa can be any naturally occurring amino acid
SNLLDWPEPIVPVQTLSNSGMSSLPQQYVKPPSERPSGVTNDPNLSIPVIDLASFSNAPEHHQEMLKAIASACKNWGFFQLVNHDVDTEAVRRMRSAWREFFDLPMEEKKAHANLPVTYEGYGSRLGVEKGAILDWSDYYFLNLFPSDIRNLDKWPKIPTDLREATEKYACQLISLCQVLLKXAMSSSLRAGREGLPPIMPLGASEGISATMRVNYYPRCPQPELTLGLSSHSDPGGITLLLTDDNVEGTQVRKGDAWVTVQPVPGSFLVNVGDQIQILSNGRYRSVEHRALVNSDKERFTIAFFCNPRGDLPVAPASELVGPGSPALYQEPVTFSDYRKYIRTKGPSGKTQVQSISSTMQPGPAA

SEQ ID NO: 59471 - protein, 571 aa, Ashbya gossypii ATCC 10895
MAQLKWGAGRADDGQDGREVDIEERWHGGAKPDSADGSRRIQIQAVNDEDDTSELITFNQDVSWFIVMLTFVASLSGFLFGYDTGYISSALQSVGTDLGHQLTYRDKEYITSATSLGALIAALGAGICADLFGRRKCIMFSNILFVVGTVLQVAAFNFWQMVVGRLVMGFGIGFGSLISPLFISEIAPKMIRGRLTVINSLWLTGGQLIAYACGAGFQHVKHGWRILVGISMLPAVLQFVSFIFLPDTPRFYVMKGRLEDAANVLERTYVGAERALIDRKIEELVLLNKTIPGRTVFHRVWNTIVAIHTVPANLRALIIACGLQGIQQFCGWNSLMYFSGDIFSLVGFKDPVAVSIVVAATNFIFTLVAFFAIDKIGRRIILLIGLPGMTTAMTVCAIAFHYIKTEVDGEKLKPVGESNAWGIVVVIFIIVYAAFYALGIGTVPWQQSELFPQPVRGVGTSFATATNWAGSMVIASTFLTMFKNITPTATFGFFAGISVISLVAVYLCYPELSGLELEEVQFVLKDGFNIKASKALAKKRKFQMAESRKQARELDLESLHKAKPSDEFTES

SEQ ID NO: 59472 - protein, 184 aa, Physcomitrella patens subsp. patens
ADRQVNLDDVDGDEDMRAEFSCPYCYEEFDIAALCSHLEEEHCFESRAGMCPVCSAKIAKDMVGHISLQHSQLRFRRAGIPSNAALSLFGKEIREAHLQALLGGTSRSSAPSSATDVLLSSLVYNISVTETEDPPKPAVVVVEQPVNSVDNLLTAEERDEKRKHANLRAMFAQQLVLSTLLGDN

SEQ ID NO: 59473 - protein, 546 aa, Phytophthora sinensis
QELVGMLNTAKIPANVEVVVAPSQVHAATVKAALRPDVRVSGQDVWKQGNGAFTGETSAEMLKDLGAEYTLVGHSERREKGETNEVVAKKAAYALEKGLAVIACIGETKELREANQTVAFITEQLDAYAAEIKDWTNVVIAYEPIWAIGTGLTASPDQAQEVHASIRAWLKEKVSPEAAEKTRVIYGGSVGAKNAPELSQKADIDGFLVGGASLKPDFLQIINAQNPTDNVGGAVNVAINGFGRIGRLVLRAAAKNPLINIVAINDPFISTTYMEYMLEYDTVHGKFDGTLSHDEQHIFVNGKPIRVFNEMNPANIKWGEEQVQYVVESTGAFTTTEKASAHLQNGVEKVVISAPSSDAPMFVMGVNHELYEKNMHVVSNASCTTNCLAPLAKVVHDKFGIKEGLMTTVHAVTATQKTVDGPSKKDWRGGRGACFNIIPSSTGAAKAVGKVIPDLNGKLTGMSFRVPTADVSVVDLTARLVNPASYDEIKAAIKSASENEMKGILGYTEEAVVSSDFVGDSHSSIFDAEAGIALTDDFVKLVSWYD

SEQ ID NO: 59474 - protein, 546 aa, Phytophthora cinnamomi
QELVGMLNTAKIPAGVEVVVAPSQVHAATVKAALRPDVRVSGQDVWKQGNGAFTGETSAEMLKDLGAEYTLVGHSERREKGESNEVVAQKAAYALEKGLAVIACIGETKELREAGQTVAFITEQLDAYAAEIKDWTNVVIAYEPIWAIGTGLTASPDQAQEVHASIRAWLKEKVSPEAADKTRVIYGGSVGAKNAPELSQKADIDGFLVGGASLKPDFLQIINAQNPTANVGGAVNVAINGFGRIGRLVLRAAAKNPLINVVAINDPFISTTYMEYMLEYDTVHGKFDGTLSHDEQHIFVNGKPIRVFNEMNPANIKWGEEQVQYVVESTGAFTTTEKASAHLQNGVEKVVISAPSSDAPMFVMGVNHELYEKDMHVVSNASCTTNCLAPLAKVVHDKFGIKEGLMTTVHAVTATQKTVDGPSKKDWRGGRGACFNIIPSSTGAAKAVGKVIPDLNGKLTGMSFRVPTADVSVVDLTARLVNPASYDEIKAAIKSASENEMKGILGYTEKAVVSSDFVGDSHSSIFDASAGIALTDDFVKLVSWYD

SEQ ID NO: 59475 - protein, 535 aa, Phytophthora syringae
QELVGMLNTAKIPANVEVVVAPSQVHAATVKSALRGDVRVSGQDVWQQGNGAFTGETSAEMLKDLGAEYTLVGHSERREKGESNAVVAKKAAYALEKGLAVIACIGESKETREANQTVAYITEQLDAYAAEIKDWTNVVIAYEPIWAIGTGLTASPEQAQDVHASIRAWLKEKVSAEAADKTRVIYGGSVGAKNAPELSQKADIDGFLVGGASLKPDFLHIINAQNPTENVGGPVNVAINGFGRIGRLVLRAAAKNPLINIVAINDPFISTTYMEYMLEYDTVHGTFDGTLSHDEQHIFVNGKPIRVFNEMNPTNIKWGEEQVQYVVESTGAFTTLEKASTHLQNGVEKVVISAPSSDAPMFVMGVNDELYEKNMHVVSNASCTTNCLAPLAKVVNDKFGIKEGLMTTVHAVTATQKTVDGPSKKDWRGGRGACFNIIPSSTGAAKAVGKVIPDLNGKLTGMSFRVPTADVSVVDLTARLVNPASYDEIKAAIKSASENEMKGILGYTEKAVVSSDFIGDSRSSIFDASAGIALT

SEQ ID NO: 59476 - protein, 667 aa, Stylosanthes hamata
MSQRVSDQVMADVIAETRSNSSSHRHGGGGGGDDTTSLPYMHKVGTPPKQTLFQEIKHSFNETFFPDKPFGKFKDQSGFRKLELGLQYIFPILEWGRHYDLKKFRGDFIAGLTIASLCIPQDLAYAKLANLDPWYGLYSSFVAPLVYAFMGTSRDIAIGPVAVVSLLLGTLLSNEISNTKSHDYLRLAFTATFFAGVTQMLLGVCRLGFLIDFLSHAAIVGFMAGAAITIGLQQLKGLLGISNNNFTKKTDIISVMRSVWTHVHHGWNWETILIGLSFLIFLLITKYIAKKNKKLFWVSAISPMISVIVSTFFVYITRADKRGVSIVKHIKSGVNPSSANEIFFHGKYLGAGVRVGVVAGLVALTEAIAIGRTFAAMKDYALDGNKEMVAMGTMNIVGSLSSCYVTTGSFSRSAVNYMAGCKTAVSNIVMSIVVLLTLLVITPLFKYTPNAVLASIIIAAVVNLVNIEAMVLLWKIDKFDFVACMGAFFGVIFKSVEIGLLIAVAISFAKILLQVTRPRTAVLGKLPGTSVYRNIQQYPKAAQIPGMLIIRVDSAIYFSNSNYIKERILRWLIDEGAQRTESELPEIQHLITEMSPVPDIDTSGIHAFEELYKTLQKREVQLILANPGPVVIEKLHASKLTELIGEDKIFLTVADAVATYGPKTAAF

SEQ ID NO: 59477 - protein, 1095 aa, Synechocystis sp. PCC 6803
MTSDPNPAQAFENWFEEEEGDDAFTSLIAGEETNSGIEELDFGDLFEGEPTVIQGEGFGSPSSGEEDPPVRMTLDFNSPEAELDALFTDEDAPTTAIDPFESSSWLEIDQMMEADPLASIPETNAPAYQTAGGLDDNDLAELQDLLGVGDVEPAITNPGLHSFAGADRVTPLTNEVLLFAAIDDLDGLINAPVLDEEFSFTELETLIDTPAPKSFATISHPFRLPVAMEEDEDEFKDLEALLEQADSSLGGGIAGMGGARLPARPRQVKSRSFEQTMRVPIKQLDNLSNLIGELVVKRNRLEQDQERLRQFLDNLLNQAQNLSDVGGRMQDLYERTLLEGALLASRSTNSRHHSSKTTYPDARITASSSSTMNDQPLDALEMDRFTGFHLLSQEMIELIVRVRESASDIQYLVDETDQVARTLRQVTTQLQEGMTKSRMVPFTQTADRLPRAIREVSMKLNKKVNLEVEGGDVLIDKMILEHLYNPMTHLVNNAITHGIETPAERQKLGKSPEGHLAVRAFLQGNQTLITVSDDGAGINTEMVKQKAVEKGLISRMEAQSLSQSEVYDLLFHAGFSTKDTADDFAGRGVGLDVVRTSLIDIRGAINIESTVGKGTTFTIRLPLTLSICKALCCLSDRARIAFPMDGVEDTRDYLPKDIVTDEDGQKCVKYGKEALLLPLYPLKDLLNYNRQLSRGSVYGGKQEEDVVRVIIARGSSGNLLALQIDQVLGEEEIVIKQIEGPIPKPPGIAGATVRGDGSIMPIADVLELIEIAQGRLRTDSSGGLWRKTLTPTVNEVHMDPTVLIVDDSITVRELLSLSFKKAGFRVEQARDGQEAWDQLKSGLPCDLVFCDIEMPRKNGLELLSELQADEELSSIPVALLTSRGADRHRKVAAKLGATGYFTKPYTEKDILDAANRMLNGEVLLPGSTRKTNSILSRFKKARGNFSEEAPTIVRSNPGTLRSTVLIIDDSVMVREMLSMTFKKADYHTETARDGQDAWEKLKSGLPCDLILCDIEMPRMNGLELLERIQEDPNLSRIPVAMITSRGAQKMQRMAAEKGAKGYFVKPYIEETLLEASQRLIRGEVLLDLAALSADE

SEQ ID NO: 59478 - protein, 546 aa, Phytophthora mirabilis
  misc_feature (120)..(120): Xaa can be any naturally occurring amino acid
QELVGMLNTAKIPVNVEVVVAPSQVHAATVKASLRSDVRVSGQDVWKQGNGAFTGETSAEMLKDLGAEYTLVGHSERREKGETNEVVAKKAAYALEKGLGVIACIGETKDHREANQTVAXITEQLDAYAAEINDWTNVVIAYEPIWAIGTGLTASPEQAQEVHASIRAWLKEKVSPEAAEQTRVIYGGSVGAKNAPELSQKEDIDGFLVGGASLKPDFLQIINAQNPTANVGGAVNVAINGFGRIGRLVLRAAAKNPLINIVAINDPFVSTTYMEYMLEYDTVHGKFDGSLSHDETHIFVNGKPIRVFNEMNPENIKWSEEQVQYVVESTGAFTTLEKASTHLKNGVEKVVISAPSSDAPMFVMGVNHELYEKNMHVVSNASCTTNCLAPLAKVVNDKFGIKEGLMTTVHAVTATQKTVDGPSKKDWRGGRGACFNIIPSSTGAAKAVGKVIPSLNGKLTGMSFRVPTADVSVVDLTARLVNPASYDEIKAAIKSASENEMKGILGYTEKAVVSSDFIGDSHSSIFDAEAGIALTDDFVKLVSWYD

SEQ ID NO: 59479 - protein, 662 aa, Stylosanthes hamata
MSQRVSDQAMAEVIAETRTNSSSRRHGGGDDTPSLPYMHKVGAPPKQTLFQEIKHSFNETFFPDKPFGNFKDQSGSRKFVLGLQYIFPILEWGRHYDLKKFRGDFIAGLTIASLCIPQDLAYAKLANLDPWYGLYSSFVAPLVYAFMGTSRDIAIGPVAVVSLLLGTLLSNEISNTKSHDYLRLAFTATFFAGVTQMLLGVCRLGFLIDFLSHAAIVGFMAGAAITIGLQQLKGLLGIKDFTKNSDIVSVMHSVWSNVHHGWNWETILIGLSFLIFLLITKYIAKKNKKLFWVSAISPMICVIVSTFFVYITRADKRGVTIVKHIKSGVNPSSANEIFFHGKYLGAGVRVGVVAGLVALTEAMAIGRTFAAMKDYSIDGNKEMVAMGTMNIVGSLTSCYVTTGSFSRSAVNYMAGCKTAVSNIVMAIVVLLTLLVITPLFKYTPNAVLASIIIAAVVNLVNIEAMVLLWKIDKFDFVACMGAFFGVIFKSVEIGLLIAVAISFAKILLQVTRPRTAVLGKLPGTSVYRNIQQYPKAEQIPGMLIIRVDSAIYFSNSNYIKERILRWLIDEGAQRTESELPEIQHLIVEMSPVTDIDTSGIHAFEELYKTLQKREVQLMLANPGPVVIEKLHASNLAELIGEDKIFLTVADAVATYGPKTAAF

SEQ ID NO: 59480 - protein, 546 aa, Phytophthora vignae
QELVGMLNTAKIPANVEVVVAPSQVHAATVKAALRPDVRVSGQDVWKQGNGAFTGETSAEMLKDLGAEYTLVGHSERREKGETNEVVAKKAAYALEKGLAVIACIGETKELREANQTVAFITEQLDAYAAEIKDWTNVVIAYEPIWAIGTGLTASPDQAQEVHASIRAWLKEKVSPEAAEKTRVIYGGSVGAKNAPELSQKADIDGFLVGGASLKPDFLQIINAQNPSDNVGGAVNVAINGFGRIGRLVLRAAAKNPLINIVAINDPFISTTYMEYMLEYDTVHGKFDGTLSHDEQHIFVNGKPIRVFNEMNPANIKWGEEQVQYVVESTGAFTTTEKASAHLQNGVEKVVISAPSSDAPMFVMGVNHELYEKNMHVVSNASCTTNCLAPLAKVVHDKFGIKEGLMTTVHAVTATQKTVDGPSKKDWRGGRGACFNIIPSSTGAAKAVGKVIPDLNGKLTGMSFRVPTADVSVVDLTARLVNPASYDEIKAAIKSASENEMKGILGYTEEAVVSSDFIGDSHSSIFDASAGIALTDDFVKLVSWYD

SEQ ID NO: 59481 - protein, 169 aa, Synechocystis sp. PCC 6803
MSSFLVFSWRRWLQILILAIALVLLWAPSALAQANTVNYTYGDLARSDFSHQDLNKAVFAAADLRESNFEGSDLSFSILTDAVFLHASLRGANLSGSLVDRVTLDFADLRDTIFTEAIATRTRFYDTDITGADFSDAVIDAYQVKLMCERAEGVNPVTGVATRDSLGCR

SEQ ID NO: 59482 - protein, 98 aa, Chlorogloeopsis sp.
ATYKVTLINDAEGLNQTIEVDDDTYILDAAEEAGLDLPYSCRAGACSTCAGKIKSGTVDQSDQSFLDDDQIEAGYVLTCVAYPTSDCTIETHKEEELY

SEQ ID NO: 59483 - protein, 289 aa, Oryza sativa Indica Group
MEGKEEDLRLGANRFSERQPIGTAAQGAGDNKDYKEPPPAPLFEPGELKSWSFYRAGIADFVATFLFLYITILTVMGVSKSSSKCATVGIQGIPWSFGSMIFALVYCTAGISGRHINPAVTFGLFLAKNVSLSRAIFYILMQCLGAICRTGFVKGFQQGLFMGHGGGANVIATGYTKGDGLGAEIVGTFILVYTVFSATDAKRNARDSHVPILAPLPIGFAVFLVHLATIPITGTGINPARSLGAAIIYNKDHAWNDHWIFWVGPFVGAALAAIYHQVIIRAIPFKSRS

SEQ ID NO: 59484 - protein, 528 aa, Oryza sativa Indica Group
MATVEHVDIQAVASVQLGMGKAATRLGTGTGTGMAAAPTWLGQVGMLSYVDADGVAGATIVPATPLSRAAFSTHAGIISVPSRVGARDPSPPRKSTKCNVASFENGIITKPQSGVAFWRNPILTMAKCQFSRRCDAMSETDSSPAAAEGRKPRRLRGHRKGVVTCCVASSSRPGVVASSGEDGCLCWFDLRTKDVLFTMEATNQPISSMCFKAGNEDLVYASAGNKILSFDVRMGPQAKPLDTYNYNRDEINQIAVSSKGFLAAADDSGDVKIINTIQKCLYKRLREAHTSVSLCSAIGMFNSDVSSFYDPSLTLILISLQHVNQLFLSFLYKICSSVQFIPWRPWTGSPEMLNGSSVSEEGILGGSYKVCAVARGDGAVDVVDLEYELAPAKSKGLPRMADLSLSSKSTDIGDGCGSQSQGKRIHLDYTGRGRDGMSAVCNHRQRRLQQPWPTPPLPLPPDVVAVGLLDGVDELGLVGMTQALAAMVSAFAQSSRGSATTTAARSAWEKERERLVERRASTTTIAVG

SEQ ID NO: 59485 - protein, 319 aa, Triticum aestivum
  misc_feature (216)..(216): Xaa can be any naturally occurring amino acid
  misc_feature (244)..(244): Xaa can be any naturally occurring amino acid
  misc_feature (276)..(276): Xaa can be any naturally occurring amino acid
  misc_feature (301)..(301): Xaa can be any naturally occurring amino acid
  misc_feature (317)..(317): Xaa can be any naturally occurring amino acid
MDYMNGPGRNHLFVPGPVNIPDQVIRAMSRQNEDYRSPAIPALTKTLLEDVKKIFKTTTGTPFLFPTTGTGAWESALTNTLSPGDRIVSFSLGQFSLLWIDQQQRLGFSVDVVESDWGYGADLGALESKLRTDSQHTIKAICIVHNETATGVTNDLHAVRKLLDAYRHPALLLVDGVSSICALDFRMDEWGVDVALTGSQKALSLPPHGAGASCAXSPKALEAGPRTAKVGARLPSHWKDYLQXSYKMGAYWPYTPSIQLLYGLRAGLDLLFEEGXDNVIKRHTRLGTATRLAVAAWGLKXCTAKEENSATRHAVVXPP

SEQ ID NO: 59486 - protein, 189 aa, Methanococcoides burtonii DSM 6242
MKELKIIVINNYGQFCHLIHRTVRDLDMDTKIVANTTSVEDILDEEPDGIILSGGPSMERVGSCQEYVESIDIPILGICLGHQLIAQTFGGHTGAGKLGGYAAIDVEVIEEDDILKGLGPRTSVWASHADEVTVLPDEFIHLARSDVCEIEAMRHEERPIYGVQWHPEVAHTDKGEELFMNFFKVCEDY

SEQ ID NO: 59487 - protein, 371 aa, Oryza sativa Indica Group
MSETDSSAAAAEGRKPRRLRGHKKGAVTCCVASSSRPGVVASSGEDGCLCWFDLRTKDVLFTMEATNQPISSVCFKAGNEDLVYASAGNEILSFDVRMGPQAKPLDTYNYNRDEINQIAVSSKGFLAAADDSGDVKISELPCFGAIEAVYNSFLGDLGQFHLTAITGGLDSKLAVWDFSKGRTLFSIDYGSPEMQNGSSGGQCFNPPFVHSIAVSEEGILGGSYKVCAVARGDGAVDVVDLEYELAPAKSKGLPRMADLSLSSKRTDLGDGCGSQSQGNRIHLDYTVGGHTSSVSCVTFSAFGEKGKFLVSGGNDSSIKLWDWSKGFSSETNNSAELVLDIKVNWLCTTPTDSDNLIVCDTSKVVKVYNLP

SEQ ID NO: 59488 - protein, 340 aa, Oryza sativa Indica Group
MSETDLSPAAAAEGRKPRRLRGHRKGAVTCCVASSSRPGVVASSGEDGCLCWFDLRTKDVLFTMEATNQPISSMCFKAGDEYLVYASAGNKILSFDVRMGPQAKPLDTYNYNRDEINQIAVSSKGFLAAADDSGDVKIINTIQKCLYKRLREAHTSVSLCSATGMFNSDVSSFYDPRSPEMLNGSSGEQCFNPPFVHSIAVSEEGILGGSYKVCAVARGDGAVDVVDLEYELAPAKSKGLPRMADLSLSSKGTDIGDGCGSQSQGKRIHLDYTVGHTSSVSCVQVPLCCFSVISDISYPFTNRLILYNSTFSAFGEKGKFLISGGNDSSVKLWGSHSLRI

SEQ ID NO: 59489 - protein, 296 aa, Bacillus cereus ATCC 14579
MMKKVRKAIIPAAGLGTRFLPATKAMPKEMLPIVDKPTIQYIVEEAVKSGIEDIIIVTGKTKRSIEDHFDNAFELEQNLLEKKKYELLEKVQASSKMVDIHYIRQKEPKGLGHAVWCARKFIGDEPFAVLLGDDIVQAEKPCLRQLMDEYEKTLSSVIGVQTVPESETHRYGIIDPLEQEGRRYQVRNFVEKPAQGTAPSNLAIMGRYILTPEIFMFLEQQHVGAGGEIQLTDAIQSLNEIQRVFAYDFEGKRYDVGEKLGFVQTTIEMALQHPELRDDMVAMMKKILEEQANQES

SEQ ID NO: 59490 - protein, 218 aa, Zea mays
MALTRIGLAGLAVMGQNLALNIAEKGFPISVYNRTTSKVDETVQRAKAEGNLPVYGFHDPASFVKSIQKPRVVIMLVKAGAPVDQTIATLAAHLEQGDCIIDGGNEWYENTERREKAMEERGLLYLGMGVSGGEEGARNGPSLMPGGSFDAYKYVEDIVLKVAAQVPDSGPCVTYIPGPRQPARRPRVRAGDHGQAGGVAQGGVPRHQQRRQHPGNVR

SEQ ID NO: 59491 - protein, 321 aa, Bartonella quintana str. Toulouse
MTQNTFFPIFPHQHLLGIKDLNVQDLIVLLDRANANIPFSKKIDKKQSPLHGCTQINLFFEASTRTQSSFELAGKRLGADVMSMPIGNSSVKKGETLIDTATTLNAMKPDILVIRHSCAGAAALLAQKVDCCIINAGDGAHEHPTQALLDALTIKRAKGRIEGLTVVICGDILHSRVARSNILSLNALGARVRAVAPSTLLPAGIADMGVEVYNTMKEGLKGADVIMMLRLQRERMTDSFIPSIREYFHYFGLHKENLSYAKSDCIILHPGPINRGIEIASDIADGPQSMIHTQVEMGIAVRMAVMEALLDSRLKASGEKK

SEQ ID NO: 59492 - protein, 441 aa, Bradyrhizobium japonicum USDA 110
MKALAEQIGDIDGVNIYGRVVGVRGLMVEVAGPIHAMSVGARLVIETGANRSIPCEVIGFSGNNAVVMPFAGLDGVRRGCKAVIANAANQVRPSTAWLGRVVNALGEPIDGKGPLPQGSSPMPFRNTPPPAHSRKRVGSPLDLGVRAMNTFLTCCRGQRMGIFAGSGVGKSVLLSMLARNVDAAVSVIGLIGERGREVQEFLQDDLGEEGLARSVVVVATSDEPALMRRQAAYLTLAVAEYFRDEDKDVLCLMDSVTRFAMAQREIGLSAGEPPTAKGYTPTVFTELPKLLERAGPGLGEGAITAIFTVLVDGDDHNEPIADAVRGILDGHIVMQRSIAERGRYPAINILKSVSRTMPKSADPEFWPTIQKARQVMATYADMEELIRLGAYRAGSSPEVDEAIRLHEPLEGFLRQRKDENASLADGYRQLAQILGNLETER

SEQ ID NO: 59493 - protein, 309 aa, Oryza sativa Japonica Group
MGVAAAAGRLLAAVDWEREAYPAYRDFFALPLFAVFFLVVRYLLDCFVFEWIGRKLIFGKEKVDYEKEETRKKIRKFKESAWKCVYFLSGEILSLSVTYNEPWFTNTKYFWVGPGDQVWPDQKIKWKLKAVYMYAAGFYTYSIFALMFWETRRSDFGVSMSHHVATVALIVLSYVFRFARVGSVVLAIHDASDVFLEVGKMAKYSHCDLLANVAFLLFVVSWVLLRLTYFPFWILRSTSYEVLLTLDKKKHNFDGPIYYYVFNSLLFSLLVLHIYWWVLIYRMLVRQIKTRNVGDDVRSDSEGEDEHED

SEQ ID NO: 59494 - protein, 184 aa, Oryza sativa
MLTAAMHMLDSSTSSSPWLPPDLMPPPPPPPSAATLHRHFRGAAAAASTSRRIAKRRPRPSRRLPTTYISADPANFRRMVHQVTGADDLPPPPPPSLSPTTTELLRHAAPAGSPGPAGALMLPTLDTSAFLLGRRAEPTAAAAPCDVSVALVGGAGNSYSNNSSSSSSGNCGGGFPTLDSWDLL

SEQ ID NO: 59495 - protein, 134 aa, Geobacillus stearothermophilus
MAEQLSFRKPGYIVMKRRGERQNGSAKSRKGGEIMFKVQVMDSGEGNHELLCHDHESLLDAANRKGIKIPYACKGGGCGMCKIKVEEGEFERGTSSKAVLPDEERAVNYTLACKTYPKTDMKILIDLSKVTHSS

SEQ ID NO: 59496 - protein, 536 aa, Phytophthora sojae
QELVGMLNTAKIPANVEVVVAPSQVHAATVKAALRPDVRVSGQDVWKQGNGAFTGETSAEMLKDLGAEYTLVGHSERREKGETNEVVAKKAAYALEKGLAVIACIGETKELREANQTVAFITEQLDAYAAEIKDWTNVVIAYEPIWAIGTGLTASPDQAQEVHASIRAWLKEKVSPEAAEKTRVIYGGSVGAKNAPELSQKADIDGFLVGGASLKPDFLQIINAQNPTDNVGGAVNVAINGFGRIGRLVLRAAAKNPLINIVAINDPFISTTYMEYMLKYDTVHGRFGGEISHDEQHIFVDGKPIRVFNEMNPANIKWGEEQVQYVVESTGAFTTTEKASAHLQNGVEKVVISAPSSDAPMFVMGVNHELYEKNMHVVSNASCTTNCLAPLAKVVHDKFGIKEGLMTTVHAVTATQKTVDGPSKKDWRGGRGACFNIIPSSTGAAKAVGKVIPDLNGKLTGMSFRVPTADVSVVDLTARLVNPASYDEIKAAIKSASENEMQGILGYTENAVVSSDFIGDSHSSIFDASAGIALTN

SEQ ID NO: 59497 - protein, 324 aa, Ehrlichia canis str. Jake
MKITILGAGSFGTAIAIALSSISTSINLWGRNHTDMQSITINRKNLKYLPTYELPDNIIPSSSIDEVLSDHNTCIILAVPTQQLRTLCLYVQQHIFEQTPLLICSKGIENISLKFPSEIVKEILPNNPTYILSGPSFAKEIAANLPCTIVLAGENEVLGTSLINKMSNKTFKIVYSKDTLGVQIGAALKNIIAIACGIITGKNLGNNAVASVIAKGMEEIKTLYTAKNETINLSTLIGPSCLGDLILTCTTTHSRNMSFGVAIGQGEDINKMLNKKSEIIEGVSTVKPLISLAEKLNIELPICTSIYNLLYKNVSLDKTISEIL

SEQ ID NO: 59498 - protein, 296 aa, Gibberella zeae PH-1
MDSQQLSEIYAFAVQLGKDAGDMLMAAAQRRIDGHGTSSTTVSYVEKENSVDLVTKTDNDVENFIRTTVASKYPEHGFLGEESYSTGASRTYLVDDKPTWVVDPLDGTVNFTHLFPMFCVSIAFVVKGVPVIGVINAPFLRQFFSSCTGQGAWLNETQRLPLIRNPIPPMPANAPSACTFSCEWGKDRRDIPDGNLSRKIESFVNLASERNGRGGKGGMVHGVRSLGSATLDLAYVAMGSLDIWWEGGCWEWDVAAGFAILEEAGGLVTTANPPNDPETAEIARAHLGGRLYLAIR

SEQ ID NO: 59499 - protein, 546 aa, Phytophthora quininea
  misc_feature (217)..(217): Xaa can be any naturally occurring amino acid
  misc_feature (290)..(291): Xaa can be any naturally occurring amino acid
  misc_feature (298)..(298): Xaa can be any naturally occurring amino acid
  misc_feature (312)..(312): Xaa can be any naturally occurring amino acid
  misc_feature (314)..(314): Xaa can be any naturally occurring amino acid
  misc_feature (510)..(510): Xaa can be any naturally occurring amino acid
QELVGMLNTARIPENVEVVVAPSQVHAATVKAQLRSDVRVSGQDVWKQGNGAFTGETSAEMLKDLGAEFTLVGHSERREKGETNEVVAKKAAYALEKGLGVIACIGESKETREANETVAFITKQLDAYAAEINDWTNVVIAYEPIWAIGTGLTASPEQAQEVHASIRAWLKNKVSPEAAEKTRVIYGGSVGAKNAPELSQKEDIDGFLVGGASLKPXFLKIINAQNPTEKVGGAVNVAINGFGRIGRLVLRAAAKNPLINIVAINDPFISTTYMEYMLEYDTVHGRFBGXXSHDEQHXFVBGKPIRVFNEMXPXNIKWGEQQVQYVVESTGAFKTIETASAHMKNGVEKVVISAPSSDAPMFVMGVNHELYQKDMHVVSNASCTTNCLAPLAKVVNDKFGIKEGLMTTVHAVTATQKTVDGPSKKDWRGGRGACFNIIPSSTGAAKAVGKVIPSLNGKLTGMSFRVPTADVSVVDLTARLVNPASYDEIKAAIKSASENEMKGILGYTEXSVVSSDFIGDSHSSIFDAEAGIALTDDFVKLVSWYD

SEQ ID NO: 59500 - protein, 184 aa, Ehrlichia ruminantium str. Welgevonden
MLPMSPIYKCFMSKHTNIPMFRIGIGYDVHRFDNINNDDSNTSITICGIKINYHKKIIAHSDGDVGLHALADAILGAVGCGSIGQHFPNTDKKWKNAESSHFVIEAQKKAQERGYIISNADIIIICEQPKIMPYALEMQHYIAQFTSIDPSFINIKATTTEKLGAIGRNEGIAAQAIVLCSQQY

SEQ ID NO: 59501 - protein, 549 aa, Saccharomyces cerevisiae
MSEITLGKYLFERLKQVNVNTVFGLPGDFNLSLLDKIYEVEGMRWAGNANELNAAYAADGYARIKGMSCIITTFGVGELSALNGIAGSYAEHVGVLHVVGVPSISSQAKQLLLHTLGNGDFTVFHRMSANISETTAMITDICTPQAEIDRCIRTTYVTQRPVYLGLPANLVDLNVPAKLLQTPIDMSLKPNDAESEKEVIDTILVLVKDAKNPVILADACCSRHDVKAETKKLIDLTQFPAFVTPMGKGSISEQHPRYGGVYVGTLSKPEVKEAVESADLILSVGALLSDFNTGSFSYSYKTKNIVEFHSDHMKIRNATFPGVQMKFVLQKLLTNIADAAKGYKPVAVPARTPANAAVPASTPLKQEWMWNQLGNFLQEGDVVIAETGTSAFGINQTTFPNNTYGISQVLWGSIGFTTGATLGAAFAAEEIDPKKRVILFIGDGSLQLTVQEISTMIRWGLKPYLFVLNNDGYTIEKLIHGPKAQYNEIQGWDHLSLLPTFGAKDYETHRVATTGEWDKLTQDKSFNDNSKIRMIEVMLPVFDCSTKLG

SEQ ID NO: 59502 - protein, 405 aa, Phytophthora brassicae
AAEIKDWTNVVIAYEPIWAIGTGLTASPEQAQDVHASIRAWLKEKVSSDAAEKTRVIYGGSVGAKNAPELSQKEDIDGFLVGGASLKPDFLHIINAQNPTENVGGPVNVAINGFGRIGRLVLRAAAKNPLINIVAINDPFISTTYMEYMLEYDTVHGTFDGSLSHDEKHIFVNGKPIRVFNEMNPANIKWGEEQVQYVVESTGAFTTLEKASTHLQNGVEKVVISAPSSDAPMFVMGVNHELYEKNMHVVSNASCTTNCLAPLAKVVNDKFGIKEGLMTTVHAVTATQKTVDGPSNKDWRGGRGACFNIIPSSTGAAKAVGKVIPSLNGKLTGMSFRVPTADVSVVDLTARLVNPASYDEIKAAIKDASENEMKGILGYTEKAVVSSDFIGDSRSSIFDASAGIA

SEQ ID NO: 59503 - protein, 468 aa, Physcomitrella patens subsp. patens
MGTSVVESEEGTRVLEGQTKTRNAYATMLYGGTPRDYEFYVAARVLLQSLASLKANADLVLIASASVPRPWLNILKKENVTVKVVEDIHNPYAKRRNFEKRFKHTLNKIYAWTLTEYERVVMLDVDNVFIRAPDELFQCGEFCAAFLNPCIFHSGLFVLKPSNETFNNMLEEIQREVPNPLDGADQGFLTSYFHDLLDRPLFHPPHLPFQQLTGLYRLPQGYQMDAALYYLNLKWNVPCGQNSVITFPSIPMLKPWYWWSYPTLPLGILWHDKRQATIGQIHILVIEILLYLFCLFATLFIQKQLVTSQEKNNNSGRMNLRSAQSFHIPRCHPRVVKAMLVVSLSGCYILPFLVVPTTVHPLLGWGAFFFGSFSLLLSIAKAFKLPFIPVLVPWLTCIGMYFIMLWPYHSNGISRSLLMIAYACISSPCLWWCSKELFFSHNGKNDEELAATWAPLKSITPVEFTKLC

SEQ ID NO: 59504 - protein, 229 aa, Pasteurella multocida subsp. multocida str. Pm70
MKKSVLAALVLGASLSVTGCFDKESKAGQEVEKAKASVVETKEAVVNAANEVKNSAVEAAKEAKETVATKVEEVKETTAAKVEEVKAATAAKVEEMKETTAAKVEEMKEASAAKMEEVKAATATKMEEMKAAVADAKNDVAEKAAEVKDAAAAKAEEAKAAVAEKSAEMKDAAAAKVEDAKVASSEAKEMVTEKATEMKDAMKAEVNKAADAVSEKTEEVKEVIVPKAQ

SEQ ID NO: 59505 - protein, 435 aa, Phytophthora katsurae
LGVIACIGETKETREANQTVAYITEQLNAYAAEIKDWTNVVIAYEPIWAIGTGLTASPDQAQEVHASIRAWLNEKVSPEAADKTRVIYGGSVGAKNAPELSQKEDIDGFLVGGASLKPDFLQIINAQNPTANVGGAVNVAINGFGRIGRLVLRAAATNPLINIVAINDPFISTTYMEYMLEYDTVHGRFGGELAHDEQNIYVDGKPIRVFNEMNPANIKWGEQQVQYVVESTGAFTTTEKASAHLQNGVEKVVISAPSSDAPMFVMGVNHELYEKNMHVVSNASCTTNCLAPLAKVVNDKFGIKEGLMTTVHAVTATQKTVDGPSKKDWRGGRGACFNIIPSSTGAAKAVGKVIPSLNGKLTGMSFRVPTADVSVVDLTARLVNPASYDEIKAAIKSASENEMKGILGYTEEAVVSSDFIGDSHSSIFDAEAGIA

SEQ ID NO: 59506 - protein, 378 aa, Glycine max
  misc_feature (93)..(93): Xaa can be any naturally occurring amino acid
MAGLLAWAVGGGGGKEAEDDGIIPILFSADQQKYVNELDQKASSLRRWIHDLRQRLPPQDISQSLPHLHAHSLASNAALALQLNSHSTTRQQXLSVKYWMKSRWRGLIVNRRKLEGFNSYNWNLGHLNAIVVQAQLREVTLKEENAAFENAISDCENKIKEKLQEADLLREKLKEMDETEKKLKAEVENMKQPSWVSDGWEEEKKANSKAGLEAESALLDELEKKKKDMSSMENAVHELEKKWAQVQENALKQPSPGQREKTLDKHLHGLIEQLAVKQAQAEGLLGEIHLKEMELERLNGLWRRTESSNSEANTAARNRFSKGSSDKLHSLSDYEGHQRLPYHSAGRTESQQRLMLLRSAFVLYILALHILVFIRLSF

SEQ ID NO: 59507 - protein, 205 aa, Flavobacteria bacterium BBFL7
MLILGIAGGTGSGKTTVVDQMVHTYPDHEVNVISQDSYYKDTSHLSYEERVKINFDHPGSIDFELLEKHLLELKEGKTIDQPVYSFVEHNRTGEVVKTAPSKVVIVEGILILTQPRIRDLFDIKVYIDCDSDERLIRRLKRDIADRGRDLTEVLERYQNTLKPMHQQFIEPTKAYADVIIPTNRFNTVGVQILRGIIDQRLAEFS

SEQ ID NO: 59508 - protein, 874 aa, Ehrlichia canis str. Jake
MSEKLIYYFSKTKCDGNLTLKHLLGGKGANLAEMCNIGVDVPPGFTLSTNLCNYYYQNNKLPDQVFSLVENAIEFLNNEVNLKFGDKDNPLLLSVRSGSVSSMPGMLDTILNVGLNDETVIGLTKKSGELFAYDSYRRLIQMYAHTVLQVENSLFEEVIYKKKRMYNIPINSQISDPNILKEIIAEFKKIVTFHTNTNFPQNVHKQLYNSIDAVFRSWMNKRAVAYRKIHNIPDNLGTAVNVQSMVFGNMSHNSATGVVFTRNPSTGAQEIFGEFLVNAQGEDVVSGTHSPLPLDKMKELMPQPYNDLEQVCKKLELHYRDMQDIEFTIENGKLWILQARTGKRSIQSSVKIAVDMVKENLISKEEAILRIDHKSFSKLFHPILENNTNINTIARGLPASPGAATGYVVFTPNDAEQFRKDGRNAILVRQETNPEDINGMNSAAGIITLRGGMTSHAAVVARGMGKPCICSATGIFIDKSEEFFYTSTGLKVHKGDSITINGCNGEVILGTIKTVIPKLSESFYTLMQWVDGIRTLKVMANADTPEDTDIAMSFQADGIGLCRTEHMFFSHNRISIVQEMIVSDNKEERIAALEKLEVMQKEDFKKIFKSTLNKQVTIRLLDPPLHEFLPDNNNAISEISARTGKSLEKLKNKILYLSEKNPMLGHRGCRLAISYPEIYEMQVRAIFLAVKELQEETGITCIVPEIMIPLVMAEKEIIIIKELINNIAQQFGNTQYSIGTMIELPKAALIADKIAKHVQFFSFGTNDLTQTTLGVSRDDSANFIGIYQNLEIVKQDPFETLDIEGVGKLISIAVDLGRKSYPNIKIGICGEHGGNFESIQFFSKLNLDYISCSAYRIPTARLIAAQSAIINQNT

SEQ ID NO: 59509 - protein, 534 aa, Phytophthora erythroseptica
ELVGMLNTARIPADVEVVVAPSQVHAATVKASLRADVRVSGQDVWKQGNGAFTGETSAEMLKDLGAEYTLVGHSERREKGESNEIVAKKAAYALEKGLAVIACIGESKETREANETVAYITEQLDAYAAEIKDWTNVVIAYEPIWAIGTGLTASPEQAQDVHANIRAWLKEKVSPEAAEKTRVIYGGSVGAKNAPELSQKEDIDGFLVGGASLKPDFLQIINAQNPTENVGGAVNVAINGFGRIGRLVLRAAAKNPLINIVAINDPFISTTYMEYMLEYDTVHGKFDGALSHDEQHIFVDDKPIRVFNEMNPSNIKWGEEQVQYVVESTGAFTTLEKASTHLQNGVEKVVISAPSSDAPMFVMGVNHELYEKNMHVVSNASCTTNCLAPLAKVVNDKFGIKEGLMTTVHAVTATQKTVDGPSKKDWRGGRGACFNIIPSSTGAAKAVGKVIPSLNGKLTGMSFRVPTADVSVVDLTARLVNPASYDEIKAAIKSASENEMKGILGYTEKAVVSSDFIGDSHSSIFDASAGIALT

SEQ ID NO: 59510 - protein, 472 aa, Vibrio vulnificus YJ016
MNMSQNVYQFIDVQRVDPAKKPLQIRKIEFVEIYEPFTKQQATAQADRCLDCGNPYCEWKCPVHNYIPQWLKLANEGRILEAVELSHQTNSLPEVCGRVCPQDRLCEGSCTLNDDFGAVTIGNIEKYITDKAFEMGWKPDMSKVEWTDKKVAIIGAGPAGLAAADILVRNGVKPVVFDRYPEIGGLLTFGIPSFKLEKGVMENRRRIFSEMGVEFRMNVEVGKDVQMQELLEEYDAVFLGVGTYKYMRAGLENEDASGVYDALPFLISNTYKVMGLEYDQPFIDMAGKNVVVLGGGDTAMDCVRTSIRQGAANVVCAYRRDEENMPGSRREVKNAKEEGVNFMFNLQPLSIDVDTRGQVTGVKVVQTALGEPDEAGRRRPEPVAGSEHVLPADVVIMAFGFQPHQMSWLEPYGVELDQWGRIKAAAKQTYQFQTSNEKIFAGGDAVRGSDLVVTAIDEGRKAAEGILDYLEL

SEQ ID NO: 59511 - protein, 398 aa, Vibrio vulnificus YJ016
MTFMFSQLPTPALDPILSLTVAFRNDPRDQKVDLGIGVYKNNKGETPIMRAVSQAQKIVADTQTTKSYVGLAGCEEFNQSMVNLLLAGTSVLDRVSAIQTPGASGALRMLGDLMKVAQPDTTVWISNPSYVNHKPVMEAAGLKVRYYRYFSPETKQVDIGQMLDDLATAGPKDVVLLHGCCHNPTGADIDFAAWQAITDLAVKNGFTPFVDIAYQGFGDGLEEDAKGLQFMADRVEEMLITTSCSKNFGLYRERTGAAIVIGKNAKESSNAKGKLLTLARSTYTMPPDHGAALVKTILQNVELTTTWKQELCEMQQRLLNLRQTLCNELRNQHNTSQFDFIESHKGMFTVLGFTPEQMGTLRDEYGIYGVGDGRINIAGLTEAHIPYVADAIVKVSQR

SEQ ID NO: 59512 - protein, 50 aa, Glycine max
SFWDKRITHEDLGAALGEDPKGYVFKIYRGRDKQGLPMKQGVLNPGSMHV

SEQ ID NO: 59513 - protein, 481 aa, Magnaporthe grisea 70-15
MASITLESLPDVLANDTKVKLAGIDVDGILRGKLVSKKKFLSIAKDGFGFCSVIFGWDMHDQTYFRELEISNAGNGYRDLVAIPDLASFRRVPWENDIPFFLVSFHDPDTMEPICACPRGLLRTQLDKIKSEGYGAMAGAEYEFYQFRTPSSDPAASSAPSTAAYLRENPPHSLPALTEGMFGYSLTRPVHNQDYFYDIFDTCEKFNCNIEGWHTESGPGVFEAALEFGEITGMADRASLFKYAVKSVATKYGITPCFMAKPKQGLPGNSGHMHISLVDNSGKNLFARETPDENAPWPDVAQLSDIGRHFLAGLLEGLPDVMPIVAPTINSYKRLVENFWAPVTVSWGLEHRAASIRLIAPPTSKPGATRFEVRVPGADTNPSLVLAAILALGWRGVQKKLEIPCPPLGKGEQVGGESDTGIRLAKSLREATDRFMRKESVAREAFGDAFVDHYGGTREHEIRQWDEAVTDWEMKRYIETV

SEQ ID NO: 59514 - protein, 288 aa, Triticum aestivum
  misc_feature (247)..(247): Xaa can be any naturally occurring amino acid
AYLGDSIEQVCTKKQAGTGPEFPGYRRPTRPKLQSSDISKDKQVDPALADILKLSFSSSEFSMAFPYVAMSDDEALENSLLSGFTENCEDGSGGNHITYTDTCTASSESVKKHLNMDSVQDLVKSRMGNNPSGPTELIVFCSGGFKDNAKTEGQLLLDLVSVLDKSGAKYTVLYASQPYGLLENPSDLPLARYLAEKTNTTKPVLEKCDGECQLKSTLLEGVFVGVVLLIILISGLCCMMGIDTPSXFEAPPGLTLVLILEPNPMWMARVCYPAQWVRLLFAAGYFPN

SEQ ID NO: 59515 - protein, 511 aa, Oryza sativa Indica Group
MARMGISKGGSGKEAKKPPLLLGRFEVGKLLGQGNFAKVYHARNVATGEEVAIKVMEKEKIFKSGLTAHIKREIAVLRRVRHPHIVQLYEVMATKLRIYFVMEYVRGGELFARVARGRLPEADARRYFQQLVSAVAFCHARGVFHRDIKPENLLVDDAGDLKVSDFGLSAVADGMRRDGLFHTFCGTPAYVAPEVLSRRGYDAAGADLWSCGVVLFVLMAGYLPFQDRNLAGMYRKIHKGDFRCPKWFSPELIRLLRGVLVTKPQRRATAEGIMENEWFKIGFRRFSFRVEDDRTFTCFELDDDAAVDAPTSPPDTPRTVDSGDVGAAPTRPRKAGSLTSCDSAPSLLEGRFGLGGSSRRRSSLNAFDIISFSPGFDLSGLFDQDDGGGAGAGSIPEQQKHTARFVSAAPVEVIVATLEAAAAAAGMAVREREDGSISMEGTREGEHGALAVAAEIYELTPELVVVEVRRKAGGAAEYEEFFRARLKPSLRELVCDDRPCPEDSGELSRSL

SEQ ID NO: 59516 - protein, 234 aa, Lactuca sativa
MDHAADAFRTDLMTITRFVLNEQSKHPESRGDFSILLSHIVLGCKFVCSAVNKAGLAKLIGLAGETNVQGEEQKKLDVLSNEVFVKALVSSGRTCILVSEEDEDAIIVEPSKRGRYCVVFDPLDGSSNIDCGVSIGTIFGIYMIKDGDEAILEDVLQPGKNMVAAGYCMYGSSCTLVLSTGSGVNGFTLDPSLGEFILTHADIKIPKKGKIYSVNEGNAKNWDGPTAKFVEKCK

SEQ ID NO: 59517 - protein, 467 aa, Hyphomonas neptunium ATCC 15444
MAETYDVVIIGGGPGGYNCAIRAGQLGLKVACIEMRGKLGGTCLNVGCIPSKALLHTSHLFSAAQNEFATLGIKTGKVELDLAQMMGQKDEAVEGLTKGVEFLLKKNKAEYIKGKGKILGKGKVEVALADGGTRVLETKNIVIATGSEPATLPGIEIDEERVVSNTGALSLKAVPKKLVLIGAGVIGLEMGSVWARLGSEVTVVEYLDRILPPADAEVAKEAERTFKKQGLAFKLGTKVTGIEKTKTKLKVAVEPAKGGAAETLDADIVIVAIGRKPYTEGLGLEAVGGKTDKRGVIEVTDHFKVADGVWAVGDCIPGPMLAHKAEDDGTAVAELIAGKAGHVNYDLVPSVVYTNPEIAWVGKNEEELKAAGVEYVKGKFPFMANSRARTNHETVGFVKILAEKGTDKILGAHMIGVGVGEMIAEVCVAMEFGASSEDIARTSHAHPTLSEAVRQAAMGVEGWTMQM

SEQ ID NO: 59518 - protein, 735 aa, Allochromatium vinosum
MSDHIFFASAPKHLGSLLAEELTRLGMAGAAETRGGARFSGRIEDGYRACLWSRIANRILLPLAQVSLGGPDEIHDSALEIPWEDHLTPDRTFAIQFDGQLQGVTNPHFAILQVKDAIADRFNRLYGRRPSVDPDDPDLRIHLYGNRDSLSFSLDLSGESLHQRGYRDAGSAAPLKENLAAALLLRAGWPEIAAEGGALLDPMCGSGTLIIEGALIAADIAPGLLRERFGFHGWTQHDEPAWQRLLAEARLRRTAGLKRLGSLRGYDVNPNAIRTSLHHLERAGLAGLAHFERRELSDCHPGREDDEGLVIVNPPYGERLGADEDLTQLYARLGSVLKERFVGWRAAVFTSSPELGKSLGLRATRIHSLYNGPIECRLLSFQIEPRYFVSHLPRPLPPEERSPGAAMFANRLSKNLKALRKWRQRDGIDCLRIYDADLPEYALAIDLYEGERRWVHVQEYAAPPSVDPKRARQRLREALGLIPEVLEVPGEQVFLKVRRQQKGRAQYERLAETGRFHEVSEYGLRFLVNFEDYLDTGLFLDHRDVRRLIGSLSDGKRFLNLFAYTGTATVHAAKGGAASTTTVDLSRTYLEWAGRNLELNGIRGPNHQLIQADCLRWIDSMAGQRRFDLIFLDPPSFSTSKRMHGTLDIQRDHVDIIQATMRLLEPGGRLIFSNNLRRFRIDLEGLAPFEVSDISAQTLPRDFARNPRIHNCWVIQHPESASNRRNGSDDEDRHA

SEQ ID NO: 59519 - protein, 326 aa, Bartonella quintana str. Toulouse
MIFYSAPSPVKFAVAPMLGWTDQHCRFFHRLLTKKALLYTEMIVADAVIHGVRERVLALNHKEHPIALQLGGSDPQKLAEAARIAEDFGYDEINLNVGCPSNRVQSGAFGACLMLQPDIVANAVEAIKQVVTLSVTIKCRIGVDEQDEELALDFLAEKVWNAGCDALWVHARKAWLKGLSPKENRDIPPINYERVYKLKRKYYNKFIGINGEIKSLDEIKEHLTLCDAAMVGRQVYHNPTLLKHIDSEIYGEPQSNLNDVDLIESMCDYAAQHIASGGLLSHVTRHMIGLFNGRNGARRWRQILSNNASRRDADVHVIKEAFSALI

SEQ ID NO: 59520 - protein, 539 aa, Kineococcus radiotolerans SRS30216
MSTHVLLVVTTVVVALAPALARRAHLPAPSVLFLLGCALAVLPSGGQVHLEPEFVLLVLLPVILYWEGYTTSVQHAWRYRRAILLTAVPLVIATAAVVAVTAHALGLSWTAAWILGAVVAPTDASAVAAYSRALPLRLTTILRGESLINDGTALVLLGIAVSAAGGADVSLASASGELAWSYAGGTAVGALVAAAGLLAVRRVRDPLVLAAVSVAEPFAASVLAETVHASGVVAVVVCALGISRAARRAVPAAGRLQVHAFWETTSWLVNGALFVLVGLEARAVFDSPGVDGGRALQLVGQGLLLAAVIVAVRVAWLFLTAWLVRLLDRRPAQRELRVPWRLRVVAAWSGMRGGVSLAAALSVPVSVGETPFPGREAVLVLTFVVVGATLLVQGATLPAVIRWAHAHDSRDEETAALTAAVSTLGRAAEEHLRLHAEHHPGDRAVVEHLRRHLHPSRTGAGEQIHPERLRQLRRSTLARQREVLAAMVRGGGLEDTQLWRLQERLDLDEALLLAEDDLPSPAAGPPAQRTTLGASGVPR

SEQ ID NO: 59521 - protein, 514 aa, Physcomitrella patens subsp. patens
MGAADLQYLLWLVGIATCVKVLLVPAYHSTDFEVHRHWLAITHSLPLKEWYSDESSQWTLDYPPFFAFFERFLAIFASWFDPQIVDLVNGQNYAVRSVVLFQRGTVMAADLVLYWGLWEIGSGLSRMRRRILYLVVIFSPGLLIVDHIHFQYNGFLFGILFLSLAAMRDGNDLLGGIYFAALVCFKHLFAIAGPIYFVYILRHYCKGPQKIARFCIMASAVISIVALAFGPFLYHGQMPQLMKRLFPFGRGLCHAYWAPNVWALYSTGDKSATVVMRKLFGVYIDRPKAGLTGGLVGDFTPYAVFPQITPIVSAILVIGSMMPCLVQAWRKPVPNAFIRWVVYTFTCGFMFGWHVHEKASLHMVIPFSVLAVERLEDARAFLFLSVVSTYSLFPLLFESKEYPIKVTLLLLYALVIWLNFSQLFGTSTKDSGDLKAKAASNTELNVQETVKPLIGPVEGAYLGGIMVIEIYGQCFHPLFFGGSFPFVPLMLTSVYCALGMTYYWLDQLHMVLSS

SEQ ID NO: 59522 - protein, 563 aa, Saccharomyces cerevisiae
MSEITLGKYLFERLSQVNCNTVFGLPGDFNLSLLNKLYEVKGMRWAGNANELNAAYAADGYARIKGMSCIITTFGVGELSALNGIAGSYAEHVGVLHVVGVPSISSQAKQLLLHHTLGNGDFTVFHRMSANISETTAMITDIRNAPAEIDRCIRTTYTTQRPVYLGLPANLVDLNVPAKLLETPIDLSLKPNDAEAEAEVVRTVVEFIKDAKNPVILADACCSRHDVKAETKKLMDLTQFPVYVTPMGKGAIDEQHPRYGGVYVGTLSRPEVKKAVESADLILSIGALLSDFNTGSFSYSYKTKNIVEFHSDHIKIRNATFPGVQMKFALQKLLDAIPEVAKDYKPVAVPARVPITKSTPANTPMKQEWMWNQLGNFLREGDIVIAETGTSAFGINQTTFPTDVYAIVQVLWGSIGFTVGALLGATMAAEELDPKKRVILFIGDGSLQLTVQEISTMIRWGLKPYIFVLNNNGYTIEKLIHGPHAEYNEIQGWDHLALLPTFGARNYETHRVATTGEWEKLTQDKDFQDNSKIRMIEVMLPVFDAPQNLVKQAQLTAATNAKQ

SEQ ID NO: 59523 - protein, 546 aa, Phytophthora lateralis
QELVGMLNTAKIPAGVEVVVAPSQVHAATVKASLRADVRVSGQDVWKQGNGAFTGETSAEMLKDLGAEYTLVGHSERREKGETNEVVAKKAAYALEKGLAVIACIGETKELREANQTVAYITQQLDAYAAEINDWTNVVIAYEPIWAIGTGLTASPEQAQDVHASIRAWLKEKVSPEAAEKTRVIYGGSVGAKNAPELSQKEDIDGFLVGGASLKPDFLQIINAQNPTDNVGGPVNVAINGFGRIGRLVLRAAAKNPLINIVAINDPFISTTYMEYMLEYDTVHGKFDGSLSHDEQHIFVDGKPIRVFNEMNPTNIKWGEEQVQYVVESTGAFTTLEKASTHLQNGVEKVVISAPSSDAPMFVMGVNHELYEKNMHVVSNASCTTNCLAPLAKVVNDKFGIKEGLMTTVHAVTATQKTVDGPSKKDWRGGRGACFNIIPSSTGAAKAVGKVIPSLNGKLTGMSFRVPTADVSVVDLTARLVNPASYDEIKATIKSASENEMKGILGYTEKAVVSSDFIGDSHSSIFDASAGIALTDDFVKLVSWYD

SEQ ID NO: 59524 - protein, 131 aa, Zea mays
MAPKALAVTALLLTLNLLFFSFVTSTKCPPTTPKTPKSPKKIPPVKPTCPTDTLKLGVCADLLGLINVLVGSPPKTPCCALLNGLANVEAAVCLCTALKANVLGINLNVPVDLSLLLNYCGKKLPYGFQCA

SEQ ID NO: 59525 - protein, 335 aa, Magnetococcus sp. MC-1
MRVLITGAAGFIGSALSRKLLDRGDEVIGIDNLNDYYDVTLKQARLARHVEHPAYTDLRVDLEDSQAVAQVFATHKPQRVVNLAAQAGVRYSLVNPHAYINANVVGFLNILEGCRNHDVEHLVYASTSSVYGANTNMPFSEHSGTQHPVSLYAATKKSNEMMAHAYSHIFRLPVTGLRFFTVYGPWGRPDMALFMFTRKMLAGEPIDVFNHGRHMRDFTYIDDIVNGVERVLDKIAQPNEAWTGQNPDPATSLSPYRIYNIGNNEPVELMRYIEVLESTLGIAAKKNFLPLQKGDVPDTYADVSNLVEDIGYRPQTTVEEGIGKFVAWYRDYYQV

SEQ ID NO: 59526 - protein, 336 aa, Xanthomonas axonopodis pv. citri str. 306
MKAFQIGNQTGLESLVAVEMPEPVAGAGEVIVAPRLVGLINRDLQILKGTYGGKLAPTRVPVAEGVGIVTCVGAGVGQVVPGDRVVSGHFPTWLDGRFRAEMFAHDLGVTHDGWLAEKVSLPASALIKVPASLEDADVAALASAAVTAWHALVEVARIKAGDLVLCLGTGGVSMAALQLAKLHGARVAITSSSDDKLELARRLGADITVNYRTHPDWAEAVMQLSGGGADVVIETGGQDTLGQSIKAAAANATIVVVGVTPGAASPIPDYVALIRKNVTIRGIANGSRAMFVDLLRAIEQHRIKTLHSKTFRFDEAPQALDYFARAQHVGKVLIRL

SEQ ID NO: 59527 - protein, 159 aa, Saccharomyces cerevisiae
MSEITLGKYLFERLKQVNVNTIFGLPGDFNLSLLDKIYEVDGLRWAGNANELNAAYAADGYARIKGLSVLVTTFGVGELSALNGIAGSYAEHVGVLHVVGVPSISAQAKQLLLHHTLGNGDFTVFHRMSANISETTSMITDIATAPSEIDRLIRTTFIT

SEQ ID NO: 59528 - protein, 547 aa, Phytophthora ilicis
  misc_feature (132)..(132): Xaa can be any naturally occurring amino acid
QQELVGMLNTARIPANVEVVVAPSQVHAATVKAALRADVRVSGQDVWQQGNGAFTGETSAEMLKDLGAEFTLVGHSERREKGETNEVVAKKAAYALEKGLGVIACIGETKEHREANQTVAYITEQLDAYAAXIKDWTDVVIAYEPIWAIGTGLTASPEQAQEVHASIRAWLKAKVSPEDAEKTRVIYGGSVGAKNAPELSQKEDIDGFLVGGASLKPDFLQIINAQNPTTNVGGAVNVAINGFGRIGRLVLRAAATNPLINVVAINDPFISTTYMEYMLEYDTVHGKFAGSLSHDEQNIYVNGKPIRVHNEMNPANIKWGEQQVQYVVESTGAFTAIETASAHMKNGVEKVVISAPSNDAPMFVMGVNHELYEKNMHVVSNASCTTNCLAPLAKVVNDKFGIKEGLMTTVHAVTATQKTVDGPSKKDWRGGRGACFNIIPSSTGAAKAVGKVIPSLNGKLTGMSFRVPTADVSVVDLTARLVNPASYDEIKAAIKSASENEMKGILGYTEEAVVSSDFIGDSHSSIFDAGAGIALTDDFVKLVSWYD

SEQ ID NO: 59529 - protein, 566 aa, Oryza sativa
NVLQYEREKLSCALLVRTCRHVDSDFSCRFTFRHSCTEHSALVSDDFQWSLCLCRGALRSEDGDLFMRWKAVSKQLRKRHRCVVVPIGSLSIGFCRHRAILFKSLADFIGLPCRIAQGCKYCSAPHRSSCLVKIDNERRFVRSYVVDLVVEPGRLSSPDSSINGQLLSSVPSPFKTSCTMSSANYATPAASWNRAISGDRRNSILSNPQYSVAKYCVAEEKSSVQVATKEAMLPKCGQITQNGNCNKNSMAVFEVSKQMKAMEISSESGDKDNISSATPLKRLSIEPSFCADWLEISWDEIELKERVGAGSFGTVYRADWHGSDVAVKVLTDQDVGEAQLKEFLREIAIMKRVRHPNVVLFMGAVTKCPHLSIVTEYLPRGSLFRLINKASAGEMLDLRRRLRMALDVAKGINYLHCLNPPIVHWDLKTPNMLVDKNWSVKVGDFGLSRFKANTFISSKSVAGTPEWMAPEFLRGEPSNEKCDVYSFGVILWELMTMQQPWNGLSPAQVVGAVAFQNRRLPIPQETVPELAALVESCWDDDPRQRPSFSSIVDTLKKLLKSMLGGS

SEQ ID NO: 59530 - protein, 175 aa, Zea mays
  misc_feature (77)..(77): Xaa can be any naturally occurring amino acid
NFPLPQFATLAIGDEGLGARILLPRGDRSSEIDLPQVRRTQLYSQFFLCSLESSHGRVVAVTILLLIVASCLKSSRXNSIVLSGLSGSGKTTIYYQLRDGSSHQGTVTSMEENSDTFVLHSEQERKDKVKPVHIIDVPGHARLKPKLDEVLPKVAAVVFVVDAQDFLSSMQAAAE

SEQ ID NO: 59531 - protein, 547 aa, Phytophthora clandestina
  misc_feature (119)..(119): Xaa can be any naturally occurring amino acid
  misc_feature (287)..(287): Xaa can be any naturally occurring amino acid
  misc_feature (302)..(302): Xaa can be any naturally occurring amino acid
  misc_feature (344)..(344): Xaa can be any naturally occurring amino acid
  misc_feature (403)..(403): Xaa can be any naturally occurring amino acid
  misc_feature (511)..(511): Xaa can be any naturally occurring amino acid
QQELVGMLNTAKIPABVEVVVAPSQVHAATVKASLRSDVRVSGQDVWKQGNGAFTGETSAEMLKDLGAEYTLVGHSERREKGETNEIVAKKAAYALEKGLGVIACIGETKDLREANQTXAYITEQLBAYAAEIKDWTNVVIAYEPIWAIGTGLTASPEQAQEVHASIRAWLKEKVSPDAAEKTRVIYGGSVGAKNAPELSQKEDIDGFLVGGASLKPDFLQIINAQNPTTNVGGAVNVAINGFGRIGRLVLRAAAKNPFINIVAINDPFISTTYMEYMLEYDTVHGXFDGSLSHDEKHIFVXGKPIRVFNEMNPENIKWGEEQVQYVVESTGAFTTLEKASAHXKNGVEKVVISAPSSDAPMFVMGVNHELYEKNMHVVSNASCTTNCLAPLAKVVNDKFGIXEGLMTTVHAVTATQKTVDGPSKKDWRGGRGACFNIIPSSTGAAKAVGKVIPSLNGKLTGMSFRVPTADVSVVDLTARLVNPASYEEIKAAIKSASENEMKGILGYTEXAVVSSDFIGDSHSSIFDASAGIALTDDFVKLVSWYD

SEQ ID NO: 59532 - protein, 306 aa, Frankia sp. EAN1pec
MTRTPTPAPNAGTITDLEAAVRQERAGRVAIHADELPPIPGLTITDHLVPGSDDDVKVRVRVYRPEGRPSPLPLAVYMHGGAFVLGSLDMVHQGVAQLALGTGAVIVSVGYRLAPEHPFPAGLNDCYSALRWASAHAEELGADPARIGLAGVSAGATLALGVALLTRDRGGPAVRFQSVVMPTTDDRLETPSMRDAVDTPVWNRPLAVQCWRLYLGEGVTEADQYAAPARADDLTGLPPTYLAVGGEDPLRDEGIIFALRLMQAGVPVDLHAYAGAAHGFRDLDIDTARRAQEEQIWALRRGLAAD

SEQ ID NO: 59533 - protein, 534 aa, Phytophthora meadii
PANVEVVVAPSQVHAATVKASLRSDVRVSGQDVWKQGNGAFTGETSAEMLKDLGAEYTLVGHSERREKGETNEVVAKKAAYALEKGLGVIACIGETKELREANKTVAYITEQLDAYAAEIKDWANVVIAYEPIWAIGTGLTASPEQAQEVHASIRAWLKEKVSPEAAEKTRVIYGGSVGAKNAPELSQKEDIDGFLVGGASLKPDFLQIINAQNPTDNVGGAVNVAINGFGRIGRLVLRAAATNPLINIVAINDPFISTTYMEYMLEYDTVHGKFAGSLSHDEKHIFVNGKPIRVFNEMNPANIKWGEEQVQYVVESTGAFTTTEKASAHLQNGVEKVVISAPSSDAPMFVMGVNHELYEKNMHVVSNASCTTNCLAPLAKVVNDKFGIKEGLMTTVHAVTATQKTVDGPSKKDWRGGRGACFNIIPSSTGAAKAVGKVIPSLNGKLTGMSFRVPTADVSVVDLTARLVNPASYDEIKAAIKSASENEMKGILGYTEKAVVSSDFIGDSHSSIFDASAGIALTDDFVKLVSWYD

SEQ ID NO: 59534 - protein, 326 aa, Zea mays
MFESTGARLPACSLAAALLPIYCLRTWRCCDTHPTDTVDDACDRAFRSRARGGIYYLERERLVSACGGARSAAAMAAWKDGYLDMVLIPLAVLFPAVYHLWLYRAVRRSPLSSTVGISAAARRIWVFSMMKNNEKQAIIVVQSIRNVLMASTLVGTTSILFCTGVAAVLSSTYAVKKPLSDAVFGAHGAHMMALKYLLILAVFLLAFLCHSLAICTLNTASFLVNALSPSPHLHLPGVTAEYVADVMERGFLLSLAGNRLFFAGAPLLLWISGPVFPCVCSMAMISVLYNMDVVDDADDGRSSSGGGANAAVVMDGDSDDQSMEVV

SEQ ID NO: 59535 - protein, 246 aa, Gibberella zeae PH-1
MSGLWAQVVTQYGTFKVEIIGSLAIQVLFWWVPSAGFVLLDRLAPSFAAKHKIQPAPKQPTSSEIFDAVLISFRNQLIITGLQVTPAILSTRSSAFQITPSLPSTKDFILHFLICLIAREILFYYAHRLLHLPYLYRRIHKIHHKFTAPVSFASQYAHPVEHIVANTIPIVLPPVLLQTHILTMWAFVSWQLIETATVHSGYDFFGGAAYRHDRHHERFNVHFGGMPWLDRLHGTDEIEGLVKKHN

SEQ ID NO: 59536 - protein, 546 aa, Phytophthora porri
  misc_feature (14)..(14): Xaa can be any naturally occurring amino acid
  misc_feature (176)..(176): Xaa can be any naturally occurring amino acid
  misc_feature (322)..(322): Xaa can be any naturally occurring amino acid
  misc_feature (521)..(521): Xaa can be any naturally occurring amino acid
  misc_feature (542)..(542): Xaa can be any naturally occurring amino acid
QELVGMLNTAKIPXNVEVVVAPSQVHAATVKSSLRADVRVSGQDVWQQGNGAFTGETSAEMLKDLGAEYTLVGHSERREKGETNEVVAKKAAYALEKGLAVIACIGESKETREANKTVAYITEQLDAYAAEIKDWTNVVIAYEPIWAIGTGLTASPEQAQDVHASIRAWLKEKVSXDAAEKTRVIYGGSVGAKNAPELSQKEDIDGFLVGGASLKPDFLHIINAQNPTENVGGPVNVAINGFGRIGRLVLRAAAKNPLINIVAINDPFISTTYMEYMLEYDTVHGTFDGSLSHDEKHIFVNGKPIRVFNEMNPANIKWGEEXVQYVVESTGAFTTLEKASTHLQNGVEKVVISAPSSDAPMFVMGVNQELYEKNMHVVSNASCTTNCLAPLAKVVNDKFGIKEGLMTTVHAVTATQKTVDGPSNKDWRGGRGACFNIIPSSTGAAKAVGKVIPSLNGKLTGMSFRVPTADVSVVDLTARLVNPASYDEIKAAIKDASENEMKGILGYTEKAVVSSDFIGDXRSSIFDASAGIALTDDFVKLXSWYD

SEQ ID NO: 59537 - protein, 367 aa, Symbiobacterium thermophilum IAM 14863
MGLSIGIVGLPNVGKSTLFNAITRAGAEAANYPFCTIEPNVGVVDVPDARLPVLAKMFNSARIVPTSIKFIDIAGIVKGASKGEGLGNKFLHHIREVDAIAHVVRCFEDPNVTHVSGRVDPLSDIEVINLELILADLETIERRYERSAKAAKAGVKEAQVEHGLLSRLKEALEAGLPARSVAIEGDEEARVLRDLHLITAKPVMYIANVAEEHVANPFAVPYVAQVKELADREGSEVVPISARIESELAEMDDEERAAFLADLGLAESGLDRVIRHGYHLLNLISFLTAGETEARAWTIRRGTKAPQAAGVIHSDMERGFIRAEVVSYDDLVTAGSMAAAREAGKVRLEGKDYVMQDGDVVTFRFNV

SEQ ID NO: 59538 - protein, 350 aa, Triticum aestivum
  misc_feature (7)..(7): Xaa can be any naturally occurring amino acid
  misc_feature (243)..(243): Xaa can be any naturally occurring amino acid
  misc_feature (294)..(294): Xaa can be any naturally occurring amino acid
MGAQRAXLASFLLAALVTQAFVSVSARTGPTDKASQDDVKKPDCVPSLDPHNFPGHGGTTVPLPSHGGSSGTPPYHGGSGTTPSHGGSGSTPSHSGSGSLPDPSHGGYGTPPSHGGSGSLPDPSHSGGGYGSTPRCALPTAEGAYGSSPTPSTGGAYGSSPTPSHDGGAYGSSPTPAHDGGSYSGTPAAPSHSSHGSVTPTPLVPVDPNSLGTCDYWRTHPMQIWSALGSWPSSVSHFFGGAXGGALAGGPSMSIQDPLANTRTERAGALLAKGTAALFNSMTRRGFAYTTHPXVGNAFGGPESGGFQKALGGARGGGSKKAQEGEEGLNSPGSPFRRVKLTGYLILGHV

SEQ ID NO: 59539 - protein, 593 aa, Oryza sativa
  misc_feature (497)..(497): Xaa can be any naturally occurring amino acid
MVSDASKKKAAQKKAAAAAKRGAKASSSSSSSSSAADKAANGIAALKLSDRTCTGVLASHPLSRDIHIESLSLTFHGHDLIVDSELELNYGRRYGLLGLNGCGKSTLLTAIGCRELPIPEHMDIYHLSSEIEASDMSALQAVICCDEERMKLEKEAEILSAQDDGGGDALDRIYERLEALDASTAEKRAAEILFGLGFNKQMQAKKTQDFSGGWRMRIALARALFMNPTILLLDEPTNHLDLEACVWLEETLKKFDRILVVISHSQDFLNGVCTNIIHMQSKKLKLYSGNYDQYVQTRSELEENQMKQYKWEQEQIASMKEYIARFGHGSAKLARQAQSKEKTLAKMERGGLTEKVVRDKVLVFRFTDVGKLPPPVLQFVEVSFGYTPDNLIYKNLDFGVDLDSRIALVGPNGAGKSTLLKLMTGDLAPLDGMVRRHNHLRIAQYHQHLAEKLDLDMPALQYMMREYPGNEEEKMRAAIGKFGLSGKAQVMPMRNLXSDGQRSRVIFAWLAYRQPQLLLLDEPTNHLDIETIDSLAEALNEWDGGLVLVSHDFRLINQVAQEIWVCEKQAVTRWEGDIMDFKEHLRSRAGLSD

SEQ ID NO: 59540 - protein, 179 aa, Thalassiosira pseudonana
MSTEFNQVNKLKKTPRRNDNLNEAKFVERLIKISRVTKVTKGGKKLSFRAVVVIGDENGKVGVGVGKAEDVVNAFKKAKTDGRKNLIDVPITKSLSIPHAVIGDLGACKIIMRPSIEGSGVIAGGAVRTVLEVAGIKNVIAKQLGSDNLLNNARTAIVALESLTTLDEVKRKRYHKSVL

SEQ ID NO: 59541 - protein, 402 aa, Photobacterium profundum SS9
MLNINRRDLKMKKVLLFTPGPVNLAENVRSSIGKKDICHREVEFDRLLISIETKLLQVFNVDTDDYRAVVITGSGTAANESILSSVVGNKHILILSNGEFGERLNKISKIHNKNTHFLPFPWGEGFDLKKVDDYLTKHQIDVVAMVHHETSSGMLNSLDDIGLLTKKHGATFVVDCVSSAGAEVIDMEKCNIAFISSSSSKAIGSYSGLSFVIGKTEEFEKLKDLPAKTMYLNLYTFYSFIKKYSQTPNTPAVHLFYALEQALSNIIDKGVDNYYEDLKDKANLLRQGILNLGLKFLIEQKNMCSILTTVCVPLNVNVSVLRKELRDKSIVIYEGKGCFQGKVFQVGNIGELSINEIEYFLSSLKEILNDFLLIGNNDLSAVEGIYINDECRIEDEMVRMEL

SEQ ID NO: 59542 - protein, 372 aa, Oryza sativa Indica Group
MDAKKPYFIAIIIQVIYTGLFVVTKAAFNHGTNTFIFIFYRQAAASLLLLPLAIILERKNAPPMSIRLFAKLFLYALLGNTISFNLYNTGLKYTSSTVASAAASSVPVLTFFFAVLLRLEVIRLRRLSGVAKVAGVGLCLGGVLVIALYSGPALSPLNHHRAFGGGAESGSSGAATRARRVTGTLLMLLSNVTWSLWIVLMSPLLNEYPCKMLATALQSLLSAAQSLVLAAAAAARDPAAWRLRLDAGLLAVAYSAVAVTGVSYYLQAWCIQKKGPVFLAMSSPLSFVFTIFCSSFFLGEVVHLGSVVGGVLMVAGLYSVLWGKSKEHDTLTVAAGQQGEDAAAPPAAESNSSSDNESKHQQGRFASADQQV

SEQ ID NO: 59543 - protein, 78 aa, Cytophaga hutchinsonii ATCC 33406
MSEIAQKVKSIIVEKLGVEESEVTTEASFTNDLGADSLDTVELIMEFEKEFNISIPDEQAENITTVGQAIAYLEQHVK

SEQ ID NO: 59544 - protein, 175 aa, Glycine max
  misc_feature (112)..(112): Xaa can be any naturally occurring amino acid
  misc_feature (122)..(122): Xaa can be any naturally occurring amino acid
  misc_feature (125)..(126): Xaa can be any naturally occurring amino acid
MASSMISSPAVTTVNRAGAGMVAPFTGLKSMAGFPTRKTNNDITSIASNGGRVQCMQVWPPVGKKKFETLSYLPDLDDAQLAKEVEYLLKKGWIPCLKFELKHSFVYQEHNXSPKYYDRHYXTIXXLAMFRYTNTSQVWKELQETKTTYANNFMHIIKFYNIRQIHYINFIGYEP

SEQ ID NO: 59545 - protein, 181 aa, Lactuca sativa
MASISSSAVATVNRSTPAQASLAAPFTGLKSNVAFPVTKKANNDFSSLPSNGGRVQCMKVWPPIGLKKYETLSYLPPLSDEALSKEIDYLIRNKWVPCLEFELEHGFVYREHHHSPGYYDGRYWTMWKLPMFGCTDSAQVMKEVGECKKEYPNAFIRVIGFDSVRQVQCISFIVSKPPGVL

SEQ ID NO: 59546 - protein, 308 aa, Glycine max
MENSYKANGNGPTENGYSVARHSYQPSLKGSLPWLDIKVFYVRVCKCELDDSTPGSLTLNHVPLNPDTLLEINGVRTSIYSDGMSTLLKRDRVDRKSEEVTFVSTDSIRMSGSVKFEVFDKDVLLLSGALELCNTNGVVGESSYNGQRWNMNCESYIIPGTSFFKGKQLLLPDSSLPTIEVYIAGSFSSTPIILTKTLQLSQKKHTKKGVLDAIPEHEASENGKDISSAHALQAPDYLYDKHEDEDYNSLYPGTAYADGEDGELSWFNAGVRVGVGIGLSVCLGIGIGVGLLVKTYQGTTSHFRRRLF

SEQ ID NO: 59547 - protein, 381 aa, Oryza sativa Indica Group
MDAKKPYIIVIVIQLINTGLFVISKAAFNHGMNTFVFIFYRQAAASLLLLPLAIVLERRNAPPMSLRLFTKLFLYALLGNTLSLNMYNLGLKYTSPTVASATTNSIPVVTFFFALLLRRAQSIIHLWVEVIRLKSLSGAAKMAGVVLCVGGVLAIALYAGPAISPVNHHRAFGGGGHESASATTRTRWVKGTLLMLLSNATWSLWTVLMASLLREYPSKLLATAAQCALSAAQSLALAAAAAGRDPAAWRLRPDAGLLAVAYSAVAVTGASLYMQAWCIEKKGPVFLAMSNPLSFVFTIFCALFVLGEVVHLGSVVGGVLMVVGLYSVLWGKSKEHDTLTLATAMPTPASVQQQEKKVAAVPAPADSSSSDSEQERLASIA

SEQ ID NO: 59548 - protein, 355 aa, Oryza sativa Indica Group
MGAKTPYVVIVIVELIYTGMYIISKAAFNQGMNTFIFIFYRQAAASVLLLPLAIVLERSTGTLNLYNMGLKYTTSTVASAAGSSIPVMSFFLALLLRLEMIRLRSLSGSAKAAGVGLCLAGVLVIALYTGPTISPLIHHRVFAGGGHEASASGSGRTRWIVGTVLILLSNVMWLLWSMLMAPVLREYPNKLLATTWQCVISAAQSLAVAAAAAARDPAAWRLRLDTGLLAVAYSGVVVTAVAFYLMAWCIEKKGPVFLAMSTPLAFVFTVFCCIFFLGETVHAGSVVGGVLMVAGLYSVLWGKSKEQDKLTLATATPTVAAVEQKEAAAAAPDADASNSGSELHHGRLVSLEQQV

SEQ ID NO: 59549 - protein, 470 aa, Cytophaga hutchinsonii ATCC 33406
MVNKKTKIIATVGPACNTKEKLWELVQAGANIFRLNFSHGTHDVHQGVINAIRELRKEHNVNIAILQDLQGPKIRTDEVENNGVELVAGAQIVITKEKMLGTKDKISTSYKMLTSDVKKGDAILIDDGNIELKVLETGNGEVTCVVIYGGILKSRKGINLPNTIVSEPSLTDKDKEDLLFGLKNEVDWIALSFVRSAVDLNELKAIIAEHGKSCKVIAKVEKPEAVKDIDAIIEASDAIMVARGDLGVELQMEDVPMIQKMIIKKCNQLAKPVIVATQMMESMITNARPTRAEASDVANAIIDGTDTIMLSAETASGNYPVITVKAMTRICQAVEKEADIYNKSTLDDITNTSDSVIASACELADKVNAKAIIGLSQSGYSAFRIASHRPKASIYIATHDEQLMNQMNLVWGVQAFRFEKFTTTDESIEAVKKSLVEKGLLKKGDIYVTTASMPMADIQLANSLKLGIVE

SEQ ID NO: 59550 - protein, 339 aa, Photobacterium profundum SS9
MNKGKNMTIKVGINGFGRIGRLALRAAFDWEELEFVQINDVAGDAKTLGHLLEFDSIQGRWNHAVTVEGDQLLIGDASITCTQERDIDAVDWSGCDVVLEATGVHRKTSLLQKYLDQGVKRVVVSAPVKEEGVLNVVVGVNDHLFDPERHHIVTASSCTTNCIAPIVKVIHEKIGIDQASFTTIHNLTNTQTILDAPHKDLRRARSCGSSLIPTTTGSATAIVEIFPELKGKINGHAVRVPLANASLTDIIFDVSRNTTAEEINALLKEASETEMIGVLGFEDRPLVSIDYKGDQRSTIVDALSTMVVNHRMVKIYAWYDNEMGYATRTSELIRQVGSA

SEQ ID NO: 59551 - protein, 127 aa, Brassica napus
MTTSKRLADRKIEKFDKNITKRGFVPETTTKKGKDYPVGPILLGFFVFVVIGSSLFQIIRTATSGGMAINETTSSFLSHFSLNLIVECFSFLCTLLHVVKNFESFLYKIIKPFNVVLKLVAVVVMLL

SEQ ID NO: 59552 - protein, 874 aa, Ostreococcus tauri
MSPTDDFDSKVLEHAAERLRTLALEDERREKLESENASLKREVASLRRNGATGSSQSSFPRRSASHESLMEQSPSERRRMAAFRTKTHRFVVRDVRDGDEDAGDVDDVDAGVAADDDGHFTSAGETFRAVESSTAVMGSSDSLASYEGADASARKKSGDGATKAAFELVLANDEGVEVLEPRDRRIRTRQKGLPHSKFSWLDSPRNALVVKKIHDEAATKMMRRAVKALEGQGITSWLERAVWDDAVDLQCSCKTWDEKDDTFRLDSIIDFVVVLGGDGTILWATKYFPKAMPPVVPFAMGSLGFLTSHRVEDMEKTLLDVCLGDFTLSLRSRLVAKVVTVDGKHSPWRYVLNEVLIDRGPKPVMVELDIAVDGYKVTKVAADGVIVATATGSTAYSLAAGGSMVHPGVPALLMTPICPHTLSFRPVVLPDSVVVTITCPPKARNTAWVAFDGKSQTELARGDSVVCRVAAYPVPTVCAHGENTDWFAAVKNSLGWNTRCADQKPHELRRDDPRTHCFRRICNTIHPYEHHVFASSPPRASPVAVPRYPSLSASPPSPRAMATNATGQVQPSGPHPWKGFASGSLGAMASGAVTHPIDLVKVRMQLRGDVADAASVASNTRCPGMIRTFGHIVKREGVLALYKGLTASLMRQATFIGTKFGSYDALKAAARTAEDSDGKLPFWKMTACGIGAGAIGAAVGNPADLAMVRMQADGRLPPELRRNYRHGGDALARVVREEGVFALWRGCAPTVNRAMIVTASQMAVYDQAKHYILEHTPLRDGLAAQTGASFAAGVVAALTSNPIDLAKSRLMSMKADKNGKMPYNGTLDCIAKTIQREGFSAVYKGLVPTTARQVPLNVVRFVSVERIKALLEPL

SEQ ID NO: 59553 - protein, 476 aa, Rhodopseudomonas palustris CGA009
MATPANQTGRITQVIGAVVDVQFEGHLPAILNAIETKNGDNRLVLEVAQHLGESTVRTIAMDTTEGLVRGQEVTDTGAPISVPVGAGTLGRIMNVIGEPVDEQGPIKSEGLRAIHQEAPAYTDQSTEAEILVTGIKVVDLLAPYAKGGKIGLFGGAGVGKTVLIQELINNVARAHGGYSVFAGVGERTREGNDLYHEFIESGVNKKGGGEGSKCALVYGQMNEPPGARARVGLTGLTVAEHFRDQGQDVLFFVDNIFRFTQAGSEVSALLGRIPSAVGYQPTLATDMGALQERITTTTKGSITSVQAIYVPADDLTDPAPATSFAHLDATTVLNRAISEKGIYPAVDPLDSTSRMLSASIVGEEHYNTARMVQQILQKYKSLQDIIAILGMDELSEEDKLTVARARKIERFLSQPFFVAEVFTGSPGKFVDLADTIKGFRAICEGKYDHLPEAAFYMVGTIEEAVEKGKKLAAEAA

SEQ ID NO: 59554 - protein, 928 aa, Cryptococcus neoformans var. neoformans JEC21
MAPSHSHPAHYRRPPSPLPDLGAPLFSLAPSASASASSRTARPHGDTDSVQDVAEMSLESLTLSPPTTATTITTTVAPPTPTTPTSSSTAAATHPVATGGTAAEYPETAAAGIATGAVFTGIGINPPTPAPSPGPHIRGFDDSDTHIREHLEQLLYHGDTTTDPHGQNLDHVQVQAKPHAKPQAQGKTLPHEPYPSPSPAPTPTPTPQTVLSQYTSLPPLLRSKFLNLLIPHLALHEALSLSRKIEPLLRRDFLRELPWEVALHVLSFVISRYWNTLLQDETTWRDLLARHHHRHRYASGGGIGISGRDPPQHARATSREGMEGMTGKEEEEKGWDVGSGLGPPADPNAATSTNTNTNTNTSSRRGGSTSSSQAGTSKQRSKTRDNALGTGSGTKQACCIKRVTPFGLEKRVLNLSSGLTGLPPPISPFSPSPSPFPSPSPSSQHSYKTRVKLAYLTETNWLTAGVLLAKHLSADDSVVTTLSFDETWIVVGMANSKIHVFSAFNGGWKRSLEGRAAHTQGVWAMVLVSPPPRTATATQTATANQMQMQEQDMKRMRGTRGMGWYGAQASASTSTSTSPNGWFGINPPSSYPHPQTQTQTQTQSETQENETPYQHGRENQSRGQDQGGNENEDEDENEGSNLCGSVRGWQGLKTSLVVSGGCDKQVKVWDVETGQCIHSLPGHTSTIRCIKVLPHRPIAVSGSRDYTLRVWDIQRGRCLHTLRGHTKSVRCVEIWGNMAVSGSYDNTAKLWNLDTGECLQTFTGHYSQIYSIAFNGSLVITGSLDSTVRVWSPTTGECLALLQGHTALVGQLQLSGSKLVTGGSDGRVIIFDLSSMSCIHRLCAHDNSVTCLQFDKRFIVSGGNDGRVKLWDVKTGGFVRELTKPCDAVWRTSFRGERIVVLCQREGRTCLEVVSFRPGEGERRGKGI

SEQ ID NO: 59555 - protein, 174 aa, marine gamma proteobacterium HTCC2143
MSVLVGKPAPDFTCSAVLGSGEMVDNFNLADTIKGKVGLVFFYPLDFSIICPSELLAVDHRMDTFKKLGVEVIGVSIDSHFTHKAWRNTAVNDGGIGKVSYTLAADINHDICRAYDVQSDGGMAFRGAFIIDQNGVVRSQTVNDLPLGRNFDEFIRVIEALQFYEEHGEVSPAG

SEQ ID NO: 59556 - protein, 355 aa, Oryza sativa Indica Group
MDSKTPYIVVIVVEVIYTGLYIISKAAFNQGMNTFIFSFYRQAAASVLLLPLAIILERNTGSLNLYNMGLKYTSSTVASATTSSIPVVTFFLALLLRQEVIRLSSSGVAKAAGVGLSLAGVLVIALYAGPAISPLNHHRAFAGGGGHEASSESGTRTRWIEGTLLMVVANAMWSLWIVLMAFLLNEHPNSKLLATTLQSVISTAQSLALAAAVERDPAAWRLRLDTGLLAVVYSGVAVTGVSCYLQAWCIEKKGPVFLAMGSPLSIVFTIFCSLFLLGEIEHLGSIVGGILMVAGLYSVLWGKNKEHKTLTLTTATATATVAAVQQQEAAAAPAPDADSGNELQQRRLASPEQQV

SEQ ID NO: 59557 - protein, 483 aa, Cupriavidus necator
MELQHTALLRTHCLIDGEWTGAQSGAELAVCNPATGERIGSVPLAGAAEAEQAVRAAERALPAWRAQTGKAVPPVLRRWADLMLAHQEDLARLMTAEQGKPLPDARGEVAYAASFLEWFGEEAKRVDGEVLASPRSSQKMLVLREPVGVCAAITPWNFPAAMITRKVGPALAAGCTIIVKPAEQTPLTALALAVLGEQAGVPRGVLQVVTGDAVQIGGVLCASPVVRKLSFTGSTAIGKLLMAQCAGTVKKLSLELGGNAPLIIFDDADMDSAVEGIIASKFRNTRQTCVCANRIYVHDRVYDEVARRLVSAVEQLLPGHGVDSGVTQGPLIDADAVAKVEAHIADALAQGATVLTGGQRHALGGTFFAPTVLANATASMRVAREETFGPLAPLFRFTSEAEVVAMANDTESGLAAYFFSRDMAKIWRVAQGLEYGMVGINTGLISNEVAPFGGVKQSGLGREGSRHGIDEYLETKYLCMEVE

SEQ ID NO: 59558 - protein, 627 aa, Cytophaga hutchinsonii ATCC 33406
MENRIYIVMGVSGCGKTTIGTLLAETLGINFYDGDAFHPISNIEKMAAGIPLTDEDRYNWLLDINKQAKESLSEGHSVVFACSALKESYRKLLAQQIEDTIVWIYLKGDLDTIHLRVKNRTGHFMSPALLQSQFNILEEPSSAMHIDTALDTDTIIHTIVKKLTKSAFGLVGLGVMGKSLARNFAANGVALSLYNRFVKGSEEQVAEKCIAEYPELQSAKGFEDLKTFAASLEQPRKIFLMIKAGEETDTFIEELVPYLNAGDVLIDGGNSYYGDTKRRIEFLARKGIYFIGTGVSGGEQGALKGPSIMPSGDPDAYALVEKYLTLIAAKDKQGESCCTYIGKDGSGHFVKMIHNGIEYAEMQLIAEVYAYLRYAIKIEPTEIAALFTEWNSGELNSYLLGITAALLIKKEGDAWLIDLILDKAGNKGTGNWATIAASELGQPATLITSALFARYVSTIKEHILVNTQPASVYHFNTAALSEIKDAYMLARIVNHQQGFMLIHEASQKYGWDLNFAEIARIWTNGCIIRSAFMEELIPALKKDSNIFTHPAILKQLKDLKPALKAFAVNALQYDLSVPSHLAALDYLNVLSGNYATANIIQAQRDFFGAHTYQKIGDSSGKYYHTEW

SEQ ID NO: 59559 - protein, 455 aa, Vibrio parahaemolyticus RIMD 2210633
MEKVMATHFDYICIGGGSGGIASANRAAMYGAKVALIEAQDLGGTCVNVGCVPKKVMWHGAQIAEAMNLYAEDYGFDVDVKGFDWSKLVESRQAYIGRIHQSYDRVLGNNKVNVIKGFAKFVDEKTVEVNGEHYTADHILIAVGGRPTIPNIPGAEYGIDSNGFFDLAEQPKRVAVVGAGYIAVEIAGVLHALGTETHLFVRKESPLRSFDPMIIDTLVEVMEAEGPTLHTHSVPKEVVKEADGSLTLHLENGESQNVDQLIWAIGRHPATDAINLASTGVATNEKGYIKVDEYQETNVKGIYCVGDIMEGGIELTPVAVKAGRQLSERLFNNKPNAKMDYDLVPTVVFSHPPIGTIGLTTQEAEEKYGKDNIKVYTSGFTAMYTAVTKHRQPCKMKLVCAGEEETVVGLHGIGFTVDEMIQGFGVAMKMGATKADFDSVVAIHPTGSEEFVTMR

SEQ ID NO: 59560 - protein, 982 aa, Arabidopsis thaliana
MAGYRADDEYDYLFKVVLIGDSGVGKSNLLSRFTKNEFSLESKSTIGVEFATRSLNVDDKVIKAQIWDTAGQERYRAITSAYYRGAVGALLVYDVTRHSTFENVETWLKELRNHTDPNIVVMLVGNKSDLRHLVAVQTEDAKSFAEKESLYFMETSALEATNVENAFAEVLTQIHHIVSKKAMEAASESANVPSKGDKIDIGKDVSAVKKELETEQSPEKLSLTVMATAMEEPRKLRGHKSTATCCIASRDRPGIVLTSGEDGCICWFDLRCKDVQFIIDVGTEPVSSLCFKTGNENILYASCGNEIKSFDVHTLSATSWKPLESYNYNKDEVNQVVCNGRSSFLASADDSGDVKPRKNVSNQHLNETYKICSSVQFIPWRPWEVITGGLDSKLVLWDFSKGRSQKIIDFGKDYATNSGSDTNNNSGQCLNPAFVHSIAIPEMDMVDKLDKICAVARGDGIVNLINIESELSRKGTSSKGSSSSSSNNVVKREKGRFLISGGNDKTVKIWDCFKCLDPNNNNNNSDLLHLNINLSKKVNWLCTNQSDSENLVVCDTTRVVKQPQPPLLLLLLLPLLLTTVSSYPLNPKQLKALQSLNISTPTNDPCNNNNNQSSSSSITCDDASPYRHITSISFTNCSSTLSLPSKTLKPLSKSLISLSFTNCPSLSPPYHLPISLHSFSAVSSFLQNNRTKLSGLFLARLKNLKTLYISSTPIQTSRRLYVILGNMHKLTSLTISNSNLTGLIPKSFHSNLRYIDLSNNSLKGSIRISITRLKNLKSLNLSHNSLSGQIPNKIKSLTFLKNLSLASNKLSGTIPNSLSSISELTHLDLSMNQLNGTVPSFFSEMKNLKHLNLADNSFHGVLPFNESFIKNLNFFEIGRNSELCYNKTVLSSNLKLEGLAPCDKYGFPLWSPSQKEESLSGENDYDVEGGNEEKTENLKTKEEEEEEHKGSNKTLFGLGIGLFSLVFLILFLFYLAKRCRLI

SEQ ID NO: 59561 - protein, 464 aa, Bartonella quintana str. Toulouse
MVSSELKRGMSKRQVIFLALGSAIGTGLFYGSAQAIKLAGPSVLIAYCVAGLAIFMVMRALGEMIIHNPLPGSFARYAANYISPLAGFLTGWTYVFEMVLVGLADITAFATYMGFWYPDVAPWIWALSITLIITGINLAAVEVYGELEFWLSSIKIIAIIAIIVLGIAIIFCGWSISTVSSTVSIHNLWKNGGIFPHGWFGFLACFSVVIFAFGGIEIIGMAVMEVQDPTQTVSKAINSTPIRILLFYIMTLTILMSLYPWNEIGFMESPFVSIFERLGISSAAHILNIVVVTAAISAMNSGMYGAGRMIYGLSQEGYASKKFQYLSKNGIPIFVILLIFAIFLFGVVLNYFYHDRLFFLIAAMATFATVFVWMMILLSQVFMRLKMPKEVQCSLKFPIPFWPIGSIFSVLFIVFIFVLLWFFDDTRPVLIVGVSWISWLVICFYALQFYNSKKNKMHPYTNKD

SEQ ID NO: 59562 - protein, 454 aa, Bradyrhizobium japonicum USDA 110
MPLLSRQQRSAAVTLHQIPNTIKTDSFWMPFTANRQFKKAPRLFSSAEGMHYTTVDGRKVIDGSAGLWCVNAGHGRKQIAAAVERQLMTLDFAPTFQMGHPLAFDFAERLAEIAPKGLDRIFFTNSGSESVDTALKIALAYHRATGQSSRTRLIGRERGYHGVGFGGTSVGGMVANRRAFATLLPGVDHIRHTHDLSRNAFAKDQPEHGAELADDLERLVGLHGAETIAAVIVEPVPGSTAVLPPPKGYLQRLREICDKHGILLIFDEVITGFGRLGTPFAANFFGVTPDLMTTAKGITNGTIPCGAVFASRKVHDGMMVGPENQMELFHGYTYSAHPTACAAGIATLDIYKDEGLLTRGASIAEYWRDALHSLKGLPNVVDIRNCGLMGAVELAPRAGVVGARGYDVMVDCFNTGLYLRMSGDSFAMSPPLIVEKSHIDQMVSILGDAIKKVA

SEQ ID NO: 59563 - protein, 461 aa, Colwellia psychrerythraea 34H
MSTGKVVQIIGAVVDVEFPQDAVPQVYDALKITEGDLEGLVLEVQQQLGGGVVRTIAMGTSDGLRRGLNVVNTGQGIQVPVGVETLGRIMNVLGEPIDEAGPIGEKDRWSIHREAPAYAEQSMSNELLETGIKVIDLVCPFAKGGKVGLFGGAGVGKTVNMMELIRNIAIEHSGYSVFAGVGERTREGNDFYHEMNDSNVLDKVSLVYGQMNEPPGNRLRVAFTGLTMAEKFRDEGRDVLFFVDNIYRYTLAGTEVSALLGRMPSAVGYQPTLAEEMGVLQERITSTNKGSITSIQAVYVPADDLTDPSPATTFAHLDATVVLSRDIASQGIYPAIDPLDSSSRQLDPLVVGTEHYETARGVQTVLQRYKELKDIIAILGMDELSEEDKQTVSRARKIQRYLSQPFFVAEVFTGSPGKYVSLKDTIAGFKGILAGEYDDMPEQAFYMVGGIEEAIEKANKM

SEQ ID NO: 59564 - protein, 372 aa, Physcomitrella patens subsp. patens
MDAIRKRASAFRETVAKQQQAVFKTFSGYVSQGDYLIHDEAELQRHQQLEKLYISTKTAKHFQREIVRAVEGIISSGVKQLEIVNKLAEDCRKYATEGPSNGGALARAAMQFGTARTQMERERDNMHRSIGTQVAEPLRAMVMGAPLEDARHLAQRYDRLRQEAENQALDVGRKQVKSKEGNTEQDQKLQMAEQKLGELLSAMAGLGKEAASAMTSVEAQQQRVTLQRLISMVEAERTYHQRATEILDQLHETMVDESQRSESTTPATDDTQTSPPYDDVQVNGGLPHASADCDSNSATSLYFLAEIMHPFEAEDGGELSLAVGDYVVVRQVTSTGWSEGECRGKAGWFPSSYVEKRQRIPASKVAGAGLAL

SEQ ID NO: 59565 - protein, 362 aa, Escherichia coli
MIKPTFLRRVAIAALLSGSCFSAAAAPPAPPVSYGVEEDVFHPVRAKQGMVASVDATATQVGVDILKEGGNAVDAAVAVGYALAVTHPQAGNLGGGGFMLIRSKNGNTTAIDFREMAPAKATRDMFLDDQGNPDSKKSLTSHLASGTPGTVAGFSLALDKYGTMPLNKVVQPAFKLARDGFIVNDALADDLKTYGSEVLPNHENSKAIFWKEGEPLKKGDTLVQANLAKSLEMIAENGPDEFYKGTIAEQIAQEMQKNGGLITKEDLAAYKAVERTPISGDYRGYQVYSMPPPSSGGIHIVQILNILENFDMKKYGFGSADAMQIMAEAEKYAYADRSEYLGDPDFVKVPWQALTNKAYAKS

SEQ ID NO: 59566 - protein, 534 aa, Phytophthora medicaginis
ELVGMLNTAKIPADVEVVVAPSQVHAATVKASLRADVRVSGQDVWKQGNGAFTGETSAEMLKDLGAEYTLVGHSERREKGETNDIVAKKAAYALEKGLAVIACIGESKETREANETVAYITEQLNAYAAEIKDWTNVVIAYEPIWAIGTGLTASPEQAQDVHASIRAWLKEKVSPEAAEKTRVIYGGSVGAKNAPELSQKEDIDGFLVGGASLKPDFLQIINAQNPTENVGGAVNVAINGFGRIGRLVLRAAAKNPLINIVAINDPFISTTYMEYMLEYDTVHGKFDGALSHDEQHIFVNGKPIRVFNEMNPSNIKWGEEQVQYVVESTGAFTTLEKASTHLQNGVEKVVISAPSSDAPMFVMGVNHELYEKNMHVVSNASCTTNCLAPLAKVVNDKFGIKEGLMTTVHAVTATQKTVDGPSKKDWRGGRGACFNIIPSSTGAAKAVGKVIPSLNGKLTGMSFRVPTADVSVVDLTARLVNPASYDEIKAAIKDASENEMKGILGYTEKAVVSSDFIGDSHSSIFDASAGIALT

SEQ ID NO: 59567 - protein, 659 aa, Magnetococcus sp. MC-1
MLHLEKVEKRYGATIILSGTDLVIHPGEKVGLIGLNGMGKTTLFRIIEEVEPLDGGRLDRHPPHMRIGVLRQELTPAHRSILQETLGGLPQLVALNNEREALHSKMVEHPEHDAYHQWVMRLGEVDHALEDLDAYSAEARAGAILLGLGFSTADLEKPLDAFSGGWRMRVALAQLLFSAPDLMLLDEPTNHLDLESVAWLERYLAGLSGAYMLISHDRDFLQRTTRVTVELEDGKLTRYKGSFDAYMNWKIEQAELLSKQAAKQADKLEAMQRFISRFRAKATKAKQVQSRVKQMEKLEAQKVELPGQGRSAPVIRLPDPPPCASQVMKIDKMSMAYGSTQVFKNCQLEISKGSRIGLLGPNGRGKSTLLKLLCGALQPTAGVVMPGDRVKPGFFAQHALESLRLGDTILESAREVAPPGTTETQLRTVLGGLLFSGQRVEKLVSVLSGGEKARLALARLFLSGANFLLLDEPTNHLDMPSRAALEEALESYQGTFVLVSHDRSLLESVCDRYVAIAQDQLHPLGEDLDHYLEHFVLQETASQPNGVQDKTTARALSKESKREAAQIRNALHQRTKPLRSQLNQCEKNIQQLEADKTRIDATLTDSSLYEEGQKERLKNLLESSTQTEQALSKAWALWETLSMEIETLEEQAKQALEQA

SEQ ID NO: 59568 - protein, 267 aa, Pasteurella multocida subsp. multocida str. Pm70
MAIPLRTEDEIVKLREACKLASDVLVMIEPYVKAGVSTGELDRICHEYMVNEQKTISACLGYHGFPKATCISVNEVVCHGIPSDDKILKHGDIVNIDVTVIKDGYFGDNSKMYIVGETNVRSQKLCEAAQEALYVGLRTVKPGIRLNEIGRAIQTYTENQGFSVVREYCGHGIGSEFHCEPQVLHYYADDGGVILQPGMVFTIEPMINAGKKEVRLMGDGWTVKTKDRSHSAQYEHQLVVTETGCEVMTIREEEVAAGRIQRIMVNV

SEQ ID NO: 59569 - protein, 535 aa, Phytophthora colocasiae
IPANVEVVVAPSQVHAATVKASLRSDVRVSGQDVWKQGNGAFTGETSAEMLKDLGAEYTLVGHSERREKGETNEVVAKKAAYALEKGLGVIACIGETKELREANKTVAYITEQLDAYATEIKDWTNVVIAYEPIWAIGTGLTASPEQAQEVHASIRAWLKEKVSPEAAEKTRVIYGGSVGAKNAPELSQKEDIDGFLVGGASLKPDFLQIINAQNPTDNVGGAVNVAINGFGRIGRLVLRAAATNPLINIVAINDPFISTTYMEYMLEYDTVHGKFAGSLSHDEKHIFVNGKPIRVFNEMNPANIKWGEEQVQYVVESTGAFTTTEKASAHLQNGVEKVVISAPSSDAPMFVMGVNHELYEKNMHVVSNASCTTNCLAPLAKVVNDKFGIKEGLMTTVHAVTATQKTVDGPSKKDWRGGRGACFNIIPSSTGAAKAVGKVIPSLNGKLTGMSFRVPTADVSVVDLTARLVNPASYDEIKAAIKSASENEMKGILGYTEKAVVSSDFIGDSHSSIFDASAGIALTDDFVKLVSWYD

SEQ ID NO: 59570 - protein, 479 aa, Acinetobacter baumannii
MTTARHSDTENSPDHLQRKLSNRHLQLIAIGGAIGTGLFMGSGKTISLAGPSILFIYMIIGGMFFFLMRAMGELLLANLHYKSFVDMAHDLIGPWAGYYLGWTYWLGWVLVGIADLSAVINYLSFWLPDGASFSPIQQAMISAGCVLFVMGLNLLTVRLFGEIEFWFALIKILAIIGLIGVGGYMIFSHFQAPQGAVASISNVWSHGGLFPKGTEGFLAGFQIAVFAFVGVELVGTTAAETKDPQKNLPKAINAIPVRIILFYVLALFIVMSVTPWDHIRADKSPFVELFLNAGIPVSAIIMNLVVLSSVMSSMNSGVFSTSRMLFGLSKDGQAPGAFGRLSKRAVPSNGLIFSCTFIMGGAVLQYFVPNTMEAFTLASSLCVILFISVWSLIMVCYLRYRKLRPELHEKSTFKMPGGIWMSYVVLAFMLFTLVILALEPDTLKALYVSPVWLIILGVTYHVLYKPRMKRLGRELVNDH

SEQ ID NO: 59571 - protein, 522 aa, Phytophthora botryosa
SNVEVVVAPSQVHAATVKASLRSDVRVSGQDVWKQGNGAFTGETSAEMLKDLGAEYTLVGHSERREKGETNEVVAKKAAYALEKGLGVIACIGETKELREANKTVAYITEQLDAYAAEIKDWTNVVIAYEPIWAIGTGLTASPEQAQEVHASIRAWLKEKVSPEAAEKTRVIYGGSVGAKNAPELSQKEDIDGFLVGGASLKPDFLQIINAQNPTDNVGGAVNVAINGFGRIGRLVLRAAATNPLINIVAINDPFISTTYMEYMLEYDTVHGKFAGSLSHDEKHIFVNGKPIRVFNEMNPANIKWGEEQVQYVVESTGAFTTTEKASAHLQNGVEKVVISAPSSDAPMFVMGVNHELYEKNMHVVSNASCTTNCLAPLAKVVNDKFGIKEGLMTTVHAVTATQKTVDGPSKKDWRGGRGACFNIIPSSTGAAKAVGKVIPSLNGKLTGMSFRVPTADVSVVDLTARLVNPASYDEIKAAIKSASENEMKGILGYTEKAVVSSDFIGDSHSSIFDASAGIALT

SEQ ID NO: 59572 - protein, 384 aa, Ashbya gossypii ATCC 10895
MEIYVRLNDDLERDYAFQIEKDDTFESKLMKLFDRKEGLARYMVLRPSVFYKDVPRGLCKSTHPGFLTEQGCLLFDYNANKEQHLQPLELREKKVWEQMWPGQLVVPQYEKSWATILGFAALMLAWLYTDLPDVVSPTPGICFTNQLSRMFMYLAQTHGYPHVAAKLAEEIQVNSTGLLAQWLFFTLHVVKVALIALFFYSGLINPISLNPVKVYSARQAFTAGSNKELAEVLRSFGWIGAKRATYDDYRDTYYQAAIDKAGGTVAAYKSGILKKASDPGVALSAGEGFQTPLENRFRENTFKTMEERRKFVLSEDYFVQLEKDLKNNIEKCNGDVAKVNAEIRRFRKFGFFDAGEELQRLVQLRKEVVPSRESNEDKKEKKTI

SEQ ID NO: 59573 - protein, 141 aa, Frankia sp. EAN1pec
MVETVGDTRLGISIPEQDDPRGPARRLAALFDPGAFTPAPGGVVSRVLVGRGTLGTVPAIAFCTDGTTMGGALGGAGLGEGVEALDGIGQIFAATVRASGRIPQISVVLGPAAGGAAYGPALTDVVIMAPAGRVPHGDIPL

SEQ ID NO: 59574 - protein, 544 aa, Phytophthora inundata
LVGMLNTAKIPANVEVVVAPSQVHAATVKASLRADVRVSGQDVWTQGNGAFTGETSAEMLKDLGAEYTLVGHSERRGKGESNVDVAKKAAYALEKGLGVIACIGESKETREANETVAFITKQLDAYAAEINDWTNVVIAYEPIWAIGTGLTASPEQAQEVHASIRAWLKEKISPEAAEKTRVIYGGSVGAKNAPELSQKEDIDGFLVGGASLKPDFLQIINAQNPTTNVGGAVNVAINGFGRIGRLVLRAAATNPLINIVAINDPFISTTYMEYMLEYDTVHGKFGGSLSHDEKHIIVNGKPIRVFNEMKPENIKWGEEQVQYVVESTGAFKTIETASAHMKNGVEKVVISAPSADAPMFVMGVNHELYEKNMHVVSNASCTTNCLAPLAKVVNDKFGIKEGLMTTVHSVTASQKTVDGPSKKDWRGGRGACFNIIPSSTGAAKAVGKVIPSLNGKLTGMSFRVPTADVSVVDLTARLVNPASYDEIKAAIKSASENEMKGILGYSEKAVVSSDFIGDSHSSIFDANAGIALTDDFVKLVSWYD

SEQ ID NO: 59575 - protein, 382 aa, Gibberella zeae PH-1
MSQIKTFRILVLPGDHVGPEIMTEALKVLDVIEASRPDIHFERDVDICGGCSIDKYGTPITESVLEKAVASDAVLFGSIGGPEWAGAEPTPESGLLRLRQRLDAFANLRPCEILVPSLVSASPIKPELVAGTKFIVVRENCGGAYFGKKEESEDEASDLWIYSRSEVERLARVSAAVARILHAGSEKANNGSKPVVWSADKANVLASGRLWRRATTNIFNRELTDIDLKHQLADSLAMLMVLDPKRFNNSVIHTDNTFGDVLSDISGGITGTLGVLPSASLAGVPGEGSCKGIYEPVHGSAPDISGKNLANPVAQILSLAMMLRYSFLLEKEADAIEQAVAKVLDTKDGGGLEIRTKDLGGSAMCSEVGDAVCKVLGDMLET

SEQ ID NO: 59576 - protein, 546 aa, Phytophthora cinnamomi
QELVGMLNTAKIPAGVEVVVAPSQVHAATVKAALRPDVRVSGQDVWKQGNGAFTGETSAEMLKDLGAEYTLVGHSERREKGETNEVVAKKAAYALEKGLAVIACIGETKEHREAGQTVAFITEQLDAYAAEIKDWTNVVIAYEPIWAIGTGLTASPEQAQDVHASIRAWLKEKVSPEAADKTRVIYGGSVGAKNAPELSQKADIDGFLVGGASLKPDFLQIINAQNPTANVGGAVNVAINGFGRIGRLVLRAAAKNPLINIVAINDPFISTTYMEYMLEYDTVHGKFDGTLSHDEQHIFVNGKPIRVFNEMNPANIKWGEEQVQYVVESTGAFTTTEKASAHLQNGVEKVVISAPSSDAPMFVMGVNHELYEKDMHVVSNASCTTNCLAPLAKVVHDKFGIKEGLMTTVHAVTATQKTVDGPSKKDWRGGRGACFNIIPSSTGAAKAVGKVIPDLNGKLTGMSFRVPTADVSVVDLTARLVNPASYDEIKAAIKSASENEMKGILGYTEKAVVSSDFVGDSHSSIFDASAGIALTDDFVKLVSWYD

SEQ ID NO: 59577 - protein, 499 aa, Gibberella zeae PH-1
MANPFQRPFQLENESLFHCTSLINGDFVSAKEGKTFNVVDPGSGKTWASCPDCTASDVDSAVASSYETFKTYSKTTPRFRAQTLMKWHNLILAAREDLARILVHETGKTLVEARGEIDYALTFVWWFSGEADRAHGTSMSCAIPGRRAVTIKQPIGVAAALVPWNFPIALALRKAAAALAAGCTMVVKPSPETPLTCVSIAHLALEAGFPRGALNVVTTSLENTPTVAEALCLDARVKKVSFTGSTRVGKIIASFCAPNLKKTTFELGGNCPFIVFDDADVGQAVSQLMPLKWRHAGQACITSNRVFVHSSIYDTFVEKVVQETRGLKLGHGMEEGSTMGALTTPRGLDKAEELYQDAISKGAKTVLGTGKREEGQGYFMAPTILTEMEDDMLMTHEEIFAPVLGFYRFESEEEVVQRANDTPLGLASYIFTKNVDRLWRLFENLDAGMIGLNAGNSSSAEAPFGGIKDSGHGKESGKDVAIDEFLITKTATLTIDGHY

SEQ ID NO: 59578 - protein, 472 aa, Methanococcoides burtonii DSM 6242
MSDKLQKIIEERGPIKKIGVLGMGYVGIPAAALFADVDKFEKVLGFQRNSASSGYKIDMINAGESPLKGEEPGLEDLLRKVTGSNKFECTPDFSRIAEMDAVTLAIQTPFENPTDLIPDFGALIEGIRNVGRYLTPGTLVVLESTITPGTTNGMAKEILEEESGLIAGEDFALAHAPERVMVGRLLRNIQEHDRIVGGIDNTSTERAIELYSPVLTKGKIIPMTSTAAEVTKTAENTFRDLQIAAANQLALYCESMGINFYDVRAGIDSLKGEGITRAILYPGAGVGGHCLTKDTYHLERGIEIAGKTPLDYPENADSIYVLARKVNDFMPNHMFKLTEDALASVGKSVKGSKIAMLGWAFINDSDDARNPPSEPLYDLLIEAGAEVRIHDPHVLDYPNVTIEKDLNAVVDGADVIAILTGHSDYFKLNPADIKTTMGKDKPVIIDGRNVVDPTKFIDSGFVYRGIGRGDVN

SEQ ID NO: 59579 - protein, 379 aa, Zea mays
MSKKVGRAKKAAGGGELSRFLESHLQTISDTFQMMAESAPGALERTEWSEVVKLGDQVSRQATVAGMLWSGDLPDVETLKENIVAYFNILQGFLLVCHGSMVGAGPTLHKSIFGSAKDVVDSSFSLFKHAVSAYESRSSDRNTTIPQVTGTVWEACAALKKVPASNCIAIGRAMTRIGVCLKDVLREMNELPIGGSGDSTAEKSSNGVVDTTSCSDRDERSDLDLDDDDDDDDDEFTEEEVAVAKLVINVVSDSLVVVKEAIRFITGLLRSSGNKDKDGANEDRVEPMEKLLSHCKEIADQVNDLGASVYPPQDSSEMELAIKRLYNGINGMRKEIGNLGGAPESTFAALEGFENCLGSLRARLADDVVNEMEGLNISH

SEQ ID NO: 59580 - protein, 807 aa, Oryza sativa
MSVLLGFLLLLSLHPPTSYATTDTVSPGQTLAGGDRLISNNSKFALGFFKMDSKNSSYTSRNSYLCIWYNKLPMITPLWSANGENPVVDPASPELTISGDGNMVIMDQATKSIIWSTRVNTTTNGTVVVLLNDGNLVLQSSSNSSMVFWQSFDYPTDSLFADAKIGWNKVTGLNRRLVSRKNSIDQAAGLYSLEFDINGVGHLVWNSTVTYWSSGDWNGQFFGSAPEMFGATIPNFTFVNNDREVYLTYTLNNEKAITHAAIDVNGQGLAGVWLDSLQDWLINYRMPLLHCDVYAICGPFTVCNDNNDPFCDCMKGFSIRSPKDWEIEDRTGGCMRNTPLNCGSTMNKTGFSDKFYYVQNIILPRNAMHVQEAASKDECSDVCLSNCSCTAYSYGKGGCSVWHDELYNVRQQSDASAVGNGDNFYIRLAANEVHEVQSAERKKKSGVIIGVAIGASTAAFCLMILLLMFWRRKGKLFARGAENDQGSIGITAFRYIDLQRATKNFSEKLGGGSFGSVFKGYLNESTPIAAKRLDGTCQGEKQFRAEVDSIGMIQLINLVKLIGLCCEGDKKLLVYEYMPNGSLDVQLFKDNDKVLDWNLRYQIAIGVARGLAYLHDSCRDCIIHCDIKPENILLNESFVPKIADFGMAKILGREFSHALTTMRGTIGYLAPEWISGTVVTAKVDVYSYGMVLFEILSGRRNSSQEYFKDGDHSAYFPMQVARQLINGGIGNLVDAKLHGDVNLEEAERVCKIACWCIQDSEFDRPTMGEVVQFLEGVLELKMPPLPRLLNAITGGSHSTPLSSLDLP

SEQ ID NO: 59581 - protein, 311 aa, Clostridium thermocellum ATCC 27405
MNPYKRIALKALSHWGRNLKKNYRVYRRFTNVVSVCTGHGCRIADLEVAAGDRNIPVRLFHPDDPALGVLIFFHGGGWVTGNVDSYTHVCSNMANQTKNIVVSVDYRLAPEHPFPSGLEDCYDATREFFKNPGLLNCKADDITLIGDSAGGNLAAAVSLMARDRGEFLPKRQILIYPSTYNDHSENSPFPSIRENGTGYLLTSEEIQNYMDMYAPNIEDRQSPYLAPLLARDLSNQPDTLIITAEYDPLRDEGEAYGMRLKEYGNNVKMYRIKGALHGFFSIPWKSQHVSRSFEIINWFLNSYNGQSEELL

SEQ ID NO: 59582 - protein, 519 aa, Triticum aestivum
  misc_feature (417)..(417): Xaa can be any naturally occurring amino acid
  misc_feature (432)..(432): Xaa can be any naturally occurring amino acid
  misc_feature (441)..(441): Xaa can be any naturally occurring amino acid
  misc_feature (453)..(453): Xaa can be any naturally occurring amino acid
  misc_feature (474)..(474): Xaa can be any naturally occurring amino acid
  misc_feature (476)..(476): Xaa can be any naturally occurring amino acid
MVLSHAASAGSSDDSVHSTFASRYVRASLPRFRMPENSIPKEAAYQIINDELMLDGNPRLNLASFVTTWMEPECNKLMMDSINKNYVDMDEYPVTTELQNRCVNMIAHLFNAPLGETETAVGVGTVGSSEAIMLAGLAFKRRWQNKMKAAGKPCDKPNIVTGANVQVCWEKFARYFEVELKEVKLSEGYYVMDPEKAVEMVDENTICVAAILGSTLNGEFEDVKMLNDLLVKKNEETGWDTPIHVDAASGGFIAPFLYPELEWDFRLPLVKSINVSGHKYGLVYAGIGWCIWRSKEDLPDELIFHINYLGADQPTFTLNFSKGSSQVIAQYYQLIRLGFEGYRNIMDNCQENAMVLKEGLERTGRFNIVSKDQGVPLVAFSLKDSSRHDEFEISEFLRPLSAGFVPAYTMPPNAQHXTVLRVVIREDFNRTXAERLLIDIXKCSTTRPLPSRXNGARPAHPTANCEREGLASNXVXSLWKKASRKKKTRVLTWHRSHLHMVNPISIPAVFKTFHNYKVS

SEQ ID NO: 59583 - protein, 532 aa, Oryza sativa
MADEATTTPLLASYKAKPAKAPSIDDAIETYIGATGAGQLFKAILLAFAWAFDAQQVFISVFTDAEPRWHCTAGADPSCSPGAASPCALPPGAWAWDRPAETSVVSEWALKCAGPALVSLPASSFFAGCLAGGFLLTTLADSLLGRRKMLLVSLASMSVAGVLTAFSPNVWAYAALRFVCGFGRSMVGTCALVLSTELVGKRWRDTVSVAGFVCFTVGFLSLPALAYTFREASWRTMYLWTSLPSLGYAILLYFLVQESPRWLLVRGRKHDAIETVRQIAALNGGGGITCSFSMLHACATEREDDAAGGAGGGGGGVFATLRSMWERRWALRRLAAIMTASFGVGMVYYGMPLNVGNLGSNLYLSVTYNALAEFPSSVLSWLLMGRINRRSSVVALTAAAGVCSLACVAIPEGTGGRMAAEVLSFFATCTAFNIILMYSIELFPTSVRNSAVGMVRQALVLGGVAAPMLVALGRERSFWSFGVFGLAVGCLGLFAVCLPETRGRSMSDTMEEEEHKEAAAAIGDMDSNADLV

SEQ ID NO: 59584 - protein, 195 aa, Brassica napus
SKLFADSKGYLVDDDGFDYMKLAFLREIKSQQRSLRDYSKTYARAKYFDEVKPWNERCDVAFPCASQNEVDQADAINLVNAGCRLLVEGSNMPCTAEAVDVFRKANVLIAPAIAAGAGGVAAGEIEVLRESNSMQWSAEDFESRLQEALKQTYEKALKAANDFGYQKESPEALLHGATIAAFLNIAQAMTDQGCV

SEQ ID NO: 59585 - protein, 467 aa, Rhodopseudomonas palustris CGA009
MATYDLVVIGTGPGGYVCAIRAAQLGLKVAVVEKNATLGGTCLNVGCMPSKALLHASELFEEAGHSFAKMGIGVSAPKLDLPAMMNFKQQGIDGNVKGVEYLMKKNKIDVLVGKGKILGTGKVEVTGADGKATSVEAKSIVIASGSAVAQLKGIEIDEKRVVSSTGALSLDKVPGKLIVVGAGVIGLELGSVWRRLGAEVTVVEFLDRILPGMDGEVVKQFQRILEKQGFAFKLGAKVTGVDTSGAKLAVKVEAAAGGNPETLEADVVLVAIGRVPYTEGLGLKEAGVALDERGRVVIDDHFATSLKGVYAIGDVVRGPMLAHKAEDEGVAVAELIAGKAGHVNYDVIPGVVYTTPEVSSVGKTEEDLKQAGVAYTVGKFPFTANGRSKVNQTTDGFVKILADAKTDRVLGVHIIGREAGEMIHEAAVLMEFGGSAEDLARTCHAHPTRSEAIKEAALTVGKRAIHM

SEQ ID NO: 59586 - protein, 393 aa, marine gamma proteobacterium HTCC2143
MSMAAVMNTYGRLPVSFTHGKGVYLYDEEGNQYIDAISGIGVNALGHAHPAVSDAIKKQADLLIHTSNLYGVENQKQLAEALCAVSGMDNVFFGNSGAEANEAAIKIARLYGHNKGVDQPHIVVMENAFHGRTMATLTASGSRKIQAGFEPLVNGFVRAPYGDIDALTNIAKNNPNIVAVLMEPLQGEGGVNCLPENHLAEIRALCDKNDWLMMLDEVQTGNGRTGCYFAYQHHHILPDVVTTAKGLGNGLPIGACLAHGKAATVLGPGNHGSTYGGNPLVCAAALVVVNTINQQQLCKNAQQMGALLLDKFNRAFEHNEAVTDIRGQGLMIGIELVRPCGELVDRARAKGVLINVTAGSVVRLLPPLIINPSQTEQLATVVIDIINDFIGNS

SEQ ID NO: 59587 - protein, 301 aa, marine gamma proteobacterium HTCC2143
MAIKHFLTLLDLSPAELASLITRAIELKAELAAGGHNEPFKNKVLGMVFEKSSTRTRVSFEAGMAQFGGHAIFLSPRDTQLGRGEPVEDSARVLSAMVDVIMIRTFGHEIIERFAKHSKVPVINALTDDYHPCQLLADIQTYVEHRGSIQGKTVSWIGDGNNMCQSYINAAKQFDFELRIACPKGFEPNAELVAANKDRVSIIRDPKLAAKDSHLLVTDVWASMGQEDQQAQRIQAFSGFQINEELLSYADSKALYMHCLPAHREEEISTGLMERPDTVIWEEAENRLHAQKALMELLLTQ

SEQ ID NO: 59588 - protein, 467 aa, Bartonella quintana str. Toulouse
MIPPLNSFDDLGLSEKVIKAVKSAGYTAPTPIQSGTIPYVLQRKDVLGIAQTGTGKTASFVLPMLTLLEKGRARARMPRTLILEPTRELAAQVEENFDKYGINHRLNVALLIGGVSFEHQDRKLERGADVLIATPGRLLDHFERGKLLLMGVEILVIDEADRMLDMGFIPDIERICKLTPFTRQTLFFSATMAPEITKLTKQFLHFPVTVEVTKASSTATTITQQLVKSGNKSWDKRAVLRELIHNEGDELKNAIIFCNRKRDISELFRSLVRHNFSVGALHGDMDQYSRMSTLADFKDNKLTLLVASDVAARGLDIPAVSHVFNYDVPTHAEDYIHRIGRTGRANRSGKAFTIVTKADQKYISAIEEMSNEKIEWLNGDLSTLTTDDQTDDILGKRQSPKLSKKISQKGRAIHTKKPLKDDKVGYIKTTNNNANPPEQHHHRKNKSYIPPGFGDDIPAFMLIKMRT

SEQ ID NO: 59589 - protein, 417 aa, Rhodopseudomonas palustris CGA009
MTEIRVPTLGESVTEATIGRWFKKPGEAVAVDEPLVELETDKVTIEVPAPSAGTLGEIVAKDGETVAVGALLGQITDGAAPAKPAAAAPAKAAAPAAAPAPAAPAPAAAPAAKAPPSDAPLAPSVRRLSTESGVDASTVPGSGKDGRVTKGDMLAAIEKAASAPTPVNQPAAAVQVRGPSPADDAAREERVKMTRLRQTIARRLKEVQNTAAMLTTFNEVDMTNVMALRAQYKDVFEKKHGAKLGFMGFFTKACVQALKDIPAVNAEMDGTDLIYKNYYHIGVAVGTDKGLVVPVVRDCDEKSIADIEKSIVDYGKRARDGQLKIEEMQGGTFTITNGGIYGSLMSTPILNAPQSGILGMHKIQERPVVIGGKIEVRPMMYLALSYDHRVIDGKEAVTFLVRVKESLEDPARLVLDL

SEQ ID NO: 59590 - protein, 476 aa, Acinetobacter baumannii
MTMVHHSDEASSPDHLQRKLSNRHLQLIAIGGAIGTGLFMGSGKTISLAGPSILVIYMLIGGMFFFLMRALGELLLANLHYKSFVDMAYDLIGPWAGYYIGWTYWLGWVLVGIADLSAVINYLSFWLPEGASFSPMQQAMISAGCVLFVLGLNLLTVKLFGEVEFWFALIKILAIIGLIGVGGYMILTHFQAPHGDVVSISNVWSHGGLFPKGVSGFLAGFQIAVFAFIGVELIGTTAAETKDPQTNLPKAINAIPVRIILFYVLALFVVMSVTPWNHIRADKSPFVELFLNAGIPISAIIMNLVVLSSVMSSMNSGVFSTSRMLFGLSKDGQAPSVLGRLSKRAVPSNGLIFSCIFIMGGAVLQYFVPNTMEAFTLASSLCVILFISVWILIMACYLRYRKIRPELHAASTFKMPGGVLMAYAVIAFFLFTLVILALEPDTLKALYVSPVWLVVLSVTYYAFYKPRMRKLGQEIF

SEQ ID NO: 59591 - protein, 398 aa, Rhodopseudomonas palustris CGA009
MNIHEYQAKAVLREFGVPVGHGFPIFKASEAEAAAKQLGGPVWVVKSQIHAGGRGKGKFKEASAGDKGGVRLAKSIDEVKEFAKQMLGATLVTVQTGADGKQVNRLYIEEGSDIDKEFYLSLLVDRATSRISFVVSTEGGMSIEDVAHETPEKIVSFTVDPATGIMGHHGRTVAKALNLKGEQAKQAEAMVAKLYTAFVAKDMDMLEINPLVLTKQGDLKCLDAKISFDGNALYRHTDIQALRDETEEDAKEIEASKYDLNYVTLDGTIGCMVNGAGLAMATMDIIKLYGMSPANFLDVGGGASKEKVTAAFKIITADPNVKGILINIFGGIMKCDVIAEGVVAAVKEVGLDVPLVVRLEGTNVEAGKKIIKHSGLNVLPADNLDDAAQKIVAAVKGA

SEQ ID NO: 59592 - protein, 526 aa, Gibberella zeae PH-1
MGLLQELAGHPLAQQFQELPLGQQVGIGFAVFLVLSVVLNVLNQLLFRNPNEPPMVFHWFPFVGSTITYGMDPPTFFRENRAKHGDVFTFILLGKKTTVAVGPAGNDFILNGKLKDVCAEEIYTVLTTPVFGKDVVYDCPNAKLMEQKKFMKIALTTEAFRSYVPIISSEVRDYFKRSPDFKGKSGIADIPKKMAEITIFTASHALQGSAIRSKFDESLAALYHDLDMGFTPINFMLHWAPLPWNRKRDHAQRTVAKIYMDTIKERRAKGNNESEHDMMKHLMNSTYKNGIRVPDHEVAHMMIALLMAGQHSSSSTSSWIMLRLAQYPHIMEELYQEQVKNLGADLPPLTYEDLAKLPLNQAIVKETLRLHAPIHSIMRAVKSPMPVPGTKYVIPTSHTLLAAPGVSATDSAFFPNPDEWDPHRWEADSPNFPRMASKGEDEEKIDYGYGLVSKGSASPYLPFGAGRHRCIGEHFANAQLQTIVAEVVREFKFRNVDGGHTLIDTDYASLFSRPLEPANIHWERRQ

SEQ ID NO: 59593 - protein, 463 aa, Bartonella quintana str. Toulouse
MGSFDFDLFVIGSGSGGVRAARLAGGLGKRVGIAEEYRIGGTCVIRGCVPKKLYVYASQYAQEFKKSVGFGWEYADPIFSWKKLVAAKNKEISRLEELYRKGLQNNNVHIYESRAVFVDEHTLELSVTGERISAEKILIATGAKIVPNTAIKGSDLCLTSNEIFDLEKLPKSIIIVGGGYIGVEFANIFHELGVKTTLLHRGNLILRNFDYDLRQLLNDAMIEKGISILYGASISQVQAIGSSYNIVLSSGQMISADQVMFATGRVPNTTGLGLEQAGVKLNEFGAVIVDERMTTNIPHIGAVGDVTGHIQLTPVAIHDAMCFVKTVFENTPTKPDYDLITTAVFSQPEIGTVGLSEEDAARRYKHLEIYRTVFRPMRNVLAGSSEKMFMKLVVDSESRIVVGAHILGENAGEMAQLIGISLKGKLTKDIFDETMAVHPTMAEELVTMYKPSYLYENGEKVEK

SEQ ID NO: 59594 - protein, 571 aa, Bradyrhizobium japonicum USDA 110
MFSLAAMCHCPRASPNAELFKSAPPSQVHRSQDQRRQTQDRIMPHQFSLAQTVRKPAVKTKGGIVAAQSRRAAEVGAQVLAAGGDCVDAIVATTMALNVLEPWNSGIGGGGAMVLYRARENRTEVIDYGMCAPQSLRVADYPLSGEGAASDLFPWPRVKDDRNIHGPGAIAVPGVVAGMEEAHRRHAKLPWKDLVAPAAALAGEGLLADWWTTLTIASSAADLRRYPASAAAFLKDGLPPTAPWGIKSETRLSQDKLKATLSHLAEAGPRDFYQGDLAKSIASDIKADGGSLSVEDLAAFRAHLREPLAIPYRGGKVFATPELTAGPTLAHALRLLQQNLKPAGAPDAATYAEYALALQAAYRERLKDMGDADGKRSLGAEYLAPACTTHFSVVDRHGNVAAVTQTLLSSFGSKYVTPHTGIAMNNGIMWFDPTPGTTNSLAPGKRCLTNYTPVIAETRDGKRLAIGASGGRRILPAVMQLASFAMDFGMDLDAAIHQPRIDASEGAVVIGDVRLPADTRKALAARFDYEESRVQALPQKFACPSVVMREGEVNFGAVEIFQPWADAVAEA

SEQ ID NO: 59595 - protein, 138 aa, Oryza sativa Japonica Group
MAERELIDRDKLVLIDLQFHGFHGVKSEEKTLGQKFVVDVDAWMDLSVAGETDSISDTVSYTDIYGIAKDVVEGPSRNLLEAVAHRIASNALLKFPQISTIRVKVGKPHVAVRGIVDYLGVEILRHRKDVGGDRQELH

SEQ ID NO: 59596 - protein, 200 aa, Haemophilus somnus 2336
MVLVTRQAPDFTAAAVLGNGEIVEKFNLKQHIAGKAAVVFFYPMDFTFVCPSELIAFDHRYKEFQDRNVEIIGVSIDSEFTHNAWRNTPVDNGGIGQVQYALVADIKHDIAKAYGIEHPEAGVALRASFLIDKEGVVRHQVVNDLPLGRNIDEMLRMVDALQFHEEHGEVCPAQWEKGKEGMTGSPEGVAKYLKQNADKL

SEQ ID NO: 59597 - protein, 234 aa, Bartonella quintana str. Toulouse
MNVQQLKKRAAAKALEFVQDDMRLGIGTGSTANEFIRLLGERVADGLRVTGVATSQYSEQLCRKFGVPVTTLEQMPELDLDIDGADEIGPEMTLIKGGGGALWREKIVAAASRAMLVIADETKVVKTLGAFALPIEVNPFGMPATRRLIEKVADDLGLSGEIILRMNGENPFKTDGGHFIFDAFWGCILQPRLLSEALLAIPGVVEHGLFWGLASRAIVAMADGQIKVLESSDF

SEQ ID NO: 59598 - protein, 429 aa, Hydrogenobacter thermophilus
MNLYEYEAYDKIFKKYGIPTPEYMFESSVSDRLVEFVNQLGECVVKSQVLVGKRGKAGAVKVCSDPQSAIETAQALLNYPVYGEMPVGVLVARKVNILKELYASITYSTEVRAPVLTLSLEGGMDIEEVPPEKVRSWTINPLKGLYPHMVRNYLLELGFPQEYMGILRELSEVVSNMYRAFWEAEARLLEINPLAICDVNGKLKVYALDAVVTIDDDASVPPSKIYGVRTAMKRPPTEREIEASLIDRDDHRGKAGSYVEVDGDIAMMTFGGGGSTVTIETTYAIGLKPANFTDIGGNPPAEKMYKITKIILSKPGIRGVLVCGGTANNTRIDVTLGEGVANAIRDLYKEGKLNPDWIWVVRRNGPEAEKGLRMLYEAFKECKVKGEIYDSSLPLTEAPIRLKELLDICTSAQSEDRHLTEEQAKDMGI

SEQ ID NO: 59599 - protein, 103 aa, Oryza sativa Indica Group
MWPQSNASPPTGNGPGLRPAEQGVEEEAGRPLPKFGEWDVNDPASADGFTVIFNKARDEKKGGNGQDTDSPCKETRTERVESYAPKTNSKKWFCCVTSSPTQS

SEQ ID NO: 59600 - protein, 541 aa, Phytophthora tentaculata
QELVGMLNTAKIPANVEVVVAPSQVHAATVKASLRSDVHVSGQDVWKQGNGAFTGETSAEMLKDLGAEYTLVGHSERREKGETNEIVAKKAAYALEKGLGVIACLGETKELREANQTVAYITEQLDAYAAEIKDWTNVVIAYEPIWAIGTGLTASPEQAQEVHASIRAWLKEKVSPEAAEKTRVIYGGSVGAKNAPELSQKEDIDGFLVGGASLKADFLQIINAQNPTTNVGGAVNVAINGFGRIGRLVLRAAAKNPLINIVAINDPFISTTYMEYMLEYDTVHGKFDGSLSHDEKHIFVNGKPIRVFNEMNPENIKWGEEQVQYVVESTGAFTTLEKASAHMKNGVEKVVISAPSSDAPMFVMGVNHELYEKNMHVVSNASCTTNCLAPLAKVVNDKFGIKEGLMTTVHAVTATQKTVDGPSKKDWRGGRGACFNIIPSSTGAAKAVGKVIPSLNGKLTGMSFRVPTADVSVVDLTARLVNPASYEEIKAAIKNASENEMKGILGYTEKAVVSSDFIGDSHSSIFDASAGIALTDDFVKL

SEQ ID NO: 59601 - protein, 535 aa, Phytophthora nicotianae
  misc_feature (480)..(480): Xaa can be any naturally occurring amino acid
ELVGMLNTAKIPADVEVVVAPSQVHAATVKASLRADVRVSGQDVWKQGNGAFTGETSAEMLKDLGAEYTLVGHSERREKGETNEIVAKKAAYALEKGLGVIACIGETKEHREANQTVTYITEQLDAYAAEIKDWTNVVIAYEPIWAIGTGLTASPEQAQEVHASIRAWLKEKVSPDAADKTRVIYGGSVGAKNAPELSQKEDIDGFLVGGASLKPDFLHIINAQNPTTNVGGAVNVAINGFGRIGRLVLRAAAKNPLINIVAINDPFISTTYMEYMLEYDTVHGKFDGSLSHDEKHIFVNGKPIRVFNEMNPANIKWGEEQVQYVVESTGAFTTLEKASAHMKNGVEKVVISAPSSDAPMFVMGVNHELYEKNMHVVSNASCTTNCLAPLAKVVNDKFGIKEGLMTTVHAVTATQKTVDGPSKKDWRGGRGACFNIIPSSTGAAKAVGKVIPSLNGKLTGMSFRVPTADVSVVDLTARLXNPASYDEIKAAIKSASENEMKGILGYTEKAVVSSDFIGDSHSSIFDAEAGIALTD

SEQ ID NO: 59602 - protein, 341 aa, Xanthomonas axonopodis pv. citri str. 306
MSDLTHKIAVLGAGSWGTALAALLARHGHPTVLWGRDAAMVDTIDRTHENARYLPGIALPDSLRATTDLQAAVADATWILVVVPSHAFTETIRLIAPLRPPGAGVAWATKGFEPGSGRFLHEVARDILGPSVPLAVVTGPSFAKEVTLGLPTAITVHGDDAAFAQVVADAMHGPTFRAYTGDDMVGAELGGAMKNVLAVATGVADGMQLGLNARAGLITRGLNEMLRLAAVIGARPETLMGLAGLGDLVLTCTGDLSRNRRLGLALGRGQSLDEAIREIGQVVESVQTADEVMRQAEHHGIELPISNAVRAVLHGEITPEAGLKELLARERKPEYPQTLFT

SEQ ID NO: 59603 - protein, 498 aa, Brucea javanica
  misc_feature (305)..(305): Xaa can be any naturally occurring amino acid
MRINPNTFGPGGPALEKKNLGHIAQIIGPVLDVSFPPGKMPNIYNALVVKGRDTAGQPINMTCEVQQLLGNNRVRAVAMSATDGLTRGMEVIDTGAPLSVPVGGATLGRIFNVLGEPVDNLGPVDTRTTSPIHKPAPAFIQLDTKLSIFETGIKVVDLLAPYRRGGKIGLFGGAGVGKTVLIMELINNIAKAHGGVSVFGGVGERTREGNDLYMEMKESGVINEQNIAESKVALVYGQMNEPPGARMRVGLTALTMAEYFRDVNEQDVLLFIDNIFRFVQAGSEVSALLGRMPSAVGYQPTLSTXMGSLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFKLILSGELDGLPEQAFYLVGNIDEVTAKATNLEMESNLKK

SEQ ID NO: 59604 - protein, 545 aa, Phytophthora megakarya
  misc_feature (210)..(214): Xaa can be any naturally occurring amino acid
DLVGMLNTAKIPTNVEVVVAPSQVHAATVKASLRADVRVSGQDVWKQGNGAFTGETSAEMLKDLGAEYTLVGHSERREKGETNEVVAKKAAYALEKGLGVIACIGETKEHREANQTIAHITEQLDAYAAEIKDWTNVVIAYEPIWAIGTGLTATPEQAQEVHATIRAWLKEKVSPDAADKTRVIYGGSVGAKNAAELSQKEDIDGFLVGXXXXXPDFLQIINAQKPTDNVGGAVNVAINGFGRIGRLVLRAATKNPLINIVAINDPFISTTYMEYMLEYDTVHGKFAGSLSHDEKNIFVNGKRIRVFNEMNPANINWGEEQVQYVVESTGAFTTTEKASAHLKNGVEKVVISAPSSDAPMFVMGVNHELYEKNMHVVSNASCTTNCLAPLAKVVNDKFGIKEGLMTTVHAVTATQKTVDGPSKKDWRGGRGACFNIIPSSTGAAKAVGKVIPSLNGKLTGMSFRVPTADVSVVDLTARLVNPASYVDIKAAIKSASENEMKGILGYTEEAVVSSDFIGDSHSSIFDAEAGIALTDDFVKLVSWYD

SEQ ID NO: 59605 - protein, 534 aa, Phytophthora macrochlamydospora
ELVGMLNTARIPENVEVVVAPSQVHAATVKAQLRSDVRVSGQDVWKQGNGAFTGETSAEMLKDLGAEFTLVGHSERREKGETNEVVAKKAAYALEKGLGVIACIGESKETREANETVAFITKQLDAYAAEINDWTNVVIAYEPIWAIGTGLTASPEQAQEVHASIRAWLKNKVSPEAAEKTRVIYGGSVGAKNAPELSQKEDIDGFLVGGASLKPDFLKIINAQNPTEKVGGAVNVAINGFGRIGRLVLRAAAKNPLINIVAINDPFISTTYMEYMLEYDTVHGKFDGSVSHDEQHVIVNGKPIRVFNEMNPANIKWGEQQVQYVVESTGAFKTIETASAHMKNGVEKVVISAPSSDAPMFVMGVNHELYQKDMHVVSNASCTTNCLAPLAKVVNDKFGIKEGLMTTVHAVTATQKTVDGPSKKDWRGGRGACFNIIPSSTGAAKAVGKVIPSLNGKLTGMSFRVPTADVSVVDLTARLVNPASYDEIKAAIKSASENEMKGILGYTEKSVVSSDFIGDSHSSIFDAEAGIALT

SEQ ID NO: 59606 - protein, 1693 aa, Synechocystis sp. PCC 6803
MTVMLSCLTQQQELLQSLADRVGQPAIQDNLYFCLAGQFTWVEDWYTTAIAGDVLIFDAGEKEQLARVLQQWEQFTGHVILITGLTEEPDPQTFLTQLALGKQQRCGERHFHWIVLVDPTIEEAFRGLQTFLDGKSHWLDLRLGVGDLEQCTDELWQCVWLEPSPLAPEKRQEMLVNLPHWLAEIVDQKQNLELEPISLLQAKLSLLQGLARESRGEMGRKQAQCHYRESLDVWELLGDTEAIIWLSLRLGYLFLLQAYGEKSRGHQLWQQTRNYAQTAIAALENQQWHFTHGETLNLLGEILRGLEDWEQLRQAAENSLIFFYQLSPFAATDTTPERNQEKLWTELELQGLISLAHSYLCEALVEQWKFDEGKEALKRAFETRPKQVEERDYRPCLANLHYLAGRVQLANDQIRESLMTLRQAQTLVSFEDNPRLYLAILVELRECYLQLEDWLAALAIDQEYQAREYRLGQRAFIGPKPLPCWPEQRICRHPLAPEKMLGGGAEARSAVQSKTMVSLTWQDLQKVWEQKPTPVLVLTGEPGVGKTSWLAGEVLQQMSPERVLLVDFTPHWAEKLWVHLGESFSLPSLGQATTPELVSALQALPILDLLLVLDGENGSLPWQKSPSLRQQELAQVLWQWLLTTSPSQGVRLLISVPPTAIADLYEELKGQLGEEHSLPPLQYQTLSPPTLGQAENWLTQAMAQCRHPWPPSLQSQFLGDLAMEGNGEQQPWLHPIDLQLLGTVLEQEQVTKSADYQGKKLDEWLTLAVQTYLAFLPPHLLKKALQLLKSLADGQQALCLKTEYQLLAALYSAPEPAADNPPEFAQEDIQQLQLLLTLLLRGRLIIVISQATLPYYRLSTTHLAHALQGKSAVISTPALINAGRRGSKSNPNLIAPSPGDRQQGNEDLIAELEAGSSAEEQVVAQKLKAAQLQYQKLVAGINLEKQCQFILKQFLVYPLEALLAAVKTGQDLQKLVTPETPLVQYPSLAPWLSLHSILARINECNRCHHEGPVTVLRISPSMENTPPLVLTATTNGIAYLWSFHGELINVLRGHQEAITALDWSADGQYFATASADHTVKLWQRHGEEVATLRGHEDWVRSVHFSPHHQFLVTSGQDNTARIWNFAGEQLTLCQGHADWVRNAEFNCHGQILLTASRDGTARLWDLEGREIGLCQGHTSWVRNAQFSPDGQWIVTCSADGTARLWDLSSQCFAVLKGHQNWVNNALWSPDGQHIITSSSDGTARVWSRHGKCLGTLRGHDHNIHGARFSLDGQKIVTYSTDNTARLWTKEGTLLTILRGHQKEVYDADFSADGRFVFTVSADQTARQWDISQKDTITLTGHSHWVRNAHFNPKGDRLLTVSRDKTARLWTTEGECVAVLADHQGWVREGQFSPDGQWIVTGSADKTAQLWNVLGKKLTVLRGHQDAVLNVRFSPDSQYIVTASKDGTARVWNNTGRELAVLRHYEKNIFAAEFSADGQFIVTASDDNTAGIWEIVGREVGICRGHEGPVYFAQFSADSRYILTASVDNTARIWDFLGRPLLTLAGHQSIVYQARFSPEGNLIATVSADHTARLWDRSGKTVAVLYGHQGLVGTVDWSPDGQMLVTASNDGTARLWDLSGRELLTLEGHGNWVRSAEFSPDGRWVLTSSADGTAKLWPVKTLPQLLSQGGQWLKNYLTHNALVSPADRPGAKVT

SEQ ID NO: 59607 - protein, 85 aa, Oryza sativa
VADRSVRALCVQVSMPGMMDTVLNLGLNDEVAAGLAAKSGDRFAYDSYRRFLDMFGNVVRTPHQITLARLADSAASCLARRSSRA

SEQ ID NO: 59608 - protein, 546 aa, Phytophthora macrochlamydospora
QELVGMLNTARIPENVEVVVAPSQVHAATVKAQLRSDVRVSGQDVWKQGNGAFTGETSAEMLKDLGAEFTLVGHSERREKGETNEVVAKKAAYALEKGLGVIACIGESKETREANETVAFITKQLDAYAAEINDWTNVVIAYEPIWAIGTGLTASPEQAQEVHASIRAWLKNKVSPEAAEKTRVIYGGSVGAKNAPELSQKEDIDGFLVGGASLKPDFLKIINAQNPTEKVGGAVNVAINGFGRIGRLVLRAAAKNPLINIVAINDPFISTTYMEYMLEYDTVHGKFDGSVSHDEQHVIVNGKPIRVFNEMNPANIKWGEQQVQYVVESTGAFKTIETASAHMKNGVEKVVISAPSSDAPMFVMGVNHELYQKDMHVVSNASCTTNCLAPLAKVVNDKFGIKEGLMTTVHAVTATQKTVDGPSKKDWRGGRGACFNIIPSSTGAAKAVGKVIPSLNGKLTGMSFRVPTADVSVVDLTARLVNPASYDEIKAAIKSASENEMKGILGYTEKSVVSSDFIGDSHSSIFDAEAGIALTDDFVKLVSWYD

SEQ ID NO: 59609 - protein, 738 aa, Methanococcoides burtonii DSM 6242
MEELQIKVEKAHPIDFGRGIIRLDPSTLLSLQLSPGDIVEIVGKKKTAAKVWRADRQDWGQGIGRIDGFTRQNAGVGIGERIHIQRAEVLVAEKVVLAPPEGVMMEFGGNINAIIKHNILKRPFVVGDVIPITSSMTQTAPGNQAIPLVAIESEPEEGILIVSENTEIELRQKPVEGYEDTATGITYEDIGGLGDEIQRVREMIELPLKHHEIFQRLNVEPPKGVILYGPPGTGKTLIAKAVANESRANFLYVAGPEIMGRFYGESEERLRKIFEEAAENAPSIIFIDEIDSIAPKRENVTGEVERRVVAQLLTLMDGMEERGQIVVIAATNRLDSIDPALRRPGRFDREIEIGVPDSDDRLEVLQIHSRGMPLAEDVDLEHLATYTQGFVGADLLSLVQEASMRALRRILPEINLDEEEISQEVLEKLVVTAEDFEDALKEVEPSAMREVLVEIPSITWEDVGGLSDAKQEIIEAVEWPLKHPDRIIEMGIKAPKGILLYGPPGTGKTLIAQAVANEANANFISIKGPQMLSKFVGESEKAVRDTFKKARQVSPCIIFFDEIDSIATTRIADSETGRSSQQVVNQLLTELDGLEPLKEVVVIAATNRPDMIDPALMRSGRFDRLVLVGNSTIQGRESIFNIHTREMPLDSEVSIQSLAAMTEGYVGADIEAVCREAAMLALREDFDAESVKERHFLAAIEKVKPTITEDMAEFYSKIQDKLKGGTHKQETSSYMGYM

SEQ ID NO: 59610 - protein, 483 aa, Oryza sativa
MACQGIDLLSTKAAGDDHGENSSYFDGWKAYDTNPFDLRHNRGGVIQMGLAENQLSLDLIEEWSKNHPEASICTPEGVSQFKRIANFQDYHGLPEFRKAMAQFMGQVRGGKATFDPDRVVMSGGATGAQETLAFCLANPGEAFLVPTPYYPAFDRDCCWRSGIKLLPIECHSFNDFRLTKEALVSAYDGARRQGISVKGILITNPSNPLGTITDRDTLAMLATFATEHRVHLVCDEIYAGSVFATPEYVSIAEVIERDVPWCNRDLIHVVYSLSKDFGLPGFRVGIIYSYNDAVVAAARRMSSFGLVSSQTQYFLARMLSDEEFIGRFLQESKCRLVARHERFTSGLREVGIGCLRGNAGLFSWMDLRRMLREKTAEAELELWRVIVHQVKLNVSPGTSFHCREPGWFRVCHANMDDETMEVALGRIHDFVRQHQQRRVKAERWAANRQLRLSLPHHHHLSPAHLSSPLALLSPQSPMVRATS

SEQ ID NO: 59611 - protein, 338 aa, Zea mays
  misc_feature (327)..(327): Xaa can be any naturally occurring amino acid
MGKIKIGINGFGRIGRLVARVALQSEDVELVAVNDPFITTDYMTYMFKYDTVHGQWKHSDIALKDSKTLLFGEKPVTVFGIRNPEEIPWGEAGAEYVVESTGVFTDKDKAAAHLKGGAKKVVISAPSKDAPMFVVGVNEDKYTSDVNIVSNASCTTNCLAPLAKVIHDNFGIIEGLMTTVHAITATQKTVDGPSAKDWRGGRAASFNIIPSSTGAAKAVGKVLPELNGKLTGMSFRVPTVDVSVVDLTVRIEKGASYEEIKKAIKAASEGPLKGIMGYVEEDLVSTDFTGDSRSSIFDAKAGIALNDHFIKLVSWYDNEWGYSNRVXVDLIRHMFKTQ

SEQ ID NO: 59612 - protein, 420 aa, Arabidopsis thaliana
MIEKKLSKMKMRTKSIPVRSSRKSLDSLLDDEANENTQCDERDVPHKKRRCLGTSETTDRGGSVEPLLDLDACIVCEVSDERVSRCCGVDCLLSFHGECLYADLGSTSSSSSSSSEDVSNPFCPYCWLKIVALKSKTLREKTVEAEKAVCKYLDKEMKSRDEDITLSGDEIGNQEQSTDIVSDHELQGEKDGCSSKPDADQGKVGTGKVIDEVGASEKVATEKFQDAEDDETAKDQGTRILNTGAGKKREVSSFLSMQESFSAKEQDQVQQNEKRRRRGLKIIDSDISSKGSSNERNGEDVTEQVTSSVQVTSPSGRMRNQQATTKVVAKSKTVRDISFFKMDQRRRLLWTYEEEEMLKVGVEKFAAEANKNMPWRKILEMGEKVFHETRTPADLKDKWRSMVKIMNKNEQGSTLTPTAM

SEQ ID NO: 59613 - protein, 467 aa, Triticum aestivum
MLGARRSFSRLAAAVRTPVDVPRMPAFDHVPLPYDGPSAVEIARKRAEFLSPSLFHFYSKPLNIVEGKKQYLYDEHGRRYLDAFAGIATVCCGHTHPEIIDAITAQANLLQHSTVLYLNHAIADFAEALAAKMPGDLKVVFFTNSGTEANELAMMMARLYTGSHDIISLRNSYHGNASGTMGATAQKNWKFNVVQSGVHHAVNPDPYRGAFGSDGEKYARDVKEIIDFGTTGHVAGFISEAIQGVGGIVEVAPGYLPLAYDAVRKAGGLCIADEVQAGFARVGSHFWGFETHDVIPDIVTMAKGIGNGIPLGAVVTTPEIAQVLTRRSYFNTFGGNPLCTAGGLAVLKVLDMERLQENAFIVGAYLKDRLRGLQEKHQSLCMHLTPIIGDVRGTGFMLGVELVTDRQLKTPAKDEICQAMEHMKDMGVLVGKGGFYGNVFRITPPLCFTKEDADFFVDVMDIALSKL

SEQ ID NO: 59614 - protein, 405 aa, Ostreococcus tauri
MSCGRGRECAWSAVDDVTDANSVSRAPGTHIKTNEEVGIKLVRDERCARTMRRERRGVELDESCKTKHPQLLYETRLYKILQGGTGVPNVRWYGIEGDYNIMVMDLLGPSLEDLFNFCNRKLSLKTVLMLADQLVSRIEYVHSKSFIHRDIKPDNFLMGLGKRANQVNIIDFGLAKKYRDPKTHLHIPYRENKNLTGTARYASINTHVGIEQSRRDDLESLGYVLIYFLRGSLPWQGLKAATKKQKYEKISEKKMTTPIEVLCKGFPPEFVTYFQVVRSLRFSDKPDYSYLRKLFRDLFIREGYQYDYVFDWTILKYQQTQALTRPTAGLGGQAQAGTSGDQGDQRDTLRRQTTLERQSSATRAAGGKEVLATERSSSFARAYERQRSSSRPLTSRDDDGGRAYQ

SEQ ID NO: 59615 - protein, 469 aa, Bacillus firmus
MNTGHITQVMGPVVDVKFKSGQLPEINNALKSTSGADKNAVDVTVTLEVALHLGDDSVRTVAMGSTDGLVRGTEALDTGAPISVPVGEATLGRVFNVLGEAIDLGEPVAADVKRDPIHREAPKFEELSTTTEILETGIKVVDLLAPYIKGGKIGLFGGAGVGKTVLIQELINNIAQEHGVISVFAGVGERTREGNDLYHEMTDSGVIKKTAMVFGQMNEPPGARMRVALSGLTMAEHFRDRDGQDVLLFVDNIFRFTQAGSEVSALLGRMPSAVGYQPTLATEMGHLQERITSTKVGSVTSIQAIYVPADDYTDPAPATTFAHLDATTNLERKLSEMGIYPAVDPLASTSRALSPEIVGEEHYSVARQVQQTLQKYKELQDIIAILGMDELSEEDKLVVHRARRIQFFLSQNFHVAEQFTGHKGSYVPVKETIKGFKESLDGKYDDLPEDAFRLVGRIEEVIEKGKQTA

SEQ ID NO: 59616 - protein, 753 aa, Oryza sativa
MISEGGVTALVVICVAIGFGFALLNFLATRAVKVDALAGPGEASASDNLLVHAVQGNVAEKIRKIAGKISTGANAFLFREYIYIGIFLVAFTFVLLLVLGLSTKDWSRTGLTIFAFILGASTSVASGYAGMWIATYSNQRTCIRAAHSVGAAFNTAFKAGLVMGFFLVSAAIIMLYILMCICKAYYTNALTVAGAADTTAMFEAIAGYGLGGSTVALFGRVGGGIYTKAADVGADLVGKLENGMPEDDPRNPAVVADNVGDNVGDIAGMGADLFGSFAESACATMVVASNSVGPNGLSMNWASLCFPLAISSTGLLVSLVTSFVATHLWQVRDVHGIEPSLKRQIGLSTIIMTPIAFLCCYYFLLTEGTFSIGSGDAAKDVKYWYVFFCVACGLWSGMAIGYITEYYTSHGWENGPVREVAEACKTGAATNIIFGLALGFKSVIIPVFCLAITIYVSYSLAGMFGIAVAALGILSTLPTSLTIDAYGPICDNAGGIAEMAGMDKGVRERTDALDAAGNTTAAIGKGFAIGSAALVSLALFGAYVTIVKLDAVGVNLLKPFEFAGLLVGAMLPYWFSAMTMKSVGLAANGMVIEVRRQLREHPEIMAQGSEVEPDYERCIAISTDHSLREMMPPGALVMLTPIIVGFFFGTHALAGVLAGALVSGVQIAISSANMGGAWDNAKKFIEGKGLGENLGKHSAPHAAAVVGDTVGDPLKDTSGPSLNILIKLMAIISVVFGPALAKFDKGLLEQWFS

SEQ ID NO: 59617 - protein, 333 aa, Brassica oleracea
DLKPDNFLMGLGRRANQVYIIDFGLAKKYRDSTTHQHIPYRENKNLTGTARYASMNTHLGIEQSRRDDLESLGYILMYFLKGSLPWQGLKAGNKKQKYERISEKKVSTSIEVLCRGYPSEFASYFHYCRSLRFDDKPDYAYLKRIFRDLFIREGFQFDYVFDWTILKYQQSQLTAPPSRNLNPAVGTSAALPPGVSNIDRYTGEEEGRPVGYSHMESSRRRASGTLDHSGNLSNQQTSSFNRDSMMPSSSMFAQSAGSSRRVAAVSSRDNLLSGEEFQRSHRTGDVSRGGVISRNSPVEAGKRSSSSRRHYESAIKGIDNLQVSSDDKFHHHH

SEQ ID NO: 59618 - protein, 169 aa, Saccharomyces cerevisiae
MAVKGLGKPDQVYDGSKIRVGIIHARWNRVIIDALVKGAIERMVSLGVEEKNIIIETVPGSYELPWGTKRFVDRQAKLGKPLDVVIPIGVLIKGSTMHFEYISDSTTHALMNLQEKVDMPVIFGLLTCMTEEQALARAGIDEAHSMHNHGEDWGAAAVEMAVKFGKNAF

SEQ ID NO: 59619 - protein, 101 aa, Picea sitchensis
MKWILHDWSDDHCRKLLKNCHKALPEKGKVIVVDTILPVAAETSPYARQGFHIDLLMLAYNPGGKERTEQEFQDLAKEAGFAGGFKPVCCANGMWVMEFHK

SEQ ID NO: 59620 - protein, 755 aa, Haemophilus somnus 2336
MDAQLRQAALDFHEFPKPGKIEVTPTKSLGTQRDLALAYSPGVAVPCLEIQADPASAYRYTSKGNLVAVISNGTAVLGLGNIGALAGKPVMEGKGVLFKKFAGVDVFDIEVDEQDPDKLVEIIAALEPTFGGINLEDIKAPECFYIEQKLRERLKIPVFHDDQHGTAIISAAAIINGLRIVNKKIEDVRLVTSGAGAASIACLNLLVSLGMKRENITVCDSKGVIYKGRDEKMDDTKKLYAIDDNGQRSLADAIPDSDIFLGCSAAGALTQEMVKTMGPNPLILALANPEPEILPPLAKAVRPDAIVCTGRSDYPNQVNNVLCFPFIFRGALDVSATTINEEMKLAAVYAIADLALAEQSEVVSSAYGESGVSFGPDYIIPKPFDPRLIVKIAPAVAKAAMDSGVATRPIEDFEAYIEKLTQFVYKTNLFMKPVFAQAKEDKKRVILTDGEEKRVLHAIQEIATLGIAYPVLLGRTHIIEESIKKLGLQLQVGRDFEIIDIENNPYYEECCDTYYNKLKRQGMTPTGAKRKMLHNPTALGAVLLELGKVDAMICGLVGPFAAHLATVKEVVGEKEHEIPATVNGLVLPTGNLFIADTFVNSSPTAEELAEITIMSAKEVRRFGIEPQVALVSHSNYGSINDPSAVKMRQVLELVREKAPDLIIDGEMHCDIALSENLRKEVMPDSPIKGAANLLIMPNMETARISLNLLQGTATPITIGPILMGVEKPAHILTSASSVRRIINMVAVAAVKAQNR

SEQ ID NO: 59621 - protein, 383 aa, Hydrogenobacter thermophilus
MKLHEHQAKEILKRYNLPVPEGKVAFSLQEALQVAEELSGYPLVVKAQVHCGGRGKAGGVKLVKNQEELREAVESMLGKVLKTFQCPEGKPVSRVWIEKATNIEKEFYLSITLDRSVSKPVFMASAEGGMEIEEVAKEKPEAIHTLHIDPALGLMPFQARKIAFKLGLPVNEFVRISLALYKMYTDMDASLVEINPLVLTKEGNLILLDAKVEIDDNAMLRHKDVEELEDLTQLDPLEIEAKRYSLNYIKLDGNIGCMVNGAGLAMTTMDIIKLAGGDPANFLDVGGGANVEQIANAFRILMADKNVKAVFINIFGGILRCDRLAQGLIEAAKMVEIKVPVVVRMEGTNVEEGRRLLSESGLNFVNAVDMWDGAKKATELALR

SEQ ID NO: 59622 - protein, 215 aa, Triticum aestivum
  misc_feature (161)..(161): Xaa can be any naturally occurring amino acid
MGSRPADAAGGQQQQQAEEPSMADVYGGHELTPLQKHAAFFDRNRDGIIYPSETYQGLRAIGCGVVLSAAGTVFINVFLSSKTVPANVKPPAFKFPIYVKTIQQGKHGSDTDVYDTQGRFVPEKFEEIFKKHAHTRPDALTDKELGEMLKANRDPKDFAGXLKVGAFVEWRLLYALCKDKEGFLHKETVKAVYDGSVFEKLEREKKEAKEFAKKK

SEQ ID NO: 59623 - protein, 99 aa, Arabidopsis thaliana
  misc_feature (18)..(18): Xaa can be any naturally occurring amino acid
  misc_feature (41)..(41): Xaa can be any naturally occurring amino acid
MERKTFSSKFIHLLIVFXLLCIFLPRTESALPYHHELLLGXKRMNYYKPNSNTIGTPSSTSNHAPGGHGRRLMSIYRPNGDIFTGPSGSGHGGGRTPAP

SEQ ID NO: 59624 - protein, 259 aa, Vibrio parahaemolyticus RIMD 2210633
MTDTSLQSNTALENETTHFGFTTVAKEEKVTKVAEVFHSVAAKYDIMNDLMSGGIHRLWKRFTIDCSGARPGQRILDLGGGTGDLTAKFSRIVGDQGHVVLADINNSMLNVGRDKLRDNGIVGNVHYVQANAEELPFPDDYFDVITISFCLRNVTDKDKALRSMFRVLKPGGRLLVLEFSKPVLEPLSKVYDAYSFHLLPKMGELVANDAESYRYLAESIRMHPDQETLEGMMQDAGFENTKYYNLTGGIVALHRGYKF

SEQ ID NO: 59625 - protein, 819 aa, Zea mays
MAFHVACPITCRRVCDCELGFGAAAARKGGGGGAAAAVWAGTAAVLEGFLVDPWLLRPAGAVDEDAATVQVEVPPLEPDPEDGEDEARRAAAQRGAAAAEDLARRFESGAYGSPEAGEDEDEWDREDQGNAAVKVMCRLCFSGENEGSTKAAKMLPCKLCSKRYHRNCLKSWGEHRDLFHWSSWVCPSCRSCEVCRRPGDPNKLMFCKRCDGAYHCYCQQPSHKNVTHGPYLCPKHTRCHSCGSGVPGSGHSTRWFLGYTCCDACGRLFVKGNYCPICLKVYRDSEVIPMVCCDVCEKWVHIECDGISEEKYQQFQADQNLQYTCAACRGECSQIRDTEDAIRELWKRRDVADHELMATLRAAAALPSLEDVSPPYQNSDDEKLGAYALKNESRNTLKFSLKSNSSKPPPDTPEQEKIVFKSSGSNKKPSKKKSGQANKTVDGHDEIFLERRHAVKSSNSCLGDQTINENHDRSPFKNDDNAYISSSTRSSEKNLKSPSMKAVTNNADMIPKVKIKGSKVSSLHYKDGEENTPKTDTGKATKLVIHLGSRHKTRSGSPKSELSNYQREQDLGSIHGRKIDVTSQLKGSRNEVKERSVMKLVRDTGVQQRNSLLGDLGTSKKHATGKRSNALISGMENANETGTRNRSFAQKQSHSSQVDENHGTADSPDSLKPSLLKLKFKRPHFEQLNTQASQPEEPTSWVSQQEEQLNVAKGQRSKRKRPSMEKADGLDGITPAKRHQQSTDEVMDANWILRKLGKDAIGKRIEVHLTSDGKWHQGMVSNVMGGTLCIRLDNGRSENVELGKQAIRLIASRSKGGKR

SEQ ID NO: 59626 - protein, 489 aa, Phytophthora infestans
MADLSDIGLFGLAVMGQNFALNMASHGFKVSVCNRSPDKVDATVQRAKDEGNLPLVGFKDMKEFVASLARPRKVVILVVAGKPVDLTIAALSEFMEPGDIIVDGGNEWFPNSVRRASELEPKGIHFVGMGVSGGEEGARNGPSLMPGGPKEAFDALEPIITKCAAQVDDGACTTYLGPIGSGNYVKMVHNGIEYGDMQLIAEAYDILKIAGGLTNDELASVFDEWNKGELESFLIEITAQIFAKKDDLTDDGYVVDKILDKTGMKGTGRWTVQEAAERSIAAPTITASLDARYLSARKDERVFASKILSGPSEIPAVDKQQLIDDVRQALYASKICSYAQGLNLIREAGVQMGWNVDLGECARIWKGGCIIRAKFLDRIKSAYTKDASLISLLVDPDFAAELQARQYSWRRVVSLAVASGIPAPSFSGSLNYYDTFRRERLPANLTQAQRDFFGGHTYERTDREGLYHCAWSAAHHSIGDVSERIRGNL

SEQ ID NO: 59627 - protein, 211 aa, Thermus thermophilus HB27
MGLPQVLERIARACRRAGRRPEEVRLVAVTKGRSVEEIREKVLAYGTFPLGESRVQEALKKMDLLHAEWHLVGHLQRNKAKFAPRFALVHSLDSLRLAEALEKVGEKAGVRLKVLVEVNLGREPQKHGVLEEELPELLPRLREMPHLEVLGLMTVPPIGPEAVVRPIFRRLSELADRYGLPERSMGMSDDYEWAVEEGATLVRVGRALFVD

SEQ ID NO: 59628 - protein, 241 aa, Saccharomyces cerevisiae
PKLVLVRHGQSEWNEKNLFTGWVDVKLSAKGQQEAARAGELLKEKGVNVLVDYTSKLSRAIQTANIALEKADRLWIPVNRSWRLNERHYGDLQGKDKAQTLKKFGEEKFNTYRRSFDVPPPPIDASSPFSQKGDERYKYVDPNVLPETESLALVIDRLLPYWQDVIAKLVGKTSMIAAHGNSLRGLVKHLEGISDADIAKLNIPPGTILVFELDENLKPSKPSYYLDPEAAGAAVANQKKG

SEQ ID NO: 59629 - protein, 183 aa, Arabidopsis thaliana
MAGEGEEDVPRDAKIVKSLLKSMGVEDYEPRVIHQFLELWYRYVVEVLTDAQVYSEHASKPNIDCDDVKLAIQSKVNFSFSQPPPREVLLELAASRNKIPLPKSIAGPGVPLPPEQDTLLSPNYQLVIPKKSVSTEPEETEDDEEMTDPGQSSQEQQQQQQQTSDLPSQTPQRVSFPLSRRPK

SEQ ID NO: 59630 - protein, 748 aa, Vibrio vulnificus YJ016
MLSQLREIVEKVSRVEDVHQALNTLVRETCTALSTECCTIYLANEERQRLELMATQGLTFHGDSIHIQFEEGLVGLVKRSAEPLNLAEASKHPAFKYFPQLGEETYHSFLGAPIIHRKKVLGVLVIQQKTPRLFSEMEESFLVTLSAQLAVIIAHAQSLGHWSLASKPAAVQGIAASSGVAIGEFWYDNSQPILSEVCPASTLDKEREQEWLAVAIEAALADFRRMRKKFDSEINKDALAIFDLFTHLLNDPMLRTDLKKHVERGDRADWALRQVVESYSSRFARMSDVYLRERAHDIRELGQRLLFFLHNSEQEQPRIERPVILVANELTASLLASVPKKYLLAVVALEGAANSHAAILSRALGVPAVMGANLNLEEVHGKQGIVDGYSGEIYIQPNRQILREYRSLVTEESELFAMVNKELALPAKTQDNVDVEVLLNAGLSADSNIAINAGVDGVGLYRTEIAFLLQHRFPSEDEQYQQYRAILSSYPQQRVVMRTLDIGGDKPLPYLPIEEDNPFLGWRGIRFTLDHPDIFLIQLRAMLRASAEHGNLSILLPMISGVGELDDAIRLIQQAYHEVVLLDERVVMPQIGVMIEVPSMVYLIPSIAQRVDFVSVGTNDLTQYLLAVDRNNARVSDVYESLHPAVLQALQQIYQQCGQYHLPVCICGELAGDPFGALLLLGLGYRSLSMNTSNVARIKYLIRHSQLSDLQALSQQALSLSYGKDIHQLMRDYFINHDFAGFIRAGKK

SEQ ID NO: 59631 - protein, 601 aa, Nicotiana attenuata
MEVLCQAPAGNSNFACNPKFTAIRTRAISSNDTFKVISSTGNNKKMKGAIRTSIPKPSALPLKVSQLSPSADSMPVPASLQDVEAGKLIENNPSGGDTEELFQYLVEILASRVYDVAIDSPLQNAAKLSKKLGVNFWIKREDMQSVFSFKLRGAYNMMTKLSKEQLERGVITASAGNHAQGVALGAQRLKCTATIVMPVTTPEIKIEAVKNLDGKVVLHGDTFDKAQEHALKLAEDEGLTFIPPFDHPDVIIGQGTIGTEINRQLKDIHAVFVPVGGGGLIAGVAAYFKRVAPHTKIIGVEPFGASSMTQSLYHGERVKLEQVDNFADGVAVALVGEETFRLCKDLIDGMVLVSNDAISAAVKDVYDEGRNILETSGALAIAGAEAYCKYYNIKGENVVAIASGANMDFSKLKLVVDLADIGGQREALLATFMPEEPGSFKKFCELVGPMNITEFKYRYNSGRKQALVLYSVGVNTKSDLESMLERMKSSQLNTVNLTNNNLVKEHLRHLMGGRSEPSNEIFCQFIFPEKPGALRKFLDAFSPRWNISLFHYREQGELDASVLVGFQVPKGEIEEFRVQANNLGYSYEIESLNEASQLIME

SEQ ID NO: 59632 - protein, 307 aa, Polaromonas sp. JS666
MPSNLNPLGALPFRFRRERVLIVGCGDVGLRVSRQLRGRVGLMALTSSTDRLPELRAHGVTPLLGNLDDSASLRRLAGLATRVVHLAPPPGDNPDWRSDPRTLALLRILRLRGRPQSLVYGSTSGVYGDCQGDWVSETRGVNPNTPRAVRRVHAEALVRLFGRATAAHTHILRIPGIYAPDREGGTPRGRLLKGTPVLRAQDDVYTNHIHADDLARACVAALWRGKPQRVTNASDDTQMKMGDYFDLAADLYQLPRPARLPRSTAREQLPLMLLSFMGESRRLDNRRMKEELKLVLRYPTVEEGLRA

SEQ ID NO: 59633 - protein, 359 aa, Ostreococcus tauri
MPGASTALPHLRDGYDPCTFAPWDSAHAVVRASAWVDVFRRSTTSFEVRAEKSARGPVELGDDAEAEKACREASGTAWPPAWRGANCLELCRARDGLLRSHGFADVFEQVKREENETAMRAVLGVFARCDAVEDDDARLLELVRGAFAGNIFDLGAAASTELFENGGVNFARTVETLRPRPWCVDDFDALRARFREVRHKKAIVFVDNAGADVCLGMIPFVRELLRRGTEVVLAANETPSINDITARELREHVFPLLVKQDDETLCEAIARGRLRVVSSGSDMPVIDLRYLSPEICAEAKDADLLVLEGMGRGIETNLFAQFTIDCLKLAMIKHEEVATLLKGNLYDCVCKFDVGSGAT

SEQ ID NO: 59634 - protein, 426 aa, Brassica oleracea
ENVKTKHPQLLYESKLYKVLQGGTGVPNIKWYGVEGEYNVLVIDLLGPSLEDLFNFCSRKLSLKTVLMLADQMINRIEFVHQRSFLHRDIKPDNFLMGLGRRANQVYIIDFGLAKKYRDSNHQHIPYRENKNLTGTARYASMNTHLGIEQSRRDDLESLGFVLMYFLKGSLPWQGLKAGNKKQKYERISEKKVSTSIESLCRGYPSEFASYFHYCRSLRFDDKPDYAYLKRLFRDLFIREGFQFDYVFDWTILKYQQSQLSTPPRPNVPGVGQSSGLPPAIASAERPSGGEEARTSGWPSGNARRISGQIFNSGNLAKQKAPVSSDPAISKNVMLSSSSFLRATGSSRRAAVSGSREAAVPGTDSEPSNPQIIEAGTSSNPKIHGGRSSPIVSSENKKLSSPSRGNTSVMKNYESNLNKGIEGLHF

SEQ ID NO: 59635 - protein, 545 aa, Neurospora crassa
MSPRAFALAHQRDRGSFVGCSRIADYEVLGKLGEGTFGEVHRARSRKTGALVALKKIIMHNERDGFPITALREIKLLKLLSHKNVLRLEEMAIEHPPRTDKRTRPIVYMVTPYMDHDLSGLLDNPSVRFTEPQVKCYLLQLLEGLKYLHANHILHRDMKAANLLINNKGVLQIADFGLARHYEGDIPQPGKGSGEGKRDYTSLVVTRWYRPPELLMHLKRYTTAIDMWGVGCVFAEMLEGKPVLQGESDLHQLELVWDLCGTPSEETMPGWRTLPGGQAFSSKPRPGNLARRFEKHGPVVISLLKELFKLDWRSRINAIDALNHPYFRTAPLPALPGDLPTFEESHEFDRRKFQDRKAALPPAPKGGTVGRGAVVNSQGPDTGFSGRDGYGGGGRNGANGGRYPPYHRGPPPGDERVPSWHSARGLPPRPPMPADYHGSGPMDHTDGYRDRPPRRGPGGPPGGGGGPSNVDTYIPSYDRDGPAPRREDWRRRDDWDDRRGGVDRDRRRPEYDVRSRDSRTRSRTRSRSPVRDRDRGRDRDAYARR

SEQ ID NO: 59636 - protein, 88 aa, Picea sitchensis
MQRFAETKCEYNCYNLQRLQKAEAKMVKVSTFAAMTLGAFIFLQSVDKLHVWIALRQDEKRERQMQELEIAKMKKTLLTDLKEKESSV

SEQ ID NO: 59637 - protein, 123 aa, Picea sitchensis
MAEGNVFACHSTEAWRSKLQEAIDTRRLVVVDFTATWCGPCRVISPVFVELSKKFPEIFFLKVDVDELRDVAQEWDVEAMPTFIFIRDGRAVDKVVGAKKDDLERKVAALAATTTEAALVAQA

SEQ ID NO: 59638 - protein, 253 aa, Zea mays
MGSGSNSKEGEERVLSHGDVVLIRSDLAILRGPCFINDRIIAFYFAHLSASLQDDDLLLLPPSIPYLLSNLPDSAAVAAVAEPLRLASRRLVLLPVNDNPDASIAEGGSHWTLLILDNITSPSVPRFVHHDSIAGAPNLPIAARLADALRPLLSGSNSKRDTVPLIEGPTPRQTNGYDCGVYVMAIARALCAWWKSGQDQRGGDWFQAVRSGVDAHSVEAMRTDLLQLISTLIQEKANANSTPMGDTDPGSLE

SEQ ID NO: 59639 - protein, 438 aa, Pseudo-nitzschia pungens
QNFALNMASHGFKVCVGNRSLAKVDSTVARAKEEGGLPLIGATSAEEFIARLRKPRKVVILVQAGKPVDETIKKLSTYMEPGDILVDGGNEWYPNSVRRSGELLHKGIQFIGMGISGGEDGARNGPALMPGGPKQAYDFVAPIFEKCAAQVERTGPCVGYLGPVGSGNYVKMVHNGIEYGDMQLIAEVYDVMKNVLYMPNDEIADVFADWNKTELDSYLIEITEICLRKQDDKTDGYLVDKILDKTGMKGTGLWTAKESAERAVAAPTIVAALDSRVLSSRKEERVAASKIFGPPKIEAVDKDQVIADLRAALYASKICSYAQGLSLIKAASDEFSWNVNLAECARLWMGGCIIRAKLLDSIQMAFSKNPALPNLMIDPGFAEQIIGAQSSWRRTVALCATSGIACPSLCGSLMYFDTYRRERLPACLTQAQRDFFGG

SEQ ID NO: 59640 - protein, 252 aa, Staphylococcus aureus subsp. aureus Mu50
MIVKTEEELQALKEIGYICAKVRNTMQAATKPGITTKELDNIAKELFEEYGAISAPIHDENFPGQTCISVNEEVAHGIPSKRVIREGDLVNIDVSALKNGYYADTGISFVVGESDDPMKQKVCDVATMAFENAIAKVKPGTKLSNIGKAVHNTARQNDLKVIKNLTGHGVGLSLHEAPAHVLNYFDPKDKTLLTEGMVLAIEPFISSNASFVTEGKNEWAFETSDKSFVAQIEHTVIVTKDGPILTTKIEEE

SEQ ID NO: 59641 - protein, 391 aa, Salmonella enterica subsp. arizonae serovar 62:z4,z23:--
MSEYSLEGVLIKSALLVLEDGTQFHGRAIGATGSAVGEVVFNTSMTGYQEILTDPSYSRQIVTLTYPHIGNVGTNEADEESSQVHAQGLVIRDLPLIASNFRNTEDLSSYLKRHNIVAIADIDTRKLTRLLREKGAQNGCIIAGDNPDAKLALEKAKAFPGLNGMDLAKEVTTAEAYRWTQASWTLKDGLPEAKSEDDLPFHVVAYDFGAKRNILRMLVDRGCRLTVVPAQTSADEVLKMNPDGIFLSNGPGDPAPCDYAIHAIQKFLETEIPLFGICLGHQLLALASGAKTVKMKFGHHGGNHPVKDMDRNVVMITAQNHGFAVDEATLPANLRVTHKSLFDGTLQGIHRTDKPAFSFQGHPEASPGPHDAAPLFDHFIELIAQYRKIAK

SEQ ID NO: 59642 - protein, 273 aa, Pseudomonas syringae pv. syringae B728a
MSVQQRNNVNIMGDGPITLIFAHGFGCDQNMWRFIAPHFAERFKVVLFDLVGNGNSDVSAWYPHKYSSLKGYATDLLEVVNEFAAEGPVVHVGHSVSCMIAVLAELQSPGRFDSHIMIGPSPRYLNEEGYLGGFTRADVDSLLETLESNYLGWSSTIAPTLMGASDRPELSEELANSFCRTNAEIARQFAHVTFLSDHRADVAQLKSRTLILQSSDDMVVPVEVGEYLHRVITDSTLHMIDNVGHYPHMSAAQECITAMNQFLASCESAAHDR

SEQ ID NO: 59643 - protein, 346 aa, Porphyra yezoensis
PSLMPGGPRSAYEALEPMLRSIAAQVDDGPCVTYIGTGGAGNYVKMVHNGIEYGDMQLIGEAYDVLKTVGGMSASEIAAVFEEWNESNLQSFLVEITAAILRTSDDLVGDGSALVEKVLDQTGAKGTGMWTVQEAAARLVPIPTIAAALEARYLSALKEDRTAASAVLAGPSTDAAPSVTAEEKAALVAAVRSALYASKICSYAQGMNLIRAAGKEYGWGLDLGSISRIWKGGCIIRAVFLDRIKAAYDVDAELASLLVDPGFASELASAQSAWRSVVTTAINAGVSVPAMSGSLAYYDTYRRTVLPSAQMVQSQRDFFGSHTYKRLDKDGVYHTRWSSDGVTETQ

SEQ ID NO: 59644 - protein, 474 aa, Arabidopsis thaliana
MELISTINLLTIVLLLFVVSKIWKACWILLLRPLMLSKRFKKQGISGPKYKILYGNLSEIKKMKKEADLCVLDPNSNDIFPRVFPQYHQWMSQYGDTFLFWTGTKPTIYISNHELAKQVLSSKFGFTIIPVKRPEVFILFGKGLSFIQGDDWIRHRRILNPAFSMDRLKAMTQPMGDCTLRIFEEWRKQRRNGEVLIKIEISKEFHKLTADIIATTAFGSSYAEGIELCRSQTELEKYYISSLTNVFIPGTQYLPTPTNLKLWELHKKVKNSIKRIIDSRLKSKCKTYGYGDDLLGVMLTAAKSNEYERKMRMDEIIEECKNFYYAGQGTTSILLTWTTMLLSLHQGWQEKLREEVFNECGKDKIPKGTSIIIPLLKMHRDKAIWGEDAEQFNPLRFENGISQATIHPNALLPFSIGPRACIAKNFAMVEAKTVLTMILQQFQLSLSPEYKHTPVDHFDLFPQYGLPVMLHPLG

SEQ ID NO: 59645 - protein, 585 aa, Magnetococcus sp. MC-1
MVMTNPYLESVTQWEFDECSFEEGTDKIVAYGEASGYCPTYQERVPPCTSACPAGEDIRGYNNIVRGVWGSDDPYATAFQRLTRKNPFPAVMGRVCPAPCQGGCNRQYRDETIGINAIEHAIGQYAIEKGLKFDKPEVASTGKHIAVVGGGVGGLSNAYQMVMRGHKVTLFDRDEKLGGMLRYGILGYRVSRAVIDAEVQRILDLGVEVKSGVTIGKDITLEQLSKDYDAVFLAVGAQKGRTIPLPGSEGKALVKSAIDFLRDFEINGGIEAGGADKVKVGKNVVVIGDGDVAMDACRLALRLGSKATLLSGVAREEMNCSAFEYDEALAEGTDMKMCTGSLEITGEGDTITGIKVIEMARKEKGEDGWNHAVPFMRYKQKAGSEATVACDMVVWAVGQTTDMAGFESCTNGTPFLQVDHNFQVKGMDNVFGGGDAVQIHLLTTAIGHGRKAAEAMDTFLKGGKLPSKAAREDVVKFDKLKSDFFVEKAQAKRKIVHPANVVGNWEETLQQLSAQSTKEEADRCMSCGMCFECNQCMLFCPQDAITKFKGNAEGEVMFTYYERCVGCHICSEVCPTGYIDMGMGN

SEQ ID NO: 59646 - protein, 385 aa, Porphyra yezoensis
HYPDSIRRTKELEKQGILFVGTGVSGGEEGARYGPSLMPGGHPEAWPHIKDIFQAISAKSGDEPCCDWVGENGAGHYVKMVHNGIEYGDMQLICEAYSLLRTVLGLSNDKCADVFDEWNKGSLDSYLIEITANILRYKDTKDGKGDADTPSLVDKIMDRAQQKGTGKWTVGTSLDMGVPVTLISEAVFARMLSSMKEERVRASEKLSGPSSEFKGNAADFIEAVRQALYASKIVSYAQGYMLFREAAKEYNWNLNYGGIALMWRGGCIIRSAFLGDIRDAFTNDPELENLLLSPYFKKEVAGCSEGWREAVAVAARQGVPIPAFMTALAFFDGYRSATLPANLLQAQRDYFGAHTYERVDKKVGEYFHTNWTGTGGDITSNAYAA

SEQ ID NO: 59647 - protein, 566 aa, Mycobacterium smegmatis str. MC2 155
MELLLVVVGAILVTAIAHHRGFEPALMIVVVGSAVSFLPDFEPPELDSHILLSVVLPPLLYSAALNFSFPTFLRHIRPILGLGVGLVVVSAFAVAAVSSWLVIVPLTFGTALVLGAIVAPPDAVTAVAVGRKLGLPKRMMAILTGESLINDAAALTLFSIAVTQVAGGHIFIENPLLLFGYSATVGPLVGAVLGYVTLWIRKRLANPGLETVQGLVVPFAAFITAEELHASGVLAVVVAGFVVGNGNLGAGYQTRLQERYVWNSVDVLLEAFVFAYIGLHLRFVLEHLNEAHESLTEVITASAVVLLIVLVIRPLSVFAIFGRNKLSRHVEKKLSVPAPDGSRSSLGAAVRKQRKKKRRANWRTMVDRRTLSWQENVVLSWTGMRGVVTLAAAAAIPAYTESGEPFPERATIQAIAFVVAVGTLLLQGSTLPWLIRKLHISRFNDDHEADRAEEVKAERVAHDAAEKILVEFQANPPANLNPALVEEIYIRIARHTQDVDEMPDPEAPIKRAAAFTTLYREVLAAQRAALIDQRDAGHIEDEAVRAMLERLDLQEAGVTARLESRL

SEQ ID NO: 59648 - protein, 267 aa, Triticum aestivum
  misc_feature (225)..(225): Xaa can be any naturally occurring amino acid
  misc_feature (232)..(232): Xaa can be any naturally occurring amino acid
NKFVQKSRLVPVRNSRDIVDPRVRFLYLARQFTGKPVEEDESQKFRLPTPLVNIVNGGKHAGGKLKIQEFMIVPRSDIPFKEALKSIAEVYHKLGAILVKKDKSAKNVGDEGGYAPQLSSPDEALGVIEEAIKAAGYEVGKDIKLALDCAASEFYDAETKKYEVIEGKFLTSEEMVDFYDQLIKDHPGLCSIEDPLDEADYEGWAKFTAKLGDKIMCVGDDLFAXNPPMIKXGIGSEVNGANPLVLKVTQCGPFSGALEAAMLLFDN

SEQ ID NO: 59649 - protein, 505 aa, Oryza sativa Japonica Group
MEREAWLLCAALAAAMVYYYYYYLACTTRRAQRRLPPGPTPLPVIGNVLSLSGDMHHELARLAREQYGPVMTLKLGLFTAVVVSSPDAAREAFTKHDRRLAARTVPDISRARGLTGRSMIWLPSSDPRWKTLRSAVATHFFSPRSLAAARGVRERKVRDIVNYFAGHAAEVIDVGEAVYGGVINIVSNAFFSADVVDVGKESAHGLRETLEDIILAIAKPNVSDLFPFLRRLDLQGWRRWAEKRYDKVFGILDDKINSRLADADADASTKKHGDFLDSLLELMSAGKIACDDVTTVMFDAFGAGTDTISNTVVWAMAELLRNPSIMAKVRAEMEDVLAGKKTIEENDTEKLPYLRAVIKEAMRLHPVAPILLPHRAAEDGVEIGGYAVPKGSTVIFNVWTIMRDPAAWERPEEFMPERFLQRAEVDFRGKDFEFIPFGAGRRLCPGLPMTERVVPFILASLLHAFEWRLPVGVAAETLDLSEKFTTVNVLVTPLKAIPILASHQI

SEQ ID NO: 59650 - protein, 211 aa, Thermus thermophilus HB27
MSAPKPFVIGIAGGTASGKTTLAQALARTLGERVALLPMDHYYKDLGHLPLEERLRVNYDHPDAFDLALYLEHAQALLRGLPVEMPVYDFRAYTRSPRRTPVRPAPVVILEGILVLYPKELRDLMDLKVFVDADADERFIRRLKRDVLERGRSLEGVVAQYLEQVKPMHLHFVEPTKRYADVIVPRGGQNPVALEMLAAKALARLARMGAA

SEQ ID NO: 59651 - protein, 396 aa, Glycine max
  misc_feature (39)..(39): Xaa can be any naturally occurring amino acid
MAIQHHNEQLEHNENVSSVLDALYCDEGKWEDEEEEEEXYEESEVTTNTGTSLFPLLMLEQDLFWEDEELNSLFSKEKVQHEEAYDYNNLNSDDNSNDHSNNNNNVLSDSCLSQPRREAVEWILKVNAHYGFSALTATLAVTYLDRFLLSFHFQREKPWMIQLVAVTCISLAAKVEETQVPLLLDLQVQDTKYVFEAKTIQRMELLVLSTLKWKMHPVTPLSFLDHIIRRLGLKTHLHWEFLRRCEHLLLSVLLDSRFVGCLPSVLATATMLHVIDQIKHNGGMEYKTQLLSVLKISKEKVDECYNAILQLSKANKYGHNNINNTSKRKYEQIPSSPSGVIDAAFCSDGSNDSWAVGSSLLYSPPEPLFKKSRTQGQQMNLSPLKRFIIGIVGTPP

SEQ ID NO: 59652 - protein, 772 aa, Mycobacterium smegmatis str. MC2 155
MDIMSDRYVRTLDILTIADAEEAGGKGANLGELVAADLPVPHGFVVMRSAYLDSVRMGGVEAELAALHTEALTHAADTARLSELCRRMQSLVNKAGLSPSVRDATLAAYRALGTDVVVAVRSSATGEDGRDASFAGMNRTITNVMGEVALLDAVTQCWMSLFSPRVITYRASRGFTAAPAMAVVVQQMLSADRAGVAFTSDPSTGDADHIVIEAAFGQGEVVVSGKVEPDTYVIDKRTLEVRDVRIGFKAIKIVRGDDGADSMVQLERSQAEARVLDDDALRKIATLAVATETHNGCPQDIEWVIADGAVWLVQARPITTLGSAGSTAGDEPSVLIRGLPAAPGVASGRVRVLLAPDDGDKLTDGEILVAPTTNPDWLPTIRRAAALVTETGGMTCHAAIVARELGVPCVVGARSATVALAVGSMVTVDGTRGEVTTGRLPETVRTTTTPQEPAPHITGEATGTKVYVNLAMPDSAEAVAAQDVDGVGLLRAEFMLTEALAGRHPRDLITKGEQDTLVDAMAAAVTRIGTAFAPRPVIYRAMDFRTNEFRGLAGGEQFEPVEHNPMIGYRGCYRYIKEPDLFALELSALARAREHTPNIHLMIPFVRTRWELEECLALVDASPLRRHRNLHRWVMAEVPSVVHWLPEYVGMGIDGVSIGSNDLTQLMLGVDRDSETCAELFDESDAAVLDAISRIISTANRLGITSSLCGQAPSTRPEFAEHLVRMGITSVSVNPDAAGAARRAVAAAERRLLLDSVRHPRHAPTASPRNPL

SEQ ID NO: 59653 - protein, 146 aa, Alkaliphilus metalliredigens QYMF
MYSEKVMDHFTNPRNVGEIENADGVGQVGNPKCGDIMKMYLKIDNDMITDVKFKTFGCGSAIATSSMATEMIQGKTVKEVLQLTNKAVAEALDGLPPVKMHCSVLAEQAVKAAIYDYAQKNNLHYEDLDDFNPNDDHDHHDDIEEE

SEQ ID NO: 59654 - protein, 115 aa, Glycine max
  misc_feature (47)..(47): Xaa can be any naturally occurring amino acid
GSSLSTLKAKVHAFSVCDDPDYFHNFTQGLIDGLKAGVSSRDIVHIXTGKAAYAMVKDMSENPKKWEGRKILFIHTGGLLGLYDKVDQLASFVGNWQRMDVNESVPKHDGIGKMF

SEQ ID NO: 59655 - protein, 754 aa, Vitis vinifera
MAAGRHGGYRDNEFKERESDLDVSRRNFAYSKDEYDRSRNGNREGRIRDSRERNRVRQKDIKERESINGGYRSSSSRSDSGSSGGGGGVPRRCVFSVRTADREPGELSSESGSDDGIESESQANNEFSKVENGIRSPLDRKRKFSPIVWDREDKESNNSSKSRIASTATALPPPPPLPKTYRQSPKLIQDEGMRVSPAKNSKIQRSQLPPSPSLPPVAPLSVTLDVSSSPIELNTSSPQEQRWSNEKEADQIEDEDYVPTRNISSSRWADEANSPVDEGEILDDEEIPKRRKKMFLSEGLEPRVLKKSVSPELGELKREGSEGARAKSTDSDERGNRGRSGTREDYPDNNSDRNDYMEIEDYHNNDASARQSDTDSEHENVSRETPEPALPPQRSVNMLQGCRSVDEFERLNKIDEGTYGVVYRAKDKKTGEIVALKKVKMEKEREGFPLTSLREINILLSFHHPSIVDVKEVVVGSNLDSIFMVMEYMEHDLKGLMETMKQPFSQSEVKCLMLQLLEGIKYLHDNWVLHRDLKTSNLLLNNRGELKICDFGLARQYGSPLKPYTHLVVTLWYRAPELLLGAKQYSTAIDMWSLGCIMAELLSKEPLFNGKTELDQIDKIFRTLGTPSETIWPGFSKLPGVKVNFVKHQYNLLRKKFPATSFTGSPVLSDSGFDLLNKLLTYDPEKRITAEAALNHDWFREVPLPKSKDFMPTFPAQHAQDRRVRRIMKSPDPLEEQRRKELQQGELGAGGLFG

SEQ ID NO: 59656 - protein, 729 aa, Bifidobacterium longum NCC2705
MRSASGNGFDSSDSFAVSGAAEGTARLHDIPPSITPSHGDDSHLLSRIASPADVKALAPNELAELCREIRATLLAYGHQHGGHIGSNLGMVEATVALHRVFDSPRDRIVFDVSHQSYVHKMLTGRAAAYLDPDRFSEVTGFTNPGESKHDQFVLGHTGTSISLACGLAKTRDMEGPNNSIGNVIAVIGDGSLSSGVAFEGLNNAAEQGGNLIIVFNDNEMSIAGDFGGMYGPLARLRASGGTAQPNLFNAFGLDYRYVEAGNDVSALVAAFEEVRDIDHPVVVHIHTLKGAGYDGEETHADRQTASASPVSFDSPTGVHPTDNVNHSEPWHSDHCNLSDHEPHEGQCEASHWQNPDAAIGKPDDPRKHYGKMAMAALEPRFAAEPGLVVISPATPGSNGITHEFRERAGAHYVDTGITESHAVAYAAGIARAGGTPVVATTASFFQRAYDQFFQEMSLNRSRVTVLDFLGGLSGSDNTHSGAYDVTMFSNIPGVTMLVPTSARDYLADLAWATAPAGSADAPAGPAVIRVPGEAILAAERDATLLPVTGGQIADRPQSASLPASASSASGGISAATVHGTVSVTAQHAGARHMLDWRVNQTGSQVAIIGLGNAYPLAEQTAAALSDDYGITATVIDPRQCTSLDSDVLESLRDGHQQVITLEDGQLEGGWGEKVTAYYANHHVSDGSRNPRVLNFGAAKEFTDRVSLGELNERYGLTVEQVTEAITRCF

SEQ ID NO: 59657 - protein, 175 aa, Zea mays
MGSGSFLKVLAKNFDVLAGPLISLAYPLYASVRAIETKNPVDDQQWLTYWVLYSFVTLFELTFAPIIEWLPFWSYAKLFFNCWLVLPWFHGAAYVYDHFVRPMFVNRRIVNIWYVPRNEKLGKSDDVLSAAERYIEQNGPEAFEKLISKLEDNLCPRASCKLFSCIRLKTTFPNF

SEQ ID NO: 59658 - protein, 317 aa, Salmonella enterica subsp. arizonae serovar 62:z4,z23:--
MPDTLSGIFYGADMRLPIILDTDPGIDDAAAITAALFTPELDLQLITTVAGNVSVEKTTRNALQLLHFWNSDIPLAQGAATPLLRPLRDAAYVHGESGMGGYDFVDHQRQPLAKPAFIAIRDALMNAPEPMTLVAIGPLTNIALLLMHYPECAFNIRRLVMMGGSAGRGNFTPNAEFNIAVDPEAAAHVFRSGIEIVMCGLDVTNQAMLSPDFLDKLPALNRTGKMLHGLFNHYRSGSRRTGVRMHDLCAIAWLTRPELFILKPCFVAVETQGEYTAGTTVVDIEGRLERPVNVQVALDIDVAGFQQWAADALALAP

SEQ ID NO: 59659 - protein, 219 aa, Vibrio parahaemolyticus RIMD 2210633
MSVKIHYQNTHFITSAPDIRHLPEDEGVEIAFAGRSNAGKSSALNRLTNQKSLAKTSKTPGRTQLINLFKVEEGCHIVDLPGYGFAQVPVEMKNKWQKSLGEYLQKRECLKGLVVLMDIRHPMKDLDQQMIFWAIDSRIPVQVLLTKADKLKSGARKQTLLKIRKQVETFGGDVSVDVFSSLKGLGVDQLRAKLDTWFAPALAHLIEEDDLEMPESNEE

SEQ ID NO: 59660 - protein, 252 aa, Campylobacter coli RM2228
MIELKKPAEIEKLRVANQIVAKTLDFLENEIKAGMSLKQIDKMAEDFILSLGAKPSFKGLYGFPGAICTSLNQVCIHGIPDEKIIKEGDILGLDVGSLIDGYYGDAARTIAIGKISSTDEALISCAKDALYHAIDIIREGMRFKELSAALGEFIDLRGFVPLRGYCGHGIGRKPHGEPEILNYLEKGASAKSGPKIKNGMVFCIEPMICQKDGTPKHFNGKWGAGSVDELNSAHYEHCVAIINGRAEILSSL

SEQ ID NO: 59661 - protein, 416 aa, Methanosarcina mazei Go1
MLRVMTSRNFLTIDDFDIRGKTILLRVDMNSPMDTQGHILDDMRIRSHIATLKDLESAKVVVLAHQSRPGKKDFTTMKPHAHLLSRYLGRQVTYVDDIFGTFAKTQIASMEDGDVIMLENVRFYSEESLERTTAEQANTFMVKKLAPFVDIFLNDAFAVSHRSHLSVVGFTEVLPSGAGRVMEKELISLEKGVKSGERPSVFVLGGAKVDDSLRVTENVLTNGGADRVLLTGVVANVALAASGVNIGKANLDFIKSQGYEDQIERARGLLAKFEDKIGLPKDVALNDNKKRVEAPISELNSDSLPINDIGLETIVDYTNEIQNAKTVVLNGPAGVSEIEDFALGTHEIIKAAIKSDFSIIGGGHISVEVAHLGLEHRFSHISTGGGACIDFLAGEKLPGVEALKAAYNKYQEAKKL

SEQ ID NO: 59662 - protein, 222 aa, Zea mays
METMSALARTAPPLAGTIRRPSCALRPTASLSFAAASTTPRGRLGLGLSTAPAGSGRAARARAVPRRIVASSEVEQSYIMIKPDGVQRGLVGEIISRFEKKGFLLKGLKLFQCPKDLAQEHYKDLKDKPFFPKLIDYITSGPVVCMAWEGDGVVASARKLIGATNPLQAEPGTIRGDLAVQTGRNVVHGSDSPDNGKREIELWFKEGELCQWESVQAPWLIE

SEQ ID NO: 59663 - protein, 352 aa, Thermus thermophilus HB27
MDWLLTPGPVRLHPKALEALARPQLHHRTEAAREVFLKARGLLRQAFRTEGEVLILTGSGTLAMEALVKNLFAPGERVLVPVYGKFSERFYEIALEAGLVVERLDFPYGDTPRPEDVAKEGYAGLLLVHSETSTGALADLPALARAFKEKNPEGLVGADMVTSLLVGEVALEAMGVDAAASGSQKGLMCPPGLGFVALSPRALERLKPRGYYLDLARELKAQKEGESAWTPAINLVRAVAAVLEAVLPRLEEHLALKAWQNALLYGVGEEGGLRPVPKRFSPAVAAFYLPEGVPYARVKEAFARRGAVIAGGQGPLKGKVFRLSLMGAYDRYEALGVAAMFREVLEEILPAS

SEQ ID NO: 59664 - protein, 598 aa, Vibrio vulnificus YJ016
MQTETTALWLAGIGVIGLACQWFAWRLKLPAILFLLVAGLLVGPVSGLLQPELLLGDLLFPMVSLAVAVILFEGSLTLNFREIRGVSNTVWSIVTLGAVVSWGLTSTATHYLLGFDWPLALLFGSLTVVTGPTVIVPLLRTVRPSTRLSNILRWEGILIDPLGALFVVMVYEFIVSSSETHSLVVLAWILAIGLGLGVLFGQFLAVVLRRSWLPEYLQPFAVLSLVLGVFALSNHLEHESGLLTVTVMGMWLANSKGVDIKHILHFKEHLTILFITGLFILLAARIQPEDFYTLGISALVLFAFIQFVSRPVSIYLATLRSSLNGKEKAFLAWVAPRGIVAASISSLFAIKLESLGMSEAALLVPLTFMVIIGTVVLQSATARPVAVALGVSEPAPKGFLIIGANDVARTLAQAINKYDCRVVLTDSNWDYIRQARMAGLDNYFGNPVSSHADEYLNLIGIGHVVALSPDRYFNIMACMHFLNDFSDKRIFCLYDKSNGNGSGDKHSVSDGYKGLPFLDEAISYKKLASLINQGAEVRHTKISENYTYADYRETHANNYVLPLFVVDTNGRVQICHNSANFSPKEGETIVSLIKVQEA

SEQ ID NO: 59665 - protein, 279 aa, Triticum aestivum
  misc_feature (36)..(36): Xaa can be any naturally occurring amino acid
  misc_feature (58)..(58): Xaa can be any naturally occurring amino acid
  misc_feature (67)..(67): Xaa can be any naturally occurring amino acid
  misc_feature (76)..(76): Xaa can be any naturally occurring amino acid
  misc_feature (92)..(92): Xaa can be any naturally occurring amino acid
  misc_feature (129)..(129): Xaa can be any naturally occurring amino acid
VRVKASRTLFFRKKEFRVLLFRTPRGIPWAPPGPEXPFEPPGVFPDKDQGPAHIKGGXKKVIISAPXSKDAPMFVXGVNEEGYKSDIDIVSXASCTTNCLAPPAKGINDRFGIVEGLMTTVHAMTATQXKTVDGPSSKDWRGGRAASFNIIPSSTGAAKAVGKVLPELNGKLTGMAFRVPTVDVSVVDLTVRLAKPATYDQIKAAIKEESEGNLKGILGYVDEDLVSTDFQGDNRSSIFDAKAGIALNDNFVKLVSWYDNEWGYSTRVVDLIRHMHSTK

SEQ ID NO: 59666 - protein, 342 aa, Vitis vinifera
MGTPRSDKKIKIGINGFGRIGRLVARVALQSNDVELVAVNDPFITTDYMTYMFKYDSVHGHWKHHDVKVKDSKTLLFGEKSVTVFGVRNPEEIPWAETGADYVVESTGVFTDKDKAAAHLKGGAKKVIISAPSKDAPMFVMGVNEKEYKPDIDIVSNASCTTNCLAPLAKVINDRFGIVEGLMTTVHAITATQKTVDGPSSKDWRGGRAASFNIIPSSTGAAKAVGKVLPALNGKLTGMSFRVPTVDVSVVDLTVRLEKSATYDEVKAAIKEESEGKLKGILGYTEDDVVSTDFIGDSRSSIFDAKAGIALNANFLKLVSWYDNEWGYSSRVIDLIRHMASV

SEQ ID NO: 59667 - protein, 330 aa, Xanthobacter autotrophicus Py2
MSVSIRAHEVRIAAYGAADALVLQEVDLPAPGAGEVLVRQHAVGINFIDIYHRRGVFPIPHLPGAIGVEAAGVVEEVGPGVTRLRAGDRVAYAGPPVGSYASARVLPEAALVKLPDAISFEAAAALMLQGMTAHMLFTRVRRVAAGDTVLVHAAAGGLGLLLVQWAKALGARVIGTVGSPTKAEHALRAGCCDVILYKEQDFATETRRLTDGAGVDVVYEGLGGDVLLKSLDCLKPFGLAVNLGQVGEPLGAVELARLGPQRSLTVAVPGVFSHLRTLPDLQAGADEMFAMVTSGAVAPTVGLSLPLADAGEAHRRLEAGTTTGSLILIP

SEQ ID NO: 59668 - protein, 521 aa, marine gamma proteobacterium HTCC2143
MFEFHPNKVATIKNDVLSGLTVALALVPEAVAFAFVAGVEPLVGLYAAFMVGLITACIGGRPGMISGATGALAVVMVALVADHGVQYLFATVVLMGLLQILAGVLRLGKFIRMVPHPVMLGFVNGLAIVIFLAQLGQFGVAGEPGWLQGTVMENSIVDVAWLGGEQLYMLVGLVLVTMSIIHFLPKLTKAVPSSLVAIVVVTLLVFGLDLNTRVVGDVASIKGGLPSFHIPSVPFNIDTLMIIFPYSMILAAIGLIESLLTLRLVDEITESRGRGNKECIGQGVANTVTGFFGGMGGCAMIGQSMINVNSGGRGRLSGITAALSLLMFILVGSSLIERIPLAALIGVMFIVVIGTFEWSSFRILNKVPRSDALILILVSGVTVATDLAFAVIVGVIVSALVFAWEHAKHIRIDAKEDHNGSTVYAVTGPLFFGSVSSFLERFDPQADNDDVVIDFARSRVADHSGLEAIDTLADRYLNAGKTLHLVHLSEECRRLLRRAGSLVEVNVIEDPQYFVAEDSLA

SEQ ID NO: 59669 - protein, 387 aa, Arabidopsis thaliana
METQGKVITCKAAVAWGAGEPLVMEDVKVDPPQRLEVRIRILFTSICHTDLSAWKGENEAQRAYPRILGHEAAGIVESVGEGVEEMMAGDHVLPIFTGECGDCRVCKRDGANLCERFRVDPMKKVMVTDGKTRFFTSKDNKPIYHFLNTSTFSEYTVIDSACVLKVDPLFPLEKISLLSCGVSTDKCLWNEGVGAAWNVADIQPASTVAIFGLGAVGLAVAEGARARGASKIIGIDINPDKFQLGREAGISEFINPKESDKAVHERVMEITEGGVEYSFECAGSIEALREAFLSTNSGVGVTVMLGVHASPQLLPIHPMELFQGRSITASVFGGFKPKTQLPFFITQCLQGLLNLDLFISHQLPFHDINEAMQLLHQGKALRCLLHL

SEQ ID NO: 59670 - protein, 462 aa, Yarrowia lipolytica CLIB122
MTLRLAFRSVGRAMATRTAYPSLARSLATHAPSTETFTASAPEGSLVAKAVEAVQNAPAGDERPIYLDMQATTPTDPRVLDVMLNYYTDMYGNPHSRTHSYGWETDTAVEKAREEIAALIGADPKEIIFTSGATESNNMVIKGIARFYKGRKRHIITTQTEHKCILDSCRYLQDEGFEVTYLPVLSSGLIDMKQLEAAIRPDTALVSIMAVNNEIGVIQPIAEIGALCRSKKVFFHTDAAQAVGKIPIDVNADKIDVMSISGHKLYGPMGIGACYVRRRPRVRLEPIITGGGQERGLRSGTLAAPLVAGFGEAARLCRQEMPYDTAHIKKLSDKLKNGLLAMEHTSLNGDAEHHYPGCVNISFAYVEGESLLMALKDIALSSGSACTSASLEPSYVLRALGADDALAHSSIRFGIGRFTTEAEVDYVLKAVQERVNFLRELSPLWEMVQEGIDLDSIEWSQH

SEQ ID NO: 59671 - protein, 348 aa, Antirrhinum majus
LSFDLVEAWIRDNPKASICTPEGAYNFKNIANFQDYHGLPVFRNAVARFMEKVRGNRVRFDPDKIVMSGGATGAQETLAFCLADPGDALLVPTPYYPGNDRDITWRTGIQLLPVVCESSNEFKLTHEALESAYKKAQDSNIKVKGLLLNNPSNPLGIVLDKQTLTDSLNFTNDKNIHLICDEIYSATVFSQPSFTSIAEIVQENENYNRDLIHIVYSLSKDLGFPGFRVGIIYSYNQTVMNCARKMSSFGLVSTQTQHLIATMLSDSDFVDRFIDESAKRLGKRHGVLSRGLAQVGIGSLKSNAGLYCWMDLRRLLKEPTFEAELDLWRVILNEVKLNVSPGASFHCS

SEQ ID NO: 59672 - protein, 302 aa, Saccharomyces cerevisiae
MNRFKQLEKLGNGTYATVYKGLNKTTGVYVALKEVKLDSEEGTPSTAIREISLMKELKHENIVRLYDVIHTENKLTLVFEFMDNDLKKYMDSRTVANTPRGLELNLVKYFQWQLLQGLAFCHENKILHRDLKPQNLLINKRGQLKLGDFGLARAFGIPVNTFSSEVVTLWYRAPDVLMGSRTYSTSIDIWSCGCILAEMITGKPLFPGTNDEEQLKLIFDIMGTPNESLWPSVTKLPKYNPNIQQRPPRDLRQVLQPHTKEPLDGNLMDFLHGLLQLNPDMRLSAKQALHHPWFAEYYHHAS

SEQ ID NO: 59673 - protein, 279 aa, Campylobacter coli RM2228
MKELFIKHLENHLPKVQSFHPFFNEALAKMLKAGGKHFRAQLLLGVVQNKAPHLIPNALNAALALEFIHTYSLIHDDLPAMDNADLRRGTPTLHKSYDETTAILVGDALNTEAFLLLSNLNLKESIKINLIRTLAFNAGINGMILGQAIDCYFEDKKLNLEELEFLHTHKTAKLIAAALKMGCEICELDEKESEKIYQIGLKLGLIFQINDDIIDETMSEEESGKPSKHDEHKNSFVNLLGLEKAIQSKENLINECKNDLGDLDANLAHMIKSLMIKYL

SEQ ID NO: 59674 - protein, 422 aa, Zea mays
MDAAALLDAFSAAPRHQLRPAAWCRSTRFASQACRATAPFARADWQAACAILASNSTGGAGHDASSNNNAQPAPRVNGQKPPPALEATPTPDELDLVPVSNLPRPLSISDLSPAPMHGSQLRVAYQGVPGAYSEAAAAKAYPGCDAIPCDQFEVAFQAVELWIADRAVLPVENSLGGSIHRNYDLLLRHRLHIVGEVQLPVHHCLLALPGVRRELLTRVISHPQALAQCELTLNAMGLNVAREAFDDTAGAAEHIAAGGLRDTAAIASARAAELYGLQVLAAGIQDDAGNVTRFVMLAREPIIPRTDRPFKTSIVFAHDTDGTSVLFKVLSAFAFRDISLTKIESRPHRHRPIRLVDDANVGTAKHFEYMFYIDFQASMADVRAQNALAEIQEFTSFLRVLGSYPMDMTPWDAALSSRASQY

SEQ ID NO: 59675 - protein, 290 aa, Triticum aestivum
MEGKEEDVRLGANRYSERQPIGTAAQGGGDDKDYKEPPPAPLFEPGELKSWSFYRAGIAEFIATFLFLYVTVLTVMGVSRSPSKCATVGIQGIAWSFGGMIFALVYCTAGISGGHINPAVTFGLFLARKLSLTRAIFYIIMQCLGAICGAGVVKGFQQGLYTGNGGGANVVASGYTKGDGLGAEIIGTFVLVYTVFSATDAKRNARDSHVPILAPLPIGFAVFLVHLATIPITGTGINPARSLGAAIIYNRDHAWNDHWIFWVGPFVGAALAAVYHQVIIRAIPFNKSRS

SEQ ID NO: 59676 - protein, 396 aa, Azoarcus sp. BH72
MRPVRLPRLSQRSADVQPFHVMELLRRARDLEAMGRDIIHMEVGEPDFPTPAPVVAAATRFLDGGDVHYTPALGLPALREAIARFYHDRFGADVAPDRIIVTAGASGALMLALAATTNPGDEWLLPDPGYPSNRHLVRSFEGVAQALPVDAATRYQPTAAQVDAAWSARTLGLMVATPSNPTGTLLDAAELAALHRGTQARGGLLIVDEIYQGLTYGVEASTVLSQPALNAADDLFVVNSFSKYFGMTGWRLGWLVAPPAYVREIEKLAQHFFIAPSTPAQHAALAAFAPDTTEILEARRHEFAARRDTLLPALRELGFVVATEPQGAFYIYADVSALASDSEQLARRLIEEAGVAATPGLDFGHHHPRRHLRIAYTTRQDRLLEAAERIAAVLRP

SEQ ID NO: 59677 - protein, 1621 aa, Arabidopsis thaliana
MTPKASVSHQKTSYRKVWTKSRRGRRVFDCYHCGKTGHIRSFCYKFKDKVKQLWQARKCFIEPLKFGKVWVNKLDLYSKSQEHDEEKYNRVVDESEEINLICNASLMQLDESAEDESEEINLTCNVSIMKLDESDEDEPVVAKVAYTSTDGSASNPWYFDSGCSRHMTGNPGVLSTYTEEACGKGLKANLISISQLCDDGLKVTFTKTDCQAMDENKNAVLSGLRSGNNCYMWTTSDTCLSATISDLELWHKRLGHMDSVRGVPKLGDKLDYLCGACNKGKQIKVNHKKGSEIGSKKILELIHMDLMGPVQVENINGKKYIFVLVDDFSRYTWVRFLREKYEAVESFKILALQLQNEKGNIVQIRSDHGGEFQNETFEKFCQSQGIRHQYSALRTPQQNGVIERKNRTLQEMARAMIHRNDMYEGYSTNSSAYRVYNKRTKTISDSVNVVFDDKARFVLPPVSDERPVKAASKPIETPVAPVAEETENEQPDDQKESVESQSPVVTAAAKKLIVPKNHKVGDVIDALEDEFWYCACTEELNQFSRNDVWDLVPRPAHVNVVGIKWIFKNKIDESGNVVRNKARLVAQGYSQAEGVDFDETFAPVARLESIRLLLGIAGILKIKLHQMDVKSAFLNGFLQEEVYVAQPKGFEDPHFPEHVYKLKKALYDLKQAPRARYERLAQFLLDDNFQRGNVDKTLFINRTGAHILIVQMYVDDIVFGSTDPKLVNKFVKTMTEEFEMSMVGELNYFLGLQITQSSTGIFISQSTYAKNLIKRFDMQTCKTAYTPMSKASKLSKDEGGHAVDQKLNRSMIGSLMYLTASRPDLCHSVCLCAHYQANPKVSHMNAVKRIIKYVKGYCDADWSGCIDDKRSTSGGCFFLGNNLISWHSKKQNCVSLSSTQAEYIGMGSCCTQLLWMKQMLADYGMTSEILIIHCDNTGAIDITKNHVHHTRTKHIEIRHHFIRELVEGKLVEIHYIDTEKQLADIFTKPLDINTFSNLQMALGICKELLIMLFFRDVQQRQPDLLALVYIMLLQELLSLKLFLDVRHGNFVFSDGFSQMSGSAVLDRKNCFIVLLSQTLDRFCFSLAAADKVSSPTADLIPQLAATLVAALGAQCYRLTLPPSPPPRILTPQVPPSSATMASSFNPTRILDHRASSHRNRRGAFPASKRRRLVDEPIDYPDLSNPAYQVLSTPLFASGIGSIRELLSSSPPPTTSSQPPSVSIPPPSAPPLVLSDSKDAEPAGLTNPSAPPSPLAPKNITPVASPVADVPMPDPLISPTAETAEGASVPDAAVSYAARAAAHRQVFAERDELDRTLRRPLVPPHTKRFLSAAAAERYKHIAKRDFIFQKTLPLDPEVLTATKYFLEHSGMAQTVVAVEQFVPEVVREFYANLPEMEYRECGLDLVYVRGKMYEFSPALINHMFSIDDSALDPEAPVTLSTASRDDLALMMTGGTTRRWLRLQPADHLDTMKMLHKVCCGNWFPTTNTSTLRVDRLRLIDMGTHGKSFNLGKLVVTHTMSLARLGPLSSHRLAYPNLIYQLLTFQRDVRSRPRDTLSDEPGVFVNDPPPTQPTQAPPPMGHKLLLEDINDLLEIGKRIRRRLTVEEEPRKRKRKNLILAELL

SEQ ID NO: 59678 - protein, 758 aa, Azoarcus sp. BH72
MDELIRAAALDYHRYPRPGKIAVAPTKVLSNQRDLSLAYSPGVAAACDAIVEDPAEAANLTSRSNLIGVITNGTAVLGLGNIGALAAKPVMEGKGVLFKKFAGIDVFDLEIAEPDPDKLIDMIAALEPTFGGINLEDIKAPECFYIESKLRERMKIPVFHDDQHGTAIVVGAAILNGLQMQGKDLKQVKLVTSGAGAAALACLGLLVKLGVPVENIWVTDLEGVVYEGRTALMDPIKARYAKKTEARKLAEVIEGADVFLGLSAGGVLKGEMVAKMAAKPLILALANPTPEILPEEVKAVRDDAIIATGRSDYPNQVNNVLCFPFIFRGALDVGATTITDEMQLAAVRAIAELARAEQSDIVAAAYGEKVSGFGTEYIIPRPFDPRLIVKIAPAVAEAAMSSGVATRPITDWDAYRGHLNNFVWHSGLLMKPVFAAAKKAPKRIIFSEGESEKVLRAVQTVIDEGMARPILIGRPDVIANNITRFGLRMEAERDFELVNPESDPRFKELWTHYHALTERKGVSVEYAKKEVRRRTTLIGSLLLKFGYGDGLICGTYGMHRLHLDFVETVLGRREGVNHCYTLNVLSLPERTLFLADTYVNYDPTPEQVVEMTRLAAEEMQRFGVEPRVALLSHSSFGSADSPTAEKMRTALRLLHERHSELQVEGEMHGDSALDAKLRTQIFPNARMREDANLLIFPTLDAANIAFNLLKSAAGEGMTVGPILLGAAKPVHILTPSATVRRIINMTALTVVEAGQQGA

SEQ ID NO: 59679 - protein, 333 aa, Methanosarcina mazei Go1
MVTFLEKISERAKKLNKTIALPETEDIRTLQAAAKILERGIAKVVLVGDEADIKALAGDLDLSKARIVNPKTYERKDEYINAFYELRKHKGVTLEGAAEIMSDYVYFAVMMAKLGEVDGVVSGAAHSSSDTLRPAVQIVKTAPGAALASAFFIIAVPDCEYGSDGTFLFADSGMVEMPSVEDVANIAVISAKTFELLVQDTPYVAMLSYSTKGSAHSKLTEATVAATKLAQELAPDVAIDGELQVDAAIVPKVAASKAPGSPVAGKANVFIFPDLNAGNIAYKIAQRLAKAEAYGPITQGLAKPINDLSRGCSDEDIVGAVAITCVQAAAQDK

SEQ ID NO: 59680 - protein, 268 aa, Neptuniibacter caesariensis
MLKPYLNKLLEAMWQDYLEITPEALRIYKLFSELNYQIINDHIALRTFDLEDVNIEKIARPFLESGYQPSGEYHFPAKQLYAQHFQHEDPALPKIFISQLLTESLSNENQLLVHNLIAELEPDSYMADNFCYSGRPWNLSYKDYQQLLEQSEYAAWLAAFGFRPNHFTIFINALTSHNNITEVNQFLKDNGVLLNSAGGEVKGSPDEYLEQSSTLAKKVLVNFSDCSAEIPGCYYEFAKRYPLDDGSLYQGFVAASADKIFESTDTQS

SEQ ID NO: 59681 - protein, 160 aa, Glycine max
MGVAVLYPQDSLPHKPSTHYQTIIPHFPSMNPKSHRTSRNRKKRPVPGPARPTTSSKSQVNNKPPQQLVMGQVKILKRGELLSQTTPDPQPQTESVEKKTETVVKKGLTSTVEGLYAGYSMLVMSPPPSSVPLPAFITKKFAALSEATSDLREMLRLDFP

SEQ ID NO: 59682 - protein, 309 aa, Thermus thermophilus HB27
MLVTGGAGFIGSHIVEDLLARGLEVAVLDNLATGKRENVPKGVPFFRVDLRDKEGVERAFREFRPTHVSHQAAQASVKVSVEDPVLDFEVNLLGGLNLLEACRQYGVEKLVFASTGGAIYGEVPEGERAEETWPPRPKSPYAASKAAFEHYLSVYGQSYGLKWVSLRYGNVYGPRQDPYGEAGVVAIFAERILKGLPVTLYARKTPGDEGCVRDYVYVGDVAEAHALALFSLEGIYNVGTGEGHTTREVLMAVAEAAGKAPEVQPAPPRPGDLERSVLSPLKLMAHGWRPKVGFQEGIRLTVDHFRGAV

SEQ ID NO: 59683 - protein, 299 aa, Oryza sativa
  misc_feature (48)..(48): Xaa can be any naturally occurring amino acid
  misc_feature (95)..(95): Xaa can be any naturally occurring amino acid
  misc_feature (196)..(196): Xaa can be any naturally occurring amino acid
  misc_feature (210)..(210): Xaa can be any naturally occurring amino acid
  misc_feature (228)..(228): Xaa can be any naturally occurring amino acid
GDTFKAKPGKAGGSGEAPPEPEPAAAATGSDAGPHKTGRGSTEPQAAXTPPGRRDGRAARTRGERHTQRGEPKPRERESRKRGTEEGQPTPDHRXRAPGGTTKTPGAKRATGEEGQTGAAAREKERGGRRARREADRPGGRKRRNERPTGPGQETKAGARPPFLLASQGSVDALNSILKEPVPMNRFRPNIIVEGXSPYSEDLGKTLKIXKLTFLGVKLWGRCQVPTXINQDKGDSWGRNQRKAPTKALPVLIEMGWGPETPKKLNPPGPFFGGKNFISGKGNPPFRAKKDGKGRGYLP

SEQ ID NO: 59684 - protein, 404 aa, Neptuniibacter caesariensis
MSSNINRDTFNQVMVPNYSPMASIPVRGLGSRVWDQQGREYIDFAGGIAVNALGHSHPELVQALKEQAEKLWHLSNVWTNEPAIQLAQSLCTKTFAGRVYFANSGAEANEAAFKLARKYAYDHFSADKHEIISCVNSFHGRTLFTVSVGGQDKYREGFEPVPAGISHVPFNDLDALEAAISDKTCAVVIEPIQGEGGIMPASKAYLMKARELCDKHNALLIFDEIQTGVGRTGQLYAYQAYGVTPDILTTAKALGGGFPVGAMLTTEPIATALNIGSHGSTYGGNPLACAVANKVLSLIDSEEVLNGVEKRHQIFIEQLRQLNKTAPVFSEFRGMGLLLGCELQPAFKGKARDLLQLALEHGLMLLIAGPDVIRMTPSLIIPEEDIHQGMQRFTQAAEQFLQQQ

SEQ ID NO: 59685 - protein, 295 aa, Saccharothrix mutabilis subsp. capreolus
MTGLYSLADLSPADVLALADRSVQLHRDRTAHDRPLTDLVVGTLFTKTSTRTRTAFTTAALRLGASVVAFGPDELQTATGESTADTGRVLASMLDGLVVRTAGPVARQRELSGGGVLPVVNAMSREEHPTQGLTDLAVLRHHFGDLAGVRVLYVGEGNNTAAALVHALAAVPGCELVLACPKGYGPRDPGPWREVADLAEVTGDVDVVYTTRWQTTGTAKADPDWREAFRPFHVDTALMDRWPDAVFLHDLPAHRGEEVAGAVLDGARSLAWTQAAMKAASAMAVLERFVGGRRA

SEQ ID NO: 59686 - protein, 566 aa, Prochlorococcus marinus subsp. marinus str. CCMP1375
MHMKDLYEPSTTRTFTEFSQHADYSLMESLQADPQATSDGNDHKPRQVFSGHYVPVSPTAIPAPEYIAHSKILFNELGLSNELVLDEQFRRLFSGDISVAQDPMRPVGWATGYALSIYGTEYIHQCPFGTGNGYGDGRAISVFEGLFNGRRWEMQLKGAGPTPYCRGADGRAVLRSSVREFLAQEYMHALGVPTSRSLTLYVSRSETVDRPWYTNDSRATDPDILVNSPAAITTRAAPSFIRVGQLELFARRVRNNAQNSSLNELQMIVKHLIKRNYKRVIDPNLPFANQVVELAHLFRGRLISLVTNWMRIGYCQGNFNSDNCAAGGFTLDYGPFGFCELFDPSFQPWTGGGEHFSFFNQPVAAKANFQMFCASIRPLITGNKEVIARLDKIQDEFSEAMDQEIEAMWAKKLGINHYDATLVNELLQLMILSKVDYTIFFRKLSDIPDQLTTLKPSFYQSTSQHVDARWNSWLQRWQNRIKSCGDLAMTSAAMKRINPKYTWREWLIAPAYKQAEQGDYSLIKELQDVFRNPYDEQSSEVSIKYDRLKPKEFFNAGGVSHYSCSS

SEQ ID NO: 59687 - protein, 379 aa, Prochlorococcus marinus str. AS9601
MINPYKKNAKLVLSNGIVFPGFFFGASGTAVGEIVFNTGMTGYQEVITDPSYYGQILTFTYPEIGNTGINFEDSESNINIKGIIVRNFSSNNSNWRSKKNFNQWLVEKNIIGLYGIDTRALVKILRSTGAMNGVITSLDKTDESCLKIIQDTPKMEGLNLSKVVSTKQQYLWNSHTQTVFDLRKRYDESSKKLKIVAIDFGIKNSILNRLVSHGCEVLVLPSRSSLNDVLSNKPDGIFFSNGPGDPSTVSEGIDLAKSLIEYGEIPMFGICLGHQIFGLALGGSTYKLSFGHRGLNHPCGQNNKIEITSQNHGFAIDPNSLPKNLVRITHYNLNDNTVAGLEVNNKPIFSVQYHPEAGPGPHDSDYLFKKFVSLMLERC

SEQ ID NO: 59688 - protein, 593 aa, Prochlorococcus marinus subsp. marinus str. CCMP1375
MKTYKPFGLILLFTLPLPLIAQVNWKSPESIDTKKLSVSTASGQAVVVTANPLASDAALRALEEGGTAMDAVISAQTVLTVVEPQSSGLGGGSFLLYWDQAKKTLYALDGRETASAQAEEDMWMTSDGGVVPWLQATRSPSAIGVPGTTALLWEGHREFGRLPWKTNFRRSIQLAKEGFIPSPRFLRSISLAKTLGINHSRTFKSLYLPNGSLPKQNIPFHNKKLAATLIRLAKGGINEFYRGKVANELITELQLQQKNNKEIRTITHEDLENYKVQKRNPICRKYKSWKICSFPPPSGGGVAVLQALGTYEFLSKANWSDNTITRWHLLAESLRFADADRSHWIGDPIDWPVPLKGLLEEDYIRERANAIKISTTTFRPLPGKPKGSELLDLASQPRTAGGGTTHLVVVDLDGNVASYTSSVETVFGSRHLSGGMVLNNQLTDFSFLSNVSGKPIANRIKPNKRPMSSMSPVIVFRDERPILAVGSPGGWLIPHYVTNALIGALDLKLSPKEVVSQNLLSVQPAYTVLEQSNNWSKSQANIQKGLRSLGHQIKYSSFSSGIALIKWHKGSWHGAADPRREGKAVSLQVEKKH

SEQ ID NO: 59689 - protein, 289 aa, Zea mays
QTRRRHQNHGVRALAGCLRKTLPLLRHCRHLPAPTPHLRFAMNPSSSSTSSSGGYHSRAAAFASPQPRGGGGGGGRDGSDRIDALGRLLTRVLRHMAAELRIDMRTDGYVRVRDLLKLNLQTFAKAPLKSHTVDEIREAVRQDNKQRFSLLEEDGELLIRANQGHTVTTVTSESLLKPILSPDEVSVCVHGTYRKNLDSILQFGLKRMARLHIHFSSGLPSDGEVTSGVRQNVNILIHLDVSKALKGGMKLYISDNKVILTEGFDGVVPVKYFERVETWPGRAPIPFQR

SEQ ID NO: 59690 - protein, 484 aa, Chlamydophila pneumoniae CWL029
MITRTKIICTIGPATNSPEMLAKLLDAGMNVARLNFSHGSHETHGQAIGFLKELREQKRVPLAIMLDTKGPEIRLGNIPQPISVSQGQKLRLVSSDIDGSAEGGVSLYPKGIFPFVPEGADVLIDDGYIHAVVVSSEADSLELEFMNSGLLKSHKSLSIRGVDVALPFMTEKDIADLKFGVEQNMDVVAASFVRYGEDIETMRKCLADLGNPKMPIIAKIENRLGVENFSKIAKLADGIMIARGDLGIELSVVEVPNLQKMMAKVSRETGHFCVTATQMLESMIRNVLPTRAEVSDIANAIYDGSSAVMLSGETASGAHPVAAVKIMRSVILETEKNLSHDSFLKLDDSNSALQVSPYLSAIGLAGIQIAERADAKALIVYTESGSSPMFLSKYRPKFPIIAVTPSTSVYYRLALEWGVYPMLTQESDRAVWRHQACIYGIEQGILSNYDRILVLSRGACMEETNNLTLTIVNDILTGSEFPET

SEQ ID NO: 59691 - protein, 416 aa, Triticum aestivum
  misc_feature (309)..(309): Xaa can be any naturally occurring amino acid
MAGAVSALFLLDIKGRVLVWRDFRGDVTAVQAERFFTKLLDKEGDAEAYSPVVYDDAGVTYMFIQHNNIFLLTASRQNCNAASILLFLHRVVDVFKHYFEELEEESLRDNFVVVYELLDEMMDFGYPQYTEAKILSEFIKTDAYKMEVSQRPPMAVTNAVSWRSEGIRYKKNEVFLDVVESVNILVNSNGQIVRSDVVGALKMRTYLSGMPECKLGLNDKVLLEAQGRATKGKAIDLDDIKFHQCVRLARFENDRTISFIPPDGSFDLMTYRLNTQVKPLIWVEAQVEKHSRSRIELMIKARSQFKERXDATNPNIRTSMGSAAYAPERDAMVWKVKSFPGGKEYMCRAEFSLPSISAEEAVPEKKAPIRVKFEIPYFTVSGIQVRYLKIIEKSGYQALPWVRYITMAGEYELRLI

SEQ ID NO: 59692 - protein, 208 aa, Alkaliphilus metalliredigens QYMF
MNRPIFIGITGGTGSGKSTVARAIFESLPEKNIAIIEQDSYYRDQSHLALEERVKTNYDHPLAFDTALLTEHLMLLAQNKTIEKPIYDFERHTRKKEFEVIEPRDIMILEGIMILDDPALRDMLDIKIFVDTDADVRIIRRIRRDMEERGRTLTSVIQQYLTTVRPAHLQFVEPNKRYANIIIPEGGDNQVAIDIMVAKIKTIIQERS

SEQ ID NO: 59693 - protein, 501 aa, Vibrio sp. Ex25
MMVIPENSSIVIFGASGDLTYRKLIPALYHLYANKQLPENFAILGVSRTEYSDESYRAKLKKSLQEMEKTEPETLDAFINHLHYQAINTSDTQDYSKLSSRLDQLADEYRFDQRNTLFYLATPPSLYSVIPTSLAAHGLNKEEDGWKRLIIEKPFGYDLESARILDKEIHEHFQEHQIYRIDHYLGKETVQNLLVLRFSNAMFEPLWNRNFIDYVEITGAEFLGVEERGGYYDNSGAVRDMFQNHLLQVLAMVGMEPPAQINADSMRDEVVKVLQCLKPLDENALRNDLVLGQYTASEVRGQSLRGYREEPGVADDSRTETYIGLKAYINNWRWNGVPFYVRTGKRLPTRVTEVVIHFKQTPHPVFGQNAPENKLIIRIQPDEGIQMSFGLKEPGAGFEAKEVKMNFHYADLQETQMLTAYERLLLDALNGDATLFARSDAVEACWQYVQPILDFKQDPQSLFGYACGTWGPKESDDLLQRDGRAWRFPCKNLTDTDYCEL

SEQ ID NO: 59694 - protein, 332 aa, Xanthobacter autotrophicus Py2
MLKGRTLGMGELEAVENRASKLAPFATGAIAAQEAHGDVVLLTADLGKYTDTYPFRDRFPDRFYNVGMAEQALVMVAAGLARTGLSAYCTTYGAFATRRAHDFLAIACAHGGASVKMFAGNPGLTTGYGGTHQAIEDLALMRAVPDMTVIDPCDATEMQQIAEQAREMEGTVYCRLLRGNVPVVFDPATHRFELGKAKRIGSGTDIGFISTGFMTERCLDASAGLAELGIKASVLHCATIKPFDTEAVAAFAASVDKVVTAENHVLVGGLASLVLDALYANGVMKPLLKIGIPDRFIECGSIPYLQTRYGLTAARVREQVAQWLGAGAQAAE

SEQ ID NO: 59695 - protein, 489 aa, Burkholderia sp. 383
MSVFGLQRLYIGGGYVDATSGKTFDTFDPATGELLAQVQQASAADVDRAVASAQEGQREWAAMTAMQRSRILRRAVDLLRERNDELAALETRDTGKPIGETLAVDIVTGADVIEYYAGLATAIEGLQVPLRAESFVYTRREPLGVCAGIGAWNYPIQIACWKTAPALAAGNAMVFKPSEVTPLTALKLAEIYTEAGVPAGVFNVVQGDGSVGALLTGHPDIAKVSFTGGVETGKKVMSLAGASSLKEVTMELGGKSPLIVFDDADLDRAADIAVTANFFSSGQVCTNGTRVFVHRSIKDAFTQRVLERVKRIRVGKPTDADTNFGPLVSAAQLDKVLGFIESGKAEGAKLLAGGTRLTDGHFGSGQYVAPTVFGDCRDDMKIVREEIFGPVMSILDFESEDEVIARANDTHYGLAAGVVTENLSRAHRTIHRLEAGICWINTWGESPAEMPVGGYKQSGVGRENGITTLEHYTRIKSVQVELGRYNPVF

SEQ ID NO: 59696 - protein, 482 aa, Vibrio sp. Ex25
MKGDIGVIGLAVMGQNLILNMNDHGFKVVAHNRTAAKVDEFLEGPAKGTNIIGAYSLEELVEKLETPRKVMLMVRAGDVVDKFIDALVPLLDKGDIIIDGGNTNYPDTNRRVAALREKGIHFIGTGVSGGEEGARFGPSIMPGGAPEAWEAVKPIFQGISAKTDAGEPCCDWVGNDGAGHFVKMVHNGIEYGDMQLITEAYQFMKDGLGMSADEMQAVFAEWNNTELNSYLVEITADILGYKDEDGEPLVEKILDTAGQKGTGKWTGINALDLGIPLTLISESVFSRCLSALKDQRVEAEKLFGKTITPVEGDKQEWVDALRQALLASKIISYAQGFMLMREASNENGWDLNYGNVALMWRGGCIIRSAFLGNIRDAYEANPELAFLGSDDYFKGILQNSLVAWRKVAAKSLEAGIPMPCTTSALTFLDGYTTARLPANLLQAQRDYFGAHTYERIDRERGEFFHTNWTGTGGDTASTTYDV

SEQ ID NO: 59697 - protein, 347 aa, Antirrhinum majus
VSFDLLEEYLEKHSEATNCDSRNSGFRENALFQDYHGLLSFRKAMASFMEQIRGGRATFDPERVVITAGAPPANELLTFILANPGDALLIPTPYYPGFDRDLRWRTGVNIVPIHCDSSNNFEITPQALEAAYNEAESKNIKVKGVLITNPSNPLGATIKRAILEQILEFVTRKNIHLISDEIYSGSSFSPEEFVSIAEILEAQDYKNSERVHIVYSLSKDLGLPGFRVGTIYSYNDKVVTTARRMSSFTLISSQTQHLLASMLSDKEFTKEYININRSRLRKRYEMIVDGLKEAGIECLKGNAGLFCWMNLKPLLEKPTKEHEVELWKLIMYEVKLNISPGSSCHCS

SEQ ID NO: 59698 - protein, 434 aa, Antirrhinum majus
MALSRKATCNSHGQDSSYFLGWEEYEKNPYDAVLNPKGIIQMGLAENQLSFDLLESWLSENPDAAGFKRNGESIFRELALFQDYHGLPAFKNAMVNFMSEIRGNKVNFDPNKLVLTAGATSANETLMFCLAEPGDAFLLPTPYYPGFDRDLKWRTGVEIVPIQCTSSNGFRITAPALEDAYELAQKRNLKVKGVLVTNPSNPLGITLTRQELNLLVKFIDKKGIHLISDEIYSGTVFNSRILSASWKFSRTENMLMIKSYWNRVHIEYSLSKDLGLPGFRVGCIYSNDPVVVAAATKMSSFGLVSSQTQYLLSAMLSNKKFARSYIVENQKRLRTVHAMLVRGLKSTGISCLESNAGLFCWVDMRHLLSSNTFEAEMDLWKKIVYEVGLNISPGSSCHCDEPGWFRVCFANMSEETLELAIQRIKLFVNRHHCN

SEQ ID NO: 59699 - protein, 506 aa, Vibrio sp. Ex25
MIYAQPGSENAIVNFKSHYDNFIGGEWVKPTGGEYFDNISPINGQAYCKVARSGEADINLALDAAHNIRTKWAKTSVTERSNILLKIADRIEQHLEELAVAETWENGKPVRETLAADLPLVVDHFRYFAGCIRAQEGSAAELDEHTASYHFPEPIGVVGQIIPWNFPMLMAAWKLAPALAAGCCVVLKPAEQTPTSILVLMEKIGDLLPPGVINVVNGFGSEAGQALATSNRIAKLAFTGSTQVGNHILKCAADNLIPSTVELGGKSPNIYFSDVFDYEDEYLDKCIEGTLLGFFNQGEVCTCPSRVLVHEAIYDKFVEKLTERAQLIKQGNPLDTDTQVGAQASQEQFDKILSYLEIGREEGAKVVFGGGVSEQPESINQGYYIQPTMLEGHNKMRIFQEEIFGPVIAITKFKDEAEALEIANDTEYGLGAGVWTRDANVAYRMGRNIEAGRIWINCYHAYPAHAAFGGYKKSGIGRETHKMMLDHYQNTKNLLISYSVDPLGFF

SEQ ID NO: 59700 - protein, 85 aa, Fragaria vesca subsp. vesca
KWKGKTAEELTESVEFFGEIVTGPFEKFTQVTMILPLTGQQYSEKVSENCVAIWKKFGIYTDAEAKAIEKFIEVFKDQTFPPGAS

SEQ ID NO: 59701 - protein, 380 aa, Pichia angusta
MSTVGKTITCKAAVAWEAGKDLTIETIEVAPPKAHEVRVKIAYTGVCHTDGYTLSGNDPEGQFPVIFGHEGAGVVESVGEGVTSVKVGDHVVCLYTPECRECKFCKSGKTNLCGKIRATQGKGVMPDGTSRFTCKGKTLLHYMGCSTFSQYTVLADISVVAVDPKAPMDRTCLLGCGITTGYGAAINTAKISEGDNIGVFGAGCIGLSVIQGAVKKKAGKIIVIDVNDAKKDWAFKFGATDFVNPTKLPEGQSIVDKLIEMTDGGCDFTFDCTGNVQVMRNALEACHKGWGESIIIGVAPAGKEISTRPFQLVTGRVWRGCAFGGIKGRTQMPDLVQDYMDGEIKVDEFITHRHPLNDINQAFHDMHKGDCIRAVVTMDE

SEQ ID NO: 59702 - protein, 499 aa, Saccharomyces cerevisiae
MSRLERLTSLNVVAGSDLRRTSIIGTIGPKTNNPETLVALRKAGLNIVRMNFSHGSYEYHKSVIDNARKSEELYPGRPLAIALDTKGPEIRTGTTTNDVDYPIPPNHEMIFTTDDKYAKACDDKIMYVDYKNITKVISAGRIIYVDDGVLSFQVLEVVDDKTLKVKALNAGKICSHKGVNLPGTDVDLPALSEKDKEDLRFGVKNGVHMVFASFIRTANDVLTIREVLGEQGKDVKIIVKIENQQGVNNFDEILKVTDGVMVARGDLGIEIPAPEVLAVQKKLIAKSNLAGKPVICATQMLESMTYNPRPTRAEVSDVGNAILDGADCVMLSGETAKGNYPINAVTTMAETAVIAEQAIAYLPNYDDMRNCTPKPTSTTETSLPRVAAVFEQKAKAIIVLSTSGTTPRLVSKYRPNCPIILVTRCPRAARFSHLYRGVFPFVFEKEPVSDWTDDVEARINFGIEKAKEFGILKKGDTYVSIQGFKAGAGHSNTLQVSTV

SEQ ID NO: 59703 - protein, 125 aa, Triticum aestivum
  misc_feature (122)..(122): Xaa can be any naturally occurring amino acid
MATTPGLCGSVLLSTSFLRKQAMASVNMRMLKANAGVFGLKGGRGGRVSAMASYNVKLITPEGEQEFECPDDVFILEKAEEFGIDLPYSCKAGACSSCAGKVVSGKVDQSDGSYLDDTQIGXGFV

SEQ ID NO: 59704 - protein, 473 aa, Colwellia psychrerythraea 34H
MYTYNKLYINGDWQLPNTEDTIDVINPANSELCAKTPSASIADVDKAIAAAKYAFAQWSATTPAERSQLITAIADEMQNRIDDFASAISTSMGCPKHLAFDIQVQGAIDAFRGYADMTSYVDESSTEHGVMQCHSAVGVCVLINPWNYPLSQLVGKIGPALATGCTIVAKPAEQTPLQDLILAEIFDKVGVLAGVFNVITGYGFKIGEHLCSHPDVDMVSFTGSTGAGIKVAQAASTTVKRVCQELGGKSPFIITDDADLAAAVRYGVEDVMINSGQTCCALTRMLVPESLYQQAIVIAKAVAEENVVGDPQDENVTMGPLSSSLQQKRVLDYINIGIKEGAELVTGGPEIPARLQQGAYVMPTIFTNVTNDMTIAQEEIFGPVLCMIPYSDEQEAIKIANDTVFGLSSGVFAKDANAALQIARKIRAGQSYIQGTYFNSHAPFGGFKQSGNGREWGVEGLREFIEVQSIIIT

SEQ ID NO: 59705 - protein, 759 aa, Pseudomonas syringae pv. phaseolicola 1448A
MLNTLRKIVQEVNSAKDLKAALGIIVLRVKEAMGSQVCSVYLLDAEVNRFVLMASEGLNKRSIGKVSMAPNEGLVGLVGTREEPLNLENAADHPRYRYFAETGEERYASFLGAPIIHHRRVVGVLVIQQKERRQFDEGEEAFLVTMSAQLAGVIAHAEATGSIRGLGRQGKGIQEAKFVGVAGSPGAAVGVAVVMLPPADLEVVPDKTVTDIAAELALFQNALEGVRNDMRTLSAKLATQLRPEERALFDVYLMMLDDASLGSEVTDVIKTGQWAQGALRSVVSEHVKRFELMDDAYLRERASDVKDLGRRLLAYLQEARQQALVYPDNTILVSEELTPAMLGEVPEGKLVGLVSVQGSGNSHVAILARAMGIPTVMGLVDFPYSKVDGIDLVVDGYHGEVFTNPSEIMRKQFGKVVEEERQLSQGLDALRELPCVTLDGHRMPLWVNTGLLADVARAQQRGAEGVGLYRTEVPFMINQRFPSEKEQLAIYREQLAAFHPLPVTMRSLDIGGDKSLSYFPIKEDNPFLGWRGIRVTLDHPEIFLVQTRAMLKASEGLNNLRILLPMISSTHEVEEALHLIHRAWGEVRDEGTDVPMPPVGVMIEVPAAVYQTRDLARQVDFLSVGSNDLTQYLLAVDRNNPRVADLYDYLHPAVLQALQSVVRDAHAEGKPVSICGEMAGDPAAAVLLMAMGFDSLSMNATNLPKVKWMLRQINLSKAKELLAQLMTNDNPQVISSSLQLALKNLGLSRMINPSSVKGH

SEQ ID NO: 59706 - protein, 223 aa, Chlamydomonas reinhardtii
MVFSSSCTVYGMPDEVPITESAPLKAISPYGRTKLFQEDMFRDLAVSDKDWRILLLRYFNPIGAHPSGELGEHPVGIPNNLMPYIQQVALGQREFLRVFGNDYPTPDGTAIRDYIHVMDLAEGHVSAVVKTLATPDLGCTPINLGTGKGTSVLEMIKAFENASGKKVEHKLVDRRPGDSVAVWAATETAEEKLGWKSKYDVDDMCKHQWAWASKYPQGYETPL

SEQ ID NO: 59707 - protein, 260 aa, delta proteobacterium MLMS-1
MSSKAVVLKTPAEIEIMAEANRLVAETLTLLSTRVAPGVSTADLDGWAEEYARKHGGVPAFKGYRGFPGSLCVSLNEQVVHGIPSRKVILREGDIISMDFGVQWQGFFGDAAVTLPVGKVTPQVGRLLEVTRGSLQRGIEKVQVGNRISDISRAVQQHVEEHGFSVVRQFVGHGIGSRLHEPPEIPNYVRGGGTSPRLQAGMVLAIEPMVNAGTHEVRVLKDGWTVITRDRLPSAHFEHSVAVTEKGPRVLSGAADLIVI

SEQ ID NO: 59708 - protein, 189 aa, Triticum aestivum
  misc_feature (12)..(12): Xaa can be any naturally occurring amino acid
MAEYLASIYGTXEKDKVNCSFYFKIGACRHGDRCSRKHVKPTFSQTLLIANMYKNPVHDAAFHLTESQLQENFDLFYEDVFMELAKFGEVEDMVVCDNVGDHLVGNVYCQYRLEESAGNAVESLNNRFYAGRPLYAELSPVTDFREACCRQHEIAECNRGGFCNFMHLKHPTLTMRPELYEGQRMDIIE

SEQ ID NO: 59709 - protein, 490 aa, Oryza sativa
  misc_feature (405)..(405): Xaa can be any naturally occurring amino acid
MMDLADPNHRLIAGAALLVATLAFIKLLLSSAGGGKKRLPPTIPAAPLVGGLLRFMRGPIPMIREEYARLGSVFTVPILSRKITFLIGPEVSAHFFKGNEAEMSQQEVYKFNVPTFGPGVVFDVDYSVRQEQFRFFTEALRANKLRSYVDQMVVEAEEYFSKWGESGTVDLKYELEHLIILTASRCLLGREVREKLFDDVSSLFHDLDNGMQPVSVIFPYLPIPAHRRRDRARQRLKEIFATIIKSRKASGRAEEDMLQCFIDSKYKSGRSTTEGEITGLLIAALFAGQHTSSITSTWTGAYMLRFKQYFAAAEEEQKEVMKRHGDKIDHDILAEMDVLYRCIKEALRLHPPLIMLLRQSHNDFSVTTKDGKEFDIPKGHIVATSPAFANRLPHIFKNPDSYDPXRYAPGREEDKAAGAFSYISFGGGRHGCLGEPFAYLQIKAIWTHLLRNFEFELVSPFPETNWKAMVVGIKDEVMVNFKRRKLVVDN

SEQ ID NO: 59710 - protein, 421 aa, Mycobacterium smegmatis str. MC2 155
MALVVQKYGGSSVADAERIRRVAERIVETKKAGNDVVVVVSAMGDTTDDLLDLARQVSPAPPPREMDMLLTAGERISNALVAMAIESLGAQARSFTGSQAGVITTGTHGNAKIIDVTPGRLRDALDEGQIVLVAGFQGVSQDSKDVTTLGRGGSDTTAVAVAAALDADVCEIYTDVDGIFTADPRIVPNARHLDTVSFEEMLEMAACGAKVLMLRCVEYARRYNVPIHVRSSYSDKPGTIVKGSIEDIPMEDAILTGVAHDRSEAKVTVVGLPDVPGYAAKVFRAVAEADVNIDMVLQNISKIEDGKTDITFTCARDNGPRAVEKLSALKSEIGFSQVLYDDHIGKVSLIGAGMRSHPGVTATFCEALAEAGINIDLISTSEIRISVLIKDTELDKAVSALHEAFGLGGDDEAVVYAGTGR

SEQ ID NO: 59711 - protein, 623 aa, Gibberella zeae PH-1
MEKVNNFHAIMKMGNVRAISLTFDRNYMSTLFLKVANNCYPTPTMDPSYQSSETLFEGLPIDTLGNGLSASAVKSGIDRLLEHDIEPEHNLGRIHDRCVETLGAVWGSSCNDKPTGCAASGSSEAILLGILAMKRKWETENGGMASSNGSALNLITGSHAHVAVTNAAKANDIEIRSVPVRPEGNYSFDPSKMQGLLDRFTRHFDPIEDTSTVLDNYEQSHGHSIPIHVDAASCDFVAPFNGGKCSRWDFSVPRVISINASGHKFGLTAAALGWIIWRDQRFLSSDMLHESPYLSGHHGLPTLRYSQPSSSVLIQYYYLAHLGRKGFENIIQALLQRSSALSRTLEGTGIFACISESHRTAANTLPVVVFRVNSAVREQRPKFNEQWISDQLFHKGYSVPCSKLPIDGEDIEVLRVVIVLKVILVDKAVITRLAYDHVEIAIEDETGHLHIRKYEQYYKTIGVELRQNQHPPSTHYCERLQSPDHLRVIMSNRHVPTRRLKSGVLFSAPDDILRVPSDESTRRPKRKKFNNIRKMIPGVRKKGVGEEMALDASPALGHQESIAMFAKFVDPSSYGSSNHPNNPPVSSQKKETLCLSVLKVSLTATVEGTLAHMVLKQSFYNPL

SEQ ID NO: 59712 - protein, 552 aa, Desulfococcus oleovorans Hxd3
MKQIETDILVIGGGATGTAVARDCAMRGIPCVLVERTDLAAGTTGRNHGLLHSGARYAVKDFESAVECITENRILKKIARHCIEETGGLFVSLPEDDPAYHDALVQACRRADIPCREIDATTALAMEPNLNPAVTRAVTVPDATIDPFRLASANALDASERGAQILTHTRVTGFIQDQDAVVGARCLDRCTRETFEIRAKVVINASGVWGQELCRMADIELVMFPSKGAMVILDYRINNVVLNRCRKPADGDILVPGDTVSLIGTTSQRIAYEAISDLRVTDDEIRTLLKEGERLVPNLSRTRVLRAFCGVRPLVAASPGETHGRNITRGIVLIDHQQRDQVKNFITIAGGKLMTSRLMAEKAVNLACRKLGENLPCRTAATPLPGSEEPIPRGVRALPFSESVAQSTYYRHGKRADDILEESDGGTGLICECEMVTSREVAYALKHLHVKDIVDLRRRTRIGMGPCQGLFCAYRSAGAFIEHRHTDGTDATKMLIDFLEERWKGIRPVLWGDTLREAEFSYWICQGIFGLGKTVASSPGRGEGVCLADEFE

SEQ ID NO: 59713 - protein, 111 aa, Glycine max
  misc_feature (33)..(33): Xaa can be any naturally occurring amino acid
MASSMISSPTVTTANRPGAGLVVQLIGLNSLVXFPTLKTHHDITFIASNGGRVQCMPVWPPVGKKKFETLSYLPDLDDAQLAKEVEYLLMKGWIPCLEFELEHSFLYREHN

SEQ ID NO: 59714 - protein, 421 aa, Hydrogenobacter thermophilus
MLKVESVYRWEGSLKVPQEGKFIKLKEDKSIEVPNFPIIPFIEGDGIGAEIMPAMIHIVNTAVEKAYGGSRNIFWVELLAGDKAEEKTGKRMPEETIEFLKEAVVGIKGPLGTPVGKGGKSLNAILRQSMDFYSAIRPVYWLGQPAPIPNPERVNVAVFRENSDDVYMSIEYMPKEERTQKVRKFFIEEMGVSEYALPEDCGITVKPMSEFKTKRHVRKALRWALQNNKKVVAVVGKGNIMKATEGAFMNWAFEVAKEPEFEGKVITEGEPKDGQVLMVKVITDQMLMQLVLKPEAYHVIITQNLNGDYISDLASALVGGPGFVPSGNIGDGYALFESTHGTAYDIAGKGIANPLSLTLSGAMMLEYLGWKEASELIYSAVKRTIAERLGTPDIANGFRKQGLEAKELTTLEFAKAIADRI

SEQ ID NO: 59715 - protein, 252 aa, Burkholderia sp. 383
MFELSGKVAVITGGASGIGLGIARGMVDAGANVVLVGRDRDKGDAAIASLPGGSERGLFVPADITRRDACMTAIEQAERRFGRLDILVNNAGMNIRQQGHELTADDWYRIIDTNLSGAHFCAQAIHPAFRRAGGGKIINIGSMLSLFGTTYGAAYAASKGGIVQLGKAWAVEWAPDNIQVNTLLPGWIETELIAEAKRLFPDLERSVLERTPLRRWGKPQDLAGIAVALCAPECDFVTGAVIPVDGGYSVQG

SEQ ID NO: 59716 - protein, 398 aa, Burkholderia sp. 383
MSSNRGVVYLGPGQVEVQKIDYPKMVDPSGRAIGHGVILKVVSTNICGSDQHMVRGRTTAPVGLVLGHEITGEVVEIGRDVETLKLGDLVSVPFNVACGRCAMCKDTHTGVCLNVNPSRAGGAYGYVDMGGWIGGQAEYVLVPYADFNLLKFPDRDQAMSKIRDLTCLSDILPTGYHGAVSAGVKPGSTVYIAGAGPVGMAAAASARLLGAAVTIVGDMNAERLAHARAMGFETVDLSKDASLGEQIEQILGVPEIDCAVDCVGFEAHGHGSSGHSEEAPATVLNSLMEITRPAGAIGIPGLYVTDDPGAKDKAAQHGSLSIRFGLGWAKSHSFFTGQTPVLKYNRNLMQAILFDRLPIAKIVNVEVISLDQAPEGYKKFDGGAPRKFVIDPHGLLAA

SEQ ID NO: 59717 - protein, 340 aa, Burkholderia sp. 383
MSTESALQATIQALVQDGKGLLAADESGPTIAKRFKTIAVESTEENRRAWRTLLLSTPGLGEFVSGVILYEETLGQCADDGTPLPELAARQQIVPGIKVDAGKIPLALAPGDEITQGLDGLAARLDGYQRQGARFAKWRAVYNVSATLPGHAAIQANAEALARYAAICQEAGVVPIVEPEVLMDGDHSIGRCAQVTDAVLHAVFDALHRHRVVLAHMLLKPSMVVAGSTHTAQPAPAEVAEATVRLLRSAVPAEVPGIFFLSGGQTPEEATAHLDAMNRVAGRPWLLSFSYGRALQEPPLAAWQGQAANVRAAQDALLLRARLNGAACRGQYDAAMERTP

SEQ ID NO: 59718 - protein, 342 aa, Polaromonas sp. JS666
MQLTLNLKKFPRHSLTFGPTPIQPLRRLSAHLGGKVELYAKREDCNSGLAFGGNKTRKLEYLIPEALAQGCDTLVSIGGIQSNQTRQVAAVAAHLGMKCVLVQENWVNYSDAVYDRVGNIEMSRILGADVRLDAAGFDIGIRPSWEQAMDDVRKAGGKPFPIPAGCSEHPYGGLGFVGFAEEVRAQEAELGFRFDYIVVCSVTGSTQAGMVVGFAADGRADRVIGIDASAKPEKTKAQILRIAKNTARLVELDRDITAKDVVLDTRYGGPEYGLPNEGTLEAIRLCARQEGMLTDPVYEGKSMHGMIDMVRRGEFAEGSKVLYAHLGGVPALNAYSFLFRNG

SEQ ID NO: 59719 - protein, 257 aa, Arabidopsis thaliana
GSKRLRRPSVRLGDIGGDQYHQHVVAAYDSPQVRRPKWRPSGGGGGGGGNRKEPNNQSGKTTSSSRTRTMTNLSSGGYENTGTLDEDPVSIGSWRVKKWVKSSGGETAATTTTNTASAKRVRSNWATRNDGVEQGDEKFSGEEEEEEEDEELGGEEGFRDFSREDSESPMKERRRYENREVELLGDWQSGGRGKEGVKIWLQELGLGRYWPMFEMHEVDEQVLPLLTLEDLKDMGINAVGSRRKMYCAIQKLGREFS

SEQ ID NO: 59720 - protein, 363 aa, Candida albicans SC5314
MDSTGTTIRKQKNQAYEEEKLHHTPWVEKYRPKSLNDVSSQEHTIKVLTQTIKSGNLPHMLFYGPPGTGKTSTILALAKELYGPNLYKSRVLELNASDERGISIVREKIKNFARLTISNPTKEDLQNYPCPPYKIIILDEADSMTNDAQSALRRTMENYAGITRFVLICNYITRIIDPITSRCSKFRFKLLNNENAQLRLKYIGQQENLRFESENNEHQVIQELLKISGGDLRKAITYLQSAAKLSETFDINHHQSLITIQSIRETAGILPDDILAELIQFIKSKTQQSRLIKYIDQSIILSGWSAQILLDQLHDKLILDESINSLSKNKISQIFFQSDRKLNNGTDEHIQLLNVLLQISQVL

SEQ ID NO: 59721 - protein, 433 aa, Haemophilus somnus 2336
MAKIVKVIGREIIDSRGNPTVEAEVHLEGGFVGLAAAPSGASTGSREALELRDGDKARFLGKGVLKAVSAVNNEIATALVGKEASNQAEIDQIMIELDGTENKSKFGANAILAVSLANAKAAAASKGMPLYAWIAELNGTPGVYSMPLPMMNIINGGEHADNNVDIQEFMIQPVGAKTLKEALRIGAEVFHNLAKVLKGKGLSTAVGDEGGFAPNLESNAAALACIKEAVEKAGYVLGKDVTLAMDCASSEFYNKENGMYEMKGEGKSFTSQEFTHYLEGLCKEYPIVSIEDGQDESDWDGFAYQTKVLGDKVQLVGDDLFVTNTKILKEGIEKGIANSILIKFNQIGSLTETLAAIKMAKDAGYTAVISHRSGETEDATIADLAVGTAAGQIKTGSMSRSDRIAKYNQLIRIEEALGEKAPFLGLKAVKGQA

SEQ ID NO: 59722 - protein, 538 aa, Azoarcus sp. BH72
MKLRHLAALLILPLSPGWVPHAHADEWQLVLSDRERRVEIDRASIFDSDRGTKVSWGRVVLAPEEARKAGYGTVRALNRYDCMNRSFFTIKRVYLDTAGRVVREEAVTDTSPVMVTRNSVDERMWREVCRPPTVSDLQKVAAAAGRSAAETRPAPTPAAKPAAAELKPAPSARTETKGAAPTPPVPPKTEPAATPAAGPAPAVVARAGAAETRDPPRSEGLRPADFQAPQAAAAAAARPATPAATPVSTAAAAPATPTTPATPVLPGTPGAPPVAAAPAAPAVPTPVQSAARVPAPRVAPAPVEAAPRPAAALEQRWSYDGETGPEHWARLRPDWRVCGDGKRQSPIDLREGVGVDLEPVRFDYRSTRFRIADTGTTLQVNVGEGMGMEVRGRRYELTHFTLHRPSEERVGGRAADMTVHFHHRDAEGRLAMVSVMLERGAEANPLLQALWNNLPLEKGTAYMPASSIDLGALLPASPGHFLYMGSLTTPPCTEGVLWVVMKTPVTISDEQLGIFARLYPRNARPIQPANGRLILESR

SEQ ID NO: 59723 - protein, 608 aa, Magnetococcus sp. MC-1
MQSSRASFLTLLFPFLSWMKEMNRSTINADLQAGLIGAIVTLPQAVAFAAIAGLPPQYGLYTCMVPAIIAALFGSSKHLVSGPTTAASIVIFAGLSSFATPESEQYVALAITLTFMVGIIQLAMGFARLGALVNFISHSVVVGFTAGAALLIASHQLKHFLGIHLEHGGHFFDLLKEIFSRLDETNLYVLVVGLSTLVVSILTKKFFPRVPYMIVAILFGSVLAYFFNSNIENAKIILAGDVPGNFPIFAMPQLSLDTLKQLAPLALATTLFALTEAVSIGRSLAIKSGQHVHSNQEFIGQGLSNLVGSFFSAYVATGSFNRSGLNYQIGAKTQLSAIVGGLVLLATIPLTAPLASFMPKAVMAAILFLVAWGLIDFHHIRNIFQTSHSDSVVLVTTFGGTLFLELEFAILLGVLLSLVIFLFKTSQPRVLERVPDPRLPKRRFNTDPNLPTCPQMKIIRIDGELFFGAVSHIQETFIRLRTESPEQKHLMLVASGINFLDVAGAELLAQEAHTRRKMGGGLYLLRIKPGVCEPISKGPYLDEISAMNIFESKGEAIHEVYQLLDKDICSQCSSHIFLECGGKPSKHSTDSLNSLDDLYREKPVTNPQ

SEQ ID NO: 59724 - protein, 115 aa, Bordetella parapertussis 12822
MHYHGSCHCGTIRFDVEGELTGAMSCNCSICRRKGALLWFVPRDHLRLATPDEQIATYTFNRHLIKHRFCPTCGIHTHGEGVDQQGRAMAAINIRCLDDVDLDAVAVHQYDGRAA

SEQ ID NO: 59725 - protein, 886 aa, Magnetococcus sp. MC-1
MSTEKFVYVFGNGQAEGDAGMSHLLGGKGANLAEMTRLGIPVPAGFTLCTEVCGLYLQKRRYPELLKEQVNEALLKVQSAMGAGFGSGDDPLLVSVRSGARVSMPGMMDTVLNLGLNDHTVQGLIKRTGDARFAYDSYRRFVQMYADVVLGVDHHHFEAMLNALKQQTGKVQDTDITADEWKSLVAQYKNKVLEVTQKPFPEEPQDQLWGAIGAVFDSWTIPRAITYRRLNEIPESWGTAVTVQAMVFGNMGTDCATGVAFTRDPSTGHNRFFGEYLINAQGEDVVAGIRTPQQITLEGKRLNGSTLPAMEEAMPELYKELYAVQNRLEMHYREMQDIEFTIQRNKLWLLQTRTGKRTAKAALKIAVNMVHEGLINTREAVSRVSPESLNQLLHPTLDPKADKRIIAKGLAASPGAATGRVVFEADEAEQWAATGQMVILVRDDTSPEDIHGMHSAKGIITARGGMTSHAAVVARGMGRPCVSGCAGLSINMENEQFSVGGVTVAKGDWVTIDGSTGEVMLGQVPTVPPELSGDFTAFMEWVDGFTRMKVRANADTPDDARMARSFGAQGIGLCRTEHMFFGAERIIHVRGLILAQTESDRMRAIDKILPLQRSDFAGLFREMKGYPVMIRLLDPPLHEFIPHDEEGQNEVALVFGMPIDKVRERVASLKEFNPMLGHRGCRLGISFPEIYEMQVRAIMEAACQLVKEEGFIITPEIMIPLVGLESELSYLRERVVAVCETVMGENSVRIPYMIGTMIELPRAALIADQLAKSGEFFSFGTNDLTQTTMGISRDDAGPFLQEYVQKNLLPKDPFISIDQDGVGQLVRLAAEKGRSTRPEIKLGVCGEHGGDPESIHFFEKVKLDYVSCSPFRVPIARLAAAQAVLA

SEQ ID NO: 59726 - protein, 215 aa, Arabidopsis thaliana
MAPTIRTIGTYATQQRYLVDFFGEEFIVIVTPDPSVIGQWIHDVLSHNRFSSHPLVVGVGVRYRSDSPRVRRRFDPPADTLQLCVGNRCIIIQLSHCERVPQVLRNFLADRDYTFVGIWNSQDAGKLKRSKHELEIAVLLDLRKFVSDSSGRTMKRCSFEKIVEENLGHSGVRLDRKVSRSDWRVYDLRYVQILQASIDVYACCKLAILDHLWEY

SEQ ID NO: 59727 - protein, 271 aa, Triticum aestivum
MVKNFRKRSLESDAADNSDDEDTRRVALEEIRYMQKLRERKLGIPAASVATGAAASATTDASSARGRGGSGAGAAGEEDLVLQDTFAQETAVTIEDPNMLRYVENELLKKRGKTIEVNDKDDKDEVDELYVVPDHLKARKKNMEESSTQWTTGIAEVQLPIEYKLRNIEETEAAKKLLQERRLAGKTKSDANIPSSYSADYFHRGRDYAEKLRREHPELYKGQDSQANENGGKPTDGNNPGGPPAGRREAATDELLLERFRKREKFRVMRR

SEQ ID NO: 59728 - protein, 491 aa, Samadera bidwillii
FGPGGSVIEKKNLGHIAQIIGPVLDVAFPPGKMPNIYNALVVKGRDTVGQPINMICEVQQLLGNNRVRAVAMSATDGLTRGMEVIDTGAPLSVPVGGATLGRIFNVLGEPVDNLGPVDTRTTSPIHKPAPAFIQLDNKLSIFETGIKVVDLLAPYRRGGKIGLFGGAGVGKTVLIMELINNIAKAHGGVSVFGGVGERTREGNDLYMEMKESGVINEQNIAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEDDRLTVARARKIERFLSQPFFVAEVFTGSPGKYVGLAETIRGFKLILSGELDGLPEQAFYLVGNIDEVTAKATTLEMESDLKK

SEQ ID NO: 59729 - protein, 614 aa, Pasteurella multocida subsp. multocida str. Pm70
MQNYPLLSLINSPEDLRLLSKEQLPQICQELRAYLLESVSQSSGHLASGLGTVELTVALHYVYKTPFDQLIWDVGHQAYPHKILTGRRDQMSTIRQKNGIHPFPWREESEFDVLSVGHSSTSISAGLGIAVAAQRENAGRKTVCVIGDGAITAGMAFEAMNHAGALHTDMLVILNDNEMSISENVGALNNHLARLLTGSFYSSIREGGKKILSGMPPIKEFVKKTEEHVKGFVSPVGTMFEQLGFNYIGPIDGHNIEELISTLKNMRALKGPQFLHIMTKKGKGYAPAEKDPIGFHGVPKFDHLSGQLPKSNTTPTYSKIFGDWLCEMAENDPKLIGITPAMREGSGMVEFSNRFPQQYFDVAIAEQHAVTFAAGLAIGGYKPVVAIYSTFLQRAYDQVIHDVAIQNLPVLFAIDRAGVVGADGQTHQGAFDISFLRCIPNMVIMTPSDENECRQMLYTGYKLNQPAAVRYPRGNAIGVELTPLTMLALGKSNLIREGEKIAILNFGTLLPTAINVAEKLNATVIDMRFVKPIDVERIHQIAQTHDLIVTLEENVIQGGAGSAVAEVLHSQQHQTKLLQLGLPDFFIPQGTQQEILADLHLDEAGIETQIKNFL

SEQ ID NO: 59730 - protein, 295 aa, Pasteurella multocida subsp. multocida str. Pm70
MYQLSQDLPQLQQRINTFLAQQLNVDSSPSPLAEAMRYGVLLGGKRIRPFLVYATGRMLGADLNQLDYAAASVEAVHAYSLIHDDLPAMDDDHLRRGQPTCHIAFDHATAILAGDALQAFAFEILTQAPALQAEQKLALVQTLSQAAGVKGMCLGQSLDLISEQKHISLIELEQIHRNKTGAMLSAAIQLGRICSPHFKNDTLAQQLQRYSEAIGLAFQVQDDILDIEGESDIIGKTVGSDLLADKSTYPKLLGLAGAKQKAQELYQNAIAELESIPFDTSALRAIAEFVVNRKS

SEQ ID NO: 59731 - protein, 293 aa, Methanothermobacter thermautotrophicus str. Delta H
MKTVNILVEALPYIKKFHRKKIMIKYGGHAMIDEAAMDSTARDTVLLKYVGMEPVVVHGGGPEISRAMNKMGKEPKFIEGLRVTDEETMEIVKMVLVGKINTSIVSKICYHGGRAIGLSGKDSNLLLARKRAPHVVRDDETGERREIDLGLVGEIESVDPGIINMLTDNNYIPVISPIGVDRDANTLNLNADTVAGEVAAGIGAEKLIVLTDVPGILEDPSDPDTLIRRISVDELSDLVKSGIVEGGMLPKTLTCIQAINDGVSSAHIIDGRVEHSLLLEIFTKKGIGTMITE

SEQ ID NO: 59732 - protein, 331 aa, Methanothermobacter thermautotrophicus str. Delta H
MYRITVIPGDGIGVEVMEAALHVLQALEIEFEFTHAEAGNECFRRCGDTLPEETLKLVRKADATLFGAVTTVPGQKSAIITLRRELDLFANLRPVKSLPGVPCLYPDLDFVIVRENTEDLYVGDEEYTPEGAVAKRIITRTASRRISQFAFQYAQKEGMQKVTAVHKANVLKKTDGIFRDEFYKVASEYPQMEANDYYVDATAMYLITQPQEFQTIVTTNLFGDILSDEAAGLIGGLGLAPSANIGEKNALFEPVHGSAPQIAGKNIANPTAMILTTTLMLKHLNKKQEAQKIEKALQKTLMRGIMTPDLGGTASTMEMAEAIKEEIVKGE

SEQ ID NO: 59733 - protein, 234 aa, Nocardia farcinica IFM 10152
MPYLERQGDVFVLHLGNEGQTDSENRFHPDWIDRFNALLDEVEASEGPAALVTTATGKFYSNGLDTDWLFGNLKQMHGYLDRVHAIYSRLLTFPLPTVCAINGHAFGAGAMLASSHDFRVMRADRGFWCLPEVHLGMPFTVGMNALLTHRLGNQVCVQAMTTGHRFPAAEARAAGIVDDVAEADALLEQAVARAAALAANRKPILPIIKRALHADALAGLAVHTTPENLAFALG

SEQ ID NO: 59734 - protein, 260 aa, Streptococcus thermophilus LMG 18311
MNKKSFKLIGLVSLVASTILLVACHSDTKTEASKPKDVQWGYTGSTGPDHWGDLSKDYELSKNGKEQSPINITGAEDVDLPELNLNNQESEAQVENNGHTIEVSFKNPKNTLTIGKEVYKLQQFHFHAPAENEIDGKTYPLEGHFVYKTDNGKITVVSVLYNYGDKNQALQLIWDKMPQAANTETDLSQAISPDDFYPENKDYYNFEGSLTTPPCTEGVNWIVFKSQETVSKEQVEKFSQTLGFENNRPIQDANGRKIKA

SEQ ID NO: 59735 - protein, 323 aa, marine gamma proteobacterium HTCC2143
MLRLRSQLQAKKLPPDLVTLIDTIAIAGKDIAFRLQQGAMSGVLGSAEKENVQGETQKKLDVISNDLLKTYLLESNTVRGIASEEEENIVAGHDHAKYLVAFDPLDGSSNIDINSMIGTIFSILHAPTTETVSQADFLQPGRNQCAAGYILYGPSVMLALTTGNGVQMYTLDQRIGEFLLTTDHVVIGKDTQEFAINMSNQRSWAVPMQNYVNDLLAGSEGPRGKNYNMRWVAAMVADVHRILCRGGLFAYPWDNREPKTPGKLRLMYEANPMGMLVEQAGGSAWTDVGPILDIQPETIHQRVPVILGSINEVTACVGYHKNN

SEQ ID NO: 59736 - protein, 289 aa, Solanum lycopersicum
KELLAGLLIPKLSSRTVRQAVGVVGCVIMPHNVFLHSALVQSREIDLKKKGQVQEALNYYSIESSFALLISFMINLFVTTVFAKGFYGSEQAGSLGLVNAGQFLQDKYGGGLFPILYIWGIGLLAAGQSSTITGTYAGQFIMGGFLDLRLKKWLRALITRSCAIVPTIIVALIFNRSESSLDALNEWLNVLQSIQIPFALIPLLTLVSKEDIMGTFQCCQLVQPTPHKRIAMLVNETSKQYIQSNPDVVSIVNHYIAERPWPWGSLITEAFFSSEEVPISLCPNCHNSF

SEQ ID NO: 59737 - protein, 382 aa, Burkholderia sp. 383
MMRDAANFEPTDSRVTRPAFWNGLPERWTSDVEETLVCCHVRQETHDVKSFFFRSPQGRSFSFEPGQFLTLELDIDGETINRCYTISSSPARPHTVSITVKRVPGGKVSNWLHDNLQPGAPVRVLGPAGEFTCARHPARKYLFLSAGSGVTPLMSMSRAHHDLAEDRDILFVHSARTPDDIIFARELDLIASNHTNFRTSFVVERVGARTNWPGVTGFLTLPLLKLIAPDFMEREIFTCGPAPYMKAVRDLLDEAGFERKQYHEESFSFETLAQTASDELLADLAPPAEGADTDTKQYTVSFAKSNREISCGSEQHVLDAARQSGVRLPASCTQGMCGTCKVKLVSGQVEMKHNGGIRQREIDQGMVLLCCSKPLSDLVIDK

SEQ ID NO: 59738 - protein, 662 aa, Aegilops tauschii
MPRTVSDGGEDFDGDVSSQTGSHRHTDSNSTHHHHGYKVGFPPARGLFAEFADGVKETFFADDPLREYKDQSRSKKLWLSLVHLFPVLDWARSYKFSMFKGDFIAGLTIASLCIPQDIGYAKLAFLPAHVGLYSSFVPPLVYAMMGSSRDIAIGPVAVVSLLLGTLLQEEIDPVKSPYEYSRLAFTATFFAGITQAMLGFFRLGFIIEFLSHAAIIGFMAGAAVTIALQQLKGFLGIKKFTKKSDIISVMESVWGNVHHGWNYQTILIGASFLAFLLTTKYIAKKNKKLFWVSAIAPLISVVISTFCVYITRADKQGVAIVKDIKQGINPPSFHLIYWSGPYLAKGFRIGVVAGMVALTEAIAIGRTFAAMKDYQIDGNKEMVALGTMNIVGSMTSCYVATGSFSRSAVNYMAGCKTAVSNVVMAIVVMLTLLLITPLFKYTPNAILASIIINAVVSLVDYETAYLIWKVDKMDFVALLGAFFGVVFASVEYGLLIAVAISLGKILLQVTRPRTALLGNLPRTTIYRNVEQYPEAAKVPGVMIVRVDSAIYFTNSNYVKERILRWLRDEEDQQQEQKLSKTEFLIVELSPVTDIDTSGIHALEELLKALEKRKIQLILANPGPAVIQKLRSAKFTELIGDDKIFLSVGDAVKKFAPKSALNV

SEQ ID NO: 59739 - protein, 649 aa, Aegilops tauschii
MSRTMSDGSEDFNGNISRTGSHRQTDHHGYKVRFPPAKGLFTELAEGVKETFFANDPLREYKDQPRSKKLWLSLAHLFPVLDCPTSYTFGMFKGDFVAGLTIASLCIPQDIGYAKLAFLPAHVGLYSSFVPPLIYAAMGTSRDIAIGPAAVLSLLLGTLLQEEIDPVKNPYEYSRLAFTATFFAGVTQAMLGFFRLGFIIEFLSHAAIVGFMAGAAITIGLQQLKGFLGIAKFTKKSDIISVMESVWGNVHHGCNWQTILIGASFLAFLLTTKYIAKKNKKLFWVSAIAPLISVIISTFCVFITRADKQGVAIVSINPPSFHLIYWTGPYLVKGFRIGVVAGMVGLTAIAIGRTFAALKDYQIDGNKEMLALGTMNIVGSMTSCYVGTGSMSRSAVNYMAGCKTAISNVVMAIVVMLTLLLVTPLFKYTPNAILASIIINAVVSLVDYETAYLIWKVDKMDFMALLGAFFGVVFASVEYGLLIAVAISLGKILLQVTRPRTALLGNLPRTTIYTNVEQYPEATKVPGVMIVRVDSAIYFTNSNYVKERILRWLRDEEEQQQEQKLSKTEFLIVELSPVTDIDTSGIHALEELLKALEKRKIHLILANPGPAVIQKLRSAKFTELIGDDKIFLSVDDAVKKFAPKSALNV

SEQ ID NO: 59740 - protein, 324 aa, Zea mays
ASTTTSFSHIFTRACVEGCQKTGSLKETSIKHCMVPTDGQPVDKSWYTHEPLYLQWKDWNCKSECRYHCMMERENERAKLGLQPVKYHGKWPLKRASVFQEPLSAALSALTLVVQFNGWLSFFLLLYYKLPLRPETHKTYYEYTGLWHIYGLLAMNSWFWSAIYHSCDTIWTEKLYFSSDAAFLGYSFILAILRTLNLRDEASRVMVAAPILAFVTTHILYLNFYELDKGLNMKVCTVIIIAQCLLWALWAVMTRHPSRLKIIFVAIGGAAAVLLEASDIPPRWGYVDGRAICLAVAIPLSYLWWSFAKEDAEMRTSAILKKAR

SEQ ID NO: 59741 - protein, 256 aa, Burkholderia pseudomallei K96243
MTNLWDRAFDLTGRVALVTGGAAGIGHACARLLAQRGASVALVDRHPETAGIAAKLEGGAARHSGMSLDLRDCSAAQAGVALAASRFGGVDMLVNSAGVALLDKALDVGEAAWDATMAINVKASFFVAQAAARQMIAGARGGRIVNLASQASVVGLERHAAYCASKAAIVGMTKALALEWAPHGITVNAVSPTIVETALGKQAWAGEAGERAKREIPAGRFAQPDEIAALVLYLLSDAAAMMTGENVVIDGGYTVR

SEQ ID NO: 59742 - protein, 186 aa, Pseudomonas syringae pv. phaseolicola 1448A
MNIPNLITVLRVLLIPIFILLFYMPYHWSYMAASAVFAFAAATDWLDGYLARRLEQSTPFGAFLDPVADKLMVAVALVLLVQAHANLWLTLPAAVIIGREIVISALREWMAEIGARAQVAVSNMGKWKTAAQMLALVILLGNPPAITIWVILGYALLLVAAGLTLWSMVQYLRAAWPHLKTTAEKK

SEQ ID NO: 59743 - protein, 116 aa, Physcomitrella patens subsp. patens
KPDRSEDSVSPEEKEEHERKVRAFLEANTPKRKLKPARSDADDLASNGHDGGDDTTQFDPPERVKYLQLVANGVPLETTGSGEVMEDFTESEYYKHMTSIDKEHYTTGSGFIQVEK

SEQ ID NO: 59744 - protein, 428 aa, Salmonella enterica subsp. arizonae serovar 62:z4,z23:--
MKLYNLKDHNEQVSFAQAVTQGLGKQQGLFFPHDLPEFSLTEIDEMLNQDFVSRSAKILSAFIGDEIPQEILEERIRAAFAFPAPVAQVESDVGCLELFHGPTLAFKDFGGRFMAQMLTHISGDKPVTILTATSGDTGAAVAHAFYGLENVRVVILYPRGKISPLQEKLFCTLGGNIETVAIDGDFDACQALVKQAFDDEELKTTLGLNSANSINISRLLAQICYYFEAVAQLPQGARNQLVISVPSGNFGDLTAGLLAKSLGLSVKRFIAATNVNDTVPRFLRDGKWAPKATQATLSNAMDVSQPNNWPRVEELFRRKVWRLTELGYAAIDDATTQQTMCELKAKGYTSEPHAAVAYRALRDQLNPGEYGLFLGTAHPAKFKESVESILGETLALPEALAERADLPLLSHHLPANFAALRKLMMARQ

SEQ ID NO: 59745 - protein, 365 aa, Physcomitrella patens subsp. patens
MGVDLARSSEESDRDQWGTEVVPHVMQLVSSYLGQRDVCALLCVSTSIRHLLTSHAPLWKILDLRNRKHAGETLVVVLAQKRFRNVEEINLEFAQDVEDKHLTAIAFKVHSDVKWTLLDSLQSLRRINLNACQKVTNSGVIFVASANPSLTSFSIYWNLKVTDAGIEAVVRSCKDLRSLNISGCKSLTDRSLRAVAKHGQRIQILNLTRWGVKLTDEGLVEVINACREIVELYLYASPNFTDTSFITLSKLSELRVLDLCGAHLLSDDGLSAISECSKLETLNLTWCINITDVGLTALAQHCSRLQSLSLHGLLGVSDEGLESLAACCGSSLIALDVNGCINVKRRSKEELRRLFPNLKVFLLHT

SEQ ID NO: 59746 - protein, 335 aa, Azoarcus sp. BH72
MKILVTGAAGFIGMHTSERLLARGDEVVGLDNLNDYYDPRLKEDRLARLTPNDGFRFVRMDVADRAGMEALFAAEKFDRVIHLAAQAGVRYSLQNPHAYIDSNLVGFTNILEGCRHSKVQHLVYASSSSVYGGNTRMPFSEHDSVDHPVSLYAATKKANELMAHTYSHLYGLPTTGLRFFTVYGPWGRPDMALFLFTKAILEGRAIDVFNHGRMKRDFTYIDDIVEGVLRTLDRVAEPDPAFDSDHPDPGRGKAPYRVFNIGNNNPVELMAFIEAIEGALGRTAEKNFLPLQDGDVPATYANTDELNAWTGFAPATSVSDGVGRFVAWYRAYYGL

SEQ ID NO: 59747 - protein, 479 aa, Bacillus anthracis str. A2012
  misc_feature (21)..(21): Xaa can be any naturally occurring amino acid
MTLIISTISLGVVVPTLKENXLGKTAIGQIILLVAVIADLVTMILLAVFVGLNSESGQSMWLLLLLFGAGIVIYFVAKRFKNIPYLDSLKAGSVQIDTRAVFALILILVGLSESVGAENILGAFLAGVLVSLLSPNEDMVEKLDSIGYGFFIPIFFVMVGVNLEVWSIFKEPSSMLMIPILIVGLFISKLIPSLVLRKWYPRNIVLGSAILLTSTLSLVIAAAQIGEKLGIISPSLSASLILSAVITCIFAPILFKKMFPKVETPKPKVSIIGASRITLPLSLDLKREDYDVTLYMMRQNKINDEEAKSHDFPIVKLDDITIASLTEQTAFHADRVVVATSDDEQNLLLAEHAKELGVEHVIASVEDPLLQEKATQEHIAVFSTINSTRILLRALIDKPSLVRLITTANETVREVELRSNKYNGVALRRLPFLGDVLVIQIYRGNKALIPHGDTRLQHGDTLLVTGSKEHIDTLKSILE

SEQ ID NO: 59748 - protein, 598 aa, Magnetococcus sp. MC-1
MTIRDVLSPFTAWKNLFREPVSIKDPIHRKAAPRYRGFHKNDVEKCIGCGTCEAICQNGAIDMVENRDVPGNRSDSGLRPRIDYGRCCWCALCVDVCMTSSLTMSNAYQWVDSDPKAFMFTPGVDPKYWDNMEQGYRRPEGHRLTPAARVHMHEMEAEERLDSFTEIVDGYSVTDAQFEADRCVACGLCVATCPAHMSIPDYIAAVRDGDYERGLALLYETNPFSNVCGRVCTHKCETVCAVNHEGEPIAIRWLKRHIADQVPVEKYRQIIGDPAPAVGKKVAVVGAGPAGLTAAFDLAKMGYQVEVYEARPKPGGMFRYGIPEYRLPYDMMDRDIDVITSMGVNIHCNMRVGHDIAMEQLREGHDAVLLTIGLHLGRSTRIPGSDHPNVTKAIDLLRQITEGQQIEVPRQLVVIGGGNVAMDIARSVARLQKQSYGEIKVTLTALEDRAHFLADPDEIRESLEEGIEILDARGPQEILVDDNGALVGLRTLRVLAIFDSEGRFAPSYDESDERIHPANMISEAIGQMSDTELLGEPLKEALEWNRGRIAVDGMGRTSEPWLWAAGDCVKGPDVIHAVADGHRAAESIDAAIKGQGGA

SEQ ID NO: 59749 - protein, 450 aa, Bordetella parapertussis 12822
MAFDFDLYVIGAGSGGVRAARFAAGYGARVAVAESRYLGGTCVNVGCVPKKLLVYGAHFHEDFEQAAGFGWNPGRPEFDWPTLIANKNREIERLNGIYRNLLVNSGVALHEGHARIVDPHTVEINGQRHSAQHILVATGGWPFVPDIPGKEHAITSNDAFFLPELPRRVLVVGGGYIAVEFASIFNGLGAQTVQVYRRELFLRGFDGSVREHLRDELVKKGLDLRFNTDVERIDKRADGVLAVTLSDGSVLETDCVFYATGRRAMLDDLGLENTGVRLAESGYIEVDDEYRTSEPSILAIGDVIGRVPLTPVALAEGMAVARRLFRPQEYRKVDYDLIPTAVFSLPNIGTVGLTTEQALEHGFRVTRYESRFRPMKLTLTQSQKKTLMKLVVDADSQKVLGCHMVGPDAGEIVQGLAVALKAGATKQVFDDTIGIHPTAAEEFVTMRTAT

SEQ ID NO: 59750 - protein, 382 aa, Neptuniibacter caesariensis
MDYPSSKLPSVGLTIFSQMTALANQQKAINLSQGFPDFDGPKPLLDAVGRFIAEGKNQYAPMAGLPELCQAVSDKVFRCYGRKLEAESEVTITSGATEAIFAAISATVNAGDEVIVFDPAYDSYEPAVTLNGGTTVHIPLLPPQFAIDFQRLQDAITLRTRMIIFNSPHNPTGSVMSSEDLLQLEQLLEGTNILLLSDEVYEHIIFDNQVHQSFNRSPMLAERSFIVSSFGKTYHVTGWKVGYCVAPEALMKEFRKVHQYLTFSTSTPMQAAIAEYMQSDAEHDQNLPVFYQQKRDLMNERLSSSRFGIMPSPGTYFQLLDYTAISDLSDQEFVLWLLKEAGVATIPLSPFYKDGTQTGMVRLCFAKSSDTLEKAAEQLCRI

SEQ ID NO: 59751 - protein, 469 aa, Nocardia farcinica IFM 10152
MTRIAIIGGGPAGYEAALVAAQHGAQVTLIDRDGIGGACVLWDCVPSKTFIASTGMRTDLRRARDLGITLDPSQAAVQLPEVNARVKALALAQSSDIRSKLLSAGVTLISGTASFTDPAPGRAPHRITVRPTGERAGERVIDAEVVLIATGASPRVLPGAEPDGERILTWRQLYDLRELPETLVVVGSGVTGAEFVSAYTELGVQVKLVSSRDRVLPGEDADAALVLEEALAERGVELVKHARADAVERTADGVVVKLSDGRTVTGTHALMTVGSTPNTGDLALDKVGIELDRGGYLRVDRVSRTAVSGIYAAGDCTGLLPLASVAAMQGRIAMYHALGEGVSPIRLKTVASAVFTRPEIATVGVSQTAIDNGEVPARTVMLPLNTNPRAKMSGLRRGFVKIFCRPATGVVIGGVVVAPIASELILPIALAVQNNLTVNDLAQTFSVYPSLTGSVTEAGRLLMRHDDLD

SEQ ID NO: 59752 - protein, 473 aa, Prochlorococcus marinus str. AS9601
MSKSPQDVLSQIKDEGIELIDLKFTDIHGKWQHLTLTSDMIEEDSFTEGLAFDGSSIRGWKAINASDMSMVPDASTAWIDPFYKHKTLSMICSIQEPRSGEPYDRCPRALAQKALKYLDSTGIADTAFFGPEPEFFLFDDVRYDSKEGGCFYSVDTIEAPWNTGRIEEGGNLGYKIQYKEGYFPVAPNDTAQDIRSEMLLLMGELGIPTEKHHHEVAGAGQHELGMKFDSLINAADNVMTYKYVVRNVAKKYGKTATFMPKPVFNDNGTGMHVHQSLWKSGQPLFFGEGSYANLSQTARWYIGGILKHAPSFLAFTNPTTNSYKRLVPGFEAPVNLVYSEGNRSAAVRIPLTGPSPKAKRLEFRSGDALANPYLAFSVMMLAGIDGIKNQIDPGDGVDVDLFELPADELAKIDTVPSSLNDSLNALKADKDYLLAGGVFTEDFIDNFIDIKYEEVQQLRQRPHPHEFFMYYDA

SEQ ID NO: 59753 - protein, 370 aa, Arabidopsis thaliana
MTFVVSVNAANPTPKVKKPTVARSIPSPTSLPLPDEIIVNCFAYIPRCDYPSLSLVSKTFNRLITSIELNIVRSLFQRTENVLYVALRFSHEEDPIWYTLNQKPYKNKSNSCIHKLVPLPSCHKIYVFGGCINGDMTSNVFVIDCLHGTFQFLPSMRVPRGCAAFGIVDGKIYVIGGYNKADSLDNWVEVFDLEKQTWESFSGLCNEELSKITLKSVVMNKKIYIMDRGNGIVFDPKKGVWERDFLLDRDWVVGSCVIDNMLYTFGFDSVKRIYRVRVYDPSVRVWSFVKGIEDIPKMDGTLGSRMANHGGKLVILLNLDKNGGTELWCIKIALERRGQQGEIWGKILWYNLVLTLENSSTIVECFDITI

SEQ ID NO: 59754 - protein, 394 aa, Prochlorococcus marinus str. AS9601
MTEAKLISALNEENLSHFSKTYVPSRLLLGPGPSNAHPEVLSALSLNPIGHLDEAYISLMSDVQQLLRYTWQCNNRLTLPMSGTGSAAMEASIANFIEEGEKILIAKKGYFGDRLVDMATRYKADVSVIEKPWGESFSYEEIKYEIETKKPAIFAIVHAETSSGVLQPLDGIGDVCRKNNCLFLVDAVTSLGALELLIDEWKIDLAYSCSQKGLSCPPGLSPFTMNKRAEEKLSSRKTKVPNWYLDLSLLNKYWGSDRVYHHTAPVNMNFAIREGLRLIANEGLENVWNRHNTNAKKLWNGLESLGMELHVSEDYRLPTLTTVKIPPAVDGDGFRNHLLRNFGIEIGNGLGELSGKVWRIGLMGFNSSDENVDRLLNLFDTELKKFSIFESSTF

SEQ ID NO: 59755 - protein, 313 aa, Cryptococcus neoformans var. neoformans B-3501A
MTLTFKLSDGKDIPFLAWGSGTGGIGKELQLAIGAGIHALKSGIRHIDTAQGYDTEEATGESFRASGLKREDVWITTKISDKLPTDKEAIRKNVLASIARLQTKPDLLLIHNPFIVQDGNISQFWTYLEDLVLDGTLEGVSLGVSNFRPQDLEAILRVARIKPVANQLEYHPYVLVHLEPVLKIAAEHGILIEAFGPLTPVLRHPDGGPLKPVLERIAQRISKDNGQKLDSTTVLLLWTRQKGVVAVTTSKNEQRIKGLADVEHLPDLTAEEMEEIEKIGRSHHYRYYIEHMTEDFPNPDLPSVPSTREKSDH

SEQ ID NO: 59756 - protein, 146 aa, Brassica napus
MARGRNPTTMNRSDRYLGSYSYGDSHGTSLTDELELAEEDIWSPAVIHDTETEDSYSGWNLSANSMKSGRVGLSLTFKSSSNAPSSSLMLVQQIHGGVGEGGEIMRNLASSAPVNVPDWSKIYRVNLVESTPELDGDDEEEPGMMP

SEQ ID NO: 59757 - protein, 577 aa, Nocardia farcinica IFM 10152
MTKRPQSQCLGPEQRRTAWERLGKEHFDVVVVGGGVVGAGIALDAATRGLDVALVEARDLASGTSSRSSKMFHGGLRYLEQLEFGLVREALRERELALSTLSPHLVKPLRFLYPLTHRGWERPYVASGLVLYDTMGGAKSVPGQRHLTRHGALRLAPGLRRDALIGGVSYYDTVVDDARHTMTVARTAAHYGAVIRTSTQVVGFLREADRVVGVKIRDTEDGRTGEVRAHVVINATGVWTDEVQALSQTRGRFHVRASKGVHVVVPRDRIVSDTALILRTATSVLFVIPWGAHWIIGTTDTDWNLDLAHPAATKADIDYLLDRVNQVLVTPLTHDDITGVYAGLRPLLAGESDSTSKLSREHAVARIAPGLVAIAGGKYTTYRVMAYDAVDEAAQDIPARVSPSITEKVPLLGADGYFALVNQTVQLAEMYGVHPYRIKHLLDRYGSLIDEVMVLAQDRPELLQPITAAPSYLRVEAVYAAAAEGALHLDDILARRTRISIEYAHRGADCAEEVARLVAPVLGWDEAEIEREIDTYRSRVEAEVRSQTQPDDASADALRIAAPEPRPQILEPVPSEG

SEQ ID NO: 59758 - protein, 228 aa, Weissella paramesenteroides
MLKATGISRENLFVTTKIQVEFKDYQTAKKSIDESLQRLNLNYLDLLLIHSPEPWVEFHNKENHYFEENIEVWRAMEEAVNNGKVRSIGVSNFKKADLNNILEHSTIKPVVNQLLIHIGNTDFGLLEQAQQNNVLVEAYSPVAHGEILQNPEIKQMADKYQISIPQLAIRYCLELGTLPLPKSQTLSHVANNADVDFEISKQDLEELKKLPQINSYGDSSSFPVFSGK

SEQ ID NO: 59759 - protein, 243 aa, Crocosphaera watsonii WH 8501
MAVGKIIIAGNWKMHKTQAEALEFLTVLKSKVEETNETREIVLCVPFTALSILSKSLHGGKVRLGAQNVHWEDKGAYTGEISGPMLTELSVDYVVIGHSERRQYFSETDETANLRVITAQRHGLTPILCVGESKQQRDAGEAESVIINQLQKGLVDVDQSNLVIAYEPIWAIGTGDTCESTEANRIIRVIRDQLSNKNVTIQYGGSVKPNNIDEIMAQSDIDGALVGGASLDPVNFARIINYQ

SEQ ID NO: 59760 - protein, 295 aa, Alkaliphilus metalliredigens QYMF
MECKAIMKEYQILTDKKLHHYLDVKEDKNKTVIDAMRYSIFAGGKRLRPIVAIATYNLFKDNLEEVLPYACALEMIHTYSLIHDDLPAMDDDNYRRGKLTNHKVYGEGIAILAGDALLNYAFEIMISHARTQSNANVHLQAIEEIAKAAGMNGMIGGQVVDLESENKQVDKNTLNYIHYNKTAALIISAFKVGAIIAEATETDIAHMNSLGKNIGLAFQIQDDILDIIGDEKKLGKDIGSDVENNKSTYPSLYGLQTSIDEVKRLTTNVDKVLNIYGKRSRFLHDLSHYLVNREV

SEQ ID NO: 59761 - protein, 585 aa, Gibberella moniliformis
MGFWNRSNKTSDVDLQDITTTTDHEKNPHPEDGHPAVSDDALPAEDVTEGVKDMEAITLVWSKASLICLFIFIWLVYLLNAFQSATVGNLLPYVTSDWSAHSLLNTIGVVASSMTAAVFIPLAKLLDLWGRAEGYLLMVGFCELGLILMATSKDLSTYCAANVFYSVGFTGLIYSVDVMTADATNLKNRALAYAFTSSPYMISAFAGSYASDRMLADIGWPWGFGTFAFITPVVCAPLYLLLKINLRKAKKNILPKKASGRTLKESIWHYVLEFDVLGVFLFAAGLIIFLLPFTIASMAPHGWSTGYIIAMIIVGFILLVGFALNEVYFAPVPFLKFHFLTDRTLVGACLLDLTYQISYYCWNNYFTSFLQVVNYLTVAEAGYVNNTFNVVSGFLLFLVGWGIRKTGYFKWLLWAGVPLYILAQGLMIYFRNPTGYVGYLVMCQIFISVGGSVFTICMQLAVLAAVDHQHVAAALAMLSVTGTAGDSIGDTISGAIWTNTFEKALKMYLPASALENLDAIYGDLPTQLSYAKGTPERIAIQKAYGYAQTRMLAAGTAIMALSFIWVALIRNLKVSEMRQTKGNVF

SEQ ID NO: 59762 - protein, 352 aa, Bacillus cereus ATCC 10987
MYKGLLKQYASYLPVNENTPDVSLMEGNTPLIPLLNISKQLGIQLYGKYEGANPTGSFKDRGMVMAVAKAKEEGSEAIICASTGNTSASAAAYAARLGMKCIIVIPEGKIAHGKLAQAVAYGAEIISIEGNFDDALKAVRNIAAEEPITLVNSVNPYRIEGQKTAAFEICDQLQSAPDVLAIPVGNAGNITAYWKGFCEYEKEKGYKKPRIHGFEAEGAAAIVKGHVIDEPETIATAIRIGNPASWSYAVEAAEQSHGEIDMVSDEEILHAYRLLAKSEGVFAEPGSNASLAGVMKHVQSGKIKKGETVVAVLTGNGLKDPDIAISSNTLDIASVSNNIEQIKEHIKGVIMS

SEQ ID NO: 59763 - protein, 138 aa, Oryza sativa
  misc_feature (102)..(103): Xaa can be any naturally occurring amino acid
MVGKLTATKPSRSDEILDGDEQVRIANQIRSQFDDLAPKRPIKPNRSEPDAVNPVDYTNSVQNIPELDKFEALRSRSHIVLSSEKLVDAQEEFVETRYYKEXXSIDKQHHATGSGFIMAVREGDDDGYEIQLPASNVD

SEQ ID NO: 59764 - protein, 159 aa, Zea mays
  misc_feature (123)..(123): Xaa can be any naturally occurring amino acid
MGWKANRIGDRGLAAVAQKCSSLQELVLIGVNLTSLSLELIATNCPTLERLALCGSDTFGDAEMSCVASKCSALRKLCIKACPVSDAGMNKLAEGCPRLVKVKVKKCRRVTSECAEHLRASRXGRSVDDSGALDNAGSDVLPEDLDDRIGPDLSSGSSG

SEQ ID NO: 59765 - protein, 183 aa, Populus trichocarpa
MSSPSKRREMDLMKLMMSDYKVEMINDGMQEFYVEFNGPKESLYQGGVWKIRVELPDAYPYKSPSIGFVNKIYHPNVDEMSGSVCLDVINQTWSPMFDLVNVFEVFLPQLLLYPNASDPLNGEAAALMMRDHTAYDQRVKEYCEKYAKPEDIGAKPEEKSSDEELSEDDYNSDDDQVAGKADP

SEQ ID NO: 59766 - protein, 380 aa, Yarrowia lipolytica CLIB122
MFGSTANSHNHMQLSPRSAGPYKSDYIYTDTYTPITTRLSQLSLRTMESLVEARKTIGKWALTSFFEGLSAAGKLHPQSDPKKHGVEVVSNIRYRETSPPQKSHYHLLDVYRPIKRDGPLPVVLYVHGGAFRILSKDTHWIMALAFARRGYVVANINYRLAPERPFPAALEDSCYAFKWVIDNIADYGGDVSQLVLAGESAGANLVTALSICATYARPEPYAQMVFNTNVAPKVVLPACGVLQVSDVDRFARQKDIPTWVVDRLEEVAFGYIGRKATANVGDRDTELANPLLILESDVEPVRPLPAYFATCGTKDVLIYDTKRLIPALEKHGAVAEAIYYPGEIHAFHALLFRKAAKKCWVDQLRFTKRILNKDKEKAKL

SEQ ID NO: 59767 - protein, 628 aa, Saccharomyces cerevisiae YJM789
MDPGIANHTLPEEFEEVVVPEMLEKEVGAKVDVKPTLTTSSPAPSYIELIDPGVHNIEIYAEMYNRPIYRVALFFSLFLIAYAYGLDGNIRYTFQAYATSSYSQHSLLSTVNCIKTVIAAVGQIFFARLSDIFGRFSIMIVSIIFYSMGTIIESQAVNITRFAVGGCFYQLGLTGIILILEVIASDFSNLNWRLLALFIPALPFIINTWISGNVTSAIGANWKWGIGMWAFILPLACIPLGICMLHMRYLARKHAKDRLKPEFEALNKLKWKSFCIDIAFWKLDIIGMLLITVFFGCVLVPFTLAGGLKEEWKTAHIIVPEVIGWVVVLPLYMLWEIKYSRHPLTPWDLIQDRGIFFALLIAFFINFNWYMQGDYMYTVLVVAVHESIKSATRITSLYSFVSVIVGTILGFILIKVRRTKPFIIFGISCWIVSFGLLVHYRGDSGAHSGIIGSLCLLGFGAGSFTYVTQASIQASAKTHARMAVVTSLYLATYNIGSAFGSSVSGAVWTNILPKEISKRISDPTLAAQAYGSPFTFITTYTWGTPERIALVMSYRYVQKILCIIGLVFCFPLLGCAFMLRNHKLTDSIALEGNDHLESKNTFEIEEKEESFLKNKFFTHFTSSKDRKD

SEQ ID NO: 59768 - protein, 344 aa, Polaromonas sp. JS666
MAGCGADFLITIQRKPTMTLAVQIDQNGGPEQLKLVDVTVGEPGPGEIRIRHKAVGLNFIDVYQRTGLYKLPMPLQLGMEASGVVEAVGEGVTHLKAGDRAAYASQPPGSYCELRVMPAKCVCRLPDAISFETGAAMMLKGLTVQYLLRRTQPQGGLNAGDFVLFHAAAGGVGLIACQWAKAMGLQLIGTAGSDEKCALAKANGAAFVINYAKEDFVARVKEITGGKGVKAVYDSVGKDTFLKSLDCLRPFGLLANFGNASGKVEPLDIGVLAAKGSLYVSRPTLFTHIATRETTQEMADDLFAMVTGGKIRIAIDQRFPLADVAEAHRSLEARKTTGCTILTL

SEQ ID NO: 59769 - protein, 117 aa, Physcomitrella patens subsp. patens
MALEEPVELKFRLYDGTDIGPNKYPPATTVANIKESILNHWPKEKQNGPKSIHDLKLINAGKILENTKTLADSRVLLGEIPGCVITMHVVLRPPTNDKASEKQAEAPKPKTCCCTIL

SEQ ID NO: 59770 - protein, 159 aa, Lactobacillus plantarum WCFS1
MNIKIICVGKLKEKYFKQGIAEYAKRMSKFAKFQIVEVPDEKAPESLSNAEMENVKAKEGQRILEKIKDRDYVYALAILGKERSSEEFAAEIDKLTTYGHSDIDFVIGGSLGLSPEVLKRADTQISFGRFTLPHQLMRLVLSEQVYRAFMINVGSPYHK

SEQ ID NO: 59771 - protein, 506 aa, Morus alba
MYRATASRLRALKARNFKLGNRFLSSAAVATSGGNISWLSGGGGYSSSLPSLMIPLADVKLPPPLPDHVEPAKTKITTLANGLKIASQTSVTPAASIGLYVDCGSIYETPVSFGASHLLERMAFKTTRNRSHLRVVREIEAIGGHVQASASREQMGYTFDALKTHVPEMVELLVDCARNPVFLDWEVNEQLQKVKAEISEASKNPEALVLEAIHSAGYAGALANPLLAPESAINRLEWVQFWEGIYWPKTTLLQEIVLAAYGGLNMKISIHCGATFGLISLLSLALRSQNLCIREGDYRCQADSGSTHFALAFEVPGGWHKEKEAIKLTVIQMLLGGGGSFSTGGPGKGMHSRLYARVLNNHPQFQSISAFSNIYNNTGIFGIQATTSSDFAAKAVDVVANELIAISKPGEVDQVQLDRAKKSTKSAILMNLESRVIASEDIGRQVLTYGKRMEVDHFLNAVDEVTVKDIASTAQKLLSSPVTLASYGDVLYFPSYDTVSSKFNSK

SEQ ID NO: 59772 - protein, 476 aa, Lactobacillus plantarum WCFS1
MMTTINEMHQIFNLQKIQYDRAQPMTYEERVTVLNQIEALIRDNIPELITALQADFGQRDPLQILSADLTGPLATIAYIKKHLRKWILPAKQRSGLMALTGTKQYVYNEPLGVVGIMSPFNAPIDLALDPAVEAIAAGNRVMVKISEYTPKTAALVQKLSQQYLNEKNFAVVTGEADIAAQFSALDWDKLVFTGGSETGKKVLSAAAPNLTPVVLELGGKNPAVVLPDANKQMTAAKIARSRSGNSGQICLDTDYVLLPTDQLDEYVGLITAQLAQVFPTYINNSEYSAIINDRSYDRILGMLTEARQRGTRLITINPNNELVPYVKRRLIPLTLAINPDRDLQIARNEIFGPILSIFTYDSLDEAIAFINSHEKPLAMYLFGRSSRHLNQIISQTSSGGVDINELSLHAGSHSMGFGGVGYSGMGRYKGGKIGFETFSNQKSVYKQGVLAKYTTRLMVPIHNKRNEKLLKRMLGL

SEQ ID NO: 59773 - protein, 596 aa, Prochlorococcus marinus str. AS9601
MSNIDLKRRTKIVATIGPATQSEEIITNLIKAGVTTFRLNFSHGDHKDHAERIKTIREVSKKLDIDIGILQDLQGPKIRLGRFKDGPVKVKKGDKFTLTSNEVECTNTIANVTYDKLSQEVSEGKRILLDDGKIEMIVEKVDTKANNLECMVTVGGVLSNNKGVNFPDVQLSVKALTEKDKEDLKFGLSVGVDWIALSFVRNPSDINEIKDLINTNGHSTPVVAKIEKFEAIDQIDTVLPLCDGVMVARGDLGVEMPAEEVPLLQKELIRKANSLGIPIITATQMLDSMASNPRPTRAEVSDVANAILDGTDAVMLSNETAVGDYPVEAVETMATIARRIERDYPLKAIESHLPSTIPNAISAAVSNIARQLDAGAIIPLTKSGSTARNVSKFRPPTPILATTTERSVARRLQLVWGVTPIVVKNDERTAKTFSLAMQIAQEMGILNQGDLVVQTAGTLTGISGSTDLIKVGLVRKIVSRGISIGEIGVTGKARIIKNNLDISLICPGEILFVPKELMKNIPLSKNIAGIVTNQNVNDVYAFFNKNNKKISTICNLENMDNHQISNGDLITLQLNEGVIYMGQIEDDDAIDKYKYV

SEQ ID NO: 59774 - protein, 636 aa, Alkaliphilus metalliredigens QYMF
MRKVYRYLEQINSPEDLKKLKENEVRLLAHDIRKFLVQSVSKTGGHLASNLGVVELTLALHTIYDTLKDKIIWDVGHQAYVHKILTGRREQFKTLRQYKGLSGFPKRHESSHDHFDTGHSSTSISAALGLASARDLKKEKHEVVAVIGDGALTGGMAFEALNHGGQSKKNITVVLNDNEMSISQNVGGLSNYLSKIRTAPIYAKVKDDLELLLGNIPAIGKSVKKTAEKAKDSIKYFFVPGILFEELGFTYIGPIDGHDYNALCTAIKNSKNIKGPKLIHVITKKGKGYKLAEKSPAEFHGVSPFKIETGKPISLTKNLSFSEVAGNTLIEAAKTNPRIVTITAAMPSGTGLADFAEQFPERFFDVGIAEQHAVTFAAGMAAEGYKPFFAVYSTFLQRAFDQVIHDVCIQNLPVTFLIDRAGLVGNDGETHHGVFDISFLSCIPNLTILAAKDGNELQAMIQFAEKHEGPVAIRYPRGTTALDKEKSILPIQLGKGEVICDWGKDALILTVGNMNEIGVALCQQLNNKGIGATVINPRFIKPIDQHLILQHAKSHKRIYVLEDNAKIGGFGEQIRSFLNEYEVYKPVKLFALPDAFIEQGNVALLYKDCKLNQEEIFTEIYQDFTKGIIGKLAITR

SEQ ID NO: 59775 - protein, 513 aa, Prochlorococcus marinus str. AS9601
MNDYFEKILQAEVYEVAKKTPLEKAHNLSNTLNNEVFLKREDLQDVFSFKIRGAYNKMSKLTNSQLAQGVITSSAGNHAQGVALSALKLNCQATILMPVTTPIVKVNAVKSLKAKVILYGDNYDETYKEAIRISQERNLCFIHPFDDPEVIAGQGTIAIELEQQLKEKPYAIYIAVGGGGLISGISIYVKKIWPEVKIIGVEPEDADAMTKSLEEEKIVELPSVGQFADGVAVKKIGKNTFDIGRKYIDKMIRVNTDEICAAIKDVFEDTRSILEPAGALSIAGMKKDILNSNHSNRKMVAIACGANMNFERLRFVAERAELGECKEVMMAVEIPERAGSLIDFCKLLDNRNLTEFSYRMSNSKNAQIFVGVQVYGLNDKKNLLNVFRNSEYSFIDISDDELSKNHLRHMVGGRLPRDFKEMEYKNFIELLYRFEFPERPGALINFLNNMKSNWSISVFHYRNYGADVGKIVIGVLIDKNEILEWNKFVKILGYKFWDETQNDTYRLFLGASD

SEQ ID NO: 59776 - protein, 478 aa, Brucella suis 1330
MKRNRKVKILATLGPASGEEAVIRKLFEAGADVFRINMSHADHDLMRTLVKRIRNVEKELGRPIGILADLQGPKLRVGKFKDGKVDLVPGQTFTLDNNEALGDETRVFLPHPEILEAVEPGHRLLIDDGKLHLVAEACDGKSIRCKVVSGTRISDRKGVSLPDTTLGVGALTEKDRCDLDAVLKEEIDWVALSFIQRPEDLAEVRKVSRGKVGLMSKIEKPQAVTRLDEIIELSDALMVARGDLGVEVPLENVPGIQKQITRKARRAGKPVVVATQMLESMITAPVPTRAEVSDVATAVFEGADAIMLSAESASGQYPVEAVATMNRIAEQVEREPTYSTIIDAQRAMPEPTGADAISLAARQIAETLKLSAIVTYTASGTTGLRAARERPRTPIIALSPVVDTARKLSLVWGLHCVVTDDAHDLEDMVNHACEIVFHEEFGKAGDRVIITAGVPFGTPGATNMLRIAYIGADGKSGI

SEQ ID NO: 59777 - protein, 509 aa, Nocardia farcinica IFM 10152
MTDTLGTAARTDLGDEAAAVLRALGVDMPPPGDLVARTPITGERLLTLPADTPAEAQAAVERASAAFQRWRTVPAPVRAAVVRRLAELLVAHKADLARLVTLEAGKIRAEALGEVQEMIDICEFAVGLARQLYGRTMPSERPGHRLMETWHPLGVVGVISAFNFPVAVWSWNTAIALVCGDTVVWKPSETTPLTALACHTLLRRAAADVGADPEVHQLIQGDAAVGAVLVDDERVALVSATGSVRMGRAVAPRVAARFGRCLLELGGNNGAIVTPSADLELAARGIVFAAAGTAGQRCTTLRRLIAHVDVVGPLLDRLTRAYRSLAVGDPREDGVLVGPLIGAGAYRDMRAALDRALADGGELVFGGERVPGFGADAFYVRPAIVRMPAQTAIVREETFAPILYVLTYRDFEHAVRLHNGVPQGLSSAVFTTDQREAERFLAADGSDCGIANVNIGTSGAEIGGAFGGEKHTGGGRESGSDAWKAYMRRATNTINYSTELPLAQGVEFG

SEQ ID NO: 59778 - protein, 396 aa, Haemophilus influenzae Rd KW20
MFEHIKAAPADPILGLGEAFKSETRENKINLGIGVYKDAQGTTPIMHAVKEAEKRLFDKEKTKNYLTIDGIADYNEQTKALLFGKDSEVIQSNRARTVQSLGGTGALRIAAEFIKRQTKAQNVWISTPTWPNHNAIFNAVGMTIREYRYYDAERKALDWEHLLEDLSQASEGDVVLLHGCCHNPTGIDPTPEQWQELAALSAKNGWLPLFDFAYQGLANGLDEDAYGLRAFAANHKELLVASSFSKNFGLYNERVGAFTLVAENAEIASTSLTQVKSIIRTLYSNPASHGGATVATVLNDAQLRQEWENELTEMRERIKKMRHLFVQLLKEYGAEQDFSFIIEQNGMFSFSGLTGEQVDRLKNEFAIYAVRSGRINVAGITEDNIRYLCESIVKVL

SEQ ID NO: 59779 - protein, 629 aa, Prochlorococcus marinus str. AS9601
MLLSELSHPNQLHGLTVSQLEEIACQIRERHLQVVSTSGGHLGPGLGVVELTLALYQTLDLDFDKVVWDVGHQGYPHKLITGRFSQFDSLRQQNGVAGYLKRSESKFDHFGAGHASTSISAALGMAIARDRKGENYKCVAVIGDGALTGGMALEAINHAGHLPNTPLVVVLNDNDMSISPPVGALSSYLNKVRVSPPLQFLSDSVQESVKNIPLIGKDIPEELKNIKGSVRRLSVPKVGAVFEELGFTYMGPIEGHDIANLIKTFNAAHKLKRPVLVHVVTTKGKGYPYAEADQVGYHAQSAFDLTTGKSIPSKKPKPVSYSKIFGQTLLKICEQDSKVIGITAAMATGTGLDILQKNIPDQYIDVGIAEQHAVTLAAGMSCDGLKPVVAIYSTFLQRAFDQLIHDVGIQNLPVSFVLDRAGIVGADGPTHQGQYDISYMRSIPNFVLMAPKDESELQRMLITSINHNGPTALRIPRGSGLGVAVMDEGWEPMNIGEAEILEEGEDILIIAYGSMVASAIETAKILKNMNINACIVNARFVKPLDKNLIMPLASRIQKVVTMEEGTLIGGFGSAIVELFNDNEINIPVYRIGIPDVLVDHASPDQSKEKLGLLPDQMADKIIKKFKLVI

SEQ ID NO: 59780 - protein, 471 aa, Lactobacillus plantarum WCFS1
MLSEIKWKGFLLPLIFGIGLWLVTPLRPVAISIMAWHLFAIFVATIIACITKPLPMMAVTLIGIVVATLTGVFTMDEVATGFGNSTAWMVAMCMFMAAGFIKSGLGKRIAYLFVSLFGKRTLSLAYALSFVDAVLAIGIPSNNARVNGIMYPIIDNLSREMGSDPKQGTQRKLGSFLVFNEYEVNNITSGLFLTGLAGNMVAIGLAKMQGITVTWMQWFMAACVPGILSLLIIPWVLYKVYPPEVKQTPDAHRWATTRLAALGKMTASEKIMSITFILAIVLWLIGTKIGIDATEVSFIAVVILLITGVLTTNDLLNEHFAWNILVWLSIIMMMSKKLMTLGFFPWFSKTLGHLLNGMNWISVLIILFLAYFYLHYMFPSVSTQISALYAGFLSIAIGAGVPHVLAALLLAFAGSINLSTTPYSAGPAALLSSTGYVTSAEWWRLSAIIGVIFNVIWLGGGLLWTKLLGFW

SEQ ID NO: 59781 - protein, 465 aa, Xanthomonas campestris pv. vesicatoria str. 85-10
MPESSSATAPQFQRSMQVRHLVMLSLGGVIGTGLFFNTGYIIASTGALGTVLAYLIGALVVYLVMQCLGELAVAMPQTGAFHVYAARYLGPATGYVVAWLYWLTWTVALGSSLTAAAFCMQYWFPHSPAWPWCLLFCALIFGLNTVSARWFAEGEFWFSLIKVVTILVFIVLGGAAVIGLLPLADGSPAPGLRHLRAEGWFAHGALPILMTMVAVNFAFSGTELIGVAAGETAQPARAIPLAIRTTLVRLVVLFVGTVLVLAALLPAKQAAVETSPFVRAFELLGIPYAADILNAVILTAILSAANSGLYAAARMLWSLANEGTLPSGLARLTGRGIPLRAVSLSMLGGLLALLTGVYAPETVFVAISAVSGFAVVVVWLSICAAHYRFRRQLLRDGAALETLAYRAPWYPWTPILGFSLCLLACIGLAFDPQQRIALWCGVPFVALCYGAYALTQWLAARRLHA

SEQ ID NO: 59782 - protein, 231 aa, Chlamydophila pneumoniae CWL029
MEKDLHLHEKKCLAHEAATQVTSGMILGLGSGSTAKEFIFALAHRIQTESLAVHAIASSQNSYALAKQLAIPLLNPEKFSSLDLTVDGADEVDPQLRMIKGGGGAIFREKILLRAAKRSIILVDESKLVPVLGKFRVPLEISRFGRSAIIEEIRHLGYEGEWRLQDTGDLFITDSSNYIYDIFSPNSYPNPEKDLLKLIQIHGVIEVGFVIEKVEVWSSNSQGLISKKYSV

SEQ ID NO: 59783 - protein, 344 aa, Oryza sativa
  misc_feature (243)..(243): Xaa can be any naturally occurring amino acid
MANLGGGAMPAGSSGGDGEVEAGFAKLQGEDFEYYMQTYSIMLGRNSKKSTVDVDLSSLGGGMNISRHHARIFYDFQRRRFALDVIGKNGCLVEGVLHLPGNHPVKLDSQDLLQIGDKKFYFLLPTRSIFASAAAARHPPIIPQQMPPPSYVRTGRPRLSEFHDRSFEGDYGREGDEIGNGISESGGMRGKLIKRNKKLSAESEMYGGHRINVEAIGTLGEDSRSEIRSRGDRDMDNQHILQXAEEKDVVSSVATVLSDLCGPGEWMPMAKLHTELLEQFGNVWHHSRVRKYLSPEDWSPTETKGRPWYGLLALLRKYPEHFVINTRSKGRVTSEFVSLVSLLS

SEQ ID NO: 59784 - protein, 440 aa, Vibrio sp. Ex25
MNDFSYITDIQQSAIRQTRLIQIRGRVTQVTGTIIKAVVPGVRVGELCELRNPDQTLSLLAEVVGFQQHHALLTPLGNMFGISSNTEVSPMGKMHEVGVGDQLLGTTLDGLGRPFDGTQSQEPSAWYPVYRDAPPPMQRKLIEKPISLGVRSIDGLLTCGEGQRMGIFAAAGGGKSTLLAKLIRSADVDVTVLALIGERGREVREFIEHDLGEEGMAKSVLVVATSDRPAMERAKAAFVATSIAEYFRDQGKRVLLLMDSVTRFARAQREIGLAAGEPPTRRGYPPSVFAALPKLMERAGQSDKGSITALYTVLVEGDDMTEPVADETRSILDGHIILSRKLAAMNHYPAIDVLRSASRVMNQIVEPDHQASAAHLREMLAKYEEVELLLKIGEYQHGADSRADMAIAQSDDIRAFLRQGTHEPSDLDGAIAQLKGMANQ

SEQ ID NO: 59785 - protein, 480 aa, Photobacterium profundum SS9
MSSSVETSSKKHNLSYIIRICCIAALGGILLGYDTAVISGAIGPIREYFNLTAAQTGWAVSSVVLGSIIGAISSGWCALKYGRRKALFLAALLFIISAIGSALAATFTIYVLFRIVGGIAVGLACVVSPMYMSEVAPKDFRGRAVSMFQQSAVIGQTGVFYVNYLIAKGMSEAWLVDIGWRWMLASEVLPALLFGSLLIIIPESPRWLVLKGHLDQAKETLSRISNPEHADRVILEIQKSLVPTNASKNNKVSLRSPLLFSILVIGTFVAAAQQLTGINVIMYYTPEILNPIAGGTENALLQTTFVGVVFIFGNALGMYLIDKVGRLPLMKYGTFGCALGMTIVGYVLYTGTEGYAALFALCLYVVAYAASWGCACWTMISEIFPNSIRSRAMAIAVGAQWFTGFIVTQSFPMLNENAYLKEHFNGAFSFWVFAVLSIMCMYVVVKYVPETKGVSLEDMEKVMAEKLGKNKKRQVAEASA

SEQ ID NO: 59786 - protein, 177 aa, Zea mays
DFKGPAESFFQGGFWKVRVELPEAYPSKSPSLGFFTKIFPPNVEGMLGFFFLDFLTPPGGPRFVFVNVFEVFLPPRWGSPNPFVPLNGGGAALMRGVRPVFDQKGKEFCEKFVYPGGGGFPPEAKSRAEGFGVGGGGATASGGGGILGIPVPFFGWETGRSVLHSFVHLRKRQVTKN

SEQ ID NO: 59787 - protein, 225 aa, Erwinia carotovora subsp. atroseptica SCRI1043
MKPFLIAPSILSADFARLGEDTTNVLAAGADVVHFDVMDNHYVPNLTIGPLVLKSLRDYGITAPIDVHLMVKPVDRIIPDFANAGASFITFHPEATDHLDRSLQLIKDHGCKAGLVFNPATPLSYLDYVMDKLDIILLMSVNPGFGGQSFIPSTLDKLRQVRRLIDDSGYDIRLEVDGGVKVENIGAIAEAGADMFVAGSAIFGHPDYRAVIDQMRNEISRTKHG

SEQ ID NO: 59788 - protein, 331 aa, Photobacterium profundum SS9
MTKIALQQDRPLDAIVLGRAGVDLYAREANTDMADISGFNKFVGGSAANIAVAISKLGGKVGFIGCVADDAFGGYVRGYMTEQGINLDGMMTDNSGSRTSVAFTEMKPNDCTVLIYRNKASDLTLKPEQVDPAYIAQSKMLVVTGTALSESPSREATLIAMEHARRSNTVVVLDVDYRPYSWRTDVDASIYYGIAAGLSDIVIGNREEFDMMETVLAPGNTDDDATADRFLRANTQVVIVKAGELGSKVYCKDGHKFQQGIFRVEVKKPFGSGDSFAGGLIWTLVNGGELEDGVKHGSAAAAINVSGNSCTEAMPTKEVLFDFIETREQDL

SEQ ID NO: 59789 - protein, 302 aa, Populus trichocarpa
MGSNESSNEIDRKFRFLTAYKDGRVEIHYPTQKIPPSNDPNTGVQSKDVTISTEPPVSARIYLPKILDPTKKVPVLYYIHGGGFCFESAFSPLFHSHLMALVAEANVIAVSLEYGLWPERPLPGSYVDAWAGLKWIASHVKGNGPEPWLNDNADFSRFFMGGDSGGANMSNFLAVQIGSYGLPGVRLIGMIMVHPFFGGMEDDEMWMFMYPTNCGKQDPKLKPPPEDLAKLGCEKVLVFLAEKDHLREVGGIFYEDLKRSGYKGALEVVEHEGVAHEFHLFDPAHDKSLSLVKKFASFLNEV

SEQ ID NO: 59790 - protein, 582 aa, Physcomitrella patens subsp. patens
MEFERRRAPGAGSGIPLSDETLACVLKYVENWQDRAAVSLVCQQWRRVDGATRKFVTISYMYSTNPELLTRRFKRLEGVKIKGKPRAEEYGLLVPNWGGYAEPWIRELGRVYRGLQTLLLRRCQVSDSDLELIASSPFHSVLQVLHLHKCAGFSTSGLLPVAKACRSLRTLSIEDSNVNDEGGEWLHVLARHNTVLEVLNFAVLGLEDVDVADLALLLEKCKSLVSLKVGEIELVDMVGALGKSSSLLELGAGSCNYLNDEDSRVYASISLPLQLTSLSGLWSMGDFGLCMILPIAPNLKKLDLKFTFLSRKAYCQLFSQCHSLEELQIRNGVGDEGLEVLGKSCKSLRRLRIEHDEAGAITQRGVVAVAQGCNNLQQLVLYVSDISNAALAMVGQGCPHLTDFRLVLTGTQHVVDLPLDDGFKLLLKGCPNISKLAVYLRHGGLTDKGMSYMGDFGKNLKWVLLGCTGESDIGLANFAYKAQKLERLEIRDCPFGEAGLVAAVVAMSSLKFLWVQGYRAPEAGYQLLGLARPWLNIEISLPSGTMPGQLIAHYAIVAARNDYPPDVKFTVQFHVPPILPAL

SEQ ID NO: 59791 - protein, 187 aa, Zea mays
MAGATTPASGALVRLCLPSLLLFLYRCCRCEAVEMERTLAMIKPDGLSGKYTEAIKEVILDSGFHIVKETEVQLDAERASVFYAEHSQRSFFDSLVKYITSGPVLAMVLERPDAVAQWRTLIGPTDAKKAKTSHPNSTLCHFSIRAMCGLDSEKNCVHGSDSPESADREISFFFGEAESVTVEHDEL

SEQ ID NO: 59792 - protein, 693 aa, Cryptococcus neoformans var. grubii
MGKGKNHDRKANPGFGKVKSKTGTSTGEFTLKRVKGENFYRDAKSASRVKMLNGGKAVRDRDGKIVEAAAFQKGEKEAEPGRVKPDRRWFGNTRVISQSALDHFRTALKEQKADPYSVLLKRNKLPMGFGSRKNRKQRPHIVETEPFGNTFGPKAQRKRPRLDIGKGNGTADLADIYHPTTSTAREPIYAKGTSRRIWGELYKVLDSSDVVIHVLDARDPLGTRCKPVVEYLRKEKAHKHLVYVLNKVDLVPTWVTARWVKHLSLSAPTIAFHASINNSFGKGSLIQLLRQFSVLHSDKKQISVGFIGYPNTGKSSIINTLKKKKVCTVAPIPGETKVWQYITLMRRIYLIDCPGIVPVSAKDSDTDTVLKGVVRVENLATPAEHIPALLERVRPEYLERTYGLEHVEGGWHGEEGATFVLTAIAKKSGKLLKGGEPDQEAAAKMVLNDWIRGKVPFFVAPPTKPESGADAHVSSATTEKVQEQEQKELAEEKETKEMLEEQERSLGKVLGIKRVKGVEQPISKIVTMTKFLGDDARRYVEEEEVDVDDVDKEMAEEDEDEDEDDDDDVEESGEDQEEEELAWDDVFPEEAAGVDAADGEEVEEDDEEEEGDEDDEDVPSAKQLGKRKAIDSDEEEQTAIKAKRMTTNKQKASNFYTHANVKNRNRDRKVPKNPGKRSRGDDEPTGKKAKKRR

SEQ ID NO: 59793 - protein, 749 aa, Cryptococcus neoformans var. grubii
MSVTDLTYFSEDEQREIQAELDSGFKDIEEKYAVTAQKGFETMLVVDNIPVVDVSKKQRLLERLKQTFAKVGAPVEEESIDMPWDVTSGTNKGFVFLTYPDVKEAENAVHVLEGVSFGKNVLHVNRFGDIQRFASLPIGEGDLPAGWKEKDYIEKDYLRSWLGDLAGRDQYVTFWDTEVSVWWNGRNGSAEVLRGPDGKPKWGELYLQWSPMGTYLASLHRVGVALWSGPKLDGPIGVNVLRFTHPNVRLIQFSPCENYLITWSEDPLPNYENHPNVALRETFGPEDEGNQYVIWDIKTTRVLRTFPGDRLASGIDDGQSRMSWPVFKWSADDSYVAKCNVGTGIAVYELPMMGLLDKKSIKIEGVQDFEWAPMSQKEMVARHEGKGKECVLAFWTPEAQNQPARVNIMSVPSRTVLRSKNLFNVSDCKFYWQSQGDFLCVKVDRHARKAKSKKATSCNLEIFRMRERDYPVEVLEFKDYVPQFAWEPLGTRFAIVLQTEVHPSAVAGASTKYSIDFYQLDLKKGDFIPIKHLDSKMANTLVWSPKGRHIALATIGSSSKFDIEFWDLDFTIDERRETAEQGANVTMLGTGEHFGITEIAWDPSGRYIATSASTWRQSPEPGFSIWDFKGQQLLHESRDRFKQFLWRPRPPTLLSKEQIKKVRRELREHSRQFDEEDAAEENRGSAEKLAQRRREIGEWNAWRARNNDRLAVERENRGKSKAKIKVEGQEARVEEWFEELIDETEELSI

SEQ ID NO: 59794 - protein, 525 aa, Ipomoea nil
MMMAICSTAVAFIFIIVLSLGCYMILKLRCRSSDDKVVPRNWPLVGMMPALLKNAHRVHEFATDVLKHSGGTFEFKGPAAFANLSMLATSDPANIHHVLSKNFSNYPKGPEFRKIFDILGDGIFNVDSQLWELHRKTTLSFLNHAQFYTLLQTNVWHKVEKGLLPVLDWFAEEGAEFDLQDVFQRFTFDAISKLVLHHDPESLCLGLPYVPCEKAFNHAVDALLYRHIFPESFWKLQNWLGIGKEKKLIQAYRAFDEFIYSALKRLEERMMMITPNIDNNSDDHHLSLFTAYVQAYKQQEQPQAALLTTTTTTKFPRDTFLSLMFAGRDTTSSTLTWFFYLLAQNPLVQANARDEIENKLNLKQEIKRFFKLEECHKLVYLHAALCETLRLFPPLAIQHKVSTAMDVLPSGHLVKPNTRIILLFYSSGRMDSIWGEDCMEFKPERWISGNGRIKHEPSYKFPAFNAGPRTCLGKEMSFVQMKMIAAIILHHYEFQVVDSHSVSPSDSIIIQAKHGLKVKFTKRSM

SEQ ID NO: 59795 - protein, 170 aa, Cocos nucifera
MECAIKSVKARQIIDSRGNPTVEVDLRITDGALYRSAVPSGASTGIYEALELRDGDKNVYGGKGVLNAVKNINEVLAPALIGVDVRNQADVDGIMLQQIDGTPNKSKLGANAILGVSLSVCRAGAGAKGVPLYRHIQELAGTKELVMPVPAFNVINGGSHAGNNLAMQEF

SEQ ID NO: 59796 - protein, 128 aa, Cocos nucifera
ASLQSSVDIQLVGDDLLVTNPMRIADAIQKKACNGLLLKVNQIGTVTESIKAALDSKAAGWGVMVSHRSGETEDNFIADLSVGLASGQIKTGAPCRSERLAKYNQLLRIEEELGNVHYAGAASDLHRC

SEQ ID NO: 59797 - protein, 385 aa, Escherichia coli
MNLHEYQAKQLFARYGLPAPVGYACTTPREAEEAASKIGAGPWVVKCQVHAGGRGKAGGVKVVNSKEDIRAFAENWLGKRLVTYQTDANGQPVNQILVEAATDIAKELYLGAVVDRSSRRVVFMASTEGGVEIEKVAEETPHLIHKVALDPLTGPMPYQGRELAFKLGLEGKLVQQFTKIFMGLATIFLERDLALIEINPLVITKQGDLICLDGKLGADGNALFRQPDLREMRDQSQEDPREAQAAQWELNYVALDGNIGCMVNGAGLAMGTMDIVKLHGGEPANFLDVGGGATKERVTEAFKIILSDDKVKAVLVNIFGGIVRCDLIADGIIGAVAEVGVNVPVVVRLEGNNAELGAKKLADSGLNIIAAKGLTDAAQQVVAAV

SEQ ID NO: 59798 - protein, 143 aa, Bacillus anthracis str. A2012
MTRVRDVMSTHIVQCTPLDNVYEAAVKMKEESIGLIPVVENEQVVGLVTDRDLVVRGIAEKHPGSNKITNVMTTNIISVAPDDSLEKATELMAQHQIRRLPVVESDQLVGMLALGDLAIRESADDQAGFAFVKSRSIRNKARL

SEQ ID NO: 59799 - protein, 612 aa, Physcomitrella patens subsp. patens
MGCTGRKSPRSQNQNFRVAVFTLCVFGLIFLAELLVAVRAEREDYVDFLEEKKKEAELNATRANTTAQAPNSREGSLAEVFDKLLEKEFPDKEDSQEAHEGLVGSSFNNSVNNQEAELETVARVTHDKPKKNDTQETNGTAKPFQLQDLINLESGESGADETPRLIDKKDNVFVISNPRESSMVLQQDVRFISDLVIVIVSAAGGGILFACLGQPVITGYLLAGSAIGPGGLDLVSELVQVETVAQFGVVFLLFALGLEFSTSKLRVVRAVAIFGGFLQIVLFMCLSAVTAVFCGARASEGIFVGAFLSMSSTAVVLKFLMDRNSTNTLHGQVTIGTLILQDCCVGLLFALLPVLGGSGTLIAGLVSMSRSLFVLAAFLLSCVVLARTLVPQFLRLMVRLSRETNELYQLTAVAFCFLIAWISEKLGLSLELGAFIAGVMISSTDLAEHTLEQVDPIRNLFASLFLASIGMLINAQFLWNHMDILLSSLILVITSKTIVIMLVVRAFGYSGKNACLVGMSLAQIGEFAFVLLSRASNLHLIQKKLYLLLLGTTALSLITTPLLFRAIPAILHLGSSMHWFPQDASQIEVTHKRNGSPQKTLLNSTSVKICLT

SEQ ID NO: 59800 - protein, 455 aa, Mesorhizobium loti MAFF303099
MDTQPAPFVPPAPKPRTSPPSTLEMIRIVYRNPLELWGEPTYNEPWISANGVGGHLIVANDPGLIRHVLVDNAKNYKMATVRQKILRPILRDGLLTAEGEVWKRSRKAMAPVFTPRHIFGFAQPMLKRTKEFVTRYEEGGASDIAHDMTLLTYDILAETLFSGEIAGEPGSFANEIDRLFETMGRVDPLDLLRAPDWLPRLTRIRGRKTMAYFRKIVTDTVKMREEKFRRDPDAVPQDFLTLLLKAEGPDGLTRSEVEDNIITFIGAGHETTARALGWTLYCLAESPWERNRVEQEIDEVLAREPDPTKWLDAMPLTRAAFDEALRLYPPAPSINREPIEPEMWKDLYIPRHAAVLVMPWVVHRHRKLWDRPDAFLPERFHPGNREKIDRFQYLPFGAGPRVCIGASFAMQEAIIALAILLSRFRFDTTAETKPWPVQKLTTQPQGGLPMQVTPR

SEQ ID NO: 59801 - protein, 527 aa, Oryza sativa Japonica Group
MHSTNLLLEEPIRMASILEPSKPSFFPAMTKIVGTLGPKSRAVDTISSCLKAGMSVARFDFSWGDAEYHQETLENLKLAIKSTKKLCAVMLDTVGPELQVVNKSEAAISLEANGTVVLTPDQGQEASSELLPINFSGLAKALKPGATIFVGQYLFTGSETTSVWLEVSEVKGDDVVCVIKNSATLAGSLFTLHCSQIHIDLPTLSDEDKEVIRRWGAPNKIDFLSLSYTRHAEDVRQAREFLSKLGDLSQTQIFAKIENVEGLNHFDEILQEADGIILSRGNLGIDLPPEKVFLFQKSALHKCNMAGKPAVVTRVVDSMTDNLRPTRAEATDVANAVLDGSDAILLGAETLRGLYPVETISIVGKICAEAEKVFNQDLYFKRTVKYVGEPMTHLESIASSAVRAAIKVKASVIICFTSSGRAARLIAKYRPTMPVLSVVIPRLKTNQLRWSFTGAFEARQSLIVRGLFPMLADPRHPAESTSATNESVLKVALDHGKASGVIKSHDRVVVCQKVGDSSVVKIIELDD

SEQ ID NO: 59802 - protein, 431 aa, Escherichia coli
MVSLEKNDHLMLARQLPLKSVALILAGGRGTRLKDLTNKRAKPAVHFGGKFRIIDFALSNCINSGIRRMGVITQYQSHTLVQHIQRGWSFFNEEMNEFVDLLPAQQRMKGENWYRGTADAVTQNLDIIRRYKAEYVVILAGDHIYKQDYSRMLIDHVEKGVRCTVVCMPVPIEEASAFGVMAVDENDKTIEFVEKPANPPSMPNDPSKSLASMGIYVFDADYLYELLEEDDRDENSSHDFGKDLIPKITEAGLAYAHPFPLSCVQSDPDAEPYWRDVGTLEAYWKANLDLASVVPKLDMYDRNWPIRTYNESLPPAKFVQDRSGSHGMTLNSLVSGGCVISGSVVVQSVLFSRVRVNSFCNIDSAVLLPEVWVGRSCRLRRCVIDRACVIPEGMVIGENAEEDARRFYRSEEGIVLVTREMLRKLGHKQER

SEQ ID NO: 59803 - protein, 319 aa, Solibacter usitatus Ellin6076
MRVYDDNSLSIGRTPLVRLNRVIDGGKAIVLAKIEGRNPAYSVKCRIGAAMVWDAEKRGVLHAGKELVEPTSGNTGIALAFVAAARGYPIHLTMPETMSVERRKVLKALGANLILTPGSDGMAGSIAKAEEMVAGDPRRYILLQQFKNPANPEIHFRTTGPEIWEDTEGTIDVLVSGIGTGGTISGVSRYIKKDRGRKILSVGVEPFSSQVLTQHMAGKPLKPGPHKIQGIGAGFIPDTLDLTMVDRVELISNEESIEMARRLAKEEGILSGISCGAAAAVAVRLGKLPEFAGKVIVTVLPDAAERYLSTTLFEGMFDE

SEQ ID NO: 59804 - protein, 203 aa, Mycobacterium smegmatis str. MC2 155
MTDMRGTGQGLNLVDSVYERLLAERIIFLGSQVDDDIANRLCAQILLLSAEDPTKDIHLYINSPGGSISAGMAIYDTMVLAPCDIATYAMGMAASMGEFLLAAGTKGKRYALPHARILMHQPLGGVTGSAADIAIQAEQFAVIKKEMFRLNAEFTGQPIERIEADSDRDRWFTAQEALEYGFVDHIITSASVNGEGPGAGLDK

SEQ ID NO: 59805 - protein, 212 aa, uncultured bacterium
PADLEIIDPDTIRSNYGGPMVEFRKSKGLTAEFAEEQLKDTVVLGTMMLAFDEVDGLVSGAVHTTANRICPALQLIKTTPDGGLVSSEFFMLMPDQVLVYGDCAVNPNPTLEELAIIAIQSGDSDKAFGIEPKVAMISYSSGTSGAGPDVEKVAKGEELVRIKCPDLLIDGPVQYDAASVSSVGKSKAPDSAVAGQATVFVFSDLNTGNTTY

SEQ ID NO: 59806 - protein, 226 aa, uncultured bacterium
PADLEIIDPDTIRTNYVGPMVEFRKSKGLTAEAAAEQLKDTVVLGTMMLALDEVDGLVSGAVHTTANTIRPALQLIKTTPDAGIVSSVFFMLMPDQVLVYGDCAVNPNPTSEELAIIAIQSADSAKAFGIEPKVAMISYSTGTSQAGPDVEKVAKAVELVRTKRPDLLIDGPLQYDAASVPSVGKSKAPDSAVAGQATVFVFPDLNTGNTTYKAVQRSANVLSVGP

SEQ ID NO: 59807 - protein, 195 aa, Mycobacterium smegmatis str. MC2 155
MALLTIGDQFPEYDLTAVVGGDLSKVDAKQPDDYFTRVTSKDYEGKWRIIFFWPKDFTFVCPTEIAAFGKLNEDFEDRDAKVLGVSVDNEFVHFQWRAQHEDLKTLPFPMVSDLKRELTAACGVLNADGVADRATFIVDPNNEVQFVSVTAGSVGRNVDEVLRVLDALQSDELCACNWKKGDPTINAGELLAGAV

SEQ ID NO: 59808 - protein, 276 aa, Desulfococcus oleovorans Hxd3
MKSGSGDYAALDHPGVLSRLFHPRRATMPEAWFLDVETFDIPVDGNGVTVGGAFFAAAPSAPVILFFHGNGETVVDYADTGGLYTAMDINFLAVDYRGYGWSGGSPTVSAMLADSRAAFRFARQWLGEKGYTGPWIVMGRSLGSACALELAARHETDINGLVIESGFAHTLPLLRLLGVDVEASGITESEGLGNLAKIACWSKPLLVIHAASDHIIPLSEGKALLDACPAPVKRMIRIDQADHNTIFYYGSEAYMSGIKEFVSTSISKQGMAGETE

SEQ ID NO: 59809 - protein, 224 aa, uncultured bacterium
EGPADLEIIDPDTIRTNYGGPMVEFRKSKGLTAEAAAEQLKDTVVLGTMMLALDEVDGLVSGAVHTTANTIRPALQIIKTTPDAGLVSSEFFMLMPDQVLVYGDCAVNPNPTSEELAIIAIQSADSAKAFGIEPKVAMISYKTGTSSAGPDVEKVAKAVELVRTKRPDLLIDGPLQYDAASVPSVGKSKAPDSAVAGQATVFVFPDLNTGNTTYKAVQRSANVL

SEQ ID NO: 59810 - protein, 157 aa, Oryza sativa Japonica Group
MMSRERKKAAALHEKLQILRSITHSHALSNTSIITDASEYIKELKQKVVRLNKEIACAEAAALRQNSIPTVTVETLGHGFLINVFSDKSCPGLLVSILEAFDELGLNVLEATASCDDTFRLEAVGGENQVDEHVIKQTVLQAISNSNCSESSGDQEG

SEQ ID NO: 59811 - protein, 226 aa, uncultured bacterium
PADLDIIEPDTIRTNYVGPMVEFRKSKGLTAEAAAEQLKDTVVLGTMMLALDEVDGLVSGAVHTTANTICPALQLIKTTPDAGLVSSVFFMLMPDQVLVYGDCAVNPNPTSEELAIIAIQTADSAKAFGIEPKEAMISYSTGTSGAGPDVEKVAKAVDLVRTKRPDLLIDGPLQYDAASVPSVGKSKAPDSAVAGQATVFVFSDLNTGNTTYKAVQRSANVLSVGP

SEQ ID NO: 59812 - protein, 694 aa, Populus trichocarpa
MAMPPGNVVIPDKVQFPAGAAGGGGGGNEIHQHQLQRHQWFPVDERDGFISWLRGEFAAANAIIDSLCHHLRAVGEAGEYDLVVGCIQQRRSNWNHVLHMQQYFSVGEVIVALQQVVLRRQQQQQQQQQQQQNHHHQQRFYYDHGKVGGRDFKRSSSAGFNRGHRGGGGGGDAVKEGVNSSVENHSFNGNSSENIRSEKFEEVKSGGDGGKSDDKKDATAKSHTDNHKNSSGNAQGTFSGNSEAVAVDDRSSPEESDSHPSNNQNEKQNLAITPKTFVAEEKIDGQMVNVVDGLKLYENLLDGLEVSKLVSLVNELRATGRRGQCQGQTYILSKRPMKGHGREMIQLGLPIADAPAEDENATGTSKERRVESIPALLQDVIEHFVAMQVMTMKPDSCIIDIYNEGDHSQPHMWPPWFGKPVSVLFLTECELTFGKVIDTLHHGDYKGSLKLSVAPGSLLVMQGKSSDLAKHAIPMIKKQRMLVTFTKSQPKKLTSNDGPRLPSHAVAPSSHWGPPPSRSPNHLRHPVPKHYAAIPTTGVLLVPPIRPQIPPPNGVQPLFMTTPVAAPMPFPAPVPIPPVSTGWPTSSPRHPSARLPVPIPGTGVFLPPPGSGNASSALQLSATATEMNFPTETEKEKENGPGKSNHDTSASPKEKSAEKTQRQDSNGDVDGIAVKKEEQQSVSHTVAGQSAGAV

SEQ ID NO: 59813 - protein, 301 aa, Eubacterium barkeri
MEKSIKIGFIGLGAMGKPMAINLLKEGVTVYAFDLMEANVAAVVAQGAQACENNQKVAAASDIIFTSLPNAGIVETVMNGPGGVLSACKAGTVIVDMSSVSPSSTLKMAKVAAEKGIDYVDAPVSGGTKGAEAGTLTIMVGASEAVFEKIQPVLSVIGKDIYHVGDTGAGDAVKIVNNLLLGCNMASLAEALVLGVKCGLKPETMQEIIGKSSGRSYAMEAKMEKFIMSGDFAGGFAMDLQHKDLGLALEAGKEGNVPLPMTAMATQIFEGGRAMGLGREDMSAVIKVWEQMTGVSVSGGQ

SEQ ID NO: 59814 - protein, 501 aa, Burkholderia sp. 383
METNEHFPLLDATRAFLAKPKKMLIGAEWSDAASGRQLDVVNPADGTVLARVPEADAHDVQQAVAAARRAFDAGPWRTAKTTDRERLLLTLADLIEANARELAEIESLDNGKPVMVAQGLDVAMAAQCFRYMAGWATKIEGSVIDAGMPYMPDSEIFTYTRKEPVGVVGAIIPWNFPLLMAAWKLAPALATGCTVVLKPAEDTPLSALRLGELIREAGFPDGVVNIVTGYGHTAGAALSSDPRIDKIAFTGSTQTGKTIGHAALDNMTRMSLELGGKSPVIVLPDVDPDKAALGVANAIFFNQGQVCTAGSRAYIHAKVFDDVIERVAKIAASLKIGPGMDPSTQIGPLVSAKQRQRVCGYIDSGFGEGARAAAGGRAVDGPGFFVEPTVLVDTTQAMRVVREEIFGPVLVAMPFDDVDTAVQLANDTPYGLGASIWSNDLSAIHKLIPRIAAGTVWVNCHSLLDNAMPFGGMKQSGFGRELGRAVIDQYTESKSVMMNYA

SEQ ID NO: 59815 - protein, 411 aa, Bacillus sp. MGA3
MGLIVQKFGGTSVGSVERILNVANRVIEEKKNGNDVVVVVSAMGKTTDELVDLAKQISAHPPKREMDMLLTTGEQVTISLLAMALNEKGYEAISYTGWQAGITTEPVFGNARILNIETEKIQKQLNEGKIVVVAGFQGIDEHGEITTLGRGGSDTTAVALAAALKAEKCDIYTDVTGVFTTDPRYVKSARKLASISYDEMLELANLGAGVLHPRAVEFAKNYGITLEVRSSMEREEGTIIEEEVTMEQNLVVRGVAFEDEITRVTVFGLPNSLTSLSTIFTTLAQNRINVDIIIQSATDAETTNLSFSIKSDDLEETMAVLENNKNLLNYQGIESETGLAKVSIVGSGMISNPGVAAKMFEVLALNGIQVKMVSTSEIKVSTVVEESQMIKAVEALHQAFELSGSAVKSER

SEQ ID NO: 59816 - protein, 635 aa, Photobacterium profundum SS9
MKHDSKTLDLICMGRVAVDLYGQQIGARLEDMGSFSKYLGGSSGNVAYGTARQGLKSSMLARVGDEHMGRFLREELNSVGVDTSHLITDEERLTALVILGIKDEETFPLIFYRDNCADMAITADDVSEEYIASARCLAITGTHLSNPQTRDAVLTALKYARRHGVKTALDIDYRPVLWGLTSLGDGENRFIESGKVTDQLQEVLGLFDLIVGTEEEFHIAGGSTNSIDALRAVRQVSQAELVCKRGALGCSVFSNDIPNDLDDGITIQGVRVDVLNVLGAGDAFMSGLLRGYLSDEGWEKACAYANACGALVVSRHGCAPSMPTKVELDDYLSRANDVPRPDIDARLNHLHRVTTRKPNWEELCVLAFDHRIQFVDMVREAGVDFDSIKPLKKLILQASQEVVEEAGLQGKAGILCDGTFGQDVLNEVTGSGWWIGRPIELPGSRPLRLEHGNIGSQLVNWPLEHVVKCLAFFHPDDQHPLRLEQEKMIKEVYTACCQSGHELLLEVILPADMSSSDDLYLRAVQRFYNLGVKPDWWKLPPQSVEGWNNISAVITERDTYCRGVVILGLDAPEAELKAGFAAAANQPLVKGFAVGRTIFGQPSRDWLAGKIDDRALIEKIKVNYHNLITLWRQRG

SEQ ID NO: 59817 - protein, 502 aa, Photobacterium profundum SS9
METVQNFINGQITESRSERFAPIYNPATGEQTRQVVLSSAAEVEQVVAVADAAFPAWAKTSPLKRARVMFKFKALLEQNMDKLARIISNEHGKVYSDAVGEVTRGLEVVEFACGIPHLQKGEHSANVGTGVDSHSLMQPLGVCVGVTPFNFPAMVPMWMFPISLATGNTFILKPSEKDPSLALELAKLLKEAGLPDGVFNVVNGDKEAVDVLLTEPRVQAVSFVGSTPIAEYIYSTASAHGKRCQALGGAKNHCILMPDADLEMAANAIMGAAFGAAGERCMALSVAVVVGDETGDKLIANLTDQIAKMHIGPGIVDGTENDMGPVISAVHKAKICDYITTGVEQGASLLIDGRNLVIEGHEEGYFVGPTLFDNVLPEMTIYKEEIFGPVLAIVRVPDYQTGLDLINRHEYGNGTAIFTRDGETARQFSEDVLAGMVGINVPIPVPMAFHSFGGWKRSVFGPLNVHGNDGVRFYTRMKTVTSRWPASVRLEQHTSAFTMPTM

SEQ ID NO: 59818 - protein, 110 aa, Deinococcus radiodurans R1
MTEAGGSLHPVQPCAPASARRVHCGHFSFRRNLVMATFDDVKDVIVDKLGVDEGKVTPEARFVEDLGADSLETVELIMGLEDKFGVTIPDEAAETIRTVQAAVDYIDNNQ

SEQ ID NO: 59819 - protein, 725 aa, Candida albicans SC5314
MSFKLSVAGKAQNVPYPVLIAVNFINSSDVDVSIPIEFVDDKTVDSKDSIKLVTPGGETFIDQLDALDYLSQTLPELLPERSKSQEWIKFALTKLYVKNFKELAVDLEKLDQHLNFRSFIVGYQYSLADIAIWGVLRANALMGSVIKNGVYANISRWYNLLADDKRFEGSVELMTKSLAEVRKAAKSAKTAAAGGKKEAHKASFEIDLPGAEMGKVVTRFPPEPSGYLHIGHAKAAVLNEYFAHKFKGKLIIRFDDTNPTKEKVEFQDSIIEDLELLGIKGDQITYSSDYFQTMYDLAVKMIKDGNAYCDDTPVDTMREQRMVGDASARRERSVEENLRIFTEEMKNGTEEGLKNCLRAKIDYKAPNKALRDPVIYRCNLTPHHRTGTEWKMYPIYDFCVPVVDSIEGVTHALRTNEYRDRNPQYEWMQKTLGLRPVAIWDFGRVNFVRTLLSKRKLQWFVDKNYVSNWDDPRFPTVRGVRRRGMTVEGLRNFIISQGPSRNIINLEWSVIWAMNKKIIDPVAPRFTAVDAKNVVSVKLLNGPKEPYTESKPKHKKNPEVGNKDVIFADQVLIDQEDADLTEGEEVTFMDWGNIIVSKVNKEGDIVKSVEANLHLEGDFRKTSKKITWLAYTKDKVEIDMVDFDHLITKDKLDENDNFEDFITPETEFHTKGFADLNVGKLKAGDIIQFERKGYFRVDKPSEEGKPAVLYTIPDGKAVSRYGAKK

SEQ ID NO: 59820 - protein, 372 aa, Campylobacter lari RM2100
MKAYIYIENDVFLSAKAFGQSGTFFGELVFNTSLTGYQEIISDPSYAGQFVVFSMPEIGIVGVNDEDNESKEVFASGMIIRELNEDYSNFRANNSLSAYLKNHGKIGLCEIDTRFLVKMIRDQGNLRAVISTEIKDKEELKKMLFSSAKIDEVNYVAQVSTKTSYTHKKGTWDHSKKAYENAKTSGKKIAVIDYGVKENILNELVSVGLKVEVFPYNTKAKDLIELYQKGVIHGVFLSNGPGEPKILKEEIAEIKKLAEAKIPMLGICLGHQLLSNAFGYETYKMKFGQHGANHPVINLTNNTVEITAQNHNYNVPEEIAEVAIITHRNLFGDNVEGVKYKNYPIISVQHHPESSSGPHESKYIFKEFLELL

SEQ ID NO: 59821 - protein, 169 aa, Methanosarcina mazei Go1
MTERQVECVLIEIPQGSRNKYEYDKERKVIRFDRMLFSSIVYPCDYGFFPDTLALDGDPLDAMVLMWEPTFPGCVIDVHPVAMLDMEDDKGRDEKILCVPQRDPLWNYIKTIEQVPPHLLKEITHFFETYKNLERKDVVVYGWRDLETARKVIQEAKDRYTEQKKLSNQ

SEQ ID NO: 59822 - protein, 273 aa, Glycine max
TQRPLRRRPLRIHAARRESATPATCSPATTSLLSILQTLTLIADQTPPVPQSARYGNVAYRTWHEKMSNSAESLILTLLPENLHPATVELVPYFTDSFGNSSRIDYGTGHETNFAAWLYCLARLGVIGVEDYPAVVARVFVKYLDLMRKLQLQYCLEPAGSHGVWGLDDYHFLPFIFGSSQLIDHKYMKPKSIHNEDILENFSNEYLYLACIAFVKKVKKGVFAEHSPMLDDISGVPNWNKVNTGLLKMYKAEVLEKVPIMQHFLFGSIIKWE

SEQ ID NO: 59823 - protein, 358 aa, Penicillium marneffei
MGGCVSSESNVDLEQKKRSQMIDRKIEEDSRRLRRECKILLLGSGESGKSTIVKQMKIIHQNGYSVEELTMYRLTVYKNLLDCAKSVIEAYEHFDIEPTSQKVRDFITYISEYNIDPDPSIPLDPKVGDAVTFIWNDPCTASVMEHQSEFYLMDSAPYFFENAKRIAASDYIPNEADVLRARTKTTGIYETRFTMGQLSIHMFDVGGQRSERKKWIHCFENVTSIIFCVALSEYDQVLLEESNQNRMMESLVLFDSVVNSRWFMRTSIILFMNKVDLFRQKLGRSPLSNYFPDYSGGNDVNRAAKYLLWRFNQVNRAHLNLYPHLTQATDTTNIRLVFAAVKETILQNALKDSGILSY

SEQ ID NO: 59824 - protein, 113 aa, Triticum aestivum
MATATRRLLPTLLRTLTGTRHPGAARGLSTEKAFGAAAVFGSHTAKWMQDTIKKSPMELINEVPPIKVEGRIAACEGDKNPALGHPIEYICLDLDAPAVCKYWGLRYVQDHHH

SEQ ID NO: 59825 - protein, 470 aa, Escherichia coli
MSAEHVLTMLNEHEVKFVDLRFTDTKGKEQHVTIPAHQVNAEFFEEGKMFDGSSIGGWKGINESDMVLMPDASTAVIDPFFADSTLIIRCDILEPGTLQGYDRDPRSIAKRAEDYLRSTGIADTVLFGPEPEFFLFDDIRFGSSISGSHVAIDDIEGAWNSSTQYEGGNKGHRPAVKGGYFPVPPVDSAQDIRSEMCLVMEQMGLVVEAHHHEVATAGQNEVATRFNIMTKKADEIQIYKYVVHNVVRNRFGKTATFMPKPMFGDNGSGMHCHMSLSKNGVNLFAGDKYAGLSEQALYYIGGVIKQPKAINALANPTTNSYKRLVPGYEAPVMLAYSARNRSASIRIPVVSSPKARRIEVRFPDPAANPYLCFAALLMAGLDGIKNKIHPGEAMDKNLYDLPPEEAKEIPQVAGSLEEALNELDLDREFLKAGGVFTDEAIDAYIALRREEDDRVRMTPHPVEFELYYSV

SEQ ID NO: 59826 - protein, 546 aa, Nocardia farcinica IFM 10152
MTSVQQQSASGSAGSPDIHTTAGKLADLRNRLEEAKHPMGEAVVDKVHAKGKMTARERILALLDEGSFVELDALARHRSVNFGLENNRPLGDGVVTGYGTIDGRDVCIFSQDVTVFGGSLGEVYGEKIVKVMDLALKTGRPLIGINEGAGARIQEGVVSLGLYGEIFHRNIQASGVIPQISLIMGPAAGGHVYSPALTDFVVMVDQTSQMFVTGPDVIKTVTGEEVTMEELGGAHTHMVKSGVAHYVASGEQDALDYVKDLLSYLPSNNRAEPPRFPATDPIEGAIEDSLTDEDLELDTIIPDSPNQPYDMHEVIRRLLDDDEFLEVQAERAMNIIVGFGRIDGRSVGIVANQPTQFAGCLDIDASEKAARFVRTCDAFNVPIITLVDVPGFLPGTGQEYNGIIRRGAKLLYAYGEATVGKITIITRKAYGGAYDVMGSKHMGADVNLAWPTAQIAVMGASGAVGFVYRKQLQQAAKDGADVDALRLELQNEYEDTLVNPYVAAERGYVDAVIPPSHTRGQIVSALRLLERKMVTLPPKKHGNIPL

SEQ ID NO: 59827 - protein, 171 aa, Triticum aestivum
HYRTSLYKKAGWYRSGIPGISSTHASAVLGAAWGIFITGSSLIGAAIKAPRITSKNLISVIFCEAVAIYGVIVAIILQTKLESVPTSRMHDPESMRAGYAIFASGLIVGFANLVCGVCVGIIGSSCALSDAQNSTLFVKILVIEIFGSALGLFGVIVGIIMSAQATWPTKV

SEQ ID NO: 59828 - protein, 484 aa, Oryza sativa Japonica Group
MASLADSFLADLDELSDNEAYPEEENAEAVGTEEIGDDDMPDLESLNYDDLDSVSKLQKTQRYNDIMQKVENALQKGTDFSNQRSILEEDPEYQLIVDCNALSVDIENEIIIIHNFIRDKYRLKFPELESLVHHPIDYARVVQKIGNEMDLTLVDLEGLLPSAIIMVISVTASTTSGKPLSEENLVKTIEACERALTLDAAKKKVLEFVESRMGYIAPNLSAIVGSAVASKLMGTAGGLGALAKMPACNVQLLGAKRKNLAGFSTATSQFRVGYLEQTDVFQSTPPALRTRACRLIAAKSTLAARIDSIRGDPTGKAGRNLLEEIRKKIEKWQEPPPAKLPKPLPVPDFEPKKKRGGRRLRKMKERYAQTDMMKLANRMQFGVPEESSLGDGLGEGYGMLGQAGSGKLRVSTAPSKLSAKITKKFKEKSYGSSGATSGLTSSLAFTPVQGIELSNPQAHGNLLGSGTQSTYFSETGTFSKIKRT

SEQ ID NO: 59829 - protein, 712 aa, Neptuniibacter caesariensis
MNKKLALISILFLAVVSFFMFDLGQFFSLEYIKDNQQAFADYYQANPVLTIAIFFAIYVLVTGLSLPGATIMTLVGGALFGLWTGLIIISFASTLGATLAFLFSRFLLRDSIQQRFGKQLESINEGVKREGAFYLFTLRLVPIFPFFVINLGMGLTSIKVWTFYWVSQLGMFAGTIVYVNAGTQLGQLESLSGILSPGIILSFTLLGIFPLIAKKVIELLKARKVYAGIKKPEKFDTNIVVIGAGSAGLVTSYIAAAVKAKVSLIEKHKMGGDCLNTGCVPSKALIRSARFLAESRNSEKYGIAKSEVEFNFAEVMERVSKVVETVEPHDSIERYTGLGVDCVQGSAQILNPYEVVVNGEIITTKNIVIATGARPRIPAIKNIEAMSPLTSDNLWKIRERPKRLLVLGGGPIGCELSQSFARFGSQVSIVLRGSHIMPKEDSDVSELVAARFKDEGISILPERKMREFVERDGEKLLICEYQGQTEEIAFDELLIATGRQANIEGFGLDNLGITSKADGTLEVNEYLQTKYPNIYACGDVAGPYQFTHAAAHQAWYAAVNALFGKFKKFKVDYSVIPAATFTDPEVARVGLNELEAKEQNIAYEVTRFDLEELDRAIADSDNHGFVKVLTVPGKDRILGATIVGPHSGELITEYVTAMKHGLGLNKILGTIHIYPTLSEANKYTAGEWKRANAPQGLLGWVEKYHNWMRGQK

SEQ ID NO: 59830 - protein, 347 aa, Physcomitrella patens subsp. patens
MSKNESSYAGVVGNGGGEFELPQEVFSVLPSDPYEQLDVARRITAMAVAARVSKLESETGKLRQKLTEKERLISGLQERASEAEGTLQETSARLSHALDEQAKLANEKNALAAQVKKLMRDVAKLETFKRTLMQSLQEDDDNPKAEGGDKRGVSSNLAIRRASQAESSLSRALDDDGQSTKSFSTSSSVNTEERGFREGGASKPPTSYQTSAHNSAQGTPHLSPKLTSSGSGRASPRRSMSLTDNSHRISLPSSKPTSQSTTAPNSPPSHGSAPSRTPRVDGKDFFRQARNRLSYEQFSAFLANIKELNAHRQTREETLRKAEETFGPDNKDLYAAFDGLLSRHLPF

SEQ ID NO: 59831 - protein, 87 aa, Ipomoea batatas
VKAQVSEVKGVMMENIEKVLDRGEKIEILVDKTENLRSQAQDFRTQGTKMRRKMWLKNMKVKLIVLAIIIALILIIVLSICGSSKCH

SEQ ID NO: 59832 - protein, 631 aa, Blastopirellula marina DSM 3645
MALISVRDVSISFHTAPLLNQANLQIEPGERVCLVGRNGTGKSTLLRMLAGEQATDAGDVVVGPEVRVATLSQTATAGEDQTVFDLVAAGLGDMGETLAEYHHLTHQIAVEATDEVVNRLDQLQHKLDMEDGWNQHQWVEQAISATKLDGDSNFAELSVGKKRRALFAQALASKPHVLLLDEPTNHLDIESILWLEEFLLSFDGTIVFVTHDRMFAQKLATRVVDIDRGKLTSWTCGFDEYVIRKEAALEAEEKQNALFDKRLAQEEVWVRQGIKARRTRNEGRVRALKKMRDEYQSRRTRIGTVKFDVQQAERSGQVVIRAEDISHSFGDFVICKDFSTTIMRGDKIGVLGPNGVGKTTLLRILLGELKPTEGEVSVGSKVEIAYFDQLHAALNEEQTLRQNIGEENEFVNINGRSRHVIGYLQEFLFTPEQSNRPIKNLSGGERNRLLLARLFAKPSNLLILDEPTNDLDADTLDLLEDLVVNYAGTLIVVSHDRSFLNNVVTSTIAFEGDGFVKQYAGGYDDWLAQRKRLADEAKAQAKLTGKENDKRDTARARKLTNKEQQELKSLPAKIEALEAEQAQLQEQMAEPTFYQKPAGEIKVVTSRLDAIGEEMLAAMERWEDLESIAGG

SEQ ID NO: 59833 - protein, 348 aa, Chromobacterium violaceum ATCC 12472
MKAVVWDGPQRLRLAMLPRPALLAPDDALLRVTHASTCGTDLHIYRGAVPGFEPGTVIGHEFVGEVAAVGAAVRRLRPGQRAACADFVACGECESCAAGRHAQCGERRLFGFSGLQPRLDGGLAEYVRVPRADVALSPLAAGADPRFGLLSGDVMPTALGALQRLALAPGERLAVVGAGPVGVLTAWLAARRGVEVLLLEASPARAARARGGGLAVAEIAVGQPLSDAAPGLAGVFDAAVDAVGGESGLKTALAALRPRGRLVGAGSQAGRFELDWGALMQREIALQFVIGDPIGLRGEVAAAMADCAPALDLMFSDRLRLDEVPDYFAALYRRERFKALVEVAGEAA

SEQ ID NO: 59834 - protein, 281 aa, Alkaliphilus metalliredigens QYMF
MKQRIGFIGTGNMATAIVQGLVKDYVGMENYISVNNRPTTQDKMSKAESLHKKFNVNLEASNLDIVKKSKIIFLTVKPNIYPKVLEEIREFITSEHVIVSVAAGVSIALIEGFFDKPVKVIRTMPNTPVFVGEGMTAVTPNNYVTDDELRTVVEIFSSMGEVEIIGEGIMDAIPAISGSSPAYVYTFIEALADGGVSLGIPRDKAYKFAAQAVYGAAKMVLESNEHPGVLKDQVCSPAGSTIEALYVLEKNGFRGTIIEAMKACTHRAKELGLSEHKTHIE

SEQ ID NO: 59835 - protein, 277 aa, Vitis vinifera
MASSAIPFSHLNLHLPLSRASLARADCLATTRCRFPSVTRSCLADASSALLQAAKHTVDTYIKSGMVIGLGSGHASDMAIQYLGRQLRTGALKDITGIPMSVASASEAAKVGIPLGHYQDCSQIDFAFDDADVIEEGTLVAIIGLIVLLSLVFIIQEKQYKCDLEGLIPVLVQSLNWMETAEEIDDLFLGDAEVWRRPSIGHAGPLGGDFPLVTSEGHNILDVIFTSPILKLAEVAESLDKIDGVVEHGVISKIPLVFLFPLRSCFSFHGWNPYCSL

SEQ ID NO: 59836 - protein, 328 aa, Burkholderia sp. 383
MHAWSARHVPAQGGKVAVVTGANSGLGWQLAETLAAKGATVVMGCRDAARAAQAADAIRRLHPDARVEVDPLDLADLASIARFAADVAERHGRVDILCNNAGVMFLPLRHTHDGFEMQFGTNHLGHFALTGHLLPALRAARRARVVTMSSGLNRGGRIRVDDLRAEHRYNRYLAYCDSKLANLVFAIELQRRFERAAFAGISVAAHPGYAATNLQFAGPAMDSSPARAALMRAANRYLAQPADQGALPAIHAATSPDLAGGAYIGPSGLFESRGLPAPASVPRAARDVASAALLWEASEAATGVRFLSSGAPAGRSPGRPFDTAAEVR

SEQ ID NO: 59837 - protein, 336 aa, Streptomyces griseoflavus
MTATRILVTGGAGFIGSHYVRTLLGPHGPAGVRITVLDKLTYAGNPANLDPVRAHPGFRLVQGDVCDAAVVDRLVAEHDQIVHFAAESHVDRSILGGAEFVRTNVGGTQVLLDAALRHHGRGRGVFVQVSTDEVYGSIPYGSWPETHPLSPSSPYAASKAAADLVALAHHRTHGLDVRVTRCSNNYGHHHFPEKLIPLFITRLLEGRTVPLYGDGLNVRDWLHIDDHVQGIELVRTKGRPGEVYNIGGGTELTNRELVSLLLEACGAGWESVEYVADRKGHDRRYSVDCAKITLELGYEPRKDFATGLAETVSWYRENRDWWEPLRQRAELGQAVR

SEQ ID NO: 59838 - protein, 200 aa, Solanum tuberosum
MADQGLEGSQPVDLTKHPSGIVPTLQNIVSTVNLDCKLDLKAIALQARNAEYNPKRFAAVIMRIREPKTTALIFASGKMVCTGAKSEQQSKLAARKYARIIQKLGFPAKFKDFKIQNIVGSCDVKFPIRLEGLAYAHGAFSSYEPELFPGLIYRMKQPKIVLLIFVSGKIVITGAKVRDETYTAFENIYPVLTEFRKNQQ

SEQ ID NO: 59839 - protein, 302 aa, Methanosarcina mazei Go1
MKRDVLSITDLSREEIYELLESAADLKKKRKAGEPTEYLKHKSLGMIFEKSSTRTRVSFEVAMSDFGGHALYLNSRDIQVGRGETIEDTARTLSGYLHGIMARVMSHDTVEKLARFSTIPVINALSDREHPCQILGDFMTIMEYKNRFEGLKFAWIGDGNNVCNSALLGSAIMGMEFVIACPEGYEPGAEFLEKAKALGGKFSITDDPKTAAKDADIIYTDVWVSMGDEAEQEKRLKDFGSFQVNTELLGVAKPDVIVMHCLPARRGLEITDEVMDGPNSVIFEEAENRLHAQKALILKLMR

SEQ ID NO: 59840 - protein, 115 aa, Rhizobium leguminosarum bv. viciae 3841
MLYEGSCHCGNVAFEVEGEFTEALDCNCSLCRRRGGLLAFVPREKLVLKTPEDNVSTYTFNRHVIQHHFCANCGIAPFGEAVGPNGAAMASINLRCIPAVDIGALTVKAYDGAAR

SEQ ID NO: 59841 - protein, 662 aa, Oryza sativa
MATMSRRALGSAFAGFTRTPAMTPTATLPSSCASPARLLRWRRSAGVGARRFASGRNARISMSLRAGIVGLPNVGKSTLFNAIDEVENGKAQAANFPFCTINPNVGVVAIPDARLHVLSKLSKSKETIPTSIELVDIAGLVKGASKGEGLGNQFLSNIREVDSILQVVRCFEDDDIVHVSGKVDPKSDIDVINLELIFSDLDQIEKRLDKLKKSKTKDQQVKVKTVLMDGKPARSVDLADHEKEAIQHLCLLTMKPVIYVANVTESDLAEPGNNPHVKEVAKLATDLESGMVTISAQLRLEGKDYIVQEGDVMLFRFNEYFLCFSKLARKQAAAAAAAGEMDSRGFDSEGREFSSATEMWAHEIGAAADAPVSAAVAEPAPAPAAGSNGVAGEEEAGGGGKREEWYSKAIAYWQGVEASTEGVLGGYGCVNDVDVKGSDAFLRPLLAERFGAARRHLVALDCGSGIGRVTKNFLLRHFNEIGLKPNGFFVLKENIARNAVEKSVSDNNSLSVPRFVPADFETRLELIPFVRGAKAAAETTAKESARSVAEITDSAKSASYTLRLALHELGAQAKGVPGKNASALDFSEWTQQAGGAVAETGSNYGDCCARVSAAFVLGVLQENGCEHVAQFPEFVKGDWPEKSYPISTTLRAWRKEYWQKEG

SEQ ID NO: 59842 - protein, 269 aa, Xanthomonas campestris pv. campestris str. ATCC 33913
MVPLRSWWRQQCDNPPMSESPYTSGTTHFGFRDVAAKDKQKLVGEVFTSVARNYDLMNDLMSLGIHRAWKRYFVATAQVKPGDRVLDLAGGTGDIAVLLKERVGNEGAVVLGDINAGMLSVGRDRLTNRGLVAGFDYVQCNAEALPFPDQSFDLVTISFGLRNVTDKDAALREMYRVLKVGGQARVLEFSEVTADWFKPIYDFHSFKILPKLGQLFARDADSYQYLAESIRKHPPQDSLKGMMGEAGFARCHYKNLTGGIVAIHSGYKI

SEQ ID NO: 59843 - protein, 488 aa, Xanthomonas campestris pv. campestris str. ATCC 33913
MKERQRRTKILATLGPATDPPGVLDALFKAGVNVVRLNFSHGDPSGQAKRAAEVRAAAVRVGAEVGILADLPGPKIRIERFAGGKIKLTMGDRFDLVADINAPAGDQHQVGVSYLGLPQDVTAGDVLLLDDGLVQLQVTDVQGARIVTTVLNDGVLSDRKGLNKQGGGLSLGALTERDKELIGIVAKIGVDFIAVSFCRNAQDMHDARQIAQQHGCDAQLVSKIERTEAIENLVEIVEASDVVMVARGDLGVEIGDAELPGLQKKIIRESLAQNKVVITATQMLQSMVESPIPTRAEVLDVANAVIDGTDAVMLSAETAAGAYPVRAVEAMARICLGAEHQFEFDTDFEAAQRNLQRADQAIAMATMFLSEHIGLGGVVALTESGGTPRYLSRFRSNMPIYAFTRHDGARRQMAMMRGVFPIGFDSRGLTPREAARAAIRLLVENERMGPGDRVVFTSGEHMETHGATNTLRLLEVGEDGRASGLGEL

SEQ ID NO: 59844 - protein, 355 aa, Streptomyces griseoflavus
MKALVLSGGAGTRLRPITHSYAKQLVPVANKPVLFYGLEAIAEAGITEVGIVVGDTAAEIQQAVGDGSAFGLDVTYIRQAAPLGLAHAVLIAREFLGDDDFVMYLGDNFIVGGIADLVAGFRESRPDTHILLTKVADPSAFGVVELDDDGKAVALEEKPAAPRSDLALVGVFLFTSVVHEAVRGIEPSARGELEITDALQWLIDHGYDVRSTTISGYWKDTGNVIDMLEVNRAVLEGAKGRVDGYVDADSEVIGQVTIEAGAEIRGSRIVGPAVIGANTRITGSYVGPSTSIAADCRIESSEIEFSIVLAGATVQGVRRVESSLIGRNVEVTPAAGVPAAHRLVLGDHSEVRISS

SEQ ID NO: 59845 - protein, 152 aa, Ipomoea nil
MVTSKETELISVKLDPFPPFMLPLTAKFTQSPAFIYFVAGLSVAGLYTIISTLASFYNLLIKPGFCPALVSHFIILDVVMLGIVGTATGAAGGVAYIGLKGNSHVGWTKVCNKYGKLCTHLGASLAVSFFAFIVLLLLIILSIHSLSKKIPK

SEQ ID NO: 59846 - protein, 419 aa, Solanum tuberosum
MFGRAPEKSDNTKYYEILGVPKTAAQEDLKKAYRKAAIKNHPDKGGDPEKFKELAQAYEVLSDPEKREIYDQYGEDALKEGMGGGGGGHDPFDIFSSFFGGSPFGGGGGSSRGRRQRRGEDVVHPLKVSLEDLYNGTSKKLSLSRNVLCSKCKGKGSKSGASMKCSGCQGSGMKVTIRQLGPSMIQQMQHPCNECKGTGEMINDKDRCGQCKGEKVVQEKKVLEVVVEKGMQNGQKITFPGEADEAPDTVTGDIVFVLQQKEHPKFKRKGDDLFVEHTLSLTEALCGFQFILTHLDNRQLIIKPQAGEVVKPDQFKAINDEGMPMYQRPFMRGKLYIHFTVEFPDTLSPEQCKNLEAVLPPKPKTQMTDMELDECEETTLHDVNIEEEMRRKQQQAQEAYDEDDEDMHGGAQRVQCAQQ

SEQ ID NO: 59847 - protein, 345 aa, Streptococcus pyogenes MGAS10394
MIFIRRKSLMVVKVGINGFGRIGRLAFRRIQNIEGVEVTRINDLTDPNMLAHLLKYDTTQGRFDGTVEVKEGGFEVNGNFIKVSAERDPENIDWATDGVEIVLEATGFFAKKEAAEKHLHANGAKKVVITAPGGNDVKTVVFNTNHDILDGTETVISGASCTTNCLAPMAKALHDAFGIQKGLMTTIHAYTGDQMILDGPHRGGDLRRARAGAANIVPNSTGAAKAIGLVIPELNGKLDGAAQRVPVPTGSVTELVVTLDKNVSVDEINAAMKAASNDSFGYTEDPIVSSDIVGVSYGSLFDATQTKVMEVDGSQLVKVVSWYDNEMSYTAQLVRTLEYFAKIAK

SEQ ID NO: 59848 - protein, 333 aa, Haemophilus influenzae Rd KW20
MKTLSEFIVERQAEYPNAKGELSGILSSIRLLAKIIHRDINKAGLTNILGQSGIENVQGESQMKLDLFAHNTMKAALMAREEVAGFASEEEESFIAFDTERGRNAKYIILTDPLDGSSNIDVNVSVGTIFSIYRRVSPIGSPVTLEDFMQPGNKQVAAGYIVYGSSTMLVYTTGNGVNGFTYDPSIGTFCLSHENMQMPKEGKIYSINEGQYLKFPQGVKKYIKYCQEEDKATHRPYVSRYIGSLVADFHRNLLKGGIYIYPSATNYPNGKLRLLYEGNPIAFLAEQAGGVATDGYRRILDIEPTALHERVPLFVGSEDMVKKAQEMMEEFKE

SEQ ID NO: 59849 - protein, 317 aa, Solibacter usitatus Ellin6076
MSHYVVTGGAGFIGSAITRRLLAEGAGRVVVIDNLLSGRESNLEEIRARIDFQRADIRNYEEIAPLIRGAAVVFHEAAIPSVPRSIEDPVPSHDVNANGTFNVLRAAKEGQAGRVVYAASSSAYGDTEVLPKVEDMTPRPKSPYALQKLLGEYYCNVFTGVYGLETVALRYFNVYGPRQDPGSPYSGVLSLFMKAALNRTAPTIFGDGEQSRDFTYVEDVAELNLKAARAKGVAGKVYNGGNGGRITLNQAWALLQKLEGIEIPSVYGPPRAGDVRDSQADTTLAVRELGHAPRYSFEEGMRLTLEWYRSQHVLQAR

SEQ ID NO: 59850 - protein, 304 aa, Brucella suis 1330
MEKLPVDFTTLLNRRAMEVEAALAGLLDERPRTGEIARPQRLIAAMRHGVLNGGKRLRPFLVLESAALFGQYGQAVLRVAAALECIHCYSLVHDDLPAMDDDDLRRGQPTVHKAFDEAAAILAGDSLLTYAFDIIASDETELDATTRIKLVCALTRASGLGGMAGGQALDLMAETRKPDEASIITLQAMKTGALIRFACEAGAIIAGASQEDRERMAEFGSAIGLAFQLADDLLDVTADAGTMGKATGKDAAAGKATLVSLHGIDWTRQQLSGLVAQAESLLAPFGEDAEPLKQAARFIAERQN

SEQ ID NO: 59851 - protein, 342 aa, delta proteobacterium MLMS-1
MPRKNKLPMHPDFCDQEQCATEPCPGKEPDSGLGHRARLPEVVERIVATCQDRSCFEHVEAEPLPSRRRAIAILDSCREIIFPGYFGHQGIDRVNLEYRIGLEVSELFDRLATEIANAIRHECTRHGHTCQHCDEAGQEKALHFLQQLPQLRAVLASDVQAAYQGDPAAAGYDEIIFSYPGLHAITIYRIAHALLRLEVPVLPRIMTEHAHSITGIDIHPGASIDQAFFIDHGTGVVIGQTAVLGKRVKIYQGVTLGALAFRRDEQGGLQRDIKRHPTLEDDVTVYAGSTILGGETVIGARSVIGGNIWLTHSVPPDTKVVLNPPELVYKTQKNGQQPAGGK

SEQ ID NO: 59852 - protein, 429 aa, Chlamydophila pneumoniae CWL029
MQSARRHLNTIFILDFGSQYTYVLAKQVRKLFVYCEVLPWNISVQCLKERAPLGIILSGGPHSVYENKAPHLDPEIYKLGIPILAICYGMQLMARDFGGTVSPGVGEFGYTPIHLYPCELFKHIVDCESLDTEIRMSHRDHVTTIPEGFNVIASTSQCSISGIENTKQRLYGLQFHPEVSDSTPTGNKILETFVQEICSAPTLWNPLYIQQDLVSKIQDTVIEVFDEVAQSLDVQWLAQGTIYSDVIESSRSGHASEVIKSHHNVGGLPKNLKLKLVEPLRYLFKDEVRILGEALGLSSYLLDRHPFPGPGLTIRVIGEILPEYLAILRRADLIFIEELRKAKLYDKISQAFALFLPIKSVSVKGDCRSYGYTIALRAVESTDFMTGRWAYLPCDVLSSCSSRIINEIPEVSRVVYDISDKPPATIEWE

SEQ ID NO: 59853 - protein, 338 aa, Erwinia carotovora subsp. atroseptica SCRI1043
MILNKVTDLIGNTPVIQIPVPYGDTRLFLKVEKNNPGGSMKDRMARNMIVAGLKSGKIRPGGTIVESSSGNTGIGLALASIEYGLRFIAVVDHHAAQDKIAIMRALGAEIRYVSGDYGEDEVAVVERQRMAAQLAEEIPGAVFMNQSDNAANAGGYADFVRELFSQIGKIDAFVGCVGTGGSMTGISHGLKVHNPDIATIAVEPVGSIVFGHPGKPYYQSGTGTPAGDTVGLVLDYSCIDCGEQVSDAQAFETARYVARNYGLLVGGSTGGVIYKALELIYQDRIGGNVVLAIADGGEKYLHTVFNEEWLAERNLTDSSVWHDLDRWLGNAISLEQAS

SEQ ID NO: 59854 - protein, 426 aa, Mesembryanthemum crystallinum
IITQPLPLGAVALMGLGAAVLTKTLTFAAAFSAFGDPIPWLIALAFFFARGFIKTGLGNRIAYQFVKLFGASSLGLGYSLVFSEALLAPAIPSVSARAGGIFLPLVKSLCIACGSNVGDGTERKLGAWLMLTCFQTSVISSSMFLTAMAANPLSATLTLNTIGQTIGWMDWAKAAVVPGLVSLVVVPLLLYVIYPPEVKSSPDAPRLAAEKLEKMGPMSRNEIIMGVTLLLTVGLWVFGGVLNVDAVTAAILGLSILLITGVVTWKECLAESVAWDTLTWFAALIAMAGYLNKYGLIAWFSETVVKFVGGLGLSWQLSFGILVLLYFYSHYFFASGAAHIGAMFTAFLSVASALGAPPYFAAVVLAFLSNLMGGLTHYGIGSAPVFYGANYVPLAQWWGYGFVISVVNILIWLGVGGFWWKAIGLW

SEQ ID NO: 59855 - protein, 533 aa, Zea mays
MAAALLLASATALLALAAAWLWDYVVVRLLWRPRAVAGMFRAQGVRGPPYSFLSGCNREMRRMKAEADDGLRLDVRDHNYLPRVMPHFLAWKQLYGEPFLYWMGPRPRVCLFDYESVRQVLFNKSGHFFKDDAHPTILAMMGKGLVLVEGTDWVRHRRVVNPAFAMDKLKMMTETMVSCAEPLIKRWEQLAAASRSSEDGGRGEVQVEFSKQFQDLTADVIAHTGFGSSYKEGKEVFHTQKQLLALAMATLLNVQLPGFKYLPTKNNRLKWALEKKMKTTLMAIIQSRVASNGRSSGYGDDLLGLMLEAWLTAERGGGERDESSLTMDEIIDECKTFFFAGHETTSHLLTWTMFLLSVYPEWQQRLRDEVLRECGQANPTADTLNKFNEMTMVLLETLRLYGPVMLMLRKPTSDIRLGSLSIPKGNGIAIPVPFLHRDREVWGDNANDFDPLRFQNGVTNAAKTPQALLSFSIGPRACIGQNFAMLEAKSVMAMIMKKFSFTLSSSYVHAPVDYITLQPKFGLPIVLRPLPDV

SEQ ID NO: 59856 - protein, 313 aa, Mesembryanthemum crystallinum
MGEEEKGKSASNSSSNSNSNSNSSGVWRTIKPFVNGGASGMLATCVIQPIDMVKVRIQLGQGSALSITKNMLRDDGIRAFYKGLSAGLLRQATYTTARLGSFKILTNKALEANEGKPLPLYQKALCGLSAGAIGASVGSPADLALIRMQADATLPEAQRRHYKNAFHALYRIIADEGVLALWKGAAPTVVRAMALNMGMLASYDQSVEFFRDSLGYGEVATVLGASTVSGFFASACSLPFDYVKTQIQKMQPDAEGKYPYKGSLDCTIKTLKSGGPFKFYTGFPVYCVRIAPHAMMTLIFLHQIQKLESTIGV

SEQ ID NO: 59857 - protein, 622 aa, Mesembryanthemum crystallinum
MEAVLQTKGLLSLPSNPKLRVLRSPQSSLRQRVTNPQALKPKPLQGFSLSSNGFQKFHGVACNTQGFGQKLRNLPICRAEAAAAAADGQPLYGEVQSPKFLGIELVTLKKIIPLGLMFFCILFNYTILRDTKDVLVVTAKGSSAEIIPFLKTWVNLPMAIGFMVLYTKLSDILPRKTLFYTVMLPFIAFFGAFGFVLYPMSNYFHPTALADQLLATLGPRFLGPLAILRIWSFCLFYVMAELWGSVVVSVLFWGFANQITTIEEAKRFYPLFGLGANVALIFSGRTVKYFSKLRANLGPGVDGWAVSLKGMMSIVVLMGLAICFFYWWVNTYVPLPTRSKKKKEKVKMGTMESLKFLVSQKYIRDLATLVVAYGISINLVEVTWKSKLKAQFPSPNEYSAFMGDFSTATGIATFSMMLLSQFIFDKFGWGVAAAITPTVLLLSGVGFFSLILFGGPLGPTLSSFGITPLLAAVYVGAMQNIFSKSAKYSLFDPCKEMAYIPLDEDTKVKGKAAIDVVCNPLGKSGGALIQQFMILTFGSLANSTPYLGGILLLIVTAWLAAARSLDKQFTELRREEDLEKEMERASVKIPVVADNSTGNGPLTGGSQLNDSPNSSSESLKSQ

SEQ ID NO: 59858 - protein, 970 aa, Brassica juncea
MPDSVRSMKMNMKSFLKKLHITPNQPDEAADGSSIPTNKSSDVSSSPHHQSPEVKPFSGLSNWLSSVGHRKSPSPPNSLNATNGGDDEQQQDSKEDPEVEEEYQIQLALELSAREDPEAAQIEAMKQFSLGSCAPDNSPAELVAYRYWNYNCLGYDDKILDGFYDLYGVLNASSAEKIPPLLDLQGTPVSDGVTWEAVLVNRSGDYNLLRVEQMGIDIAAKTESVSSSSFVNSELVRKLAVLVGDYMGGPVVDPDSMLRAWRSLSYSLKATLGSMVLPLGSLTIGLARHRALLFKVLCDSVGVPCRIVKGQQYTGSEDVAMNYIKTDDGREYIVDLMGDPGTLIPADAAGLQIDYDEPVCSTSPGDNDSFHDASSTNGIESSFQENIEFPPGEHSSSTKSSKEDVAKVEKAPPVQNLSSRPIHSFTHMRSPSWTEGVSSPAARRMKVKDVSQYMIDAAKENPRLAQKLHDVLLESGVVAPPNLFSEVYPQQLDATVEIKNLTEAKKEKETAQQGRHQNDLGPVRFLPPLPRLHSKADTHDQQHDHGKVVSQSDSSHSEASSTEYARTVPAAVAAAAVVASSMVAAAAAKTANTESSTLELPAAAAATATAAAVVATAAAVSRHLELGSNSDGDAGSGGHEPQGSGDSPHGPNSGGDRVSDRSTGDESSKSDGTLDDVSDCEILWEEITLGERIGLGSYGEVYRGDWHGTEVAAKKFLDQDLTGEALEEFRSEVQIMKKLRHPNIVLFMGAVTRPPNLSIITEFLPRGSLYRLIHRPNNQLDERRRLRMALDAARGMNYLHSCSPMIVHRDLKSPNLLVDKNWVVKVCDFGLSRMKNSTYLSSKSTAGTAEWMAPEVLRNEPADEKCDVYSYGVILWELFTLQQPWGRMNAMQVVGAVGFQHRRLDIPDFVDPAIAELISKCWQTDSKLRPSFAEIMVTLKKLQRPATGSNIPRPVPSSSSLSTEQEQKDC

SEQ ID NO: 59859 - protein, 388 aa, Mesembryanthemum crystallinum
MAEMNKQPSVIQKAAGQFHLSSGLSQITQPRLGGSQGPALHQRRFAYGNYSNAAFQYPTSSTTQDLSFVNTMASPVVAHAPAEKNFKTFAIDFMMGGVSAAVSKTAAAPIERVKLLIQNQDEMLRSGRLSEPYKGIGDCFKRTTADEGMIALWRGNTANVIRYFPTQALNFAFKDYFKRMFNFKKDESYWKWFAGNLASGGAAGASSLVFVYSLDYARTRLANDAKAAKKGGERQFNGLIDVYKKTFASDGIAGLYRGFNISCVGIIVYRGLYFGMYDSLKPVLLTGKLQDSFFASFGLGWLITNGAGLASYPIDTVRRRMMMTSGEAVKYKGSFDCFAQILKNEGAKSLFKGAGANILRAVAGAGVLAGYDKLQVILLGKKFGSGGA

SEQ ID NO: 59860 - protein, 494 aa, Wolbachia endosymbiont of Onchocerca volvulus
MNIALKYRPDSFKDLIGQDVLVRILKNAFTLNKIPQSILLSGSSGVGKTTTARIIALCLNCSLGPTFEPCGLCENCLAIKNSNHSDVIEIDAASHTSIEDIKVILENICYLPISSKFKIYIIDEVHMLSGSAFNALLKTLEEPPSSVKFILATTEIKKMPITIIARCQRFDLYKIPATKIVGRLNDIAQKENYLIENRALELIAHHCSNSMRNALFLMNQAMLYSKNGPISTEDVTEILGLVDEGIVFDLMEAVLDSDLRKALLVFDKAAKTANPLSIFENLLQTIQLICRFLITKEVDSSLLEHGKDRIKDLSARKSLIFFSRLWKVLLKGIQAIKVSSCNDIAAEMMLISLCYLSDLPSPEQVIKKILAQNTRQRDIYNIGNTQQENYDFDKILQLLRQDNQVYLYKQLCNNLQLVDCKPGYLRLKAVSQLDSNFCNDLKNYLDQVTQQQWLVTVDVGYINREISNLNHVPTVKGILDTFKGAKIVNIESKE

SEQ ID NO: 59861 - protein, 153 aa, Brassica napus
  misc_feature (131)..(131): Xaa can be any naturally occurring amino acid
RVPARDKNVRALFTDKAVEKIESETGCKIKMDDKFIIVSGKDRLILRKGVDAVHKVREEGEAKTSSASHRSRSRSPRRTSVGPPPPPRAARNPEPLRQQHPPPSHGSSSFSERSGRQDKFVDNRVREENRXRNAPRGSPQAYGSDRARSRSTH

SEQ ID NO: 59862 - protein, 420 aa, Nostoc punctiforme PCC 73102
MTFTPTKTLADKVRADFPILHQEVNEKPLVYLDNAATSQKPLFVLNTLRDYYEQYNANVHRGAHSLSAKATDAYEGARDKVAKFINAASRQEIVYTRNASEAINLVAYSWGMNNLQPGDEIILSVMEHHSNIVPWQLVAQKTGAVLKFVELTPEETFDLEQFKKLISEKTKLVSVVHISNALGCINPVEEIGAIAHKYGAKFLVDACQSVPHYPVDVQKIDCDWLVASGHKMCAPTGIGFLYGKLELLESMPPFFGGGEMIAEVYLDHSTYAELPHKFEAGTPAIGEAIALGAAIDYLSSIGMDKIHAYEAELTAYLFQQLEQIPQIRIYGPKPNAKGEGRAALASFTAGEVHANDLSTLLDQEGVAIRSGHHCTQPLHRYLGLAATARASLSFYNTREEIDIFIKALKETLDFFAGFLA

SEQ ID NO: 59863 - protein, 123 aa, Pyrus communis
LVEACKNSLEKLQLDYLDLYLVHYPMPTRHNAIGKTASLLGEDKVLDIDVTISLQQTWEGMEKTVSLGLVRSIGLSNYDLFLTRDCLAYSKIKPAVSQFETHPYFQRDSLVKFCIKHGVLPTA

SEQ ID NO: 59864 - protein, 627 aa, Oryza sativa
DYKGSGALEELEMLTVNAKEAQELILTKILERNQATEYLSKFMNGSTNISAFKRHVPVVTYDKVHPYILRIATGEESSILCGEYILELLRRLLLMTVINPEAQTELRLGKIVYIYFLECARLEMTGHTKLLAFSGTSRGEPRLMPSILKDLDRRTYLYSLIMPIMNKYISGLGEGKAMYLLFVKAETLTDSGIPVRSVLTSYYKSPHFLHRKHDLYNNYTSPDEVILCPDSQQSMYCQLLCGLVERQHVLRIGAVFASAFLRSISFLEQHWRDLVNDIRIGQLNSSITSPACRLAMLNFLALPNPELADQVEAICSCGSWKGILGRLWPNVKYIEAVLTGTMAQYIPMLEFYGGGAIPFVCTMYASSESYFGVNLSPLCSPADVSYTILPNMAYFEFIPLEDGLRLTDHEEVIENDKLVSLVDVKVGCYYELVVTTFSGLYRYRVGDVLQVTGFYNRAPQFKFICRRNVILSIDSDKTNEEDLHNSVTTAKKILENQNYLLLEYTSYTDISTVPGHYVLFWEIKSTHDERPAPLDAQLLESCCAAVEESLDYVYRRCRAHDRSIGPLEIRLVEAGAFDALMDLLVSHGSSINQYKTPRCIESSLALKLLNSKVIACFFSPQDPECGM

SEQ ID NO: 59865 - protein, 357 aa, Streptomyces griseoflavus
MTITASGSLPPSAPVAVQILDLLMGGWRAGVVSTFAELGVADGLAAGGLTPAQLAVRLGLEHDTAERFFRAGASVGLLRRGEHDTLELTELGRALASDDGSMRNFARWTGSTAERATWAHLATAVRTGRSPFAAMHGSGVWEFMESDPDTAAVFNSAMTELSKRVIQPVIEAFDFSRFSSVTDVGGGRGALLAAVLRKHPEMTGVLFDQPDVVSRSLPELSDAAVAHRVTVKSGSFFDGVPSGSDLFMISNVLHDWDDGRSRLILRNIAEAMHEGAHIAVVEAVAGLDDTADKAISLMDMDMLLLCEGKQRTVEEFRLLMAEVGIELVGVSRAGLQSVVEGRKVSGETGTPGSPRSR

SEQ ID NO: 59866 - protein, 499 aa, Glycine max
MLSPLLLFLCLTLPLFLLSFFKYRKTFKNPPLPPGPRGLPIIGNLHQLDSPSLHEQLWHLSKKYGPLFSLQFGLRPAIVVSSPKLAKEVMKDNDLECCGRPKLLGQQKLTYNGLDMGFSSYDSYWREIRKICVVHVLSSKRVQSFTSIRHFEVKQMIKKISRHASSSKVTNLNEVLISLISTIVCRIVLGRRYEEEGSEGSRFHKLFNECEAMLGNFFVSDYIPFMGWIDKLRGLDARLERNFKEMDKFYQEAIDEHMNSKKKTPEEEDLVDVLLQLKENNTFPIDLTNDNIKAVLLNLLVGATGTTEVTTIWAMTELIKNPSIMKKVQEEIRGLSGKKDFLDEDDIQKFSYLRAVIKETLRLHLPAPLLIPRETNKKCMLDGYEIPAKTLLYVNAWAIHRDPKAWKDPEEFIPERFLNCDIDLYGQDFEFIPFGAGRRLCPGMNMAFAALDLILANLLYSFDWELPQGMKKEDIDTEVLPGVTQHKKNPLCVVAKCYM

SEQ ID NO: 59867 - protein, 340 aa, Physcomitrella patens subsp. patens
MSDAGGNPHGVGKERSPDGNAGVDSGADEQDDSNERVESPTLSKREEREVRKKAKLEGDTRHPIYRGVRKRPWGIWVTEIRRPKNKSRIWLGSFATAEMAARAYDCAALALRGNGALLNFPKMAASLPRPADLTDKSIQAAATIAANNFAQLPSEMDVYGAMPSQSALSSSPKGDEDHQQHGSQQKLRQTSKSTTFTLGRVGGSSSQRLISNSDGSKSYQPSSSTKQGEEANLHKIIVSTSNPQSRSSEIAGTQSRYSSMCTSDTESMENLKHHATGGENNPPSSSGVQQLLFVDSEDMFTIGFTNLCDAMCIPPPAPEHATETDGEEGSTIWEPHLWSY

SEQ ID NO: 59868 - protein, 471 aa, Vitis vinifera
MFAGLLFHVHRIHDEAAEILEKTGCTFLFKGPWFCNMDMLGTTDPANVHYIMSSNFSNFPKGTEFRKMFEVLGDGIFNADGESWRNQRKLGQSMINNPRFHRFLAKVTYNKVEKGLVPLLDHLSEQGRVVDLQDVFQRLTFDTTCMLVTGFDTKCLSIEFPEVPFATALEDVEEAVFYRHALPETLWRLLRWLGIGKEKKLRKGWKTLDHTIAEYISMKREELSKGITKLREDEDGADLLTSYMTEDNAIGLKCDGKFLRDTILNFMIAGRDTTSSALTWFFWLVSKNPLVESKIREEIETAIPEKEDRKGRHIFKTEGLNKLVYLHAAMCEALRLYPPVPFQHKAPIQPDVLPSGHKVDPKMKIFFPVYAMGRMTAIWGKDCLEFKPERWISELGKIKHEPSYKFFSFNAGPRTCIGKEVAFTQMKAVAATIIHNYHVEMVKGHHVAPNVSIILYMKRGFKVRVSKRWGG

SEQ ID NO: 59869 - protein, 259 aa, Streptomyces griseoflavus
MTSPRHALVTGGSSGIGKSVARRLASAGHTVTICGRDSERLQQAAKELSEQGAPVTSLIADVSKPRQVGDLVREAVETNGPLGILVNNAGRNGGGRTAELSDELWREVLSTNLDSVFYVTREVLARGGIGEVDHARIINIASTAGKQGVLLAAPYSASKHGVVGFTKAVGKELAPQGITVNAVCPGYVETPMASRVRQAYADAWETTEAEVLSAFEAKIPLGRYSTPDEVASLVEYLTTEGAASITAQAFNVCGGLGNF

SEQ ID NO: 59870 - protein, 313 aa, Bacillus anthracis str. A2012
  misc_feature (5)..(5): Xaa can be any naturally occurring amino acid
MRNVXCIGELLIDFVCRNTNVSLVNGSNFEKKAGGAPANVAAAITKLGGHATFMGQVGNDPFGEFLEQTLQHAHVDTSMLIKDKQTTLAFVSIDQNGERDFTFMRGADGEYHFNSIDLSKIKTNDLIHFGSATALLSSPLKDTYFQLLQHARESGQFISFDPNYRNALITNTEQFIQDCLTFIKHAHFVKVSQEEAIMLSKESDLQQSALKLLNHGAKAVAITLGKDGTLLATKDKQTIVPSISIQQVDTTGAGDAFVGAMLYQIAKSEQMFLHNFEGLTTFISFANKVGALTCTNYGAISSLPSLTDVKAYE

SEQ ID NO: 59871 - protein, 98 aa, Triticum aestivum
VQSKSLIEKNKQFVVQPPTVEKCQELSKQLFYTRIASLPVRYEAFWKEADQVKQLWRNRKDLNVEHAGIIALFGLELYGWFCIGEIAGRGFTFTGYSV

SEQ ID NO: 59872 - protein, 342 aa, Physcomitrella patens subsp. patens
MADWEWQDAVQSLIIGIVFAYMCGRLFTLISSIRDQKFRLERGGENAAAPLFTTTFDEQEYAPAAELNVPYAPIEEELDAFDGGDEQEGNVTDDWEGVESTELEELFGAASTYVASVINVPGAKSSREEMLQLYAYYKIATEGPCSTPQPSAFQPTARAKWIAWQKLGNMSQEEAMQKYVAVLTAIDPTWHQKGAFLHSSSKNMNPGPAFSSLAATDDVEGTSTMDALHTCARDGDLQGLSKLLEQGRSIDVKDSDGLTPLIWAVDRGNVSAMEVLVAKGAEIDTKDVEGQTALHHAILSNQEEVAKYLFEHGANINIADKDGNTPLSQCPAHWQWLQRTTG

SEQ ID NO: 59873 - protein, 383 aa, Archaeoglobus fulgidus DSM 4304
MMRLHEHQAKQIFAKHGIRVPRGEVATSPEEAEKIAEKLGGRVVVKAQILVGGRGKAGGVKKANSPEEAKEVAKKILGMTIKGHRVEKVLVEEQLNMRKEYYVGYVVDKSSRLPTVIFSRMGGMDVEEIAAKHPDAIHRIYFDPLWGLKDYEVRKALFRAGFEGEEFKQMFDIIKKLVDIAFAYEAELTEINPLAVTDEGFLAADARLNTDDNALYRHPELAELREATEEDPLEREARLKGINYVHLGGNVGVIANGAGLAMATMDIINLMGGKPANFLDTGGGLADPVKMKNCLLHVLKDPNVRVVFINIYAEITRCEKVAEGIILALDEAPRKVPLVVKLAGTNEEIGREMLERYSSEKGAEIHFVESIEEGARKAVELAG

SEQ ID NO: 59874 - protein, 72 aa, Cucumis sativus
AFTGEISVEQLKDIGCKWVILGHSERRHVIGEDDQFIGKKAAYALSEGLGVIACTCENLEEREAGKTFDVCF

SEQ ID NO: 59875 - protein, 504 aa, Pericallis cruenta
MSILTLICTFITGLMFYGLVNLLSRRASRLPPGPTPWPIIGNLMHLGKLPHHSLADLAKKYGPLIHVRLGSVDVVVASSASVAGQFLKVHDANFANRPPNSGAKHMAYNYHDMVFAPYGPRWRMLRKMCSMHLFSAKALTDFRQVRQEEVTILTRVLARTGQSAVKLDQQLNVCFANTLSRMMLDRRVFGDGDPKADDYKDMVVELMTLAGQFNIGDYIPWLDLLDLQGIVKRMKKVHSQFDSFLDTIIDEHTIGTGRHVDMLSTMISLKDNADGEGGKLSFIEIKALLLNLFSAGTDTSSSTVEWGIAELIRHPQLMKQAQEEMDIVVGKNRLVTEMDISQLTFLQAIVKETFRLHPATPLSLPRIASESCEVKGYHVPKGSILFVNVWAIARQSELWTDPLEFRPGRFLIPGEKPNVEVKPNDFEIVPFGGGRRICAGMSLGLRMVNLLIATLVQAFDWELANGLEPEKLNMEEVFGISLQRVQPLLVHPRPRLARHVYGTG

SEQ ID NO: 59876 - protein, 467 aa, Coccidioides immitis RS
MLNLTNVLLIPPAAGALHVGYRYLQSYLEAERVRKLENTEDPPKAPNQGIFGINVYRDMARHKEEHVFLQKNLERYDELGDTYTSDMFGRTYIDTRDPENIKAILSTQFEQFSLGDSRLDAFYPMLGEGIFTHVYGGGPKGEPWRHSRAVLRPQFARHQIQDLAKLEDLLPDSPPKETQFYHDFTRGTEICMLRTLLGDLYFLQKDSSEFKRVSAFVQEYIDRFTHKALELHAAGKPTSYDSNGKYVFLEEISKSIRDPVRLRSELLNILLAGRDTTASLLSACFHQLARHKDVWDELRKEIMDNVGDRLPTYEDIKSLRYLRYVLNETLRLFPVVPWNGRQAVVTTTLPRGGGPDGKNKILVKKGTFVLYSTWGLHRSKFYGEDTNEFRPSRWETIRPGWNYIPFNGGPRICLGQQYALVEASYVITRLLQVFKDIENRDPVLPFVEHTTLTLSSEHGAKVALTPA

SEQ ID NO: 59877 - protein, 258 aa, Xanthomonas campestris pv. vesicatoria str. 85-10
MSVNLKTKEEIELMRVAGRLAAEVLDVVAPHVKPGVTTAELDRICHDHIVNVQGTIPANVGYRGFPKSVCTSVNNVICHGIPSAAKVLKDGDIVNIDVTVIKDGWHGDTSRMYYVGTPSVMAKRLVETTYEAMWRGIRAVKPGATLGDVGHAIQKFAEAERFSVVRDYCGHGIGKVYHDEPQVMHYGRPGEGLVLKPGMTFTIEPMINEGTYHHKTLPDGWTVVTKDRKLSAQWEHMVAVTEDGVDVLTLSANSPAPV

SEQ ID NO: 59878 - protein, 142 aa, Dechloromonas aromatica RCB
MAIERTLSIIKPDAVAKNVIGKIYSRFESNGLKVIAARMTWLSEQEAGQFYSVHKERPFFKDLVSFMTSGPVMIQALEGENAIAKNRELMGATDPKKADAGTIRADFAESIDANAVHGSDAPETAAVEIAFFFPGMNTYAGR

SEQ ID NO: 59879 - protein, 211 aa, Zea mays
MSKVFTLDAVAKHNSKEDCWLIIGGKVYDVTKFLVDHPGGDHLIRISGAGKLSVHQTSTSSRSLQPLPAASKQMATVLSSPRAPAFSFSLRAAPAPTTVAMTRGGGASSRLRAQATYNVKLITPEGEVELQVPDDVYILDYAEEEGIDLPYSCRAGSCSSCAGKVVSGSVDQSDQSYLDDGQIAAGWVLTCVAYPTSDVVIETHKEDDLIS

SEQ ID NO: 59880 - protein, 357 aa, Leptospira interrogans serovar Lai str. 56601
MKKLLYTLNLSEQFLWEFPHFKNRWIRNKSQRFRFYSKGAFSQEFPQKDQKTFYLQKYDFMDCRNNLAPRLSKFRTSFLIVNRWIEILFFWSFVLFCTFFSFPISAEIQWEKSVQIAFEKARSSGKPIFIDVYADWCSYCKTLKKEIYPKKEVQLELSKFVALSLDGDKFPNLKRKYGIKGYPSILFLDRNGSLIDKITGMPDSKMILKSLKNAYVRRNLENEYLENLAKDPQGIQTNFQAGVYYFEAKEYSKAIQFFQKAIDSNDSKNLEKKHDALFNLGISYLEIGNFKLAISTFNSYLSKYPNGDLVSVLFFRANAYEELNLKEEAKADYKKVLELTLDPDEKQDLQMRIDSLN

SEQ ID NO: 59881 - protein, 303 aa, Antrodia cinnamomea
MGPFVLGAALSVAALSAVQALPSRYPTLKARASITALPGAQITDYTPYTYYASTGYCNASETLSWSCGANCEANPDFEPVASGGNGDSIQYWFVGYDPTLETVIVSHQGTDPSEILPLITDADIEKTTLDSSLFPGLSSDIEVHSGFANEQSKTATDVLSAVQSAMSKHSASKVTVVGHSLGAAIALLDAVYLPLHISDATFSFIGYGLPRVGNQAFANYVDAQPTSVTHINNEEDPIPICPGMSLGFVHPSGEVHIEDSGEWAACPGQDNPSTQCIVGDVPSIWDGDESDHDGPYNGIEMGC

SEQ ID NO: 59882 - protein, 409 aa, Haemophilus influenzae Rd KW20
MAIEILVPDLPESVADATVATWHKKLGDTVKRDEVIVEIETDKVVLEVPALSDGVLAEVVQAEGETVVSKQLLGKISTAQEGDVSSATLKATNEPTPSDRQNAAIENSHNHNADQSPVIRRLLAEHDLQADQIQGSGVGGRLTREDIEREIAKRQAQQVKQEAATEQNTISTVAYSARSEKRVPMTRLRKRIAERLLEAKNSTAMLTTFNEVDMQPIMTLRKTYGEKFEKQHSVRLGFMSFYIKAVVEALKRYPEVNASIDGDDVVYHNYFDISIAVSTPRGLVTPVLRDCDKLSMAEIEKQIKALAEKGRDGKLTVEDLTGGNFTITNGGVFGSLMSTPIINPPQSAILGMHAIKERPIALNGQVVIRPMMYLALSYDHRLIDGRESVGFLVTIKELLEDPTRLLLEI

SEQ ID NO: 59883 - protein, 414 aa, Mycosphaerella graminicola
MGDLQGRKVFKVFNQDFIVDERYTVTKELGQGAYGIVCAATNNQTGEGVAIKKVTNVFSKKILAKRALREIKLLQHFRGHRNITCLYDMDIPRPDNFNETYLYEELMECDLAAIIRSGQPLTDAHFQSFIYQILCGLKYIHSANVLHRDLKPGNLLVNADCELKICDFGLARGFSVDPEENAGYMTEYVATRWYRAPEIMLSFQSYTKAIDVWSVGCILAELLGSKPFFKGRDYVDQLNQILHYLGTPSESTLARIGSPRAQEYVRNLPYMQKIPFHTLFRNANPDALDLLDRMLAFDPSQRIDVDEALEHRYLSIWHDASDEPNCPTTFDFGFEVVEEVPEMRQMILQEVRQFRQSVRAPQQQQYSQGHQQGQQVPIPDGYDRTHEDPRPQEMGSTDPYGLERELHDGLDAMR

SEQ ID NO: 59884 - protein, 327 aa, Arabidopsis thaliana
MVSKKDKQIHSDHNPQDASPVEWAEIRHKLLAFQENIQSGSDIDARSDDPQMCGLYVSDIYEYLRELEVKPKLRPLHDYIEKIQEDITPSKRGVLVDWLVEVAEEFELVSETLYLTVSYIDRFLSLKMVNEHWLQLVGVSAMFIASKYEEKRRPKVEDFCYITANTYTKQDVLKMEEDILLALEFELGRPTTNTFLRRFIRVAQEDFKVPNLQLEPLCCYLSELSMLDYSCVKFVPSLLAASAVFLARFIILPNQHPWSQMLEECTKYKAADLQVCVEIMLDLYLSRSEGASKAVREKYKQHKFQYVAAIPVYQELPVTFWEDVVTI

SEQ ID NO: 59885 - protein, 245 aa, Brassica napus
IGMGQMERYEVDFESFMLLDSASYYSRKASSWIQEDSCPDYMLKSEECLKKERERVAHYLHSSSEPKLVEKVQHELLGVYANQLLEKEHSGCRALLRDDKVDDLSRMYRLYHKIAKGLEPVANIFKQHVTAEGNALVQQAEDTATNQAANTASVQEQVLIRKVIELHDKYMVYVVECFQNHTLFHKALKEAFEIFCNKTVAGSSSAELLATFCDNILKKGGSEKLSDEAIEDTLEKVVKWLGLYK

SEQ ID NO: 59886 - protein, 349 aa, Erwinia carotovora subsp. atroseptica SCRI1043
MQLSFIARTITAACLMLSSHALLADDAKPGVTIYATGGTIAGKAESNTATTGYKAGAIGIQELLNAVPAIGDVATVTGEQIANTASGNIDQAILLKLSKAINKQLGDSNTHGVVITHGTDTLEETAFFLDLTVKSEKPVVVVGAMRPATAISADGPMNLLEAVTLATSKNAEKRGALVLLNDRIGSAFYTTKTNATALDTFKANEQGYLGAFYGGVPRFFYQPAAPENKPFFDVSNKDTLAKVDILYGYQDQDSGLLNAAIEQGAKGIIIAGSGNGATPTRIKEDIKKAVAKGIPVVISTRTGSGYVTDKKKDGAIGSGFYNPQKARILLSLALSNGDDIEKIRTYFEQ

SEQ ID NO: 59887 - protein, 322 aa, Streptococcus thermophilus LMG 18311
MIKKILVLHTGGTISMSADDDGKVSQNADNPMNHVGLDLDNLALTVLDFFNIPSPHITPYHMLDIYKKIKETAGQYDGVVITHGTDTLEETAYFLDTMNVPEIPIVITGAMRSSNELGSDGVYNYLSALRVASNDKAADKGVLVVMNDEIHAAKYVTKTHTTNVATFQTPTHGPLGIIMKHDILWFKTAEPRVRFDLKQITGTVPIIKAYAGMGIGDGIISLLAPEKIDGVVIEALGAGNLPPLAAREIKSLMDKGVPVVLVSRCFNGIAEPVYAYEGGGVKLQEAGVMFIKELNAPKARLKLLIALSAGLEGQELKDYIEG

SEQ ID NO: 59888 - protein, 226 aa, Brassica napus
MEEEEEEGDTFEDAVCTKTPARVNTPLSVITEAFENLADLLKPDISTDEDGLSLDAFCSACTHVSILFSCLGFAFKFAEMEYISKVKDLVEASKTLDTLQNILDLDVEKETVKTPGSRSRNLRRVRQGLDLIRAIFEQFLMTDEYSLKHAATTAYTEVCAPFHTWAVRTAVYAGMYTLPTRDQLLLRLNETDQSVEKNMRRYMEASQPIIEYIDKLYIERNIKLDW

SEQ ID NO: 59889 - protein, 261 aa, Burkholderia xenovorans LB400
MAITYKTPDDIARLRISGRLAADVLAMIGEHIKAGVSTEELDALCNDYIVNTQKSIPANVGYLGFPKTICTSVNSVVCHGIPNRGEVLKDGDIINIDVAIIKDGYFGDTSRMYCVGQPSTVARQLIDTTYEAMLAGIREVKPGATLGDVGHAIQKIAQRDGFSIVRDYCGHGIGKVYHEEPQVLHYGQPGQGVRLKPGMVFTIEPMINAGRAGTTVLRDGWTVVTKDRSLSAQWEHMVAVTDEGYELLTPWPDGTGRYEAP

SEQ ID NO: 59890 - protein, 467 aa, Zea mays
MAAPAAAPLDEGKAKKVLRQVEFYFSDSNLPRDKFLRETVEQSDDGLVSLPLICSFSRMKSHLGLDADVKPETVPEETVLAVAEVLRPSPALRVSEDGKKIGRASELLKPDEIIEQVDSRTIAVSPLPCNVKQEDVQSFFTNYAKVNSVRLPRNIANKKHFCGTALVEFSEEEEAKRIMETALVFAGANLEIRPKKEFDAEQKSKKEAYEKTHLKKDNQYEGYQKGLIVAFKLEKATADTVVQQDNIDKENDSATKLDVSSSMEKPSGQGPEESILESDVIKQGMSSDDMTKEKDLNTGEATESEKCISDVPIESDKHGDSEPLSREGKIISGNVNVKNQISREDLKEAFKKFGAVRYVDFSIGDNSGYLRFEDSKAAEKARMSAVLADGGLIIKDHIVTLEPVTGEAEKDYWDTIRSIQGKYKDSRSYKGRASNNQRGGKRFNAKRDRNPDSEKNSNKARKVEAIA

SEQ ID NO: 59891 - protein, 479 aa, Ruminococcus albus
MESTNIGKFVQIVGAVVDVRFDKEHMPNLLNALEIDNNGTKLVVEVAQHIGDDVVRCIAMSSTDGLVRGVDAVDTGRAISVPVGRETLSRMFNLLGDPVDNLPAPETAERWEIHREPPSYEEQTAANEILETGIKVIDLIAPYLKGGKIGLFGGAGVGKTVLIQELINNVANQHGGISVFTGVGERTREGNDLYWEMKESGVIDKTVLVYGQMNEPPGARMRVGLSGLTMAEYFRDVEGQDVLLFIDNIFRFTQAGSEVSALLGRMPSAVGYQPTLATEMGALQERITSTNKGSITSVQAVYVPADDLTDPAPATTFAHLDATTVLSRSIASLGIFPAVDPLESTSRILTPEIVGNEHYQVARQVQSILQRYVELQDIIAIMGMDELSDEDKLTVSRARKIQRFLSQPFFVAEQFTGYQGKYVPLKETIRGFKEIIEGKHDDLPESAFLLSVLSMRLWKRQRSPQKKNNERRKLWQFSN

SEQ ID NO: 59892 - protein, 204 aa, Deinococcus radiodurans R1
MEVMSVIPYVIEQTGRGERSYDIYSRLLKDRIIFVGTPVESQMANSIVAQLLLLDSQNPEQEIQMYINCPGGEVYAGLAIYDTMRYIKAPVSTICVGMAMSMGSVLLMAGDKGKRMALPNSRIMIHQGSAGFRGNTPDLEVQAKEVLKLRDTLVDIYHKHTDLPQEKLLRDMERDYFMSPEEALKYGLIDQVIDQTRENRGGEE

SEQ ID NO: 59893 - protein, 92 aa, Triticum aestivum
  misc_feature (14)..(14): Xaa can be any naturally occurring amino acid
  misc_feature (73)..(73): Xaa can be any naturally occurring amino acid
MAFSMLSFGTMAAXSAAQATMVAHFNGLMSSAVFPATATANNDTTCMTSNGGRGNCMQVWPTIVKKKIETLSXLSDPTDSAWAYEVDYLIRN

SEQ ID NO: 59894 - protein, 479 aa, Mesorhizobium loti MAFF303099
MAQFRKNLIDGEWVGDAGSHNINPSDTGDVVGEYASAGVEQAKQAIAAAKAAFPSWSRSGPLARHAVLKKASDEIMARKDEIGRNLAREEGKTLAEGIGETIRAAQIFDFFAGETLRLTGEMVPSVRPGVGVEITREAVGVVGIITPWNFPIAIPAWKIAPALAHGNTIVFKPAELVPESAWSIVDILHRAGLPKGVLNLVMGKGSVVGQAMLDSPDINAITFTGSVGTGKRVAAASVEHMRKFQLEMGGKNPLVVLDDADLAVAVDCALNGAFFSTGQRCTASSRLIVTEDIHDRFVEALKERMGKLVIGDALDAQTQIGPVVDATQLKQDEDYIAIGVREGATLAFGGERLDRKTPGFYLSPALLTEATNAMRSSREEIFGPVASVIRVKNYDEALSVANDTPFGLTSGICTTSLKHATHFKRNSEAGMVMVNLPTAGVDFHVPFGGRKGSSYGPREQGRYATEFYTTVKTAYTFAG

SEQ ID NO: 59895 - protein, 753 aa, Cryptococcus neoformans var. neoformans
MSVTDLTYFSEDEQREIQAELDAGFKDIEEKYAVTAQKGFETMLVVDNIPVVDVSKKQRLIERLRQTFAKVGAPVEEESIDMPWNVTTGTNKGFVFLTYPDVKEAENAVHVLDGVSFGKNILHVNRFGDIQRFASLPIGEGDLPAGWKEKDYIEKDYLRSWLGDLAGRDQYVTFWDTEVSIWWNGRNGSAEVLRGPDGKPVKNNKWGELYLQWSPMGTYLASLHRVGVALWSGPKLDGPIGVNVLRFTHPNVRLIQFSPCENYLITWSEDPLPSYEKHPNAALRETFGPEDEGNQYVVWDIKTARVLRTFPGDRLASGADDGQSRMSWPAFKWSADDSYVAKCNVGTGIAVYELPMMGLLDKKSIKIEGVQDFEWSPMSQKEIVARHDGKGKECVLAFWTPEAQNQPARVNIISVPSRTVLRSKNLFNVSDCKFYWQSQGDFLCVKVDRHARKAKSKKATSCNLEIFRMRERDYPVEVLEFKDYVPQFAWEPLGTRFAIVLQTEAHPSSVSGASTKYSIDFYQLDLKKGDFIPIKHLDSKMANTLVWSPKGRHIALATIGSSSKFDIEFWDLDFTVDERREAAEQGANVTMLGTGEHFGITEIAWDPSGRYIATSASTWRQSPEPGFSIWDFKGQQLLHESRDRFKQFLWRPRPPTLLSKEQIKKVRRELREHSRQFDEEDAAEENRGSAEKLAQRRREIGEWNAWRARNNDRLAVERENRGKSKAKIKVEGQEARVEEWFEELIDEIEELST

SEQ ID NO: 59896 - protein, 570 aa, Pyrobaculum aerophilum str. IM2
MNVEEIAFKYALANAVKYGGKADVKAVMAKLMAEVPELRARAREVKQIVDAVVARVNSMPLEEQRRILRERWPELLEERRAEQRRPGLEGLPELPNVRGGVVVRFAPNPDFVLHLGSARPAILNYAYRIKYGGKFILRFEDTDPRIKSPLVTEEVNAYESIREDLRWLGVRWDEEYIQSQRMEIYYEHAKKLLEMGAAYVDLCKPEEWRRLRNEKKACPHREQPPEVNLELWDKMLEGRFKEGEAVLRIKTDLTHPDPSVRDWVAFRIIDTSKTPHPLTGDKYIVWPTYNFAVSIDDHLMGVTHVLRAQEHSVNTIKQSYVFRHFGWEQPVTIHFGRLRIEGATLSKSKLKAMRIKYDDLTLPTLAGLRNRGIVPEAIWDLILSVGIKPSDSTVALANLFAFNRKHIEPIADRYMYVADPVKLVFEADKELTAHVPFHPSFKERGERTYRLGPGRVEVYIQRRDAVAGKVVRLMELANVEIVRVEGDVAYGRIHSYSLDEAKKIGAPIIQWVWDPVEITVIKPAGVGRKEVEVGLGEGWLERVEVGKYVQFFRYGYLKKRGPREFVFLHD

SEQ ID NO: 59897 - protein, 510 aa, Nocardia farcinica IFM 10152
MHDDGNVLEFRLPDLGEGLTDAELVSWSVAVGDHVDLNQTIAEVETAKAVVALPCPYAGTVAALLADPGETVPVGAPLIRVRADGAGSAVGSGGDAARGAENGSGAGSGGGAPGGGGAATADGADIGNGGGSTVPAENAGAGGGAGADASASASFDAGADADADAGGGGGGGAGAGAGADSDAGAASGNGRRSVLVGYGPEAEQQTRRRRTTAPVPVARPAAVAARPAATPAARKLARELGVDLWQVDGSGPNGAVTVDDVRAAATPTGAAVAEPGPAREERTPVTGVRKRTAAAMVTSATTIPQASTFVTVDCTATMELIDHLRTTPAFAGLSLTPLVVVAKAVLAALAEFPGVNAQWDEERQQIVTKRYVHLGIAAATDRGLLVPSVKEAHRLSLRELCAEIGRTIEAARAGTATPADLTGGTFTITNVGVFGVDSGVPLVNPGEAAILCLGAIGRRPWVVADELAVRWVTTLGLSFDHRLIDGELAARFLATVAGLLTDPLTLLSRL

SEQ ID NO: 59898 - protein, 262 aa, Bordetella parapertussis 12822
MAGRTDCAPAAGRLAGRVALITGAAGGIGSAAALRFAAEGAALALLDRRPDAIEQLAGRICGQGGQAIGVAADVTDDDSVRQAVRRAVEHFGRIDTLFNCAGGSVAGDTAVDKVDLALWNRTLRLDLDSTMLCCRHAVPAIVRAGGGAVVNMSSGAGLRGSFGGHAYTAAKGAVIALTRALAAEYAPHGVRVNAICAGRIRTERILRNLDAGAPAQAGAAQRYPCREGDPIDIAHIALFLASHESRMITGEAIAANGGYSAF

SEQ ID NO: 59899 - protein, 509 aa, Mesorhizobium loti MAFF303099
MAREQTKAATFPVDRNDVELVRGAHPPRWKNPTPDGPYNLVVIGAGPAGLTAARDAASLGAKVALIERGLIGGACVNVGGVPSKSIIRTARLYADMRDAENFGGDTPARLPVDFERAMMRMRQIRQRLSRADSAAAITAEGIDLYFGEARFGGPDTVEVAGKTLHFKKALVATGAHPSGPAIPGLAEAGYLDNESMFNLTRRPERLLVIGGGPLGCETAQAFCLLGAKVILAQSDPMFLPGEERDAAQILSDTLAREGVEVRLNTEVVAVRKEGGRKLADLLRDGDTTTISVDEIITGVGRSPNVRGLGLEEAGVVYDANGIKVDDHLRTTNPHIYAAGDVCLEYKFTHTAEAAARIVVRNALFRGRERLSDLVVPWCTYTDPEIAHVGLYPIEARQNGIPVKTYTVLMHDVARAVMDGEEEGFVKIHVREGSDRILGATVVASHAGEMINAVTLAIRSGMGLHALADVIHAFPTQAQGIKMAGDAYRRTRFTSLRRRLAARWLAWSRR

SEQ ID NO: 59900 - protein, 299 aa, Cryptococcus neoformans var. neoformans B-3501A
MTSTAIPPAAVAANNNTLNSALAAEQISSPASPVDKPVDEKKQLEEGEIEENPSEGDSQTKTIFDDASKFNVKHPLFSTWTLYFDSPQSKSLPKTPQTTPAMPQGSHGWMADIRKVVSFDSVEEFWGLYNNIIPPSQLPGKANYYLFKNGIIPAWEDPQNKNGGKWSIQVPKNSESKSSIDRMWLYTMLAAIGETFETASTDSENAPSPTQSDLITGVIVSPRPAFYRISIWTREASDVNVPDTDAIKARLLNIGKHFKTSVLGYELEQKLTEGGFQTELTFDAHKDSEKKVNKNKFTV

SEQ ID NO: 59901 - protein, 356 aa, Glycine max
MIIWVFLDYGVYYLLSIMGTNLSTPKTEKSSDDGENEHLRYGLSSMQGWRATMEDAYAAHLDLDASTSFFGVYDGHGGKVVAKFCAKYLHQQVLKNEAYIAGDIGTSLKESFFRMDDMMRGQRGWRELAVLGDKIDKFNGKIEGLIWSPRSRHSKEQDDTWAFEEGPHSNFAGPTSGSTACVAIIRNNKLFVANAGDSRCVVCRKGQAYDLSIDHKPDLEIEKERIVKAGGFIHAGRVNGSLSLARAIGDMEFKQNRFLSAEKQMVTANPDINTVELCDEDEFIVLACDGIWDCLSSQQLVDFVRQQLLLETKLSAVCERVLDQCLAPTITVGDGCDNMTMILVQFKKLAQSSAPA

SEQ ID NO: 59902 - protein, 325 aa, Lactobacillus plantarum WCFS1
MQALVVPDPSAQTMEQLQWQERPMPNLGPTEVLIKTQAVGLNPVDFKLVAAGNAAWQYPHTLGLDTAGIVEAVGAEVTNFRPGERVCGHANLANNGTFAEYVSLPAAVLAKIPTTVSFEAAAASLCAGLTAYQALLRKANLNAAQTVLIHAGAGGVGSMAIQLAKAAGKTVFTTVSKAKQAFVAPLHPDAQIDYHHEDVTTRIQDLTQQHGVDLIINTIGHADADLPRLAYNGQLVCVLATPDHFPSNQVVTISKLDLGGAHRSGNPAQVADLGQMTAALLALVQAGKVDPLITQVLHRDQLVTGLQQLQAGQVVGKLVVTFDAC

SEQ ID NO: 59903 - protein, 77 aa, Leptospira interrogans serovar Lai str. 56601
MADFEKVKSIIVEQLGVDESEVTPEAHFIDDLGADSLDTVELVMALEEEFGIEISDEDAEKIQTVGDVTKFIDNLKS

SEQ ID NO: 59904 - protein, 406 aa, Methanothermobacter thermautotrophicus str. Delta H
MDGESVIRCISCGREYDLEEIIYTCRECGSVLEVECDVEVSRDVFRGRRQNMWRYREFMPVDPSRIVSLDEGGTPFVRCDTIGSELGIELYVKVEGSNPTGSFKDRGMSVGITKALELGVDTVGCASTGNTSASLAAYAARAGLGCVVLLPSGKVALGKLAQAMFHGARVLSVRGNFDEALEAVTELALMGELYLLNSVNPFRLEGQKSIGFEIVDDLGWESPDRIILPVGNAGNISAIWKGISEFYRAGFIDERPMMTGIQAEGASPVVEAFRKGRTEIEPVRDPETVATAIRIGAPVSYLKALRAIYESDGYAESVTDEEILSAQKLLARREGIGVEPASAASIAGLIKLVDEGVVDRGERVVCVVTGHVLKDPDTAIKASTEPVEVEPDINQLRSIIRGTGSS

SEQ ID NO: 59905 - protein, 130 aa, Methanothermobacter thermautotrophicus str. Delta H
MKKEVNSMAKAIYVKFDVPKELADKAAEALEIARETGKVSKGTNEVTKAVERGVAQLVLIAEDVEPAEIVAHLPLLAEEKEIPYIYIPTKDELGAAAGLNVGTASSAIVEAGDAEDLIKEIIEKVEELKK

SEQ ID NO: 59906 - protein, 125 aa, Brassica napus
MASPSVFAGIAQGPEDPILGVTVAYNKDPSPVKVNLGVGAYRTEEGKPLVLNVVRRAEQMLIQNESRVKEYLPITGLADFNKLSAKLIFGADSPAIQENRVATVQCLSGTGSLRVGGEFLARHYH

SEQ ID NO: 59907 - protein, 454 aa, Lactobacillus plantarum WCFS1
MQRKLSTGQMQMIALGGTIGVGLFMGSSSTIKWTGPSVLIAYIVSGAFLYLIMRALGEMLYVDPNTGSFAKFASEYIHPVFGYLTAWSNIFQFVVVGMSEMIALGGYCRYWWPNLPDWIPGLIAIVFLCAANLISVKMFGTLETWFSLIKVVTIILMIIAGLGLIIFGIGNGGHPIGISNLWTHGGFFTGGVKGFVFALAIVLASYQGIELIGVTAGEAENPQSTIVKAIRSTVARILIFYVGAIFVIVSIYPWDKLSQIGSPFVQTFAKIGITAAASIINFVVITASLSGTNSGIYSASRMTYTLAESHQLPRKMTLLNRHGVPFYSVIAIATGILIGVVLNVVLPMFFKDASEIFVMVYSSSVLPGMVPWFVILVSQIAFRKQNAAKMANHPFKMPLSPYSNYLTLAFLALTLVFMFINPETRYSILVGVVFLVIMTLIYFRKYAGNKEETL

SEQ ID NO: 59908 - protein, 151 aa, Methanothermobacter thermautotrophicus str. Delta H
MMEKSFVMLKPDAVKRRLAGRIIARFEDRGLKIVAFKMLQIPEDLAMEHYQEHREKPFFRDLVDYITSAPVIAMVIEGKDCISLIRKMVGATNPAEADLGTIRGDFALETGRNIIHASDSPESAEREIKLFFDESEICSYEMPDREMIYEE

SEQ ID NO: 59909 - protein, 126 aa, Methanothermobacter thermautotrophicus str. Delta H
MAFKVVISDKEKSVQMEVDPSESRGLIGLTIGDEFDGSIIGLSGYKLKITGGSDKNGFPMKKTVPGARRIRSLVSGGVGYKPRRDGERRRKTFRGNTISDDIVQINTVVIEKGEKPLEELLGADEE

SEQ ID NO: 59910 - protein, 375 aa, Bacillus cereus ATCC 10987
MLFYFELVVILLCTKLAGDISVRLGQPSVLGKLIIGIIIGPAVLGIINSSELIDELSEIGVLLLMFMAGLETDLEELNRNLKSSFAVAAGGIIFPFIGGYVTGLLFGLIQSHAIFLGLLLCATSVSITVQTLRDLGKMNTRESTTILGAAVFDDVIVVILLAFVMSFLGTQDVNITLVIVKKIIFFVSIVFIAWKVVPWIMKMLVPLRVTEALISAALIICFSFSYYSEMMGIAGIIGAFAAGIAISQTEYKHEVEHKIEPIAYAIFVPVFFVSIGMEITFQGIGSQLWFIIIMTLIAIFTKLIGSGLGARLTGFNLQSSISIGAGMVSRGEVALIIAANGLTANLLAKENFTAIVIVVILTTIITPPLLKKYFV

SEQ ID NO: 59911 - protein, 118 aa, Hordeum vulgare subsp. vulgare
MAAEEGAVIACHTKQEFDTHMANGKDTGKLVIIDFTASWCGPCRVIAPVFAEYAKKFPGAIFLKVDVDELKDVAEAYNVEAMPTFLFIKDGEKVDSVVGGRKDDIHTKIVALMGSAST

SEQ ID NO: 59912 - protein, 192 aa, Glycine max
MGYWKSKVLPKIKKVFEKNSTKKAAAAEATKSFDESKEEYNKAFEEKKTELQTKVVEIYEASSTEIKSLVKEPKEAGLKKNSTEVQKFLEELVKIDFPGSKAASEASSKFGPALASGSVFFVFEKVSTFIVTEEKDVEAPPGVETKTEEETSSVVKEREIVVEEEKKKEKKEEEKPQVIETSDEKKVEEKTS

SEQ ID NO: 59913 - protein, 414 aa, Populus trichocarpa
MVAQAAAITTSSSHLLFSTSRSLSRPSPSQLCVFDSKTLVSYPNSTSTYKKKRGGDGLKCMAVSTASDAKTKKSTFEIQTLTGWLLKQEQAGVIDAELTIVISSISMACKQIASLVQRASISNLTGVQGSVNVQGEDQKKLDVVSNEVFSSCLRSSGRTGIIASEEEDVPVAVEESYSGNYIVVFDPLDGSSNIDAAVSTGSIFGIYSPNDECLADIGDDSTLDQTEQRCIVNVCQPGNNLLVAGYCMYSSSVIFVLTIGKGVFSFSLDPMYGEFVLTQENIQIPKAGKIYSFNEGNYQLWDDKLKKYIDDLKDPGPSGKPYSARYIGSLVGDFHRTLLYGGIYGYPRDKKSKNGKLRLLYECAPMSFIVEQAGGKGSDGHQRVLDITPTEIHQRVPLYIGSVEEVEKLEKYLA

SEQ ID NO: 59914 - protein, 122 aa, Hordeum vulgare subsp. vulgare
MAASATAAAVAAEVISVHSLEQWTMQIEEANTAKKLVVIDFTASWCGPCRIMAPVFADLAKKFPNAVFLKVDVDELKPIAEQFSVEAMPTFLFMKEGDVKDRVVGAIKEELTAKVGLHAAAQ

SEQ ID NO: 59915 - protein, 267 aa, Antirrhinum majus
YFWEAKGQTPLFPRIFGHEAGGIVETVGEGVTELQPGDHVLPIFTGECKECRHCKSSESNMCDLLRINTDRGVMIGDGKTRFFKNGQPIYHFLGTSTFSEYTVLHVGCVAKINPEAPLGKVCVLSCGISTGLGATLNVAKPTKGSTVAIFGLGAVGLAAAEGARMAGASRIIGIDLNPSRFNEAKKFGITECVNPKDHNKPIQEVLAEMTDGGVDRSVECTGNVNAMISAFECVHDGWGVAVLVGVPNKDDAFKTHPVNLLNGRTLK

SEQ ID NO: 59916 - protein, 236 aa, Sophora flavescens
YFWEAKGQTPLFPRIFGHEAGGIVESVGEGVTHLQPGDHALPVFTGECGECLHCKSEESNMCDLLRINTDRGVMINGGQSRFSIKGQPIYHFVGTSTFSEYTVVHAGCVAKINPAAPLDKVCILSCGICTGLGATINVAKPKPGSSVAIFGLGAVGLAAAEGPRISGATRIIGVDLVSSRFELAKKFGVNEFVNPKDHNKPVQEVIAEMTNGGVDRAVECTGSIQAMISAFECVHD

SEQ ID NO: 59917 - protein, 170 aa, Oryza sativa
  misc_feature (13)..(13): Xaa can be any naturally occurring amino acid
  misc_feature (42)..(42): Xaa can be any naturally occurring amino acid
  misc_feature (46)..(46): Xaa can be any naturally occurring amino acid
  misc_feature (59)..(59): Xaa can be any naturally occurring amino acid
  misc_feature (64)..(64): Xaa can be any naturally occurring amino acid
  misc_feature (67)..(67): Xaa can be any naturally occurring amino acid
  misc_feature (79)..(79): Xaa can be any naturally occurring amino acid
  misc_feature (82)..(82): Xaa can be any naturally occurring amino acid
  misc_feature (86)..(86): Xaa can be any naturally occurring amino acid
  misc_feature (88)..(88): Xaa can be any naturally occurring amino acid
  misc_feature (99)..(99): Xaa can be any naturally occurring amino acid
  misc_feature (106)..(106): Xaa can be any naturally occurring amino acid
  misc_feature (123)..(123): Xaa can be any naturally occurring amino acid
  misc_feature (126)..(126): Xaa can be any naturally occurring amino acid
  misc_feature (129)..(129): Xaa can be any naturally occurring amino acid
  misc_feature (134)..(135): Xaa can be any naturally occurring amino acid
  misc_feature (143)..(143): Xaa can be any naturally occurring amino acid
  misc_feature (145)..(145): Xaa can be any naturally occurring amino acid
  misc_feature (147)..(147): Xaa can be any naturally occurring amino acid
  misc_feature (155)..(155): Xaa can be any naturally occurring amino acid
  misc_feature (161)..(161): Xaa can be any naturally occurring amino acid
  misc_feature (163)..(163): Xaa can be any naturally occurring amino acid
GLHSKGLKSTAGXPVSRRSTNSGFGNVSNGGRIKCMQVWPIXGIKXFETLSYLPPLTVXDLLKXIEXYLLRSKWVPCLXFSXVGIXLXRKNHRSPGLLXAGYWTMXWKLPMFGCTDSTQVLKXLEXEAXKAYPXXFVRIIGFXNXRXVQLINFIXAYKPPXLXKNLGGNT

SEQ ID NO: 59918 - protein, 128 aa, Zea mays
MNPSSCLSFACEDLAMAAADELVCGEEPVARRRPKTTIACTLGPASRSAEMISRLLRAGMCVECFNFSYGSHEYHQEMLDKLHAAMQLTGILCDAMLDIKGPETTTGFLKDGKAIQSIVGQEITISTD

SEQ ID NO: 59919 - protein, 202 aa, Triticum aestivum
  misc_feature (91)..(91): Xaa can be any naturally occurring amino acid
MGVLPWSCRCGLNPTPSKNRGAPARPPPPPPAARVRRSKYTGQSVRAMPMRVLTVGKKRSQGTQLLVEEYKEKLGHYCDVEDTLIKSNPKXTRDVKVQIEPEDASMMQQLKAEDFVVVLDENGKDVMSEQIADLIGDAGNTGSSRLTFCIGGPYGLGIQVRERADATIRLSSLVLNHQVALILLMEQLYRARTIIKGQKYHH

SEQ ID NO: 59920 - protein, 151 aa, Physcomitrella patens subsp. patens
MQLERTFIAIKPDGVQRGLISEIIGRFERKGYKLVAIKLIVPTKEFAAQHYDDLSSRPFFNGLCDFLSSGPVVAMVWEGQGVIKYGRKLIGATSPQASEPGTIRGDLCVQVSRNIIHGSDGPETAVNEIGLWFKPEELVSYTKNDEKWLYE

SEQ ID NO: 59921 - protein, 489 aa, Pseudomonas syringae pv. phaseolicola 1448A
MPLITVEPCTFALFGALGDLAVRKLFPALYQLDRAGLLHEDTKILALAREPGDEQSHLAYIEKSMRRFIPEAELEPDNLGRFLARLSYLHVDFLKAEDYVALAERVGTAETLIAYFATPASVYGAICENLASVNLAERTRAVLEKPIGHDLASSRRVNDAVAQFFPENRVYRIDHYLGKDTVQNLIALRFANSLFETQWNQNHISHVEITVAEKVGIEGRWGYFDQAGQLRDMIQNHLLQLLCLIAMDPPSDLSADSIRDEKVKVLKALAPFTPERLATQVVRGQYTAGYSEGKAVPGYLEEENSNTQSDTETFVALRADIRNWRWSGTPFYLRTGKRMPQKMSQIVIHFKEPPHYIFAPEQRLQISNRLIIRLQPDEGISLQVMTKDQGLDKGMQLRSGPLQLNFSDTYRSARVPDAYERLLLEVMRGNQNLFVRKDEIEYAWQWCDQLIAGWKKAGDAPKPYPAGTWGPMSSIALITRDGRSWYGDM

SEQ ID NO: 59922 - protein, 284 aa, Pyrobaculum aerophilum str. IM2
MIIAFQNALDLAAELEGIGPVAQIEERVFPDGEVLVRLPEARGEVAVVARLYPAVNDNLIKLFLTIDALNDAGASKIILVIPYMPYARQDRRFRPGEPISSKTVLKLLAHLNVFGIITVDLHKGYVAEYAPRLVIKNLYPAEEFAKALGGVDVVLSPDFGSVHRAEAVARLLQVPYTYFEKYRDRSTGAITLIPRQDVDLRNKRVAIVDDILSTGGTLVDACKAAKTLGAAEVYAAITHCQLLKDARERVRSCVDKIICTDTVLNEFAEVRIGRLIRRELEALL

SEQ ID NO: 59923 - protein, 1530 aa, Schizosaccharomyces pombe
MNQNSDTTHGQALGSTLNHTTEVTRISNSSDHFEDSSSNVDESLDSSNPSSNEKASHTNEEYRSKGNQSYVPSSSNEPSPESSSNSDSSSSDDSSVDRLAGDPFELGENFNLKHYLRAYKDSLQRDDIITRSSGVCMRDHSVYGVGSGYEFLKTFPDIFLQPYRAITEKQVVEKAILSHCHALANAGELVMVLGQPGSGCSTFLRSVTSDTVHYKRVEGTTHYDGIDKADMKKFFPGDLLYSGEHDVHFPSLTTAETLDFAAKCRTPNNRPCNLTRQEYVSRERHLIATAFGLTHTFNTKVGNDFVRGVSGGERKRVTISEGFATRPTIACWDNSTRGLDSSTAFEFVNVLRTCANELKMTSFVTAYQASEKIYKLFDRICVLYAGRQIYYGPADKAKQYFLDMGFDCHPRETTPDFLTAISDPKARFPRKGFENRVPRTPDEFEQMWRNSSVYADLMAEMESYDKRWTETTPASSEDPEKDNFGSDISATTKHELYRQSAVAEKSKRVKDTSPYTVTFSQQLWYCLARSWERYINDPAYIGSMAFAFLFQSLIIGSIFYDMKLNTVDVFSRGGVLFFSILFCALQSLSEIANMFSQRPIIAKHRASALYHPAADVISSLIVDLPFRFINISVFSIVLYFLTNLKRTAGGFWTYFLFLFIGATCMSAFFRSLAGIMPNVESASALGGIGVLAIAIYTGYAIPNIDVGWWFRWIAYLDPLQFGFESLMINEFKARQFECSQLIPYGSGYDNYPVANKICPVTSAEPGTDYVDGSTYLYISFNYKTRQLWRNLAIIIGYYAFLVFVNIVASETLNFNDLKGEYLVFRRGHAADAVKAAVNEGGKPLDLETGQDTQGGDVVKESPDNEEELNKEYEGIEKGHDIFSWRNLNYDIQIKGEHRRLLNGVQGFVVPGKLTALMGESGAGKTTLLNVLAQRVDTGVVTGDMLVNGRGLDSTFQRRTGYVQQQDVHIGESTVREALRFSAALRQPASVPLSEKYGYVESVIKLLEMESYAEAIIGTPGSGLNVEQRKRATIGVELAAKPALLLFLDEPTSGLDSQSACSIVCFLRKLADAGQEILCPIHQPSAVLFDQFDRLLLLQKGGKTVYFGDIGEHSKTLLNYFESHGAVHCPDDGNPAEYILDVIGAGATATTNRDWHEVWNNSEERKAISAELDKINASFSNSEDKKTLSKEDRSTYAMPLWFQVKMVMTRNFQSYWREPSILMSKLALDIFAGLFIGFTFYNQGLGVQNIQNKLFAVFMATVLAVPLINGLQPKFIELRNVFEVREKPSNIYSWVAFVFSAIIVEIPFNLVFGTLFFLCWFYPIKFYKHIHHPGDKTGYAWLLYMFFQMYFSTFGQAVASACPNAQTASVVNSLLFTFVITFNGVLQPNSNLVGFWHWMHSLTPFTYLIEGLLSDLVHGLPVECKSHEMLTINPPSGQTCGEYMSAFLTNNTAAGNLLNPNATTSCSYCPYQTADQFLERFSMRYTHRWRNLGIFVGYVFFNIFAVLLLFYVFRVMKLRSTWLGKKITGTG

SEQ ID NO: 59924 - protein, 226 aa, Campylobacter lari RM2100
MIFAANLKCNHTRSSFELYAQKLNQNLSNEDEIFIFPPSIAFSSLKVNFHQGAQNFYPCENGAYTGEIGKIHLEEFNIKSVLIGHSERRALNEDESFLKAKFDFAKNLDFNIIYCIGESLETKNANKSLDFLKKQIENIDLSYKKLIIAYEPIYSIGTGVSANLDDINTILNFLRKFTNAKLLYGGSVNQSNIKEICALKNCDGVLIGSAALNASDFLNMIQIAKG

SEQ ID NO: 59925 - protein, 415 aa, Wolbachia endosymbiont of Drosophila simulans
MNVESKKIHDAKIKLPIFLDYQSTTKVDPRVLEVMIPYFGEFSNAHSRSHSFGWTAEEAVEKARKHIADLVNADSKEIIFTSGATESNNTAIKGVAHFYKNKGNHIITVCTEHKCVLDSCRHLENEGFKVTYLPVKQNGIIDLSKLEEAITDQTILVSVMMVNNEIGVIQPVKEIGVICRKHNIFFHTDAAQSFGKVPIDVNEMCIDLMSLSSHKIYGPMGIGALYVRRKNPRVRLIPLISGGGQERGMRSGTVPTPLAVGFGEAARIAREEMKKETTRVEELRDILYNKIKEAFPDIVLNGDYENRIPGNLNLSFPYIEGESLIMAIKDLAVSSGSACTSASLEPSYVVRSLNNGHDLEHSSIRFGLGRFTTKEEVLYAADLVAKNVGRLREMSPLWEMVQEGVDLNTVKWDSH

SEQ ID NO: 59926 - protein, 226 aa, Brucella suis 1330
MSDVVANLNAVKAVIARAEKEARRENGSVTLVAVSKTFDAQAIRPALDAGQRVFGENRVQEAQGKWPALREAWASIELHLIGPLQSNKVADAVALFDVIETVDREKIAAALASEIRKQGKSPKLYVQVNTGLEPQKAGIPPQEAVAFVERCRKEHGLVIEGLMCIPPAGENPGPHFALLEKLAREAHVEKLSMGMSGDYETAIGFGATSVRVGAAIFGGRAYSASV

SEQ ID NO: 59927 - protein, 176 aa, Methanothermobacter thermautotrophicus str. Delta H
MNLWKDIEPGPSVPEVVYAVVEIPKGSRNKYEYHKDLQAFALDRVLYSAVFYPAEYGIIPRTLYDDGDPMDILVLMDEPTFPGCIIESRPIGLLRMIDGGDQDDKILAVPVADPHFADVKDISDIPEHNLKEIANFFETYKKLEGKKTETLGWEGAEKAFEAVNHSIELYRKKYME

SEQ ID NO: 59928 - protein, 460 aa, Escherichia coli
LWPLSRVLYPKQFLCLKGDLTMLQTTICRLNGVECESPVVICNEQHRFIVAEQLRQLNKLTENIILEPAGRNTAPAIALAALAAKRHSPESDPLMLVLAADHVIADEDAFRTAVRNAMPYAEAGKLVTFGIVPDLPETGYGYIRRGEVSAGEQDTVAFEVAQFVEKPNLETAQAYVASGEYYWNSGMFLFRAGRYLEELKKYRPDILDACEKAMSAVDPDLDFIRVDEEAFLACPEESVDYAVMERTADAVVVPMDAGWSDVGSWSSLWEISAHTAEGNVCHGDVINHKTENSYVYAESGLVTTVGVKDLVVVQTKDAVLIADRNAVQDVKKVVEQIKADGRHEHRVHREVYRPWGKYDSIDAGDRYQVKRITVKPGEGLSVQMHHHRAEHWVVVAGTAKVTIDGDIKLLGENESIYIPLGATHCLENPGKIPLDLIEVRSGSYLEEDDVVRFADRYGRV

SEQ ID NO: 59929 - protein, 250 aa, Leptospira interrogans serovar Lai str. 56601
MGMSFRDHFSSHSSFYSEFRPGYPKDLFYYLKNLSPHGKTVWDCGTGTGQAAVPLGELFEKVIASDPSENQIVNAEPHQNVEYRVCKAENSTLGNHEVDLITVAQAFHWFDFNPFYKEVIRVGKKKGILAIWGYGLHSISSEIDGLVDKLYGEIVGPYWPSERKYVEEKYKTIPFPFEEIVPPHFSMKEEWNVDQLLGYLRTWSSVQKYIQKNESDPVLLVEEYIRNSWGPTQTKIVEWPLFFKIGRLPD

SEQ ID NO: 59930 - protein, 399 aa, Arabidopsis thaliana
MASATFSVAKPSLQGFSEFSGLRNSSALPFAKRSSSDEFVSFVSFQTSAMRSNGGYRKGVTEAKIKVAINGFGRIGRNFLRCWHGRKDSPLDVVVINDTGGVKQASHLLKYDSTLGIFDADVKPSGDSALSVDGKIIKIVSDRNPSNLPWGELGIDLVIEGTGVFVDRDGAGKHLQAGAKKVLITAPGKGDIPTYVVGVNAELYSHEDTIISNASCTTNCLAPFVKVLDQKFGIIKGTMTTTHSYTGDQRLLDASHRDLRRARAAALNIVPTSTGAAKAVALVLPNLKGKLNGIALRVPTPNVSVVDLVVQVSKKTFAEEVNAAFRDAAEKELKGILDVCDEPLVSVDFRCSDVSSTIDSSLTMVMGDDMVKVIAWYDNEWGYSQRVVDLADIVANNWK

SEQ ID NO: 59931 - protein, 403 aa, Triticum aestivum
  misc_feature (281)..(281): Xaa can be any naturally occurring amino acid
  misc_feature (357)..(357): Xaa can be any naturally occurring amino acid
  misc_feature (381)..(381): Xaa can be any naturally occurring amino acid
KAGGHGPDARDIVDPRVRPYTFTIFNFGAQKTVHSWQLFLCVAVGLWAGLVIGFITEYYTSNAYSPVQDVADSCRTGAATNVIFGLALGYKSVIIPIFAIAFSIFLSFSLAAMYGVAVAALGMLSTIATGLAIDAYGPISDNAGGIAEMAGMSHRIRERTDALDAAGNTTAAIGKGFAIGSAALVSLALFGAFVSRAGITTVDVLTPNVFIGLLVGAMLPYWFSAMTMKSVGSAALKMVEEVRRQFNTIPGLMEGTAKPDYATCVKISTDASIKEMIPPGXALVMLTPLIVGTFFGVETLSGVLAGALVSGVQIAISASNTGGAWDNAKKYIEAGASEHAKSLGPKGSDCHKAAVIXGDTIGDPLKDTSGPSLNILIKLMXAVESLVFAPFFATYGGILFKYL

SEQ ID NO: 59932 - protein, 292 aa, Alteromonadales bacterium TW-7
MKAVIPVAGLGTRMLPATKAIPKEMLPVVDRPLIQYVVNEAVAAGIKEIVLVTHSSKNSIENHFDTSFELEATLEKRVKRQLLAEVQAICPKDVTIIHVRQGEAKGLGHAINCAAPIIGNEPFVVILPDVIIDDVESDLKKDNLAEMIAHFEQTKHSQIMVEPVPMQEVDKFGVVDLGGTEIAQGESSPIVSMVEKPPVDEAPSNLAVVGRYVLSENIWPLLAKTPQGAGDEIQLTDAIAMLMQSEKVDAYAMKGRSHDCGSKIGYLKATIEFALRRDEFADELKTFIKTLV

SEQ ID NO: 59933 - protein, 500 aa, Erwinia carotovora subsp. atroseptica SCRI1043
METKDLIVIGGGINGAGIAADAAGRGLSVLLLEAQDLACATSSASSKLIHGGLRYLEHYEFRLVSEALSERETLLKMAPHIIFPMRFRLPHQPHLRPAWMIRIGLFMYDNIGKRVSLPASKGLKFGADSVLKPELKQGFEYSDCWVDDARLVVLNAQEVAKRGGEVRTRTKVTRARREQGVWIVDAVDSLTGETFTWRAKGLVNATGPWVKEFFDDGLQLKSPYGIRLIKGSHIVVPRVHNQPQAYILQNKDHRIVFVIPWQDDYSIIGTTDVEYKGNPHDVKIDDNEVGYLLDVYNDHFKQQLTRDDIVWTYSGVRPLCDDESDSPQAITRDYTLSVDDDNGQAPLLSVFGGKLTTYRKLAEHALDKLHKYYPQAGKAWTKDAVLPGGDIAGTRDDYAAALRRRFNLPESLTRRYSRTYGSNSELILANVKGLSDLGEDFGHDLYEAELRYLVEKEWAVTLDDVIWRRTKLGMRFDDAQKQRISDWLVSYRQQQMAKAG

SEQ ID NO: 59934 - protein, 218 aa, Triticum aestivum
  misc_feature (78)..(78): Xaa can be any naturally occurring amino acid
  misc_feature (101)..(101): Xaa can be any naturally occurring amino acid
  misc_feature (122)..(122): Xaa can be any naturally occurring amino acid
  misc_feature (158)..(158): Xaa can be any naturally occurring amino acid
  misc_feature (184)..(184): Xaa can be any naturally occurring amino acid
NYVANIVPMQLASAMVSITAAQKLIVPADAGLKTSSITSWECKLAVDIASGGRAVVLNRETLTLVKEAALAAYLVSIXAHHMCSAGFSCGFPSQVAYMVRXGSACVQVAGPDGKRALETPTXAGILFIVPRSRVVSKIAETSGTEWFSIIRSSNPMLXAFVGRPRLWQTISPELSAASFSCTTXMETLFRSKRLYSETFLHPLVGPLPRASAGYLWQE

SEQ ID NO: 59935 - protein, 218 aa, Bacillus sp. SG-1
MKGVIPSMNHKPIVIGVAGGSGSGKTSVTRSIYESFQEHSILMIEQDYYYKDQSHLPFEERLKTNYDHPLAFDNDLLIAHLMKLLKSEGIEKPVYDYKMHTRSQETILVEPKDVIILEGILVLEDERLRNLMDIKLYVDTDADLRIIRRMLRDIKERGRSIDSVIDQYINVVRPMHNQFIEPTKRYADIIIPEGGHNHVAIDLMVTKIQTILEQKSFL

SEQ ID NO: 59936 - protein, 236 aa, Sophora flavescens
TSGKLRGKLLYFPRIFGHEAAGIVESVGEGVSNVQVGDHVLPVFTGECGECAHCKSEESNMCALLRIDTIRGVMHSDGKCRFSINGTPINHFVGTSTFSEYTVVHSGCLAKINPQAPMDKVCILSCGISTGLGAALNVAKPKKGSTVAIFGLGAVGLAAAEGARIAGASRIIGVNLNPKRFELAKNFGVTEFVNPKDHDRPVQEVIADMTNGGVDRSIECTGNINFMISAFECVHD

SEQ ID NO: 59937 - protein, 298 aa, Bacteroides fragilis YCH46
MHKLTTANGHDVPMVGLGTYPLQGEAMASMALDAFKCGYRLIDTADDYRGETGLGLALSRLNNETGFRREDVFIQTKISQDNAYGDEPLEGVWFNKLSKYQNRHTVEEVVMDKVTISLRELQTDYIDSLLIHYPFPGYYEDIWDVMMRLKKEGKVRYIGVSNFHINHLEKLKSIGECPSINQIYVSPLSIKHEDLEYSINNAIQLMTYSPLMDLVHGQLNDNILMPLAEKYRKTKHQVILRWNIDRGCMPLPRTTNPNRLLGNFELFDFKLTEEEIEAISAMNRDLQFLVESKQCPGL

SEQ ID NO: 59938 - protein, 236 aa, Wisteria floribunda
TSGKLRGILLCFPGIFGHEASGIVESVGEGVTDLQVGDHVLPVFTGECGECAHCKSEESNMCDLLRIDTDRGVMHSDGKSRFSINGTPINHFVGTSTFSEYTVVHSGCLTKINPQAPLDKVCILSCGISTGLGATLNVAKPKKGSTVAIFGLGAVGLAAAEGARIAGASRIIGVDLNPNRFEEAKKFGVTEFVNPKDYDKPVQEVIAGMTNGGVDRSIECTGNINAMISAFECVHD

SEQ ID NO: 59939 - protein, 235 aa, Wisteria floribunda
PRIFGHEASGIVESVGEGVTSLKPGDHALPIFTGECGERAHCKSNESNLCDLLRINTERGVMLADGKTRFSKDGKPIYHLVGTSTFSEYTVLHVGCVAKINPAAPLDKVCVVSCGFCTGHGATVNVAKPKPNSTFAVFGLGAVGLAAAEGARLSGASRIIGVDLVPGRFEQAKKFGVTDFVNPKDHNKPVQEVIIEMTDGGVDRAVECTGHIEASIQAFECVHDGWGVAVLVGVP

SEQ ID NO: 59940 - protein, 425 aa, Erwinia carotovora subsp. atroseptica SCRI1043
MVNNDKHDPLMLARQLPLKSVALILAGGRGTRLKGLTALRAKPAVHFGGKFRIIDFALSNCLNSGIRRIGVITQYQSHTLVQHIQRGWSFLNAEMNEFVDLLPAQQRYSTDHWYRGTADAVCQNLDIIRRYRAEYMVILAGDHIYKMDYSRMLIDHVEKGAECTVACLPVPLEEASAFGVMSVDKQHRILDFAEKPDNPTPMPDNPDMALASMGIYVFNADYLYQLLETDRNASDSAHDFGQDLIPKIVSQRLAWAHPFTLSCVTSGEDEHQYWRDVGTLEAYWRANLDLASVTPELDVYDRHWPIRSAIESLPPAKFVQDRSGSHGMTMNSLVSGGCIVSGSVVTHSVLFPRVRVNSFCSIDSTVILPDVNVGRSCRLRRCVIDRACHLPEGMVIGENAEEDSRRFYRSEEGIVLVTRSMLEKL

SEQ ID NO: 59941 - protein, 235 aa, Triticum aestivum
  misc_feature (190)..(190): Xaa can be any naturally occurring amino acid
  misc_feature (195)..(195): Xaa can be any naturally occurring amino acid
MGKSSKKSAAPTVVAPAAVLTKGKAGKKREVDDEIEKAVSAKKQKAAPAKAVPGPKEAAKKAKKQPPPKKVESSSSEEESSESEEEEVPKKTAKPVKHESSDDSSDDFSSDEEPAKKPSAKPVTPAASNGSKKGKPESSSSSSEDESDDDEKPAALGKRTPVIESDSSESDSDDSSNEDVPAKSPAAAAXKVDSXDRSELESESEDEEKFKKAAQGHKIAPAAAKREEGSSDSSE

SEQ ID NO: 59942 - protein, 448 aa, Streptococcus pneumoniae R6
MTSAKEYIQSVFETVKARNGHEAEFLQAVEEFFNTLEPVFEKHPEYIEENILARITEPERVISFRVPWVDRDGKVQVNRGYRVQFNSAVGPYKGGLRFHPTVNQGILKFLGFEQIFKNVLTGLPIGGGKGGSDFDPKGKTDAEVMRFCQSFMTELQKHIGPSLDVPAGDIGVGGREIGYLYGQYKRLNQFDAGVLTGKPLGFGGSLIRPEATGYGLVYYTEEMLKANGNSFAGKKVVISGSGNVAQYALQKATELGATVISVSDSNGYVIDENGIDFDLLVDVKEKRRARLTEYAAEKATATYHEGSVWTYAGNYDIALPCATQNEINGEAAKRLVAQGVICVSEGANMPSNLDAIKVYKENGIFYGPAKAANAGGVAVSALEMSQNSLRLSWTREEVDGRLKDIMTNIFNTAKTTSETYGLDKDYLAGANIAAFENVANAMIAQGIV

SEQ ID NO: 59943 - protein, 488 aa, Candida albicans SC5314
MYKSIFKTTGRLGKTVSSRNFVTTLPKPLATSSSPATNAPNKTSNPKTGELHVSTPVDTAKISIEPPEGSSISLKSASRDASLFGTRPIYLDVQATTPVDPRVLDKMLEFYTGLYGNPHSSTHAYGWETDKEVEKARTYIADVINADPKEIIFTSGATETNNMAIKGVPRFYKKTKKHIITTQTEHKCVLDSARHMQDEGFEVTYLPVSSEGLINLDDLKKAIRKDTVLVSIMAVNNEIGVIQPLKEIGKICRENKVFFHTDAAQAYGKIPIDVNEMNIDLLSISSHKIYGPKGIGACYVRRRPRVRLDPIITGGGQERGLRSGTLAPPLVAGFGEAARLMKQESSFDKRHIEKLSSKLKNGLLSIPSTQFNGCNDAKSQYPGCVNVSFAYIEGESLLMALKDIALSSGSACTSASLEPSYVLHALGADDALAHSSIRFGIGRFTTEAEVDYVIQAINERVDFLRKMSPLWEMVQEGIDLNTIEWSGH

SEQ ID NO: 59944 - protein, 400 aa, Campylobacter lari RM2100
MSSILSIKDIDLAKKKVFIRCDFNVPQDEFLNITDDRRIRSAIPTIRYCLDNGCAVILASHLGRPKEIASKYSLEPVAKRLARLMAKDVIMAKDVIGEDAKKKASELKSSEILLLENLRFEKGETKNDENLAKELASMADVYINDAFGVCHRAHASVEAITKYFDNTHKGAGFLLQKEIEFASNLIKHPARPFVAVVGGSKVSGKLQALTNLLPKVDKLIIGGGMAFTFLKAQGYDIGNSLLEEDLIEEANKILLKGKNLGVKIYLPVDVTAAQTCSQEAVMKYTPVQEIPAGWMGLDIGPASVRLFKEALSDAQTIWWNGPMGVFEIDKFSKGSIKMSHYISESHATTVIGGGDTADVVARAGDADEMTFISTGGGASLELIEGKELPGVKPLTIKDSE

SEQ ID NO: 59945 - protein, 331 aa, Campylobacter lari RM2100
MAVKVAINGFGRIGRCVARIIMKRDDIELVAINDTTDIELTKYLFKYDTVHGVYDGSVENDGDDLIIDNKKIKVLKSRNVADLDFAKYGAQIVLECTGAHLTMEKCQGFLDHGVQKVIMSAPAKDKTPTYVLGVNAHEYKGENIISNASCTTNCLGPICRVLQDNFGIEKGLMTTIHAYTNGQSIIDAKARDKRRSRAAAQNIIPTSTGAAKAMKLVMPELDGKLHGQSMRVPVADVSSVDLTATLKKKVSKEEINEAFRKAAASNLKGILLVDDEERVSSDFITCPYGAIVASDLTQVICDDFVKVVAWYDNEWGYSSRLVDMAVFVAKA

SEQ ID NO: 59946 - protein, 474 aa, Corynebacterium efficiens
MERRTKIVCTLGPAVASADGILRLVQDGMDVARLNFSHGDHPDHEQNYKWVREATDKTGRAVGILADLQGPKIRLGRFKEGSTVWETGETVRITVDDVEGTHDRVSTTYKNLAKDARPGDRLLVDDGKVGLVCVSVEGNDVICEVTEGGPVSNNKGVSLPGMDISVPALSEKDIKDLRFALKLGVDFIALSFVRSPADVELVHAIMDEEGRRVPVIAKLEKPEAVAALESIVLAFDAIMVARGDLGVEVPLEEVPLVQKRAIQIARENAKPVIVATQMLDSMIENSRPTRAEASDVANAVLDGADAVMLSGETSVGKDPHNVVRTMSRIVRFAETDGRVPDLTHIPRTKRGVISYSARDIAERLNARALVAFTTSGDTAKRLARLHSHLPLLVFTPDPSVRSQLALTWGAQTFLCPKVDDTDGMMREVDRALLAMDEYQKDDMMVVVAGSPPGVTGNTNMIHVHLLGEDTRIPK

SEQ ID NO: 59947 - protein, 213 aa, Pyrobaculum aerophilum str. IM2
MGIEDAIAAFKAGRLVMIYDGDDREAEVDFVIRADAVTPTTIRWLRQNAGGLLCFVTTREVGEILGLEFLSSYYKRRGFLATAPYGDEPAFMGYVNHVKTKTGIRDVDKALTIRELAKVVQLAQRDPEEAREAFKANFYMPGHVPILGGRLGERWGHTELSLILAKAAGVPPAVVIVEVLGDHTEAMPVEEAREYSKTLGVPLVTGTEIKSLI

SEQ ID NO: 59948 - protein, 400 aa, Rhizobium leguminosarum bv. viciae 3841
MAFLADALSRVKPSATIAVSQKARELKAKGRDVIGLGAGEPDFDTPDNIKTAAIDAINRGETKYTPVSGIPELRKAIAAKFKRENGLDYSWEQTIVGTGGKQILFNAFMATLNPGDEVVIPAPYWVSYPEMVALCGGTPVFVSATQEHNFKLQAADLEKAITPKTKWFIFNSPSNPTGAAYTQDELKALTDVLMKHPQVWVLTDDMYEHLTYGDFKFVTPVEVEPKLYDRTLTMNGVSKAYAMTGWRIGYAAGPIQLIKAMDMIQGQQTSGATSIAQWAAVEALNGTQGFIPANKKIFEGRRDLVVSMLNQAKGIVCPVPEGAFYVYPSCAGLIGKTAPSGKVIETDEDFVSELLETEGVAVVHGSAFGLGPNFRISYATSEELLEEACRRIQRFCGACK

SEQ ID NO: 59949 - protein, 252 aa, Burkholderia xenovorans LB400
MRLTGKTAIVTGGGSGFGEGIAKTYAREGANVVVNDLNGPAAERVASEIALAGGKAIAVTGNVAQREDWQKLREAALEDFGSVQIVVNNAGTTHRNKPVMEVTEAEFDRVYAVNVKSIYWSVQEFVPYFREQGGGCFINIASTAGVRPRPGLVWYNGSKGAVIIASKSLAVELGPDRIRVNCVNPVIGETALLSEFMGVEDTPENRQRFLAGIPLGRFSTPQDIANAALYLASDEAEFITGVCLEVDGGRCV

SEQ ID NO: 59950 - protein, 1181 aa, Oryza sativa Indica Group
MGAAGDNAAKAPAAAAGSNGKGTAASMDVVSSSSSSSPAPAPSVLKSVLLSYAYVSVWITLSFSVIVYNKYILDPKMYNWPFPISLTMIHMAFCASLAVVLVRVLRVVAVPASPPMTPSLYAASVVPIGALYALSLWFSNSAYIYLSVSFIQMLKALMPVAVYSLAVAFRTDSFRRASMLNMLGISAGVAVAAYGETRFDAFGVMLQLAAVAAEATRLVLIQILLTSKGMSLNPITSLYYIAPCCLVFLTLPWYFVELPRLRAAAGAAVRPDVFVFGTNSLCAFALNLAVFLLVGKTSALTMNVAGVVKDWLLIAFSWTVIKDTVTPVNLVGYGIAFLGVAYYNHAKLQGLKAREAERRAASMATAKDGDAEAGARLLPEKDAAKSLYYPCNDQGMTNYMLPRNFELFKMPRRTDNAASANSVEPDKSEECLEFDDEEEEVEEEEIEYEEIEEEIEEEEEVEEDEDVVEEVEEVDEEEDEEEEEESDETEGVSKTKGVHQKDVTEKGKHAELLALPPHGSEVYVGGISSDVSSEDLKRLCEPVGEVVEVRMMRGKDDSRGYAFVNFRTKGLALKVVKELNNAKLKGKRIRVSSSQAKNKLFIGNVPHSWTDDDFRKAVEEVGPGVLKADLMKVSSANRNRGYGFVEYYNHACAEYARQEMSSPTFKLDSNAPTVSWADPKNNDSASTSQVKSVYVKNLPKNVTQAQLKRLFEHHGEIEKVVLPPSRGGHDNRYGFVHFKDRSMAMRALQNTERYELDGQVLDCSLAKPPAADKKDDRVPLPSSNGAPLLPSYPPLGYGIMSVPGAYGAAPASTAQPMLYAPRAPPGAAMVPMMLPDGHLVYVVQQPGGQLPLASPPPQQAGHRSGSGGRHGGSGSRYGGGGGSSGSSRPEEFVSETRLYMRIYQYFPISQIAESEEALYRQFTSVSHMEYEISGQESEVDSEVWLGWVAQRRVCSRLETRLPLPKLNTSCCLVTLSRGGRGGAGPPLQIPVDRESTKHRTHGDDTAIRRSWVLAEGESSDDDSCGGDKAKPKKGRKPLGNREAVRKYRQKKKAHTAHLEEEVKRLRAINQQLVKRLQGQAALEAEVVRLRSLLVDVRSRINGALGSYPFQAQCGVDNVLGCDGMAQCFAGKPELGERRSCTPSVVNCHISSDSGQNLVVPHALSPSDVIGSFMVSSTSKDE

SEQ ID NO: 59951 - protein, 205 aa, Picea sitchensis
MQGALRSIQLHGGIFKNSILQHLRVAEPSFRSKIIARHESVSPARLEESGFESTTIADILKGKGKSADGSWLWCTTDDTVYDAVKSMTQHNVGALLVVKPVEEKSIAGIITERDYLRKIIVQGRSSKTTKVGDIMTEENKLITVTSDTKVLKAMQLMTDNRIRHIPVVEGKSMLGMVSIGDVVRAVVDEHREELKRLNAFIQGGY

SEQ ID NO: 59952 - protein, 232 aa, Wolbachia endosymbiont of Drosophila simulans
MNGMRSSFVDFIGKLNNKSNEITSKLVICPPFTSFPSSIELNNNINIGAQNCHHKKFGSYTGEISAEMLKELGCTYVILGHSERANEKDSEIKLKSEIAIESGLHPIICVGENSEDYKNEKTKEVIEYQCKNRLPTHGEYTVAYEPIWAIGTGHVPNNDAIAKVIEVIKLCTSKKHIIYGGSVSSENIENLLNISNLSGVLIGSASLDFDHFYKIIQQVEKKFSLINSKISN

SEQ ID NO: 59953 - protein, 460 aa, Escherichia coli
LWPLSRVLYPKQFLCLKGDLTMLQTTICRLNGVECESPVVICNEQHRFIVAEQLRQLNKLTENIILEPAGRNTAPAIALAALAAKRHSPESDPLMLVLAADHVIADEDAFRAAVRNAMPYAEAGKLVTFGIVPDLPETGYGYIRRGEVSAGEQDTVAFEVAQFVEKPNLETAQAYVASGEYYWNSGMFLFRAGRYLEELKKYRPDILDACEKAMSAVDPDLDFIRVDEEAFLACPEESVDYAVMERTADAVVVPMDAGWSDVGSWSSLWEISAHTAEGNVCHGDVINHKTENSYVYAESGLVTTVGVKDLVVVQTKDAVLIADRNAVQDVKKVVEQIKADGRHEHRVHREVYRPWGKYDSIDAGDRYQVKRITVKPGEGLSVQMHHHRAEHWVVVAGTAKVTIDGDIKLLGENESIYIPLGATHCLENPGKIPLDLIEVRSGSYLEEDDVVRFADRYGRV

SEQ ID NO: 59954 - protein, 542 aa, Bordetella parapertussis 12822
MKAFNWVNPYPSTRIPVFARNVVSTSHPLAAQAGLRMLLKGGNAVDAAIAAAATIVLVEPVSCGLGGDCFAIVWDGRQLHGLNSSGVAPAAWNVEYFKRKYGTGPDGLAVQPKRGWDAVTVPGVVAGWAALHEKLGKLPFEQLFEPAIEIAERGYTVPPVVAHKWAAAAAELSEQPGYAQAFMPEGRAPRVGEHFRFPDAAYALRRIAASGGRDFYEGELAERIAAFSKECGGAMTLDDLRNYRPEWVKPISRSYRGYELHEIPPNGQGIAALIALGICERFDLADMPVDSVQSQHLQIEAMKLAFSDLYRYVADPRSMEVTPQQMLDDAYLDSRARLIDPDRATHFEAGRPHAGGTIYLTAADENGMMISFIQSNYMGFGSGVVVPGTGISLQNRGVGFSMNPASANVVEGGKRPFHTIIPGFLTRGGKPVMSFGVMGGDMQPQGHLQTVIRMLDYHQQPQAACCAPRWKVNRDFTLDIESTMNRATVEGLRNLGHRLKAVDDPYMDFGAGQFIWRMAESDNDLGYVAASDSRRDGQAVGF

SEQ ID NO: 59955 - protein, 282 aa, Lactobacillus plantarum WCFS1
MTVLTTMYQLANGVNIPKVAFGTWQIPGGEATYQAVRAALAAGYRHIDTALAYQNEASVGQAIRDSGIPREQIFVTTKLPAETKSYQGALNDFDRSLKNLGLDYVDLYLVHAPWPWGQVGRVYDEANLDVWQAMEAIYQSGRAKAIGVSNFAVRDLKNILNQATIPPMVNQIQYYLGFTEPKITKFSEEHAMLVEAYSPLATGGVLDNPQVQAYADKYGVSVAQLALRFVLQNGVLPLPKAVNPAHIEANTQLDFAISVADMQALNDLPDAAGSYMHNPTQG

SEQ ID NO: 59956 - protein, 406 aa, Cyanidioschyzon merolae
MFSCLTSVAQGNGRLQRTSKQVPLVARRERRHRLAVRTLRPALESSLSRFTEQEQAFPTLKADAKPKTASNSRTAGVPNRLKEEEGACFVEFLRRAVEDCRRNVQAGGHGTEDLVWERVRLEAEAAAREEQLLASFLYATVLNHDTLEACLAFHLANKLASTTLPSTMLNEIIREALEKAPEARYAIRLDLLAVADRDPACTRVIDALLFFKGFHALQTHRVAHWLWSQNRQALAMYLHSQVCKVLQIDIHPAARIGYGVFIDHGTGVVIGETARVGNNVSLLHHVTLGGTGTKLGDRHPRIEDCVLIGAGATILGNITVGYGAMVGACTVLTSDLPPHSTAVGVPARVIGAPRTKAPAFDMDQDPTHCRKRRTAVEHPDGSSHSLPETGTVDVTSTSTNGHALDS

SEQ ID NO: 59957 - protein, 398 aa, Zea mays
MPLSSFSFLRHHLPLPLQLPPTSNRQPPHPRLFHLLLPPFTPRRTFVCQPLTAATDDMAAAAAAASPPTLLEHMGQAGTAADLTVLVAHIQSACKRIAALVASPGNAELSRAKARGGAMAAGRDAPKPLDELSNDIILSALQSSGKVAALASEENDLPIWISDGGPYVVVTDPLDGSRNIEVSIPTGTIFGIYNRLVEVDHLPLEERAQLNSLQSGTRLVAAGYVLYSSATILCISFGAGTHAFTLDWSTGEFILTHPSIQIPPRGQIYSVNDARYFDWPEGLRKYIDTIRQGKGQHPKKYSARYVCSLVADFHRTLIYGGVAMNPRDHLRLVYEANPLSFLAEQAGGRGSDGKNRILTIQPVKLHQRLPLFLGSMDDMLELESYGDVQQKVNPGYEV

SEQ ID NO: 59958 - protein, 242 aa, Alteromonadales bacterium TW-7
MLKNIEGQTIPNVTFATRQNDEWKSVTTDEIFKGRTVAVFSLPGAFTPTCSSTHLPRYNELAGVFKQNGVDEIVCLSVNDTFVMNAWAEHQEAQNITLLPDGNGEFTDGMGMLVDKNDLGFGKRSWRYSMLVKDGVIEKMFIEPDLPGDPFEVSDADTMLDYINPKQAKPEPVSVFTKPGCPFCKKAKELLTEKGFAYEEIVMGAGASLTSLKAISGRDTVPQVFIGGNHIGGSDDLEKYFA

SEQ ID NO: 59959 - protein, 151 aa, Sinorhizobium meliloti
AEHKLLPALYHRQMEGQFTEPTRIIGASRASLSHDEYRRFASDALKEHLKSGEFNEAEVEKFTSRLYYVSVDAKSEQGWDDLKKLLEEGKDRTRAFYLAVGPAIFSDISEKIRDHKLITRNTRIVVEKPIGRDLASATELNDTIGKVFREE

SEQ ID NO: 59960 - protein, 617 aa, Arabidopsis thaliana
MADSQNGKSAFFFFFVSLILLFLSPSYSDVTASESDPIPYENSDASPGVVTSSESDRQGVSLHRLEELVRNLTELVARLDAKLSETPFKVKKEITRDEIEEKAKAFSVTKYSPFWSERFEFTSAVKLDSEATCINVLPFRDHEGLSKYFAVGDSSGRVFVFLRNGDVLVEFFTTCDSPITAMVSYMSVYKNESFVVTGHQSGVILLHRLREGSIGEDLNSAVMENVGKFDGTEDGLQVTLLEVHHVGRVRYILATDLSGKLTVFTENRTVYGSVSPTSRPLVFLKQRLLFLTETGAGSLDLRSMKIRESECEGLNHSLARSYVFDASERAKAYGFTSEGEIIHVLLLGDIMNFKCRVRSKKKVQMEEPVALQAIKGYLLIVNQEKVFVYNVSTQHYVRTTGPRLLFPAALEDIRSTFLSHRESTKTTDHQKLEKVTPLIASDREKLLVMGLGDGYVATYKSKLPISKAEFNTMLWSSPVFFFILFLFGAWHFFSKKKESLTAWGPDDPFSSTTMSSSSTTTAQNSSAFSESTRRNDDHMDLRRRYVSPSRYPPGAATGAYRSVGSNDPSSRAPVETTNYRTTAQEMKYRGGSGLDSGGFGKRRESLFGNNKALDDES

SEQ ID NO: 59961 - protein, 1200 aa, Oryza sativa Indica Group
MGGVEPPPPPAPAPAGLAAWLVARGVKRRAVSAKRSWPPLCGRFPAPPPPPPTAPVAGDDGSKGVEGVVANQGGAEGVAVSPDRSVPLSGSPTAASSLPPPPSIIAGDVGDNSVEGRGDVGDKGVHGVTEGNEEEQVASAAVSSAACNGALSHGPSQPEAERMEVDEGEGRETGEAQLPNDTDARLSDDQGMGEVLDVMPLAVAAPVSCGANVSNGSAGNVRDVASLLMDREGGKGGCEFERKEVTSDRDGRETESRVGVGQLERTNDVHDGGRKKRWLMSVLNPPPKRRAISAIRKFPRDCGRAASTLAESGASMEELPLEATPISVATGGASMEDSLARTPISVQGASLVCGLDHSSEAIDGKTIEDDESSKVENRIQEFQVATNVALDDFEGAKNGSTHPNDSIAKPSPSHGFVERVNGKGSQQEKKLVARSAWDGKMVSKYEERLQKGTPETRMRDLVDVKAKKKILKSDKMNGALQNDARSSGDGKMKTKASSTQRGVVRSDMSLKQGDIARKVDATGKCKGGVNSLIKEATSRKHATTNGIEENDDRDLVSDRIIVQALMAPDKCPWTRRRKSIGGSSESRTPKLKKKFGRPRKELKDTTPREEVSPEVASCKAIKHEAIEDKEDSYFEDEGNSKASYSDGEGNSKELVRGGKALVVCGGKKELCVTLPPSAPSGTDPRSKIRNLLIKFHAACRKLVQVEEQHKGNIGRIDIEAGKALKQNGFIKPGPIVGNVAGVEVGDEFNFRIELSFVGLHRPYQGGIDSTKVNGILVAISIVASGGYHDELSSSDELIYTGSGGKAIGNKAAGDQKLERGNLALKNSIETKTPVRVIHGFKGHSKGEASHSKSKQISTYIYDGLYMVVDYWKEGPEGSMVYKYKLQRIPGQPELALHIIKATRKSKVREGVCVPDISQGRERIPIPAINTIDDTQPTAFKYTTEVIYPHSYAKEPPKGCDCTNGCSDSNRCACAVKNGGEIPFNSNGAIVEAKPLVYECGPSCRCPPTCHNRVSQHGIKIPLEIFKTGNKGWGVRSLSSISSGSFVCEYAGEVLQENGDEHVETDEYLFDIGHHYHDEVWEDPKFEGILGLESSTSKTTEDTEGSKTTEDTEGSTIDASKCSNVGRFINHSCSPNLYAQNVLWDHDDMKKPHIMFFATENIPPLQELTYDYNYGKVEDKNGKEKVKPCFCGSPDCSRRLY

SEQ ID NO: 59962 - protein, 181 aa, Nostoc punctiforme PCC 73102
MSDSRLVKISKYLSKYLRHTPDAIGIKLAPGGWVAVDELITACAKNKFPITRQELEAVVESSEKQRFSFDSTGTLIRANQGHSVEVDLQLEPVVPPDELYHGTGHKSVDSIMETGLCKMSRHHVHLSKDIATAQTVGARHGKPVVFAISAAAMHQAGYIFYCSDNGVWLVDRVPPEYLQKI

SEQ ID NO: 59963 - protein, 479 aa, Burkholderia xenovorans LB400
MEEARHFIGGEWSAASGGETIAVLDPSDGQPFTQLARGTAADIDAAVHAARRAFEGAWGEASAAERGRVLYRLSMLVAARQEELALLEARDTGKPLKQARADSAALARYFEFYAGAADKLHGETLPYQTGYTVLTIRDPHGVTGHIVPWNYPMQIFGRSVGAALAAGNACVVKPAEDACLSVLRVAELAAEAGLPAGALNIVTGYGHEAGAALARHPGIDHISFTGSPETGKLVTQMAAENHVPVTLELGGKSPQIVFADADLDAALPVLVSAIVQNAGQTCSAGSRVLIDRSIYEPLLDRLSGAFHALRVGPSHADLDCGPLISAKQQRRVWDFLSDAQHDGIPMAAHGEVIPEAPESGFYQAPTLLRDVPASHRLARDEVFGPVLAAMSFSGEDEALALANGTPFGLVAGIWTRDGARQMRLARRLRSGQVFINNYGAGGGVELPFGGVKHSGHGREKGFEALYGFTVLKTIAIRHG

SEQ ID NO: 59964 - protein, 172 aa, Chlamydomonas reinhardtii
MPNPIVFFDITADGAPVGRIEMELYADDVPKTAENFRALCTGEKGVGRSGKPLHFKGSTFHRVIPNFMCQGGDFTRGNGTGGESIYGEKFPDENFKHRHTGPGVLSMANAGPNTNGSQFFLCTVETAWLDGKHVVFGKVCKGMDVVKKVEGYGSSSGKTRATIAIADCGQLA

SEQ ID NO: 59965 - protein, 175 aa, Burkholderia xenovorans LB400
MSFNHVPAGKDLPQDFNVIIEIPAQSDPVKYEADKETGLLHVDRFISTGMRYPANYGYIPQTLSGDGDPVDVLVITPFPLLAGSVVRARALGMLQMTDESGVDAKLVAVPHDKVCPMTADLKSIDDVPAYLKDQIKHFFEQYKALEKGKWVKVDGWAGIEAAHKEITDGAANYKK

SEQ ID NO: 59966 - protein, 237 aa, Clostridium difficile 630
MIIMGSIKDNLSEIRNKIDKAAKKVDRDSKEITLLAVTKTVDVDLVNEAMREGITSVGENKPQELARKYDIIGDKLNWHLIGTLQTNKVKYIIDKVCMIHSLDRIALCEEIQKRAEQINREIDCLVQVNISKEESKHGLDREEVVDFVKEVSEKYKNIKIKGLMTMAPFIEDEDEIRGVFKGLKDLSKQIKELNIPNVGMDVLSMGMSHDYEIAIEEGATIVRVGTSIFGERNYNKK

SEQ ID NO: 59967 - protein, 179 aa, Picea sitchensis
MACVAKYRRPPHMLDENPRKRRKLTSSWDVLPSQLQVQPTLIFTGKDFGIGSRNGEGQNAPLLAGAGVSIPASDCSRSTSSNIQSKEEGSRSGSPPWRSDDKDGHYMFEIGENLTSRYKILSKMGEGTFGQVLECWDRKSKDMVAIKIVRGLQKYREAAMIEVDVLRKVGKYDRNGTRI

SEQ ID NO: 59968 - protein, 140 aa, Myxococcus xanthus DK 1622
MVDKLTLSDDEWRKRLSPQEYEVLRRQGTERPGSGCFLGTKTPGTYVCAGCGNPLFKAGTKFESGTGWPSFTQPVAPDAVTEIQDVSHGMIRTEVRCARCDGHLGHVFPDGPPPTGLRYCMNSVSMKHVPEGQPLELVKT

SEQ ID NO: 59969 - protein, 110 aa, Brassica napus
  misc_feature (3)..(3): Xaa can be any naturally occurring amino acid
  misc_feature (11)..(11): Xaa can be any naturally occurring amino acid
  misc_feature (99)..(99): Xaa can be any naturally occurring amino acid
MTXRLPFFIFXFLYTITTLTSKASGTVSCRTSCGSIQINYPFGIDKGCGSPQFQGMLNCTSTDLDFFTPSGAYRVRSIDYDESTMVVFDPFMSTCSILXPHHDFKLSDIQ

SEQ ID NO: 59970 - protein, 512 aa, Zea mays
  misc_feature (285)..(285): Xaa can be any naturally occurring amino acid
  misc_feature (294)..(294): Xaa can be any naturally occurring amino acid
IESLSLTFHGHDLIVDSELELNYGRRYGLLGLNGCGKSTLLTAIGCRELPIPEHMDIYHLSHEIEASDMSALQAVVTCDEERDDGGGEALERVYERLDAMDAGTAEKRAAELLFGLGFNKQMQTKKTKDFSGGWRMRIALARALFMNPTILLLDEPTNHLDLEACVWLEETLKKFDRILVVISHSQDFLNGVCTNIIHMQSKKLKLYTGNYDQYVQTRSELEENQMKQYKWEQEQIASMKEYIARFGHGSAKLARQAQSKEKTLAKMERGGLTEKVVRDRVLVFXFTDVGKLPXPVLQFVEVKFGYTPDNLIYKSLDFGVDLDSRIALVGPNGAGKSTLLKLMTGDLVPLDGMVRRHNHLRIAQYHQHLAEKLDLDMSALAYMMKEYPGTEEEKMRAAVGRFGLSGKAQVMPMKNLSDGQRSRVIFAWLAYRQPQLLLLDEPTNHLDIETIDSLAEALNEWDGGLVLVSHDFRLINQVAQEIWVCENQEVTRWEGDIMDFKAHLKSKAGLSD

SEQ ID NO: 59971 - protein, 338 aa, Arabidopsis thaliana
MVTGKRYYGDEVHNEEEANVFKKLVADINDCSGARHPGDYLPFMKMFGGSFEKKVKALAEAMDEILQRLLEECKRDKDGNTMVNHLLSLQQNEPEYYTDVTIKGLMLIFCFFGQLQILWFTNIETGWGMMIAGTDTSAVTLEWAMSSLLNHPEALEKAKLEIDEKIGQERLIDEPDIANLPYLQNIVSETFRLYPAAPLLVPRSPTEDIKVGGYDVPRGTMVMVNAWAIHRDPELWNEPEKFKPERFNGGEGGGRGEDVHKLMPFGNGRRSCPGAGLGQKIVTLALGSLIQCFDWQKVNGEAIDMTETPGMAMRKKIPLSALCQSRPIMSKLQAHLKG

SEQ ID NO: 59972 - protein, 443 aa, Mesorhizobium loti MAFF303099
MNLTVFGIGYVGLVQAAVLAEVGHQVVCVDIDENKVERLNQGFVPIFEPGLESLVRENHAAGRIKFTTDAAAAVRHGEIQMIAVGTPPGEDGSADLKYVLAVAETIGREMDTAKIVVGKSTVPVGTCEKVKAKIAETLKKRGREDLSFDVASNPEFLKEGSAVADCMRPDRIIVGTSSEGTEAVMRELYAPFNRNHEKMIVMDVRSAEFTKYAANCMLATKISFMNEMANLAEQLGADIEEVRKGIGSDPRIGYHFIYPGLGYGGSCFPKDVRALIKTAEGVKFDAKLLRAVEERNNDQKSVLFDKVNRYFKGSLKGKTFALWGLAFKPNTDDMREAPARVLMEALWKAGATVQAYDPEAMQECQAIYGLRDDLLLCGTKEAALRGADALLIATEWKSFRAPSFDALKDALTTPVIFDGRNLYDPKVVARYGIEYHSIGRMAA

SEQ ID NO: 59973 - protein, 242 aa, Zea mays
  misc_feature (224)..(224): Xaa can be any naturally occurring amino acid
  misc_feature (233)..(233): Xaa can be any naturally occurring amino acid
  misc_feature (236)..(236): Xaa can be any naturally occurring amino acid
SPTPNLQSTHPLLIHSAVATAARPLRLVASRSARAIRLVARAGGVDDLPLVGNKAPDFEAEAVFDQEFINVKLSDYIGKKYVVLFFYPLDFTFVCPTEITAFSDRYEEFEKLNTEVLGVSIDSVFSHLAWVQTDRKSGGLGDLKYPLISDVTKSISKAFGVLIPDQGIALRGLFIIDKEGVIQHSTINNLAIGRSVDETMRTLQALQYVQENPDEVCPAGWKPXERSMKPDPXGSXEYFAAV

SEQ ID NO: 59974 - protein, 77 aa, Dichelobacter nodosus
  misc_feature (46)..(46): Xaa can be any naturally occurring amino acid
RKVVAMAISQGLPVPCLSAGLTFLDGYTRESLPANLLQAQRDYFGXHGYERVSKRGQTFHTDWTKMGGNAVSGNYDA

SEQ ID NO: 59975 - protein, 323 aa, Salmonella enterica subsp. enterica serovar Ohio
MSKIFEDNSLTIGHTPLVRLNRIGNGRILAKVESRNPSFSVKCRIGANMIWDAEKRGVLKPGVELVEPTSGNTGIALAYVAAGRGYKLTLTMPETMSIERRKLLKALGANLVLTEGAKGMKGAIQKAEEIVASNREKFLLLQQFNNPANPEIHEKNTGPEIWGETDGQVGLFISGVGAGGTLNGVGRFLKSPRGKKNLITVAGEPTDSPVIPQALAGEELKPGPHKIQGIGAGFIPGNLDLKLVDKVIGITNEEAISTARRLMEEEGILAGISSGAAVAAALKLQEDEAFTNKNIVVTLPSPGERYLSTALFADLFTEKELQQ

SEQ ID NO: 59976 - protein, 489 aa, Talbotia elegans
GPAVSTLEEKNLGRIAQIIGPVLDVVFPPGKMPNIYNALVVKGRDTAGQQIKVTCEVQQLLGNNRVRAVAMSATDGLMRGMEVIDTGTPLSVPVGGATLGRIFNVLGEPVDNLGPVDTRTTSPIHRSAPAFIQLDTKLSIFETGIKVVDLLAPYRRGGKIGLFGGAGVGKTVLIMELINNIAKAHGGVSVFGGVGERTREGNDLYMEMKESGVINEKNIAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFQLILSGELDGLPEQAFYLVGNIDEATAKAMNLEVESNLK

SEQ ID NO: 59977 - protein, 484 aa, Typha latifolia
MRINPTTSSPGGSTLEEKNLGRIAQIIGPVLDAVFPPGKMPNIYNALVVKGRDTLGQQINVTCEVQQLLGNNRVRAVAMSATDGLMRGMEVIDTGAPLSVPVGGTTLGRIFNVLGEPVDNLGPVDTRTTSPIHRSAPAFIQLDTKLSIFETGIKVVDLLAPYRRGGKIGLFGGAGVGKTVLIMELINNIAKAHGGVSVFGGVGERTREGNDLYMEMKESGVINEKNLAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQRVKETLQRYKELQDIIAILGLDELSEEDRLTVARARKIERFLSQPFFVAEVFTGSPGKYVGLAETIRGFQLILSGELDSLPEQAFYLVGNIDEAT

SEQ ID NO: 59978 - protein, 294 aa, Leptospira interrogans serovar Lai str. 56601
MFLMEKLLERVNYILEALPYITQYSGKTVVIKYGGAAMAKADLKESFAKDIVLLKYVGIHPVIVHGGGPEINRLLDNLKIPTEFVHGHRVTDNQTMEIVEMVLTGKVNKQIVSLINSQGGKAVGISGKDGNLAKATKAPIEIELEGKEKQLFDVGLVGKIESVNPEILHNLQKAGFIPVISPVAENSEGESLNINADTFAGEIAGALKAEKLILLTDTQGILIDNQLVTGLNRNKVKDYIRKGEISGGMIPKVECCLTAIDQGVRRTHIIDGRVSHSILIEIFTDQGIGSLIES

SEQ ID NO: 59979 - protein, 152 aa, Brassica napus
  misc_feature (16)..(16): Xaa can be any naturally occurring amino acid
  misc_feature (31)..(31): Xaa can be any naturally occurring amino acid
  misc_feature (38)..(38): Xaa can be any naturally occurring amino acid
FTQFLALKDMDPLDAXATNPHSNFGKFCKSXKYLILIXPKMEASFFGNLDQREYVTGGGHPRTAFYQAFLKLAKSIWLLHRLAYSFDPAAKIFQVKKGSEFSDSYMESVLKNIVVDEKGESPSVGLMVMPGFWIGGSVIQSRVYVSGVKVVE

SEQ ID NO: 59980 - protein, 276 aa, Xanthomonas campestris pv. vesicatoria str. 85-10
MKAQWRERFAGIDRLYGVGTVERLSACRVAVVGMGGVGSWVVEALARTGVGHIRLIDADDVCVSNTNRQLPALAGQYGRSKARAMAERCVAINPDIEADAVEAFLTSGNIETLLGEEFDLVIDACDSFRVKVETIAWCRRRKLPLLTVGAAGGRTDPTLVRVRDVSRTEHDAMLALIRKKLRSEFNFPKNPQRYFGVPAVYSLENVKYPQADGSVCGIRPQLDADATLKLDCGAGLGAATHITGTFAFVAVGKALEMLLKPKPKAAAPAAEAVAAS

SEQ ID NO: 59981 - protein, 1521 aa, Issatchenkia orientalis
  misc_feature (456)..(456): Xaa can be any naturally occurring amino acid
METISVGKESDVSSDGNVAYGGFNEGTNKQIRDLAREFTRQTSVGDGVQDSDDATDSNEVEKFGVDHASPNSPPKSNQYDLLRTLTSMSQVPGVNPVDQTIDPRLDPNSDEFESKFWVKNMRKLLDSDPDYYRPTSLGFAAKNLIAKGISSDADYQANFLNYPFKVVRDTYMDLFRGNDESRYFEILKSMDVLIKPGTLTVVLGRPGAGCSTFLKTVAAQTYGFKVDDSSIISYDGLTPKEINKNYRGEVIFSAEMDNHFPHLSVGQTLEFAAKMRTPQNRFPGVSRNEYAKHMSEVYMATYGLSHTVNTKVGDNFIRGVSGGERKRVSIAEASLCGANLQCWDNATRGLDAATALEFVRALKTSAHILDTTPLIAIYQCSQDAYDLFDNVVLLYEGYQIYFGPGDRAKDFFERMGYECPDRQTTADFLTSITSPAERVAKKGWENKVPQTPKEFXDYWRASAEYKELVADIDEYLSHCHNNNTREEFAEAHAIKQANHARPSSSFRVSYWMQIKLIAQRNIWRTKGDPSIMMFSVIANIIMGLIISSLFYNLSATTGTFYYRSAAMFFAVLFNAFSSLLEVMSLFESRPIVEKHKMFALYHPSADAFASIFTELPAKIATSLGFNLMFYFMVNFRRNPGRFFFYLLMNFMATLVMSHIFRSIGSCFKTLSESMPPATVFLTAMVIYTGFALPTPSMHGWSRWINYLDPVAYVFEALMANEFDGRRFECSQFIPSYPNADLANQVCSVVASVPGFSYVNGTDYIYESYRYKITHKWRNFGIVVGFIIFFLFVYVTLVELNKGAMQKGEIILFQQSKLREMRKEKKSKQISDIEGGSEKPAGVYDHGNEDSEDGVNNLTVGSDIFHWRDVCYEVQIKDETRRILNHVDGWVKPGTLTALMGASGAGKTTLLDVLANRVTMGVVSGSMFVNGRLRDQSFQRSTGYVQQQDLHLQTSTVREALRFSAYLRQSRTISKKEKDEYVESIIDILEMRSYADAVVGVAGEGLNVEQRKRLTIGVELAAKPKLLLFLDEPTSGLDSQTAWSVCQLMRKLADHGQAILCTIHQPSALLLKEFDRLLFLAKGGRTVYFGDLGENCQTLINYFESHGAHPCPAEANPAEWMLEVIGAAPGSHANQDYHEVWMSSDERRAVQEELHRMETELLQIPVDDSAEAKRSFASSYLIQYICVTKRVLQQYYRTPQYIWSKLFLAGANSIFNGFSFYRAGTSLQGLQNQMLSIFMLSVMLNTLVQQMLPLYITQRSIYEVRERPSKTFSWWVFLAAQVTAEFPWNLICGTISYFCWYYPIGLQNNASVTHTTAERGALTWLLIVGFFNYASSLGLMCIAGVEQEQNGANISNLLFTMCLNFCGILKYPTGFWKFMYRANPFTFWIASVLGAGVGDTPLVCSSKEIVYFAPPKGETCTTYIQPYIDEAGGYLVDSEREGYCGFCTASNTNAYLKSVHVEYSKRWQNWGIFICFIAINNIFMFLFYWLARVPKKDNRVKDASALKSDEKATLGPQTTSEA

SEQ ID NO: 59982 - protein, 498 aa, Brucella suis 1330
MRNIGHFIGGKHVAGKSGRTADIFQPLDGTVQGKVALATKEEVRAAVENAKAAQPAWAATNPQRRVRVLRKFIELVEAEYDSLAELLAREHGKTIADARGDIQRGLEVVEVCLGAAHMLKGEFTDNAGTGIDTYSMRQPLGVVAGITPFNFPAMIPLWKAGPAIACGNAFILKPSERDPGVPMRLAELFQEAGLPAGIFNVVNGDKESVDALLDDPDVQAIGFVGSTPIAQYIYGRGCANGKRVQCFGGAKNHLLIMPDADMDQTVDALIGAGYGSAGERCMAISVAVPVGEDTANRLMEKLIPRVESLKIGPSTDNSADYGPLVTKAALDRVRGYVDLGVEEGAKLVVDGRNFKMQGYENGFYMGGCLFDHVTPDMRIYKEEIFGPVLSIVRAKNYEEALALPSDHEFGNGVAIFTRDGDAARDFASRVQVGMVGINVPIPVPIAYYTFGGWKASGFGDLNQHGPDAFRFYTKTKTVTSRWPSGVKDGAEFVIPTMK

SEQ ID NO: 59983 - protein, 182 aa, Triticum aestivum
  misc_feature (45)..(45): Xaa can be any naturally occurring amino acid
  misc_feature (72)..(72): Xaa can be any naturally occurring amino acid
  misc_feature (100)..(100): Xaa can be any naturally occurring amino acid
  misc_feature (136)..(137): Xaa can be any naturally occurring amino acid
  misc_feature (151)..(151): Xaa can be any naturally occurring amino acid
  misc_feature (163)..(163): Xaa can be any naturally occurring amino acid
MSSDSSSWARALVQISPYTFSAIGIAVSIGVSVLGAAWGIFITGXSSLIGAAIKAPRITSKNLISVIFCEAXVAIYGVIVAIILQTKLESVPTSQMYAPXESLRAGYAIFASGLIVGFANLVCGVCVGIIGSSCAXXSDAQNSSLFVKILXIEIFGSASWDGXCGVIVGIIMSAQATWPAKA

SEQ ID NO: 59984 - protein, 306 aa, Dechloromonas aromatica RCB
MAIKHFLQFKDFTREELEYVFERTSWIKNQFKSYQKYWPLSDRTLVMIFEKASTRTRLSFEAGMQQLGGSAIYLNTRDSQLGRGEPVEDAAQVISRMSDIVMIRTFEQEIIERFAANSRVPVINGLTNEYHPCQILADIYTYIEHRGCIQGKTVAWVGDANNMCNTWLQAAEVLDFKVHVSTPPAYEIQPELVGKINPARFKVFADPMDACRGADLVTTDVWTSMGFEAENEERIKAFADWCVDGDMMRVANPQAVFMHCLPAHRGEEVTAEVIDGPQSVVWDEAENRLHVQKALMEYLMLGRIQG

SEQ ID NO: 59985 - protein, 1521 aa, Issatchenkia orientalis
  misc_feature (19)..(19): Xaa can be any naturally occurring amino acid
  misc_feature (456)..(456): Xaa can be any naturally occurring amino acid
METISVGKESDVSSDGNVXYGGFNEGTNKQIRDLAREFTRQTSVGDGVQDSDDATDSNEVEKFGVDHASPNSPPKSNQYDLLRTLTSMSQVPGVNPVDQTIDPRLDPNSDEFESKFWVKNMRKLLDSDPDYYRPTSLGFAAKNLIAKGISSDADYQANFLNYPFKVVRDTYMDLFRGNDESRYFEILKSMDVLIKPGTLTVVLGRPGAGCSTFLKTVAAQTYGFKVDDSSIISYDGLTPKEINKNYRGEVIFSAEMDNHFPHLSVGQTLEFAAKMRTPQNRFPGVSRNEYAKHMSEVYMATYGLSHTVNTKVGDNFIRGVSGGERKRVSIAEASLCGANLQCWDNATRGLDAATALEFVRALKTSAHILDTTPLIAIYQCSQDAYDLFDNVVLLYEGYQIYFGPGDRAKDFFERMGYECPDRQTTADFLTSITSPAERVAKKGWENKVPQTPKEFXDYWRASAEYKELVADIDEYLSHCHNNNTREEFAEAHAIKQANHARPSSSFRVSYWMQIKLIAQRNIWRTKGDPSIMMFSVIANIIMGLIISSLFYNLSATTGTFYYRSAAMFFAVLFNAFSSLLEVMSLFESRPIVEKHKMFALYHPSADAFASIFTELPAKIATSLGFNLMFYFMVNFRRNPGRFFFYLLMNFMATLVMSHIFRSIGSCFKTLSESMPPATVFLTAMVIYTGFALPTPSMHGWSRWINYLDPVAYVFEALMANEFDGRRFECSQFIPSYPNADLANQVCSVVASVPGFSYVNGTDYIYESYRYKITHKWRNFGIVVGFIIFFLFVYVTLVELNKGAMQKGEIILFQQSKLREMRKEKKSKQISDIEGGSEKPAGVYDHGNEDSEDGVNNLTVGSDIFHWRDVCYEVQIKDETRRILNHVDGWVKPGTLTALMGASGAGKTTLLDVLANRVTMGVVSGSMFVNGRLRDQSFQRSTGYVQQQDLHLQTSTVREALRFSAYLRQSRTISKKEKDEYVESIIDILEMRSYADAVVGVAGEGLNVEQRKRLTIGVELAAKPKLLLFLDEPTSGLDSQTAWSVCQLMRKLADHGQAILCTIHQPSALLLKEFDRLLFLAKGGRTVYFGDLGENCQTLINYFESHGAHPCPAEANPAEWMLEVIGAAPGSHANQDYHEVWMSSDERRAVQEELHRMETELLQIPVDDSAEAKRSFASSYLIQYICVTKRVLQQYYRTPQYIWSKLFLAGANSIFNGFSFYRAGTSLQGLQNQMLSIFMLSVMLNTLVQQMLPLYITQRSIYEVRERPSKTFSWWVFLAAQVTAEFPWNLICGTISYFCWYYPIGLQNNASVTHTTAERGALTWLLIVGFFNYASSLGLMCIAGVEQEQNGANISNLLFTMCLNFCGILKYPTGFWKFMYRANPFTFWIASVLGAGVGDTPLVCSSKEIVYFAPPKGETCTTYIQPYIDEAGGYLVDSEREGYCGFCTASNTNAYLKSVHVEYSKRWQNWGIFICFIAINNIFMFLFYWLARVPKKDNRVKDASALKSDEKATLGPQTTSEA

SEQ ID NO: 59986 - protein, 777 aa, Ralstonia eutropha JMP134
MSSKTSGDAPQHAPNSPEAQLRLAALEYHRSPTKGKIQVTATKALSNQRDLSLAYSPGVAYACEEIAKDPSTAAEYTSRANLVAVITNGTAVLGLGDIGPLAGKPVMEGKGCLFKKFAGIDVFDIELDARDPDKIVEIVAALEPTLGGVNLEDIKAPECFYIEQKLRERMNIPVFHDDQHGTAIISAAALLNGLKVVGKDIAKVKLAVSGAGAAAIACLDTMVSLGVKRENVSVVDSKGVIYVGRDANMEANKARYAQDTSARTLADIVNGADVFLGCSTAGVLTGDMVKTMADKPIILALANPEPEIRPEVAKAARPDCIIATGRSDYPNQVNNVLCFPYIFRGALDCGATKITEAMKLACVKAIAELAEAELNDAVAAAYGGRELKFGPDYIIPTPFDQRLIEKIAPAVAKAAEESGVATRPIQDLDAYRQQLSTYVYHTGMIMKPVFSAAKASPKRVAYAEGEEERVLRAVQSVVDEGLARPILIGRPHVIQMRIEKAGLRLKAGVDFELINPEDDPRYRAYHEAYHALRGRDGVTPDMAKVALRRSNTLIGTMLMHMGDADALLCGTVGRFEAHLEHVSDVIGLAPGAKVFAALNALMLEKHTLFITDAFVNDDPNAEELAAITQLAAEEIRRFGLHPKVALMSHSMFGSSTRPSARKMREAAEILAKVAPHLEVEGEMQGDAALDEDVRRHFLPSTKLAGSANLLVMPTLDAANIAFNLLKMTGGQGVTVGPILLGAAKPVHILNPQATTRRIVNMTAVAVAEANANASVQQ

SEQ ID NO: 59987 - protein, 320 aa, Bifidobacterium longum DJO10A
MPEPVRERLEALKDAPGSVIVVGSMNADYTVTTKRLPKPGETVNGGAMKVLPGGKGANQASAAARLGVNVQLLGAVGEDSNADFLLSKLDEAGVDTADILHVEGPSGTTVITVSAEGENTIVYSPGSNAKASAGYVQSHRTTIAECAVLGLCLESPIATVIAAAQTAHDAGVTVLLNDSPFMDELPHELVEATDILLVNQHEVAQLLGLPDDDVESLDWYEVAERFTDYGFDRAIVTLGASGSVVIENGRWHRVSAAQVNAVDTTGCGDSFMGTVLAGLAAGHTLLQSAQIGSYVSAYAATKLGAQSAYGTAEEVIAYFS

SEQ ID NO: 59988 - protein, 390 aa, Dechloromonas aromatica RCB
MSHVMNTYARLPVTFSHGNGSRITDTEGKEYLDALSGIAVSTLGHAHPKLVAAIAAQAGRMLHTSNLYRIGEQEQLADKLCELSGMQEVFFGNSGAEANEAAIKLARFYGHKKNIEIPTVVVMEKAFHGRTMATLSATGNRKTQAGFEPLVAGFVRVPYGDLEAIKAVAEHNKNIVAVMLEIIQGEGGIHLADPSFYRGVRELCDAQDWLMICDEVQCGMGRTGKWFGYLQAGVQPDIATLAKGLGSGVPIGACMAGGKAAGLFGPGNHGSTFGGNPLVSTAALTTIEVIEQDDLLGNAERIGLLIRKLFAEALAGVKGVVDIRGHGLMIGLELDRPCGALVGKALAAGLLINVTADTVLRFLPPLIFSESDAHELVERTAPLIKEFLAA

SEQ ID NO: 59989 - protein, 314 aa, Pueraria montana var. lobata
MAAIEIPTIVFPNSFAQHRVPVVEMGSAPDFTCKKDTKEAIIEAVKQGYRHFDTAAAYGSEQALGEALKEAVDLGLVSRQDLFVTSKLWVTDNHPHLVVSALRKSLKTLQLEYLDLYLIHWPLSSQPGKFSFPIEVEDLLPFDVKGVWEAMQECQKLGLTKAIGVSNFSVKKLQNLLSVATIRPVVNQVEMNLAWQQKKLREFCKENGIVITAFSPLRKGASRGPNEVMENDVLKEIADAHGKSIAQVSLRWLYEQGVTFVPKSYDKERMNQNLQIFDWALTQEDHHKISQISQSRLISGPTKPQLSDLWDDEI

SEQ ID NO: 59990 - protein, 657 aa, Alteromonadales bacterium TW-7
MQSTNAQFFGLLVAAVIFVWFFKRIGLPPILAYLATGVLAGSHGVGWLEHTHEIDFVAELGIVFLLFSLGLEFSISRLMAMRNIVFGLGSLQVIVTSLVLIIILYCLNFSLLTSFTIGSIMALSSTAVVVKLLKESGELNQRRGQLAIGVLLFQDIAVVPLLIILPLFATSDSQTIGWALAFSLTKGAFVCVLLWAIGKWLLPKVFSEIALVRTDELFVLTTLLVALFAGLLTYMFGLSMALGAFLAGMMLGESHYRHQLEADIRPFRDILMGLFFVTVGMQLDLLYVFSNGLIIVGALFGLLVLKIAVVAISAQLMGERKQDSLACGIMLWQMGEFGFVLIALGRQHQLLTSEHISFLIALGVLSMALTPFLIEKTPYILRRLGLLNSPSIAWEGEPQVSALYTNHVVICGFSRVGQTIARFLKPEAIEYVAVESNPILVQEGKAAGEPVIFGHVKQKDILKCAGVERARLVIITFTEFEQTQIVIDAIKQIAPEVKILIRTRDDSQLEKLRELGVTEVVPETLEASLMIVSHVLSMSGVPMSRIIRRVSDERRNRYQFLQSFFTGEHINNDESNSDKLEYLHVVALPDKAHAVNKSINELNLVKRKVSIKALRRQDREIDAPSDQIILLANDILVLQGKPRRVERVEHFLLDGIE

SEQ ID NO: 59991 - protein, 556 aa, Erwinia carotovora subsp. atroseptica SCRI1043
MKQNTGNWRETDVVVIGGGATGAGTARDCALRGLRCLLLERYDIATGATGRNHGLLHSGARYAVTDGESARECIEENQILRRIARHCIEPTDGLFITLPEDDLGWQAQFITACQQAGIGAQALDPQEALRLEPAANPTLIGAVRVPDGSVDPFRLTAANMIDACEHGAEVLTYHEVIGLIRQGDRITGVRVFDHKKGVETEIYAQVVVNAGGIWGQHIAEYADLRVRMFPAKGALLILGHRINNMVINRCRKPADADILVPGDTISLIGTTSTHIDYDQIDNMLVTPAEVETLMREGSMLAPALASTRILRAYAGVRPLVANDSDPSGRSVSRGIVLLDHASRDGLEGFITITGGKLMTYRLMAEWVTDAICKKLGHDVACSTAQTPLPGSESLDEVKTVPHALSAYPAAKPLSAPLRGSAIYRHGERAGRMLSGERLDRSLVCECEAVTAGEVRYAVESLQVNNLIDLRRRTRVGMGTCQGELCACRAAGLLCRLGTATPEQSLTQLSQFLNERWKGIRPVAWGNALRESEFTSWIYQGLCGLTASDSQEDRHAL

SEQ ID NO: 59992 - protein, 521 aa, Pueraria montana var. lobata
MLLELALGLLVLALFLHLRPTPTAKSKALRHLPNPPSPKPRLPFIGHLHLLKDQLLHHALIDLSKKYGPLYSLYFGSMPTVVASTPELFKLFLQTHEATSFNTRFQTSAIRRLTYDNSVAMVPFGPYWKFIRKLIMNDLLNATTVNKLRPLRTEQIRKFLRVMAQSAEAQQPLNVTEELLKWTNSTISMMMLGEAEEIRDIAREVLKIFGEYSVTNFIWPLMYLKVGKYEKRIDDIFNKFDPVIERVIKKRREIVRRRKNGEVVEGEASGVFLDTLLEFAEDETMEIKITKEQIKGLVVDFFSAGTDSTAVATEWALAELINNPRVLQKARDEVYSVVGKDRLVDEVDTQNLPYIRAIVKETFRMHPPLPVVKRKCVEECEVNGFVIPEGALILFNVWAVGRDPKYWDRPLEFRPERFLESGAEGEVGPIDLRGQHFQLLPFGSGRRMCPGVNLATSGMATLLASLIQCFDLQVVGPKGEILKGNDAKVSMEESAGLTVPRAHNLRCVPLARTSVAAKLLS

SEQ ID NO: 59993 - protein, 463 aa, Oryza sativa Japonica Group
MALLLRHSPKLRRAHAILGCERGTVVRHFSSSTCSSLVKEDTVSSSNLHPEYAKKIGGSDFSHDRQSGKELQNFKVSPQEASRASNFMRASKYGMPITANGVHSLFSCGQVVPSRCFSSGADLPPHQEIGMPSLSPTMTEGNIARWVKKEGDKVSPGEVLCEVETDKATVEMECMEEGYLAKIIHGDGAKEIKVGEIIAVTVEEEEDIGKFKDYKAPSSAESAAPAESKPQSEPTEPKKEKEQPKAPEPKATKTEESFLSEDRTFSSPIARKLAEDNNVPLSSIKGTGPDGRILKADIEDYLASVAKGAKKETAAAPGLGYVDLPNTQIRKVTANRLLHSKQTIPHYYLTVDTRVDKLIKLRSELNPLQDTSGGKKISINDLVIKAAALALRNVPECNSSWMNDFIRQYHNVNINVAVQTEDGLFVPVIRDADKKGLATIADEVKQLAQRARDNSLKPEDYEV

SEQ ID NO: 59994 - protein, 521 aa, Aphanothece halophytica
MTIEAAMGEEAIKENLEQFLIVLSVSLGVATLSQISSFFRQIPYTLLLVIVGLGLAFVDIRLVNLSPELILEIFLPPLLFEAAWNIRWRNLKKNLFPVVLLAIIGVVISVVGIGFSLNYFSGLSLPIALLVGAILAATDPVSVIALFRELGVGERLTVLMEGESLFNDGVAVVAFSLLVGIPLGTQEFSVTNTLIQFVTLQGIGIGCGGVIGFGISYLTQRFDLPLVEQSLTLVSAYGTYLITEELGGSGVIGVVTVGLILGNFGSRIGMNPRTRLLVSEFWEFIAFFVNSIVFLLIGDQINIRGLADNGQLILITIIALVIIRAISIYGLGTISNLITKQDISWQEETVLWWGGLRGSVSIALALSVPVMLDGRQDIIEAVFGVVLFTLLVQGLTMQTVIEKLGLIGDRAQRRTYSELIARRSALERVLAHLNAVPPSPSIRMKSLKTTKEASKGQLESRQTKKLRSYNNSYPQLRSLEQEQLRELTFKVEADTYAELIRAGKLNNNLSPLLQEVLAKPE

SEQ ID NO: 59995 - protein, 343 aa, Clostridium difficile 630
MVLNMEKVCVLGTGSWGSALALGLAKKGNDVSMWTRKEEQAKKINRTKENTDYLPGVLFPNNITISTDIEKTIKDCKVIVLAVPSQAVRSTCQKIKPFIKEGQVIVNVAKGLEKGTGLRLSQVCEEELPQNPYVILSGPSHAEEVARDIPTTVVVASKDLKIAQMIQDLFMSPKLRVYTNPDIVGVELGGALKNIIAFGAGICDGLGYGDNAKAALMTRGISEMSRLGIAMGANMSTFAGLSGIGDLIVTCTSMHSRNRRAGILIGKGMSLEDTLKEVKMVVEGITATEVAHDVAEKLDIDMPITNAIYSVIKKGSNPKEVGIELMMRSKKHEMEEVVLGDDI

SEQ ID NO: 59996 - protein, 346 aa, Physcomitrella patens subsp. patens
MVTASDSFDCHLIVLAFAARDMDDLVVCFGELLIDFVPTVGGLSLAEAPAFKKAPGGAPANVACGIAKLGGNAAFVGKVGDDEFGYMLCEVLKDNKVQTKGVRFDAQARTALAFVTLRDDGEREFMFYRNPSADMLFQTDELDIELLNQASILHYGSISLITEPSRSTHLEAMRIAKEAGALLSYDPNLRLPLWPSADAAKEGIMSIWDQADIIKVSDEEVIFLTGADPKDDALNLKMMHPGCKLMLVTEGGEGCRYYTPKFHGHVSGLKVQPVDTTGAGDAFCAGLLSQIAKSPALVEDEAKLREALLFANACGAITTTERGAIPSLPDQNTISRILSKTHRLPV

SEQ ID NO: 59997 - protein, 337 aa, Chlamydomonas reinhardtii
LRSQYQFLGVVGRGQFGQVYCIRHLRHGQKYACKTLGKKKLLSQLDAEDIKKEIEVMHHLSGHHSVVSLHRVFEDEKNVHLVMDLEAGSPREAAGAEGYLPEDKAAPLMLLAIKAVQYCHSMGVLHRDIKPENFLLTCRNDLGQIKLTDFGLSTFYQDGQVFNELLGSPYYIAPEVIKQKYGKEADIWSCGVMLYIMLCGEAPFFGEGDEGIFKSIMKAKLDFSFEPWPSLSRDVKLLLRRMLVKDPRERASLEEVISHPWFARGLTPSGTAGPTLLSLRQSYSVASRTKKAALRYIVASLPDEVTAGLYNLFQDFDQEETGWIGQDMPYEGLRGIW

SEQ ID NO: 59998 - protein, 472 aa, Haemophilus somnus 2336
MSNTTAITNVFKLIEENDIKFVLLRFTDVKGKEHGVSLPVSLVDEDLFEDGKMFDGSSVEGWKAINKADMLLMPIAETAVVDPFAQIPTLSIRCSIFEPTTMQSYDRDPRSIAMRAENYMRSTGVADDVFFGPEPEFFLFDDVRFDVSMNGNSYTVDDIEAAWNTNKHYEGGNKAYRPLKKGGYCAVAPNDIAHDIRSEMCLLMEEMGLVIEAHHHEVATAGQNEIATKFNTLTLKADETQIYKYIVQNVAYEHGKTACFMPKPIINDNGSGMHCNMSLSKDGKNIFQGDKYAGLSETALYFIGGIIKHAKALNAFTNPSTNSYKRLVPGFEAPVLLAYSASNRSASIRIPAVTNPKAIRIEARFPDPLANPYLAFSALLMAGLDGIQNKLYPGDAMDKNLYDLPPEELKDIPAVASSLSEALDNLEKDYEFLTHGKVFSKEFIDTFIAMKRKEVERLNMTPHPVEFEMYYA

SEQ ID NO: 59999 - protein, 272 aa, Physcomitrella patens subsp. patens
MGLQQCEDLETCLAVAVDVAKKAGQIIKDGFHIAKAVEHKGMVDLVTETDKACEDLIFTQLKTSFPSHELIGEEESSESGIPLLTDAPTWVVDPLDGTTNFVHKFPFVCVSIGLVINKVSVVGVVYNPLLEELFTAIQGQGAFLNGERIYASSQEHIGNGLLATEIGTKRDKHTVDRTTNLINDMLYKVRSLRLSGSCAMNLVGVACGRLDMFYELGFGGPWDVAAGTLILREAGGLVYDPSGGEFDMMSHLIAASNGHLKQSLVDCLVDYL

SEQ ID NO: 60000 - protein, 455 aa, Wolbachia endosymbiont of Drosophila simulans
MGVYCEIFPSNISFETISKFNGFILSGGPQSVNDDCSETSRVVHEIIKLNEATSVPILGICYGQQLICHYFGAKVKESFKQEFGRTKIKILKESPIVKDTWDVNSEVDVLMNHADSVDTIPQGFTVIASGVINQTIAMIVNEQRKIYCTQFHPEVKPTTNGSKLLSNFLDIANCKRDWTMKSFIEEQKEKIKNVVGEKKVIAAVSGGVDSSVAAALTHKAIGKQLNCIFIDTGLLRKNQTIAMLKEIPINYVDKSNLFLSRLKGITDPEEKRKIIGNTFIEVFEEEAKKIGDVDFLMQGTIYSDVVESGHASDNTSTIKSHHNVGGLPEKMNLKLVEPLRYLFKDEVRLLGKEIGLSDEIIFQHPFPGPGLAVRIISEVDKEKVQILQEVDEIYINTMKNYDLYDKIWQAFAVLLPIKTVGVMGDGRTYGYVCALRAVTSSDGMTADAFPFEDKD

SEQ ID NO: 60001 - protein, 175 aa, Candida glabrata CBS 138
MGAAPSKIVETLLEDTNFDRDEIERLRKRFMKLDRDSSGSIDKNEFMSIPGVSANPLAGRIMEVFDADNSGDVDFQEFITGLSIFSGRGSKDEKLKFAFKIYDIDKDGLISNGELFIVLKIMVGSNLDDKQLQQIVDRTIMENDLDGDGQLSFEEFKSAIETTEVAKSLTLQYSV

SEQ ID NO: 60002 - protein, 268 aa, Haemophilus somnus 2336
MNPMLNIAIRAARKAGNIIVKGYERRDEIQTMQKGINDFVTNIDKASEAAIIEVVRKSYPEHTIITEESGAHEGQNNDIQWVIDPLDGTTNFVKGLPHFAVSIAVRVKGRTEIGVVYDPIRNELFTAVRGEGAKINELRLRVDSSKRDLQGAILATGFPFKKPSLMPTQFAMMSNLTENVADFRRAGSAALDLCYVAANRVDGYFEMGVKPWDITAGDLILREAGGLVCDFYGGHKYFTDSHIVAATPRLVKEILNKIQPCLAPDFKV

SEQ ID NO: 60003 - protein, 520 aa, Trametes versicolor
MSRFHSLLAFVVASLAAVAHAGIGPVADLTITNAAVSPDGFSRQAVVVNGGTPGPLITGNMGDRFQLNVIDNLTNHTMLKSTSIHWHGFFQKGTNWADGPAFINQCPISSGHSFLYDFQVPDQAGTFWYHSHLSTQYCDGLRGPFVVYDPNDPAADLYDVDNDDTVITLADWYHVAAKLGPAFPLGADATLINGKGRSPSTTTADLTVISVTPGKRYRFRLVSLSCDPNHTFSIDGHNMTIIETDSINTAPLVVDSIQIFAAQRYSFVLEANQAVDNYWIRANPSFGNVGFTGGINSAILRYDGAAAIEPTTTQTTSTEPLNEVNLHPLVATAVPGSPVAGGVDLAINMAFNFNGTNFFINGASFTPPTVPVLLQIISGAQNAQDLLPSGSVYSLPSNADIEISFPATAAAPGAPHPFHLHGHAFAVVRSAGSTVYNYDNPIFRDVVSTGTPAAGDNVTIRFRTDNPGPWFLHCHIDFHLEAGFAVVFAEDIPDVASANPVPQAWSDLCPTYDALDPSDQ

SEQ ID NO: 60004 - protein, 500 aa, Coccidioides immitis RS
MAKQYELPFQLDDPSLLHFDSFVNNEWVTAADGNRFEVVDPGTGKPWATCPTSTAKDVPSTVEAAHAAFEEYKKMNPRQKAMLLMKWDELIREARSDLAKILTHETGKPIPEALAEIDYALGFTWWFAGEAERIHGSISTPAAPNRRVFTIKQPIGVAAALVPWNFPIAMVLRKASAAFAAGCTMIVKPSPETPISTLVLGHLAKKAGYPPGVFNVLTTDLDSTPSLSEALCKHPLVKKVTFTGSTRIGKLIASHCAHGLKKLTLELGGNCPFIVFDDANLDQAISQLMTLKWRHAGQACITANRIYVQSGIYDKFVQLFKERTAALVVGHGAKESTTMGPVTTPRTLEKAANQVEDARKLGGKVILGGKPKTDCGGGYFFEPTIITDMTQEMLISREETFAPIAAVYKFDTEEEAVKWANDTSMGLASYAFTKNVDRMWRMLENLEAGMIGMNTGNSSAAESPFGGIKESGYGKESGKDVAVNEYLITKTGTFTLEGQY

SEQ ID NO: 60005 - protein, 472 aa, Pseudomonas fluorescens PfO-1
MSGQNSQSGELKRGLKNRHIQLIALGGAIGTGLFLGSAGVLKSAGPSMILGYAICGFIAFMIMRQLGEMIVEEPVAGSFSHFAHKYWGGFAGFLSGWNCWILYILVGMSELTAVGKYIHYWAPEIPSWVTAAAFFVLINAINLANVKVFGEAEFWFAIIKVVAIVGMIALGSYLLVSGHGGPQASVSNLWSHGGFFPNGVSGLVMAMAIIMFSFGGLEMLGFTAAEADKPKTVIPKAINQVIYRILIFYIGALVILLSLTPWDSLLETLNASGDSYSGSPFVQVFSMLGSNTAAHILNFVVLTAALSVYNSGTYCNSRMLLGMAEQGDAPKALAKIDKRGVPVRSILASAAVTLVAVLLNYLIPQHALELLMSLVVATLVINWAMISFSHFKFRQHMNKTHQKPLFKALWYPYGNYICLAFVLFILGVMLLIPGIQISVYAIPVWVVFMWICYVIKNKRGAQQALHAASAAK

SEQ ID NO: 60006 - protein, 339 aa, Ralstonia eutropha JMP134
MTRISLTRYLVEEQRKHNTIQPELRLLIEVVARACKAISNSVNKGALAGVLGSAGTGNVQGETQQKLDVIANEVLLDANEWGGHLAAMASEEMESFYEIPNRYPKGEYLLMFDPLDGSSNIDVNVSIGTIFSVLHMPKPGQTVTEADFLQPGTHQVAAGYAVYGPQTTLVLTVGNGVHVFTLDREAGSFVLTQSDVQIPEDTKEFAINMSNMRHWAPPVRKYIDECLAGDEGPRGKNFNMRWIASMVADVHRILTRGGIFMYPWDKREPEKAGKLRLMYEANPMAMLIEQAGGAATNGHIRILDVQPEKLHQRVSVILGSKNEVERVTRYHHEAAGQQG

SEQ ID NO: 60007 - protein, 406 aa, Pseudomonas putida GB-1
MAIEIKAPTFPESVADGTVATWHKKPGEAVKRDELIVDIETDKVVLEVLATADGVLGDIVKGEGDTVLSDEVLGSIVEGGAAAAPAAAAAPAAAPAAAAADAGEDDPVAAPAARKLAEENGIDLATVAGTGKGGRVTKEDVVAAVANKKSAPAAAPAAKPAAAAAPVVVAAGDRTEKRVPMTRLRAKIAERLVEAQSNMAMLTTFNEVDMTEVMALRSKYKDLFEKTHNGVRLGFMSFFVKAATEALKRFPAVNASIDGNDIVYHGFADVGVAVSSDRGLVVPVLRNAESMSLAEIENGIATFGKKARDGKLSIEEMTGGTFTITNGGTFGSMMSTPIVNPPQAAILGMHNIIQRPMAVNGQVVIRPMMYLALSYDHRLIDGKEAVTFLVTIKNLLEDPSRLLLDI

SEQ ID NO: 60008 - protein, 478 aa, Pseudomonas putida GB-1
MTQKFDVVVIGAGPGGYVAAIKAAQLGLKTACIEKYTDAEGKLALGGTCLNVGCIPSKALLDSSWKYKEAKESFNVHGISTGEVKMDVAAMVGRKAGIVKNLTGGVATLFKANGVTSIQGHGKLLAGKKVEVTKADGTTEVIEAENVILASGSRPIDIPPAPVDQNVIVDSTGALEFQTVPKRLGVIGAGVIGLELGSVWARLGAEVTVLEALDTFLMAADTAVSKEAQKTLTKQGLDIKLGARVTGSKVNGNEVEVTYTNAEGEQKITFDKLIVAVGRRPVTTDLLAADSGVTIDERGYIFVDDHCATSVPGVFAIGDVVRGMMLAHKASEEGIMVVERIKGHKAQMNYDLIPSVIYTHPEIAWVGKTEQALKAEGVEVNVGTFPFAASGRAMAANDTGGFVKVIADAKTDRVLGVHVIGPSAAELVQQGAIAMEFGTSAEDLGMMVFSHPTLSEALHEAALAVNGGAIHVANRKKR

SEQ ID NO: 60009 - protein, 388 aa, Pseudomonas putida GB-1
MNLHEYQGKQLFAEYGLPVSKGFAVDTPEAAAEACDKIGGSEWVVKAQVHAGGRGKAGGVKLVRSKEDAKAFAAQWLGKRLVTYQTDANGQPVTKILVESCTDIAKELYLGAVVDRSSRRIVFMASTEGGVDIEKVAHETPEKIIKATIDPLVGAQPFQGRELAFQLGLEGKQVAQFAKIFVGLAKLFKEHDLALLEVNPLVIKADGDLHCLDAKINIDANAMYRQPKLKTFHDPSQDDPREAHAASFELNYVALEGNIGCMVNGAGLAMGTMDIVNLHGGKPANFLDVGGGATKERVTEAFKIILSDSNVAAVLVNIFGGIVRCDMIAEGIIGAVKEVGVKVPVVVRLEGNNAELGAKVLAESGLNIIAATSLTDAAQQVVKAAEGK

SEQ ID NO: 60010 - protein, 575 aa, Haemophilus influenzae Rd KW20
MISGILASPGIAFGKALVLKEEKIVLDTQKITDDQIDAEVARFYEGRNAAVEQLNSIRERALISLGEEKAAIFEGHLMILEDEELEEEILDYLRSNKVNAGVAASKILDQQVTMLSEIDDEYLKERAGDIRDIANRLVKNILGMYIVDLGDIQEESILVAYDLTPSETAQLNLEKVLGVVTDIGGRTSHTSIMARSLELPAIVGTNKVTKLVNTGDYLILDAINNQVYINPTASQIDELKALEAKISEEKAELAKLKDLPAITLDGHKVDVVANIGTIRDCDGAERNGAEGIGLYRTEFLFMDREQLPTEEEQFIAYKQVVEAMNGRLTVIRTMDIGGDKELSYLDLPKEMNPFLGWRAIRIALDRREILNAQLRAVLRASAFGKLAVMFPMIISVEEIRELKAVIETLKAELREEGRLFDNNIQVGVMVETPSAAVNAKFLAKEVDFFSIGTNDLTQYTLAVDRGNEFISHLYNPMHPSVLGLIKQVIDASHAEGKWTGMCGELAGDERATLLLLGMGLDEFSMSAISVPRIKKLIRNVNFQDAKVLADTALQKPTAAEIDQLIEEFLLENSLN

SEQ ID NO: 60011 - protein, 359 aa, Arabidopsis thaliana
RVPITSLRSLRSTCKKWEASSKTNLVGGKATARKSSHVGFILIGDKICSMKLDLNGGDDFVDTSVNQVSAFDGFAISQLFHCDGLLFCISNNHYSNYTLMVCNMYLGETRLIQNRSLFESYQNFCSYAFGYDSSKNRNHKILRNNSVSGGYEIYSLKSDSWKDLNVDLEKSIHLWRLGSVSLKGNAYFRVIKVIEEGVWEYNLLCFDFTRESFGKLLSLPFESLGDEGEGIMVISCVRDDHLAVLYQRDTLGIWISTEIEPNKVSWREFLQVDLATLDGFPDVFIAGRFIVDEEKQVVVVFGQETELDLNHGNAFIFGRDGYFTSFTVGDAPPEDFTSYVPSLVSLQIDKTGKRKARDD

SEQ ID NO: 60012 - protein, 413 aa, Chromobacterium violaceum ATCC 12472
MMMNKTVCVVGLGYIGLPTAALLASNGYKVVGVDLNQHAVDTINQGNVHIVEPDLDGYVRSAVATGMLKAFVTPQSGDVYMICVPTPFHEGGGIPQPNIDHVLAATRSIAPFVKEGDLVILESTSPVGTTEKMAEVLAESGVDVGKIHIAYCPERVLPGKIMVELVENDRIVGGLTPEATSAVATFYRSFVSGEVLETNSKTAEMCKLTENSFRDVNIAFANELSLICAKENIDVWKLISLANRHPRVNILQPGVGVGGHCIAVDPWFIVARDPENARLIRSAREVNNSKTDWVVDRIKAEIADAHVKLGRAPRVACLGLAFKPDIDDLRESPAVQVVDAILRAGHDVIVVEPNIREHSEYVLIDLDSALDVADLIVVLVRHKQFLDHAVNQRLLSLNIHDYCGLRAANKISR

SEQ ID NO: 60013 - protein, 549 aa, Geobacillus stearothermophilus
MLTFHRIIRKGWMFLLAFLLTALLFCPTGQPAKAAAPFNGTMMQYFEWYLPDDGTLWTKVANEANNLSSLGITALWLPPAYKGTSRSDVGYGVYDLYDLGEFNQKGAVRTKYGTKAQYLQAIQAAHAAGMQVYADVVFDHKGGADGTEWVDAVEVNPSDRNQEISGTYQIQAWTKFDFPGRGNTYSSFKWRWYHFDGVDWDESRKLSRIYKFRGIGKAWDWEVDTENGNYDYLMYADLDMDHPQVVTELKSWGKWYVNTTNIDGFPLDAVKHIKFSFFPDWVSDVRSQTAKPLFTVGEYGSYDINKFHNYFMKTNGTMSLFDAPLHNKFYNAPKSGGTFDMRTLMTNTLMKDQPTLAVTFVDNHDTEPAQAPQSWVVPWFKPLAYAFILTRQEGYPCVFYGDYYGIPQYNIPSLKSKIDPLLIARRDYAYGTQHDYLDHSDIIGWTREGVTEKPGSGLAALITDGPGGSKWMYVGKQHAGKVFYDLTGNRSDTVTINSDGWGEFKVNGGSVSVWVPRKTTVSTITRPITTRPWTGEFVRWTEPRLVAWP

SEQ ID NO: 60014 - protein, 598 aa, Streptomyces avermitilis MA-4680
MTTPTSDIRSGIPSDLPEAGTVRLVDHLAGELARAGVTHMFGVGGANIEDLYDAVHRGRAVHGVVAKHEFSAVTMADGYARTTGRLGVVAATSGGGAMNLVPGLAEAYASRVPVLALVGQPPTGQEGHGAFQDSSGRAGSFDAREVFTPVSRFCARVENADSLTELLPRAMAAAQAHPRGPAVLLLPKDVQQARIQVPGRGATPTPGMPEPEPTAEAAWLDSAVLTAVSDTLRGAGRVLVIAGEDVAAADARAELAELAGRLGAWVAVTPDAKDVFDNRDPRFAGVAGVMGHANVEECLRRADVCLLAGTRLPLLARGGLDRALAATEVVCLGPEPPFVAGTALGGNLRDALRAVTGRLPPRPRACPEHAGPLPTPTPSPVSQARGRPIPYAQAVAAVEAALPQDAHVFVDAGNAGASAVHLLPAPRHGRFVVAVGMGGMGYTFGAGIGAALATGRRTYVLAGDGSFFMHGMEVHTAVEYAAPVTFVVFNNNAHAMCAVREEFLQGGVRSDDLFARTDLAAGVAAAFPSLEVTGADDAAQLRQALLRSNAGGGPAFVALDCDPGEIPPFLPFQSFTEATENATENKESPVERGIVHVG

SEQ ID NO: 60015 - protein, 785 aa, Pyrobaculum aerophilum str. IM2
MDKKEKTSPLRRPAESLLVVVPALLAMFAIALYARMYRVFLWGWWLDEFDPYIRYYLAKYTLQHGVGWWWSGAHFTQFWYPYGVDWGKVLLPGTSFYGLFVHSILAPFGVDLWHAVIAAPAIMNALAVFSAFYLGYRIGGQLGVANGGIRVGLITALLVAIMPAYIERGLSAWFDDEPISLFLIPLGLALLIDGLKRPWAGALAGAALGYIAWTWGAHFYLWNLVGLYALVLPTYYYLKLVFTRSQRAARKGRQQTPQPLELPFSARNLFLSYLLFYVVYALFVATIPRYGVESLISAFNILPTFGLVVTATVWLLDKLLGAARTVELLRRYVWIILALALAGVLVFITAVAMGLIGGKFLATLLPFGRSAIVASVAEHSTTQFYQILIRYGPVLPFIIASVPYLFTPGGLIALSYLLTASYAAATMVRLLVLLAPIAAVTAAIGIVKLLDSKRLGFLALAASTISLVILLVSAFSVASQPTQIVTSAVGFVSDDFLDALMWLKTRLPPYEPVASWWDYGYWISVVGNKTSLADNSTINATQIGKIGLGMMAPPEIGASIFTKQFKTKYILAIMPYSTYRITLQTQLVPVLVHDYPPGGDFLKSYWMTRIALENVKEAASILGASPGMSPDDFIYTRVMSYPGPPPGSYAYFTIEGNYYPVPLNLNRTLYAMLFSKVRFFPIYGNNTQYLSWIFEGVEQGGAFTSFRRLQLTGGNVYLPVDATQRLQGITTYVIQGWTLRGVDVVIDPLTGRTENIPFITAQTGPLRLVYVSRPNGWVVVYQITT

SEQ ID NO: 60016 - protein, 503 aa, Acidobacteria bacterium Ellin345
MDLLATKPLDVLMSEASETGEHSLKRALGPVNLMMLGVGAIIGAGIFVLTGAAAAQFAGPAIVFSYILAGIACVFAGLCYAEFASLIPIAGSAYTYGYATLGEIFAWIIGWDLVLEYAFGAATVASGWSSTLVAFLQDYGVSLPPRICDVHGSIWVQYQGRWSPLATVQSVLDTAHIDYHTLPNVVCIFNLIAFLAILAVTTLLVIGIKESANFNTGVVFVKLFAVLVFIGVAGAFVIKNPTVAQANWHPFLAFGWAGVIRAAGVVFFAYIGFDAVSTAAQEAKNPQRDMPIGILGSLIICTVLYILVSGLLTGVVHYDRLNIGAPVSLAIRETGRKWGSYIVNAGALAGLSTVMLVMLLGQSRVFYSMAHDGLLWKWAGEIHPKLRTPWKSTIVVGICVAFFGATIPIGDLGTLVSIGTLLAFVIVCAGIMILRKRRPDLPRPFKTPLVPLVPILGILTSLLMMVFLPLVTWIRLVVWLLIGFIIYFTYGRKHSKVQAMQKK

SEQ ID NO: 60017 - protein, 371 aa, Oryza sativa Indica Group
MNTTAKLLALAVFAAAAILSLDSRSDVRQLEIRDGDVELIPLLDGAAGPESIVFGDAGDGPYTSVSDGRILKWLPPPERRWVEHSCSVPELLDSCRGSKDTKREQECGRPLGLKFNSKTGELYVADAYLGLRVVSPGENVSRPLVPKRTGSPFSFSNGVEIDHETGVIYFTETSTRFQRREFLNIVITSDNTGRLLKYDPKENKVEVLVDGLRFPNGLAMSIDGSYLLLAETTTGKILRYWIKTPKASTIEEVAQLPGFPDNIKMSPRGGFWVGLHAKRGKIAEWSISYPWLRKLILKLPAQRIQRITSFLTGFGRQVIALRLSEDGKTIEAMSVHGDVRKLFKSISEVEEKDGNLWIGSVLSPFLGLYRI

SEQ ID NO: 60018 - protein, 522 aa, Ipomoea batatas
MAAATIGALSSPYTGGVGERIDGDVSKASFRRLSFASSHLSGDKLMPLPPRRLRSGGKSSEVRTAPFIVSPKAVSDSQNSQTCLDPDASRSVLGIILGGGAGTRLYPLTKKRAKPAVPLGANYRLIDIPVSNCLNSNISKIYVLTQFNSASLNRHLSRAYASNMGGYKNEGFVEVLAAQQSPENPNWFQGTADAVRQYLWLFEEHNVLEFLVLAGDHLYRMDYERFIQAHRETDADITVAALPMDEKRATAFGLMKIDEEGRIIEFAEKPKGEQLKAMKVDTTILGLDDQRAKEMPYIASMGIYVVSKDVMVNLLRQKFPGANDFGSEVIPGATSIGLRVQAYLFDGYWEDIGTIEAFYNANLGITKKPVPDFSFYDRSAPIYTQPRYLPPSKMLDADVTDSVIGEGCVIKNCKIHHSVVGLRSCISEGAIIEDTLLMGADYYETDADRRLLAAKGSVPIGIGRNSHIKRAIIDKNARIGNDVKIINNDNVQEAARETEGYFIKSGIVTIIKDALIPSGTII

SEQ ID NO: 60019 - protein, 455 aa, Bacillus cereus E33L
MSVSSIVNKQKAYFYNGYTRSVEVRKNNLKKLYEGIQRFEEEIFQALKLDLNKSAHESFTTEVGYVLKEISFQLKHISSWSKPKRVRTALTHFGSKGKVVPEPYGVTLIIAPWNYPFQLAIAPLVGALAAGNTIVLKPSELTPNVSKVLTRMLGELFQEELVAVVEGGVEESTALLKEPFDYIFFTGSVGVGKVVMEAAAKQLTPLTLELGGKSPCIVHEDAKIDVTARRIVWGKFLNAGQTCVAPDYMYVHASVKEQLIEALRHEIEEQYGKEPLHNDNYVRIVSERHFERLCMFLKDGKTVIGGNYKKETLHIEPTVVTNITWQDAVMEDEIFGPILPIIEYDNIEDVIGTIQQHPKPLALYVFSEDKEVQKKVTSNISYGGGCVNDVVYHLATPYLPFGGVGSSGLGSYHGEESFRTFSHYKSILAQSTAFDMKIRYSSTKSALKFIRKLLK

SEQ ID NO: 60020 - protein, 399 aa, Desulfovibrio vulgaris subsp. vulgaris str. Hildenborough
MSDVFRVSRRVQQIRISATKLMPMLAARVGGCVSLGQGVPSFRTPEHIVEAVCRALRDKADAGRYTLQPGMPALREAIAADLAARKGYMVNPDSEVGVTVGAMEALLMALLTVVDRGDEVIIPSPGYASHAEQVLMAEGVPVHVPLRADDWGLDVDAIRAAVTPRTRAVIVCNPGNPTGTVYDDADVRALCELALERNIMLISDETYDYMVYGGGEPLSPASLPEMRRHVIVVNSFSKKYALTGWRVGYCAADAAWMGELLKVHDAAAICAPAVSQYAALAALTGPQDCVDDMRAALSARRNLACARLDAMAPHFDYVQPRGAFYIMARYTFTDAPSDMVARRLLEEGRVITVPGASFGPTGERHLRLSFGMEEAELDEAFDRMAAWTQRVVASGGLGG

SEQ ID NO: 60021 - protein, 636 aa, Haemophilus somnus 2336
MKKEKTLDLICLGRVAVDLYAQQIGSRLEDVSSFAKYLGGSSGNVAYGTAVQGVKSSMLARVGDEHMGRFLREELQRLGVDTSHLITDKERLTALVILGIKDQDTFPLIFYRDNCADMAITADDFDEEYIASAKALAITGTHLSHPKTRHAVLTALEYAGRNGTKRLLDIDYRPVLWGLTSLGDGETRFIDSEAVTQSLQEVLHHFDVLVGTEEEFHIAGGSTDTLTALKNVRKVSNATLVCKRGALGCSVFEGDIPNHIDGGINVYGVRVEVLNVLGAGDAFMSGLLRGYINGESWEQCCRYANACGALVVSRHGCAPAMPTKEELDNYLSRAESVPRPDLDEQLNHLHRVTTRKQQWHDLCIFAFDHRKQLVDMAEKCGADLKRIPTLKTLLLKAAEQTAQKEGIYNGNAGVLADTTFGQEALNEITGKKWWIGRPIEMPSSRPLRLEHGDLGSQLISWPAEHVVKCLAFYHPADKAELKADQDATLKEVYRACCRTGHELLLEIILPADMEQKESYYTDMIAHFYSLGIKPDWWKLPGVSAKTWADISQVIEKNDKHCRGILILGLDAPEAVFENVFKASANAPLVKGFAVGRTIFGQPSADWLAGKIDDEQLIKETSERYRRLIKLWKNRKN

SEQ ID NO: 60022 - protein, 120 aa, Desulfovibrio vulgaris subsp. vulgaris str. Hildenborough
MSKLIMSVDDSASIRQMVGFTLRNAGYEVIEASDGKDALGKLSGPVKMVITDLNMPNMDGIELIRRIRATPAYKFIPVVMLTTESQAARKQEGKAAGATGWIVKPFKPEQLLAVVQKLLG

SEQ ID NO: 60023 - protein, 142 aa, Brassica napus
RGGPRRPEKEEKLLLVNFFFSSAVVVTARVKATMGVPLTAWKSSFAFPVTRRATTAIPSIVGTGGGVNCLQVWPPIGKKKFGTFFYFPDLTEVEWGKEVDYFFRTRWIPGVEFKLEHGFVARGHGSTPGYYDGRYWPMWKLP

SEQ ID NO: 60024 - protein, 341 aa, Pseudomonas putida GB-1
MTEQQPVAVLGGGSFGTAVANLLAENGVPVRQWMRDPAQAEAMRVNRENPRYLKGIRLHDGVEPVNDLLATLQASELVFVALPSSALRSVLAPHAELLRGKGLVSLTKGIEAQSFKLMSQILEEIAPQARIGVLSGPNLSREIAEHALTATVVASEDEKLCQQVQAVLHGRTFRVYASADRFGVELGGALKNVYAIIAGMAVALGMGENTKSMLITRALAEMTRFAVSQGANPMTFLGLAGVGDLIVTCSSPKSRNYQVGYALGEGHSLEEAVNRLGEVAEGVNTLKVLKAKAQEVQVYMPLVAGLHAILFEGRTLNQVIEHLMRAEPKTDVDFISISGFN

SEQ ID NO: 60025 - protein, 567 aa, Triticum aestivum
  misc_feature (204)..(204): Xaa can be any naturally occurring amino acid
NSPLNRGLSRSLDLTSLYKKAGWYRSGIPWISSPRPSRDRSPQTTEQSAMDKAYIAVLSFAFLFLLHYILGKKSNGSKGAVQLPPSPPAIPFFGHLHLVEKPLHAALCRLGARYGPVFSLRLGARNAVVVSSPACARECFTEHDVAFANRPQFPSQMLVSYGGTSLVSSSYGPHWRNLRRVAAVRLLSAHRVAGMSGVIAAEVXAPWRARLCRAAAASTGGGAARVELKRSLFELSLSVLMETIAQTKGTRPEADGDTDMSLEAQEFKQVVDEIIPLIGAANVWDYLPVMRWFDVSGVRSRILATVSRRDAFLHRLIDAERRRMDEGGAGDEGEKKSMIAVLLTLQKTEPELYTDQMIIALCANLFVAGTETTSTTIEWAMSLLLNHPAALKKAQAEMDASIGASRMVAADDVPRLSYLQCIINETLRLYPAAPLLLPHESSADCKVGGYDVPSGTMLIVNAYAIHRDPAVWEDPAAFRPERFEDGKADGLLLMPFGMGRRRCPGETLALQTVGVVLGTLVQCFDWDRVDGAEVDMTEGVGITMPKAVALEAVCRPRAAMGDVLQKL

SEQ ID NO: 60026 - protein, 461 aa, Arabidopsis thaliana
MGKENAVSGNSIPIHGRPVTRALASALRASSKLITSSEVAATTQNQGRVLRAKSKRTALDEKKANAPKKRAVLKDITNVTCENSYTSCFSVAVENIKQIKKGRQSSSSSKVASSSATSQVTDAKVEVVSNSAGASLSVFTDTSLGTNETSYSIIAKPSSRSPPRPFGTVERSCGGASSPKFVDIDSDDKDPLLCSLYAPDIYYNLRVAELKRRPFPDFMEKTQRDVTETMRGILVDWLVEVSEEYTLVPDTLYLTVYLIDWFLHGNYVERQRLQLLGITCMLIASKYEEIHAPRIEEFCFITDNTYTRDQVLEMESQVLKHFSFQIYTPTSKTFLRRFLRAAQVSFPNQSLEMEFLANYLTELTLMDYPFLKFLPSIIAASAVFLAKWTLNQSSHPWNPTLEHYTTYKASDLKASVHALQDLQLNTKGCSLNSIRMKYRQDKFKSVAVFSSGELPDKLFIS

SEQ ID NO: 60027 - protein, 326 aa, Triticum aestivum
  misc_feature (151)..(151): Xaa can be any naturally occurring amino acid
  misc_feature (158)..(158): Xaa can be any naturally occurring amino acid
  misc_feature (246)..(246): Xaa can be any naturally occurring amino acid
  misc_feature (261)..(261): Xaa can be any naturally occurring amino acid
  misc_feature (283)..(283): Xaa can be any naturally occurring amino acid
ATHASETSSRSAAAAQASPTHPRPSLSPPILPQHAPPDGPPPFPPRHPRRPPAHLLRAALYRRTWAAWPSGPREDDQGRGMPLRRQPGSESGGGGGVIPWKLTDSPLVRGDGSVCNAKSFGASGTQVGEVVFNTSLTGYQEILTDPSYAGXYVLMTNXPHIGNTGVNSGDEQSIKCFLGGLIIRNLSICTSNWRCTETLDEYLRKRNFLGLYQLDTLAITRRLRDDGSPIGVLSTGQLPKDEGLLXIAQNWKIVGVDLVTXVTSEAPYEWVHKTRSGCDFSRXQFNETFISVVFDFDQNPTICHAWHYLGPQTRCPTKRTDQHILY

SEQ ID NO: 60028 - protein, 249 aa, Arabidopsis thaliana
  misc_feature (131)..(131): Xaa can be any naturally occurring amino acid
  misc_feature (165)..(165): Xaa can be any naturally occurring amino acid
  misc_feature (195)..(195): Xaa can be any naturally occurring amino acid
MASLSFVSSSHLTLRTPSIALRSTGSSPRTSVSFSVKAQSVALSQDDLKKLAAEKAVEAIKPGMVLGLGTGSTAAFAVDQIGKLLSSGELYDIVGIPTSKRTEEQARSLGIPLVGLDTHPRIDLAIDGADXGLGGSGLAMPVEVVQFCWNFNLIRLQDLFREFGXGSKVRGDGRASLRGLKQEGQYLFYFNTPLXDRFPPAKEIGNFQGLVEHGLFLGMATSVIIAGKNGGERRGQREVKSSMGFLLGE

SEQ ID NO: 60029 - protein, 399 aa, Bacteroides fragilis YCH46
MPTISIRGTEMPASPIRKLAPLADAAKQRGIHVFHLNIGQPDLPTPQAAIDAIRNIDRKVLEYSPSAGYRSYREKLVGYYEKFNINLTADDIIITTGGSEAVLFSFMSCLNPGDEIIVPEPAYANYMAFAISAGAKIRTIATTIEEGFSLPKVEKFEELINERTKGILICNPNNPTGYLYTRREMNQIRDLVKKYDLFLFSDEVYREFIYTGSPYISACHLEGIENNVVLIDSVSKRYSECGIRIGALITKNKEVRDAVMKFCQARLSPPLIGQIAAEASLDAPEEYSRETYDEYVERRKCLIDGLNRIPGVYSPIPMGAFYTVAKLPVDDSDKFCAWCLSEFEYEGQTVFMAPASGFYTTPGSGKNEVRIAYVLKKEDLTRALFVLQKALEAYPGRTE

SEQ ID NO: 60030 - protein, 261 aa, Alteromonadales bacterium TW-7
MSAIIKTPEEIEKMRVAGRLAADVLEMIGPHVVPGITTDELNTICHDYIVNEQKAVPAPLNYHGFPKSICTSVNHVICHGIPNDKPLKEGDSVNIDITVIKDGYHGDTSKMFHVGKPNIQGKRLAEVTQESLYLAIKMVKPGVRLGDIGEAIQKYAESFNYSIVREYCGHGIGSEFHEEPQVMHYGKAGTGETLKAGMCLTIEPMVNAGKRQCKLLKDEWTVVTRDRSLSAQWEHTLLVTENGVEILTLRSDDTIDRIIEH

SEQ ID NO: 60031 - protein, 194 aa, Escherichia coli
ADERPGKINLGIGVYKDETGKTPVLTSVKKAEQYLLENETTKNYLGIDGIPEFGRCTQELLFGKGSALINDKRARTAQTPGGTGALRVAADFLAKNTSVKRVWVSNPSWPNHKSVFNSAGLEVREYAYYDAENHTLDFDALINSLNEAQAGDVVLFHGCCHNPTGIDPTLEQWQTLAQLSVEKGWLPLFDFAYQ

SEQ ID NO: 60032 - protein, 115 aa, Oryza sativa Indica Group
MAVAIEAPFHVLAVDDSLPDRKLIERLLKTSSFQVTTVDSGSKALEFLGLHDHEDSPISTQSDQQEVAVNLIITDYCMPGMTGYDLLKKIKESSYLRDIPVVIMSSDNIPSRINR

SEQ ID NO: 60033 - protein, 295 aa, Listeria monocytogenes str. 4b F2365
MRVKKAVIPAAGLGTRFLPATKAMPKEILPIVDKPTIQYIVEEAVASGIEDILIVTGKGKRAIEDHFDSVPELENNLREKNKLELLHLVEQTTNINLHFIRQAKPKGLGDAILQAKGFVGNEPFIVMLGDDIVESKIPCSKQLMNQYEKTHSSVIGVQTVPHEETYRYGIIDPINEYDKNLYNVKGFVEKPDPANAPSDLAILGRYLLTPQIFDFLETQKPGAGGEIQLTDAINSLNEVQRVFAYDFEGQRFDVGDKFGFIQTTMQFALKHPEIKDDVKDLINDLYNQIHKKDKK

SEQ ID NO: 60034 - protein, 174 aa, Ammopiptanthus mongolicus
MISSPAVTTVKASMGAPFTGLKSMASFPVPRKVNSDITTIANNGGRVQCMLVWPPLGRKKFETLSYLPPLSIESLTKEVEYLLRKGWVPCLEFELEHGFVYRENNRSPGYYDGRYWTMWKLPMFGCSDASQVMKELEECKKEYPTAFVRIIGFDNKRQVQCISFIAYKPPGFEN

SEQ ID NO: 60035 - protein, 227 aa, Oryza sativa Indica Group
MAAEMEADDVDVHEVPECIASMIDRGSVESHRLFLARRTAMEMLRDRGYSVPEAEIARTPPEFRAWWAEKPGIERLAFTTTLVSDPSKKVQLVFCPPEPVKIATIREIYLQTKEENLSRLVLILQSKILSRAREAIKEIFKFKVDIFQATDLLVNITKHVLKPKHEVLSADQKAKLLKEYNVEDSQLPRMLETDAVARYYGFDKGTVVKVIYDGELTGKRVAYRCVF

SEQ ID NO: 60036 - protein, 673 aa, Candida glabrata CBS 138
MEVRQVKHSRDDTEAEGAKRRKMPYDEQIQMLAEEEEEDTMKRDMGDALATSTESQSGVSVLPRDNFQRYCYRHNPEIQTSNTHELCYKQDMQRIKMINNKISQLACPKEQADIHHIISKYTNSNDKVRKLILDGILTSSCFPQLSYIAQHINTMIKIDFISVLPQELSLKILGYLDCQSLCNASMVCKNWHLLADDDRVWYHMCEQHIDRKCPNCGWGLPLLHMKRARVCYIKAKNPNTTVNDRKMIQDNDNRISPLTDRTQGNESPGATFSTNVCTTASNNTVSGSKSSGQGQQENGRCRQKSWKMVYRERFKVESNWRKGLCTIQEFKGHMDGVLTLQFNYRLLFTGSYDTTVAIWDLFTGKLIRRLTGHSDGVKTLYFDDQKLITGSLDKTIRVWNYITGECISTYRGHTDSVMSVDSHKKIIVSGSADKTVKVWHVESRTCYTLKGHTEWVNCVKLHPKSFSCYSCSDDTTIRMWDIRTNTCLRVFRGHVGQVQKVIPLTIIDAQNLVTHERKPGEEDDIASNGTGEDDPENGVNGQRELDKKMPYPTHLLSCALDNTIKLWEVRSGRCIRTQFGHVEGVWDIAADNFRIISGSHDGSIKIWDLQSGKCMHTFHGRKLKGSDVNTSSNPDHDERTKSAPVACVCIGDSECFSGDEFGCVKMYKFDSQD

SEQ ID NO: 60037 - protein, 344 aa, Triticum aestivum
GTRAHSAGYYDDETGAFNELLLISGKAMQVWVDYESDSTQISVFLAPLKNGAKPSTPLVSAKSNLSKVLVEPAYAGFSSSTGTVRSRHYLLGWSFAMDGPAPPIDIGSLPKLPFVGAKPRSKVPDIVLPIATAAFVLGVVAVVILLVRRRSRYAEVREEWEVEFGPHRFTYKDLFRATEGFKNKTLLGFGGFGRVYKGALPKSKLEVAVKKVSHESRQGIKEFVAEVVTIGRLRHRNLVQLLGYCRRKGELLLVYDYMSNGSLDKYLYSGSKEKPALDWAQRFRIIKGVASGLLYMHEDFEQVIIHRDIKASNVLLDADMNGRLGDFGLARLYCSIAFPISQAI

SEQ ID NO: 60038 - protein, 201 aa, Caulobacter crescentus CB15
MARGEQQRGEGGQRRDRRDRNAPEERVDSDIVEKLVHINRVAATVKGGRRFSFAALMVVGDQKGRVGFGHGKAREVPEAIRKATEEAKKTMIRVPLRESRTLHHDGAGRWGAGKVMMRAAPPGTGVIAGGPMRAVLETLGVQDVVAKSTGSSNPYNMVRATFEALKVQSSPRQIAAKRGKKVGDILGRRADGASAPEAIEG

SEQ ID NO: 60039 - protein, 251 aa, Bacillus cereus E33L
MKTTENFTDKADIYAKYRPSYPNKYIEYLLSANELNENQIVADIGSGTGIFSRQLLESGLHVIGVEPNDDMRKMAEQSLNQYPRFQSIKATAEHTTLKENSVDLVTVAQAFHWFDKEAFKIECQRILKQKANVALVWNSRDVTSPLIKENAEICQKTCPTFKGFSGGIDETPEVFNSFFKDGKYEFKEYQNDLLFDYESFLGRNLSASYAPKENDEQYKNFIFLLSELFEKYSKNGKIVLPNLTRSYMGNV

SEQ ID NO: 60040 - protein, 265 aa, Candida glabrata CBS 138
MTSVPVKKALTTLLRDPGNASCADCKSQSHPRWASWSLGVFICIKCAGVHRSLGTHISKVKSVDLDTWKEEHLKELVQMRNNVNANRVYEAKLPDSSKFNGKSLGNDINLLQEFIRQKYERKRWMDSSVDLSRDQPVVSQANSSSSSLVSTMSSSNESTNNTVAVEEKLKPQSTHSSSLLNLQGRKEIVENKRPARPTQQDTPQRNDLKKSILSLYSSANASKSNNNSTMNVSSGMGMTTPFNTTPQNNSSLSIDDDELFKNVWS

SEQ ID NO: 60041 - protein, 393 aa, Mycobacterium tuberculosis H37Rv
MSGEDSIRSFPVPDLGEGLQEVTVTCWSVAVGDDVEINQTLCSVETAKAEVEIPSPYAGRIVELGGAEGDVLKVGAELVRIDTGPTAVAQPNGEGAVPTLVGYGADTAIETSRRTSRPLAAPVVRKLAKELAVDLAALQRGSGAGGVITRADVLAAARGGVGAGPDVRPVHGVHARMAEKMTLSHKEIPTAKASVEVICAELLRLRDRFVSAAPEITPFALTLRLLVIALKHNVILNSTWVDSGEGPQVHVHRGVHLGFGAATERGLLVPVVTDAQDKNTRELASRVAELITGAREGTLTPAELRGSTFTVSNFGALGVDDGVPVINHPEAAILGLGAIKPRPVVVGGEVVARPTMTLTCVFDHRVVDGAQVAQFMCELRDLIESPETALLDL

SEQ ID NO: 60042 - protein, 415 aa, Hevea brasiliensis
MAESWVIMVTAQTPTNIAVIKYWGKRDEKLILPVNDSISVTLDPAHLCTTTTVAVSPSFAQDRMWLNGKEISLSGGRYQNCLREIRARACDVEDKERGIKISKKDWEKLYVHIASYNNFPTAAGLASSAAGFACLVFALAKLMNAKEDNSELSAIARQGSGSACRSLFGGFVKWKMGKVEDGSDSLAVQVVDEKHWDDLVIIIAVVSSRQKETSSTTGMRETVETSLLLQHRAKEIVPKRIVQMEESIKNRNFASFAHLTCADSNQFHAVCMDTCPPIFYMNDTSHRIISCVEKWNRSVGTPQVAYTFDAGPNAVLIAHNRKAAAQLLQKLLFYFPPNSDTELNSYVLGDKSILKDAGIEDLKDVEALPPPPEIKDAPRYKGDVSYFICTRPGQGPVLLSDESQALLSPETGLPK

SEQ ID NO: 60043 - protein, 211 aa, Bifidobacterium longum DJO10A
MDKQSSPKSSLFDGWNAPPNLVTYSRIVLVVFFLTLDILAGAWGENNLTMRWVAAVLFIIAASTDKIDGWMARKYNQVTEMGKLMDPIADKLLTCGAMIVCSAFGELGWWVTILFLIREIGITVMRFFVMERPGGKVIAAAWPGKLKTVFQCVGLSMLLLPFWSLGNGQATPFWMTAYYFLTYAIIYVALVLCLYSGAVYLYNTFVAPKRK

SEQ ID NO: 60044 - protein, 529 aa, Mycobacterium tuberculosis H37Rv
MTTPSIAIAPSFADEHRRLVAELNNKLAAAALGGNERARKRHVSRGKLLPRERVDRLLDPGSPFLELAPLAAGGMYGDESPGAGIITGIGRVSGRQCVIVANDATVKGGTYYPMTVKKHLRAQEVALQNMLPCIYLVDSGGAFLPRQDEVFPDREHFGRIFYNQATMSAKGIPQVAAVLGSCTAGGAYVPAMSDEAVIVREQGTIFLGGPPLVKAATGEIVSAEELGGGDLHSRTSGVTDHLADDDEDALRIVRAIADTFGPCEPAQWDVRRSVEPKYPQAELYDVVPPDPRVPYDVHEVVVRIVDGSEFSEFKAKYGKTLVTAFARVHGHPVGIVANNGVLFSESALKGAHFIELCDKRKIPLLFLQNIAGFMVGRDYEAGGIAKHGAKMVTAVACARVPKLTVVIGGSYGAGNYSMCGRAYSPRFLWMWPNARISVMGGEQAASVLATVRGEQLSAAGTPWSPDEEEAFKAPIRAQYEDQGNPYYSTARLWDDGIIDPADTRTVVGLALSLCAHAPLDQVGYGVFRM

SEQ ID NO: 60045 - protein, 576 aa, Arabidopsis thaliana
MEGSKLLPCVHKSPVPTSHQLYINYEILGLTKLKKHKYTQNKMSSSDSSSAESRLATAKTVLTTAASVAATAMLARSLVQDYLPDEVHHYISYGFRSIFGYFSSQMTIIIEEFEGFAHNEVFEAAEAYLATKISPSNKRIKVSKHEKENNYNVTVERDEEVVDTYNGVKFQWILHCRHVESKHFHNPRDLNSTLRSEVRSFELNFHKKFKDVALESYLPFMVKRATLMKQEKKTLKIFTLSPENMYGNYSDAWTSVTLDHPSTFKTLAMDSDVKTSVMEDLDKFVKRRDFYKRVGKAWKRGYLLYGPPGTGKSSLIAAMANHLNFDIYDLELTAVNNNSELRRLLIATANRSILIVEDIDCSLELKDRTSDEPPRESDDIEDPRYKKVTLSGLLNFIDGLWSSCGDERIIIFTTNYKEKLDAALLRPGRMDMHIHMSYCTPSTFKALALNYLEIKEHRLFSKIEEGIEATEVTPAEVAEQLMRNDSVDKVLEGLIEFLKVKKIENEQDKAKTEKQELENKKKTKEGTDSVVKKEVDEQLVRNDRVDKVLEGLVELLKAKKIEDDQDKAKHEEVEQH

SEQ ID NO: 60046 - protein, 234 aa, Glycine max
  misc_feature (185)..(185): Xaa can be any naturally occurring amino acid
  misc_feature (190)..(190): Xaa can be any naturally occurring amino acid
FLSMTRLRRLGAAVGAAMATAYGGAILVSTPVSASDHSVGGSHLAAVREKIHDPFAVVPAREVQRSALTGASAANPLDMLVIGGGATGSGVALDAVTRGLRVGLVEREDFSSGTSSRSTKLIHGGVRYLEKAVFKLDYGQLKLVFHALEERKQLIDNAPHLCHALPCMTPCFDWFEVVYYWMGLXMYDLXAGARLLHLSRYYSCKESVELFPTLGKGGKGRSLRGTVVYYDGAD

SEQ ID NO: 60047 - protein, 451 aa, Bacillus sp. SG-1
MVKTGQSQENLLSQDEQFIWHSMKPYNPSGTMVVEESKGSWVTDHNGDKYLDGMAGLWCVNVGYGRQELAEAAYEQLKKMAYFPLTQSHQPAIQLAEKLNKMLGDEYVIFFSNSGSEANETAFKIARQYHQQKGEGSRYKIISRYRAYHGNSMGALAATGQAQRKYKYEPLAPGFIHVPPPDSYRDEVTEGDSLNLPGVKAIDQAMTWELSETVAAMIMEPIITGGGVLVPQEGYMKAAKEVCDKHGALLIVDEVICGFGRTGKPFGFMNYDVKPDIITMAKGITSAYLPLSATAVKREIYEAFKGSEEYDYFRHINTFGGNPAACALAMKNIEIMENEKLFERSAELGEKALNTLQSKLQQHKVVGNVRGKGLLIGIELVSDKATREPLPVDQVNKVIGYCKSKGVLIGKNGATVAGFNNVLTISPPLNIELEDLEFLLNTVCDGVNSLS

SEQ ID NO: 60048 - protein, 297 aa, Dechloromonas aromatica RCB
MSIKPFAEWMAVTQDRAESALGRFLPGPDCIPARLHEAMRYATLGGGKRVRPLLAHAAGELTGATPEALDIVGCAVEMIHAYSLVHDDLPCMDDDVLRRGRPTCHVEFDEPTALLVGDSLQTMAFELLASQPLGEPKQQLEIIALLAHASGSRGMAGGQAIDLASVGKPLTQPELELMHALKTGALIRAAVLLGALAGQPLSADERTSLDRFAKRAGLLFQVVDDILDCTASTATLGKTAGKDEAADKPTYVALLGLDAARTYADELRADARDALSIFGERASRLNQLADFICHRQF

SEQ ID NO: 60049 - protein, 488 aa, Bacillus sp. SG-1
MSVIKEEVAVLKNYIDGKWVESLSSQTLEVVNPATNKELARVPISTKEDVDRAVSAAKKASKTWRNVPVPKRARYLYKYHALISENHEELAKLVVQENGKSYKEAYGEVQRGLECVEFACGAPTLMMGETLSGIAEDIDSEMFRYPLGVVGGITPFNFPMMVPLWMFPLAVACGNTFVLKPSERTPILANRLAELFTEAGVPDGVLNVVHGAHDVVNGLLEHKDIAAISFVGSQPVAKYVYEQAASQGKRVQALSGAKNHHVVMPDADYNKAAEHIISSAFGSAGQRCMACSAVVVVGDNEQFVQALNKKADELGIGNGMDDEVLLTPVIRQENRERTLKYIEKGLEEGASLIRDGRKEMDDFKEGNFLGATIFDHVTPAMTIAREEMFAPVLSLLRAKDLDEGLEYIRQSRFGNGATIYTKDAKAVRQFREEADAGMLGINVGVPATMAFFPFSGWKDSFYGDMHVNGKDGVNFFTRKKMITSRFDF

SEQ ID NO: 60050 - protein, 350 aa, Desulfovibrio vulgaris subsp. vulgaris str. Hildenborough
MTTMRGRLPLSTRIYRLRNRFGSVWPLLIGQVSLLCVFICATLGYMYIEGWSAFDSFYMVVITLSTIGFGEVHPLSSQGRLLTTLVVFAGVGNFAFIIGAFSQLLVDGKLYRYMGRRRVLKAIAKLRDHCIVCGYGRIGSVVAKELMEEGVALVVIENDPAMIEALETEGILHLAGDATNDELLQAAGIERARALVAALSLDSANVYVVLSAHQINPSMTIVARASEPSHIGKLKLAGADRVFLPHHLGGLRMAQSILRPTVTSFIELAHTRSDLSIQMEELEIGDDSVLVGKTLIESGIRPQYNLIIIGVKRPDGTMHFNPESTYTLQARDTLIAVGFPENFKQFQEIL

SEQ ID NO: 60051 - protein, 618 aa, Dechloromonas aromatica RCB
MTASRLLETINSPADLRRLDRKQLPQLASELRAFLIDSVSKTGGHLSSNLGTVELTIALHAVFNTPEDRLVWDVGHQCYAHKVLTGRREGMSTLRMHGGVSGFPKRAESPYDTFGVGHSSTSISAALGMALAAKHKGEDRKAIAIIGDGAMSAGMAFEAMNNAGVADADMLVILNDNEMSISPPVGALNNILTRLTSSKTYNVAREAGRHMLGFAPPLLELARRAEEHVKGMIAPGTLFEEFGFHYYGPIDGHDLDALIPTLENLKKLKGPKFLHVITKKGQGYKLAENDPILYHGVGKFAACDGIQSAKGPAKLTYTQVFGDWLCDMAKADSRLVGITPAMREGSGMVRFSAEHADRYFDVGIAEQHAVTFAAGLACEGLKPVVAIYSTFLQRGYDQLVHDVALQNLPVIFAVDRGGLVGADGPTHHGTFDLSFVTCIPNMTVMAPADEAECRKMLSTAMTIDGPSMVRYPRGSGTGTIPEAKLDTLPVGKGDIRRRGKDIALLAFGSLVAAAVAAGEELDATVANMRFIKPLDADLIVELAGNHSLLVSIEENAVIGGAGSEIERVLAERGLQVPVLRLGLPDRFIDHGEQGQLLAELGLDKEGIVRAVRARTNPQ

SEQ ID NO: 60052 - protein, 428 aa, Shigella flexneri 2a str. 2457T
MKLYNLKDHNEQVSFAQAVTQGLGKNQGLFFPHDLPEFSLTEIDEMLKLDFVTRSAKILSAFIGDEIPQEILEERVRAAFAFPAPVANVESDVGCLELFHGPTLAFKDFGGRFMAQMLTHIADDKPVTILTATSGDTGAAVAHAFYGLPNVKVVILYPRGKISPLQEKLFCTLGGNIETVAIDGDFDACQALVKQAFDDEELKVALGLNSANSINISRLLAQICYYFEAVAQLPQEARNQLVVSVPSGNFGDLTAGLLAKSFGLPVKRFIAATNVNDTVPRFLHDGQWSPKATQATLSNAMDVSQPNNWPRVEELFRRKIWQLKELGYAAVDDETTQQTMRELKELGYTSEPHAAVAYRALRDQLNPGEYGLFLGTAHPAKFKESVEAILGETLDLPKELAERADLPLLSHNLPADFSALRKLMMNHQ

SEQ ID NO: 60053 - protein, 518 aa, Treponema pallidum subsp. pallidum str. Nichols
MTSVQNVVSDAKTCDVPVESEPEARTYRPHALLQEEACQRLAQLQGKELKMKDRTQIPLQRMRMLPPKKRSLLMQEAALGFTEQQALVESQRCLNCKTKPCVKGCPVGVPIPEFIACVQRGAFKEAVDIIKTTSLLPAICGRVCPHERQCQLQCTVGKMFKDVSKAVSIGALERFVADWERQHGQITVPYCAPSTHKKVAVIGSGPAGLAVASDTARAGHSVTVFEALHKPGGVVTYGIPEFRLPKEVVVTEIETLKKMGVTFRMNFLVGRTATLEQLFSQYGFDAVFIGTGAGLPRFMNIEGEELCGVFAANDYLTRATLMKAYDTAHADTPVYAAKSVVVVGGGNVAVDSSRTALRLGAEQVHCLYRKTRADMTACVEEIAQAEDEGVTFHFLCQTTRILGDEEGNVRAVVFRDCQEQIDAGERVFLPCGDAECKLAADAVIVAVGNGSNPLMAKTTRSLAVSERGTIVVDEDQRTSIPGVWAGGDIVLGAATVIRAMGQGRRAAASINAYLAQKA

SEQ ID NO: 60054 - protein, 282 aa, Streptococcus pneumoniae R6
MKIAYLGPKGSFSHHVVQTAFPHEELQAFANITDVIKAYEQGLVNYSVVPVENSIEGSVHETLDYLFHQAHIQAVAEIVQPIHQQLMVVPGHTKIEKIFSHPQALAQGKKFIDEQYPEAQIEVTASTAYAARFISEHPDQPFAAVAPRSSAEEYGLELIAEDIQEMEANFTRFWVLGAEKPSIPLQAQTEKMSLALTLPDNLPGALYKALSTFAWRGIDLTKIESRPLKTALGEYFFIIDVDYTDKDLVHFAQKELEAIGIQYKILGAYPIYPISDHGKERR

SEQ ID NO: 60055 - protein, 290 aa, Brassica napus
  misc_feature (143)..(143): Xaa can be any naturally occurring amino acid
  misc_feature (229)..(229): Xaa can be any naturally occurring amino acid
MKIEGNPFGSSHQRNQIFLKFVAFFLLVGLTYRLIITDSTDSPIAQVRTSPDPPGLTASVAQAPAPVYSPVNITTAASENASTKCDIFSGNWVPDPSGPVYTNTSCRHIQEHQNCLKNGRPDSNYLLWRWKPRDCDLPRFDPXEHFLDRMRNKWWALIGDSISRNHVQSLLCILSQVEEVEEIYHDQEYRSKIWRFPSHNFTLSVGWSPFLLKADVFENSQGVSFSDIXLHLDTLDPKWTHQYVNFDYVVLSGGKWLLKTSIFHENHTVTGCHYCQGKINLTELGYEYSY

SEQ ID NO: 60056 - protein, 365 aa, Clostridium difficile 630
MKLGIVGLPNVGKSTLFNAITQAGAESANYPFCTIDPNVGVVSVPDERLNKLQELYNSEKIVPTAIEFCDIAGLVRGASKGEGLGNKFLSHIREVDAIVHVVRCFEDENVVHVDGSVDPLRDIETINLELIFSDIEILERRINKTQKAAKADKTLGSELDLLKSIMSTLEESKCVRTMEFTEDEQTFVNSLDLLTSKPVIYASNVSEDDLADNGENNKYVQQVKAFAETEDAEVVVVCAQIEAEISELDSAEEKKEFLETLGLEQSGLDKLIKSSYALLGLISFLTAGPKEVRAWTIKVGSKAPQAGGKIHSDIERGFIRAETIAFNDLVEHGTMAAAKEKGLVKLEGKEYIVKDGDVILFRFNV

SEQ ID NO: 60057 - protein, 196 aa, Escherichia coli
RADERPGKINLGIGVYKDETGKTPVLTSVKKAEQYLLENETTKNYLGIDGIPEFGRCTQELLFGKGSALINDKRARTAQTPGGTGALRVAADFLAKNTSVKRVWVSNPSWPNHKSVFNSAGLEVREYAYYDAENHTLDFDALINSLNEAQAGDVVLFHGCCHNPTGIDPTLEQWQTLAQLSVEKGWLPLFDFAYQG

SEQ ID NO: 60058 - protein, 388 aa, Glycine max
SYVGPPPIEPRITFDLTNAGLQQINQLGRLKHLSLVRSQEFQITYFRRVNDLGLLLMADKCANMESICLGGFCRVTDTGFKTILHSCTRLYKLKVTHGTHLTDLVFHDISATSLTLTHVSLRRCNLLTNHAVLSLASNKVLKILDLRDCRSLGDEALQAIGTLPRLKILLLDGSDITDAGLLYLRPSVISSLYALSLRGCKRLTDKCITALFNGCCVLELRELDLSNLPNLSDNGVLLLAKSQIPFFELRMRQCPLIGDTSVMALASMLVDEAKHGSSLRLLDLFNCGGITPLAFRWLKKPYFPRLKWLGVTGSVNRDMVDALARSRPFLHVACHGEELGADPYGTSDGLYTHDYDDVDEFEQWLLEADIDSDYEEMGDAENNDEMVM

SEQ ID NO: 60059 - protein, 419 aa, Arabidopsis thaliana
MATEKWVFMVTAQTPTNIAVIKYWGKRDEVRILPVNDSISVTLDPDHLCTVTTVAVSPAFDRDRMWLNGKEISLSGSRYQNCLREIRGRAGDVEDMEKGIKIRKKDWEKLNLHIASHNNFPTAAGLASSAAGFACLVFSLAKLMNVDEDPSHLSAIARQGSGSACRSLFGGFVKWTMGSKEDGSDSVAVQLADEKHWDDLVIIIAVVSSRQKETSSTSGMRESVETSLLLQHRAKEVVPKRILQMEEAIKNRDFASFTQLTCTDSNQFHAVCLDTSPPIFYMNDTSHRIISLVEKWNRSEGTPQVAYTFDAGPNAVLIARNRKVAVQLLQGLLYYFPPKSDTDMKSYVVGDNSILKEAGLDGASGVENLQPPPEIKDNIGSQDQKGEVSYFICTRPGKGPIVLHDQTQALLDPETGLPK

SEQ ID NO: 60060 - protein, 424 aa, Vitis vinifera
MTSVLDAPVDMKCYESLLFVAAGSSVSTIDLRTMQRVMTTSCGTEDGLVWFRDFTDATCPVSSSHEDKSSSKFWDPVSERGIGTSGLSGLRDSSEQQLNQAVTINQSVSLNGASLLPYDCQRLPGLVLGFVSSSTSLSPTTESKYNEKTEIKDAGTVESKLGVVAADDGRCSGIGAFMLRKGGLAVNAEVATAWRVGIFNPMASGIGGRAFMIVQSSSTLKSEAFGMRETAPLVAPQNMYENNPRAKYLGTLAMGVLKEIAGLRDAGLKHGRLVWRSLFQPAIRLAKYGYMLQMGSCYKQGISRLEMYEVDNMKRLRSSPQRDLDSNAGTVMRPLIAAVTAAGGDASYVIDGVLRMRETSIGDLVTGLKQLGADVNGFLGTNCSPVRVNGNGGLPGGKMKLFESKSILDCFAYGSCFGSRRYGD

SEQ ID NO: 60061 - protein, 191 aa, Shigella flexneri
ERPGKINLGIGVYKDETGKTPVLTSVKKAEQYLLENETTKNYLGIDGILEFGRCTQELLFGKGSALINDKRARTAQTPGGTGALRVAADFLAKNTSVKRVWVSNPSWPNHKSVFNSAGLEVREYAYYDAENHTLDFDALINSLNEAQAGDVVLFHGCCHNPTGIDPTLEQWQTLAQLSVEKGWLPLFDFAY

SEQ ID NO: 60062 - protein, 772 aa, Burkholderia xenovorans LB400
MTKQSGTTSFREAALDYHEFPTPGKIAIAPTKQMINQRDLALAYSPGVAFACEEIVGNPLNAARFTARSNLVGVVTNGTAVLGLGNIGPLASKPVMEGKAVLFKKFAGIDVFDIELNESDPHKLVDVIAALEPTFGGINLEDIKAPDCFIVERECRKRMKIPVFHDDQHGTAIVVAAAITNGLKVVGKDIREVKLVSSGAGAAALACLDLLVDIGLPLENITVTDLAGVVYKGRVELMDPDKERFARETDARTLAEAIGGADVFLGLSAGGVLKQDMVKQMADKPLILALANPTPEILPELALEVRPDAVLCTGRTDYPNQVNNVLVFPFLFRGALDAGATTVTREMEIAAVNAIAELARQEQSDIVATAYGIQDLSFGPEYLIPKPFDPRLIVKVAPAVAQAAMDSGVAERPIEDMDAYEQHLQQFVYHSGTTMKPIFQLARSVEPEKKRIVFAEGEEERVLRAMQIIVDEKLAKPILIGRPAVIEQRIARYGLRLVAGQDYTVVNTDHDERYRDFWQEYHRMMSRKGISAQMAKLEMRRRTTLIGAMLVEKGEADGMICGTVSTTHRHLHFIDQVIGRKAGAKVYAAMNALVLPNRQIFLVDTHVNVDPTPEQLAEITIMAAEEVRRFGIEPKVALLSHSNFGTSNAPTAQKMRDTLAILRERAPDLQVDGEMHGDIALDANLRREVMPDSTLEGDANLLVLPNIDAANISYNLLKTAAGNNIAIGPILLGAARPVHVLTASATVRRIVNMTALLVADVIAFPKQAKPGT

SEQ ID NO: 60063 - protein, 514 aa, Listeria monocytogenes str. 4b F2365
MKDFTEQEKIIVLDFGSQYNQLITRRIREFGVYSELHPHTITVEEMKALNPTGIIFSGGPNSVYDEDAFRADERIFDMGIPILGICYGMQLMTTHFGGKVERAKDREYGKADIHVEKPNRLFAGLPTDQVVWMSHGDLVVEEPAGFEVTITSKSCPIAGIADEERSLYGVQFHPEVRHSVYGNELLKNFALNVCGCKGDWTMENFSEVEIAKIQEIVGDKKVLLALSGGVDSSVVGVLIHKAIGDQLTCIFVDHGLLRKGEADQVMATLQGEFNMNIIKVDAKKRFMDKLAGVSDPEQKRKIIGNEFIYVFDDEANKLDGVEFLAQGTLYTDIIESGTATAQTIKSHHNVGGLPEDMQFKLIEPLNTLFKDEVRALGTELGMPDAIVWRQPFPGPGLGIRVLGEITEEKLEIVRDSDYILREEIKNAGLEREIWQYFTALPNIRSVGVMGDGRTYDHTVVVRAVTSIDGMTADWARIPWDVLEKISVRIVNEVDHVNRVVYDITSKPPATVEWE

SEQ ID NO: 60064 - protein, 390 aa, Streptococcus pneumoniae R6
MVVMNRIRVSKRVEKKLAKGLVLLEASDLENVNLKDQEVEVQGQEGNFLGTAYLSQQNKGLGWFVSKDKVAFNQAFFETLFRKAKEKRSAYYQDDLTTAYRLFNQEGDGFGGLTVDLYGDYAVFSWYNSYVYQIRQTISEAFRQVFPEVLGDYEKIRFKGLDYESAHVYGQEAPDFFTVLENGVLYQVFMNDGLMTGIFLDQHEVRGSLVDGLAMGKSLLNMFSYTAAFSVAAAMGGASQTTSVDLAKRSRELSQAHFQANGLSTDEHRFIVMDVFEYFKYAKRKNLTYDVIVLDPPSFARNKKQTFSVAKDYHKLISQSLEILNPGGIIIASTNAANVSRQKFTEQIDKGFAGRSYQILNKYGLPADFAYNKKDESSNYLKVISMKVSK

SEQ ID NO: 60065 - protein, 183 aa, Shigella boydii
PGKINLGIGVYKDETGKTPVLTSVKKAEQYLLENETTKNYLGIDGIPEFGRCTQELLFGKGSALINDKRARMAQTPGGTGALRVAADFLAKNTSVKRVWVSNPSWPNHKSVFNSAGLEVREYAYYDAENHTLDFDALINSLNEAQAGDVVLFHGCCHNPTGIDPTLEQWQTLAQLSVEKGWLP

SEQ ID NO: 60066 - protein, 190 aa, Shigella flexneri
RPGKINLGIGVYKDETGKTPVLTSVKKAEQYLLENETTKNYLGIDGILEFGRCTQELLFGKGSALINDKRARTAQTPGGTGALRVAADFLAKNTSVKRVWVSNPSWPNHKSVFNSAGLEVREYAYYDAENHTLDFDALINSLNEAQAGDVVLFHGCCHNPTGIDPTLEQWQTLAQLSVEKGWLPLFDFAY

SEQ ID NO: 60067 - protein, 329 aa, Kluyveromyces lactis NRRL Y-1140
MVKVAINGFGRIGRLVLRIALQRKALEVVAVNDPFISVDYAAYMFKYDSTHGRYKGEVTTSGNDLVIDGHKIAVFQEKDPANLPWGKLGVDIVIDSTGVFKELDSAQKHLDAGAKKVVITAPSKTAPMFVVGVNEDKYNGETIVSNASCTTNCLAPIAKIINDEFGIDEALMTTVHSITATQKTVDGPSHKDWRGGRTASGNIIPSSTGAAKAVGKVLPELQGKLTGMAFRVPTVDVSVVDLTVKLAKEATYDEIKAAVKKASQGKLKNVVGYTEDSVVSSDFLGDTHSTIFDASAGIQLSPKFVKVVAWYDNEYGYSERVVDLVEHVA

SEQ ID NO: 60068 - protein, 350 aa, Kluyveromyces lactis NRRL Y-1140
MAASIPETQKGVIFYENGGELQYKDIPVPKPKANELLINVKYSGVCHTDLHAWKGDWPLPTKLPLVGGHEGAGVVVAMGENVKGWKIGDFAGIKWLNGSCMSCEYCELSNESNCPEADLSGYTHDGSFQQYATADAVQAAKIPVGTDLAEVAPVLCAGVTVYKALKSANLKAGDWVAISGAAGGLGSLAVQYAKAMGYRVLGIDAGEEKAKLFKDLGGEYFIDFTKSKNIPEEVIEATKGGAHGVINVSVSEFAIEQSTNYVRSNGTVVLVGLPRDAKCKSDVFNQVVKSISIVGSYVGNRADTREAIDFFSRGLVKAPIHVVGLSELPSIYEKMEKGAIVGRYVVDTSK

SEQ ID NO: 60069 - protein, 268 aa, Zea mays
MAADERDRERWILPGATALVTGGSKGIGHAIVEELAALGARVHTCSRNAAELEECRRRWAEKGGGRLLQQVTVSVCDVAVRADREALMATVRDVFGGKLDILVNNAAQVVFKPAVECTGEEYARIMATNLESCFHLSQLAHPLLRNASLAGGGSVVHISSTAGLLGFPGAVLYSTAKGGVNQLTRSLAAEWACDKIRVNSVAPGIVMTDMVKNAASSEAVEQETSRIPLRRAGEPAEVASVVSFLCMPAAAYVTGQVIYVDGGRTISA

SEQ ID NO: 60070 - protein, 198 aa, Cupriavidus necator
MNDTEIELIDSARLPTRFGDFTAHAFKGADSGIEHLALSVGDVTGDGVLIRMHSECLTGDVFGSCRCDCGPQLELAMEKIAAEGRGILLYLRGHESRGIGLAEKIRAYRLQDGGLDTVDANLALGQAIDARNYAFAADLLHQWGVKSVRLMSNNPLKAAALEKAGITVTEQLRHIVPSNAENEKYLATKRTRMGHLLD

SEQ ID NO: 60071 - protein, 419 aa, Bacillus cereus E33L
MIEIKVPELAESITEGTISQWLINVGDKVEKGGSVVELETDKVNVEIIAEDSGIVSKLLGEPGDTVEVGATIAILDANGAPVAVSTPAPAAEQPKQETAEAPKAAAPSAEQTATLQGLPNTNRPIASPAARKMARELGIDLNDVRSTDPLGRVRPHDVQAHAAAPKEAPAAPKSPAPAPVAKTEFEKPVERVKMSRRRQTIAKRLVEVQQTSAMLTTFNEVDMTAIMELRKERKDAFEKKHDVRLGFMSFFTKAVVAALKQFPLLNAEIQGDELIIKKFYDIGIAVAAPDGLVVPVVRDANQLNFAEIESEIRELGKKARDNKLSLKELQGGTFTITNGGVFGSLMSTPILNSPQVGILGMHKIQVRPVAIDAERMENRPMMYIALSYDHRIVDGKEAVSFLVAVKDMLEDPKSLLLEG

SEQ ID NO: 60072 - protein, 343 aa, Desulfovibrio vulgaris subsp. vulgaris str. Hildenborough
MRAEPLPPNGRKVAIIGAGPSGLAATGYLACMGYQVEVYDKLPGAGGLMVFGIPGHRIPADRIQRGVHILERQYGTIFHTRTKICCSAPLHEEEGDHFSCDIRGLGELVEGYDAVMICTGSWKSRKLGIPGEALPGVYSGLEFLFPIRAVRYATTNVSLPDVAGRIVAVVGAGHSAVDVVHSAHALGAEKVYMVYRRTRREAPCGSFEIDRIEEAGGTWLERCTPTGIVGDGKVEGLELRDSETGETSVLPVDVVVTAIGEIPTPPFQKELGLENVRKGEVRWLHMTSIENVFVAGDVLTGPSKIGKAVYSGLRAARSLANWLDLRAQHRESEYNYDADVIHR

SEQ ID NO: 60073 - protein, 976 aa, Pseudomonas putida GB-1
MSSPQHPPASPALATLIQRSGLPSPSLSETQAHAVLQKHYGIAGNLTALGSQQDLNFRVTTPQGGFVLKACHGSYAQLELEAQHAALAFLRNQGLPVPAVRPALDDQGLLTLDLDGQPLRIRLLEYIEGQPLTRLKHMAPRLMAELGGLCAKLDKALVDFDHPGLARTLQWDPQHAQALIQHLLPVLQNTEQRARIEQATQLAAEHLAPLVNQLPSQAVHLDITDDNTVWARDGERQWQLQGVIDFGDLLHTWRIADLSVTCAALLHHAGGDPLRILPAISAYQALNPLTEAEVRALWPLVLNRAAVLVLSSAQQLAVDPGNQYTRDNVAHEWEIFDTATAVPFALMEAAILQAAGLQPKAPDLSGCAPLLPELAGQAVTRVDLGVLSTYCEAGNWEQPGFDQHLLTLQAAPACSLHGQYRLSQTHIDRPEEPATCALGVELHVANGSQVQAPETGIWQRHGDGRGCLRTTHWALWLQGLEDAPADGQAVEKGQSLGRSCGFLSVQLCLDNGVQPSFFATPSQAAAWLALCPSPAALLGFDCDADPLPDPQALLARRDASFARSQKHYYAQPPHIERGWRNYLIDMQGRSYLDMLNNVAVLGHGHPRMAAESARQWSLLNTNSRFHYAAITEFSERLLDLAPDGFDRVFMVNSGTEANDLAIRLAWAYSGGRDLLSVLEAYHGWSVATDAISTSIADNPQALETRPDWVHPVEAPNTFRGRFRGADSAADYLQDVDAKLAALDARGRQLAGIICEPVYGNAGGISLPAGYLRDAYAKVRARGGVCIADEVQVGYGRLGEYFWGFEEQGVVPDIITMAKGMGNGQPLGVVITRREIAEALEAEGYFFSSAGGSPVSCRIGMAVLDVMQEEGLWDNARDTGRYFKARLQALVDKYPLAGAAHGSGFYLGLELVRDRATLEPATEETMTLCNRLRDLGIFMQPTGDYLNILKIKPPMCTSRASVDYFVDCIDRVLGEGL

SEQ ID NO: 60074 - protein, 444 aa, Alteromonadales bacterium TW-7
MSVQIASLSERLSQYQQNIKPYTPAVAGILTRVVGLTLEAKGLRAPVGSQCKIETMNGFVDAEIVGFNDQTLYLMPNDHISGVLPGARVIPQVNNLGLPVGMSLLGRVVDGLGRPLDGLGKINAEHYLKFAQNTINPLARRPISQPMDVGVRAINSVITVGQGQRMGLFAGSGVGKSVLLGMMTRGSEADVIVVGLVGERGREVKEFIEEILGEEGRKRSVVVAAPADSSPLMRLKGCESAVTIAEYFRDQGLNVLLLLDSVTRYAMAQREIALAVGEPPATKGYPPSVFAKLPALVERAGNGGEGQGAITAFFTVLSEGDDMQDPIADAARAILDGHIVLSRELADSGHYPAIDIEKSISRVMPQVVSEPHMQQARVLKQVYSMYQQNKDMITLGAYQKGTDPMLDQAINMMPRVNGFLQQGMRDVISYDDGLQGLAQLLGQG

SEQ ID NO: 60075 - protein, 163 aa, Dechloromonas aromatica RCB
MRHIISILIENESGALSRVAGLFSARGYNIDTLTVAPTEDPSLSRMTILTRGSDEVLEQITKQLNKLVDVVKVVDLSEAAHVERELMLIKVRATGKDREEMKRMADIFRGRIIDVTESTYVIELTGASSKLDSFIAALDAGLILETVRTGVCGIGRGDRILKV

SEQ ID NO: 60076 - protein, 901 aa, Treponema pallidum subsp. pallidum str. Nichols
MNIAKSIHFLSNKEALDKRLDRGLLGIRGRQADELSSLGLPVLPSVVIDATVSRSLYGEKLRSALSPYLRKFTLLNRKEYADAKNPMLLKVVLSPNLAISNYPVLHNFGLTRDTFAGFAERVGEHFATHEVFFLLKGVFGVLLGIAESEENTKGASEFVETLKEIEVFLQGGKSSPSGREAMNRYRALLPDGFFDDAYVQLEEAVRLVSKLLSFEEDGEDGVAILIQPMVYGNYGGGSYSGRFFSRNIITGEKKLQGQYFEERFDECDAEGSDVNAIKPAYLKQLQDIAWKLEDHSREIREVRFTIEAGSLWLIEQKPVEAKSTISLVRLLLDLYEREVVDAEYVVKSVKPGQLNEILHPVIDMTSVTGLKSSQGGIIGVPGAAVGRVYFTADSLIEAWRVAKMGGQDTRCILCMPATYAGDVKAIEVATGVLSNEGGYSAHASVVARQYGKISLVRPDMKIYSDKAVVDGMTINEGDFVTLNVPYYGESTLYMGAAQLIEPDPETSGLVSFIELAKGFVRSFHVRANADSPHDAELALAFGAQGIGLCRTEHMFFKEDRINVFRRMIFSENAEERTGSLKQLQKMQGEDFYGIFKVMQGHEVTIRLLDAPLHEFLPHGESEVSKFLEYLEKVCGKGLSREELQERISMLSEVNPMLGHRGCRIAISYPEIYAMQVRAVFEAVYRLQKEKISVYPEIMIPIVMNCRELKQIVYGKKIEGHAYQGIGSIEEEVRLALKAKEVDYKVGAMIELPAAALSADEIARYAQFFSFGTNDLTQTTLGLSRDDFNTFMPDYTMYDLVDGNPFAILDARVRELIEVAMQRGRLARPDIQLGLCGEHGSRSENIRFCMEVGLDYVSCSSYSVPIALLAIAQAEIENAEKEGRKPAWRGRSSAKSGGRRAR

SEQ ID NO: 60077 - protein, 140 aa, Brassica napus
MPRVISNETLGCPPIRTLTFDSLGLIKVTEARGKERGTPTVVNTWGEMNASRCVLAASMDDRLNNPLLAVARKDGNVEVLNPCNGDLHFAYSVFGDNEISGLHLFRKQKEDQTEKSCTLLTCTKKGDVSLRTVQFPDARA

SEQ ID NO: 60078 - protein, 748 aa, Bacteroides fragilis YCH46
MTIEEIKNQVLQGTAISREQAGWLALYPRKEELYDAAHDITTACASQEFDMCSIINARSGRCPENCKWCAQSSHYKTKADVYDLVSAEECLRQAKYNEAQGVNRFSLVTSGRKPSPKNMKELCVAVRRMRRHSSIRLCASLGLLDEEELQALYDAGVTRYHCNLETAPSHFDSLCTTHTQEQKLKTLYAARRVGMDLCCGGIIGMGETVEQRIEFAFTLRDLNIQSIPINLLQPIPGTPLEHQSPLSEEEILTTVALFRFINPAAYLRFAGGRSQLTPEAVRKSLYIGINSAIVGDLLTTLGSKVSDDKEMILSEGYHFADSQFDREHLWHPYTSTSNPLPVYKVKRADGATITLESGQTLIEGMSSWWCAVHGYNHPILNQAVQDQLSRMSHVMFGGLTHDPAIELGKLLLPLVPPSMQKIFYADSGSVAVEVALKMAVQYWYAAGKPEKNNFVTIRNGYHGDTWNAMSVCDPVTGMHSIFGSALPIRHFLPAPSSRFGDEWNPEDIRPLEHLLEKHADELAAFILEPIVQGAGGMRFYHPEYLREAARLCHRYGVLLIFDEIATGFGRTGKLFAWEHAGVEPDIMCIGKALTGGYMTLSAVLTTNEVADCISNHAPGAFMHGPTFMGNPLACAVACASVRLLLTSGWQENVKRIEAQLNRELAPARELPQVADVRVLGAIGVIEMKEPVNMAYLQRRFVEEGIWLRPFGKLIYVMPPFIITPEQLTKLTEGMIRIISNGLPGSQTK

SEQ ID NO: 60079 - protein, 680 aa, Clostridium difficile 630
MSILVTLLGLLVCTTISTVFSKKWSNIPLAIYQIVLGIILSILPFKFSFSFNPEIFVICIIAPLLFSEGQNVSRKELLELRKPILLLAFGLVLITVFAGGIFIHFLIPGMPLSVSFALAAVISPTDLVAVKSITQGLNFPKNMMSILEGESLLNDAAGVVAFKVAVLATVTGVFSIEEAGIQFMITAFGGIIVGSILGYIIIKIRLSLHKWNLEEIPMVIVIQIMTPLFVYFVAEEIGVSGILAVVMAGIAHGIEKEHLQNTTTKLRIISDNTWYVLEYVLNGFVFTLLGFLLPSIYTGLSSKNENMALELTFISTLIVLILFVIRFIWVYLWHNSFIKPKKNPLNNFFVGFLGFKDEEVVKESISKCKYSLIVATCGVHGTFTLATALSIPFYLADKDVFPMRDTVLFISSEVILISLVLATVLLPRLLKNNVQESEPLLSDKEAYKLILKEAILKLSNEKAQEVQPVIHDLNEQLVDSEKGILNTPDNKLISMMIAEADQQGLLAVLKLLEDGKISDRAFKLYRFYITKSRKSVQKSIFKIVKLKISMWIINRKVKKEVKEKITKIVSENKEIIKEFHHAYALSTKTAISFINKNTDEDNRHEALIAIRFYNRYLNWITRKIQNDDKFEARVEYYRVMAIQSQRDSVQQLVETKQISREVAKELLENILYDEMMMIES

SEQ ID NO: 60080 - protein, 615 aa, Arabidopsis thaliana
MQQNQVKKGTKEMEFFTEYGDANRYRILEVIGKGSYGVVCAAIDTHTGEKVAIKKINDVFEHISDALRILREVKLLRLLRHPDIVEIKSIMLPPSKREFKDIYVVFELMESDLHQVIKANDDLTREHHQFFLYQMLRALKFMHTANVYHRDLKPKNILANANCKLKVCDFGLARVAFNDTPTTVFWTDYVATRWYRAPELCGSFFSKYTPAIDVWSIGCIFAEVLTGKPLFPGKSVVHQLELITDLLGTPKSETISGVRNDKARKYLTEMRKKNPVTFSQKFSKADPLALRLLQRLLAFDPKDRPTPAEALADPYFKGLSKIEREPSSQQISKMEFEFERRRLTKDDIRELIYREILEYHPQLLKDYMSGSEGSNFVYPSAIGHLRQQFTYLEENSSRNGPVIPLERKHASLPRSTVHSTVVHSTSQPNLGATDSRRVSFEPSKNGASSAGHPSTSAYPTKSIGPPPRVPPSGRPGRVVESSVSYENGRNLKEAYFRSAVSSPHCYFRPNTMTNPENRNIEASSFPPKPQNPVHQFSPTEPPAATTNQADVETMNHPNPYFQPQLPKTDQLNNNTHMAIDAKLLQAQSQFGPAGAAAVAVAAHRNIGTISYSAAS

SEQ ID NO: 60081 - protein, 230 aa, Chlamydophila pneumoniae
MEPSTNKPDCKKIFDSIASKYDRTNTILSLGMHHFWNRSLIQILGSGYSLLDLCAGTGKVAKRYIAAHPQASVTLVDFSSAMLDIAKQHLPQGSCSFIHSDINQLPLENHSYPLAAMAYGLRNLSDPHKALQEISRVLMPSGKLGILELTPPKKTHPTYSAHKLYLRAVVPWIGKSVSKDPDAYSYLSKSIQQLPKDHDLEDLFSKSGFYIAKKKKLFLGAATIWLLEKQ

SEQ ID NO: 60082 - protein, 195 aa, Shigella boydii
RADERPGKINLGIGVYKDETGKTPVLTSVKKAEQYLLENETTKNYLGIDGIPEFGRCTQELLFGKGSALINDKRARTAQTPGGTGALRVAADFLAKNTSVKRVWVSNPSWPNHKSVFNSAGLEVREYAYYDAENHTLDFDALINSLNEAQAGDVVLFHGCCHNPTGIDPTLEQWQTLAQLSVEKGWLPLFDFAYQ

SEQ ID NO: 60083 - protein, 439 aa, Desulfovibrio vulgaris subsp. vulgaris str. Hildenborough
MALFTKEEALRYHACGHPGKVETVPVKPCATQRHLSMAYTPGVADACRAIHADAAEGYAYTNKGNLVAVVSNGTAVLGLGDIGPLAGKPVMEGKGVLFKVFADVDVYDLCIEQKDPAKIIEFVRMLEPTFGGINLEDIKAPECFEIEQTLIREMDIPVFHDDQHGTAIISGAGLIAALELAGKKAEEVKVVVSGAGAGAIACTNFFMALGVRRENVYMFDSRGLLHKGRAGLNAAKLAFAQERDHGSLADVMRGADVFLGLSVGGMVTPDMVASMAANPIVFACANPDPEIAYPDAKAVRDDLIMATGRSDYPNQINNVLGFPFIFRGALDVQARTINEEMKMAAARALAALAKEPVPAEALAPYGLASASFGVDYIIPKALDPRVIEWVAPAVAEAAMRTGVARRVIDLDAYRVELRERMKAARARIGAFIDSYGLDF

SEQ ID NO: 60084 - protein, 473 aa, Bacillus caldotenax
MTRGRVIQVMGPVVDVKFENGHLPAIYNALKIQHKARNENEVDIDLTLEVALHLGDDTVRTIAMASTDGLIRGMEVIDTGAPISVPVGEVTLGRVFNVLGEPIDLEGDIPADARRDPIHRPAPKFEELATEVEILETGIKVVDLLAPYIKGGKIGLFGGAGVGKTVLIQELIHNIAQEHGGISVFAGVGERTREGNDLYHEMKDSGVISKTAMVFGQMNEPPGARMRVALTGLTMAEYFRDEQGQDVLLFIDNIFRFTQAGSEVSALLGRMPSAVGYQPTLATEMGQLQERITSTAKGSTTSIQAIYVPADDYTDPAPATTFSHLDATTNLERNVAEMGIYPAVDPLASTSRALAPEIVGEEHYQVARKVQQTLQRYKELQDIIAILGMDELSDEDKLVVHRARRIQFFLSQNFHVAEQFTGQPGSYVPVKETVRGFKEILEGKYDHLPEDRFRLVGRIEEVVEKAKAMGVEV

SEQ ID NO: 60085 - protein, 228 aa, Gossypium sturtianum
FTSLCHTDVYFWEAKGQTPLFPRIFGHEAGGIVESVGEGVAHLKPGDHVLPVFTGECGNCRHCKSKESNMCDLLRINTDRGVMLSDGKTRFSINGKPIYHFVGTSTFSEYTVAHVGSVAKINPAAPLDKVCILSCGISTGLGATLNVAKPTKGSTVAIFGLGAVGLAAAEGARIAGASRIIGVDLNPNRFEEAKKFGCTEFVNPKDHNKPVQEVLAEMTNGGVDRSVE

SEQ ID NO: 60086 - protein, 468 aa, Acidithiobacillus ferrooxidans
MSERCKENAVGHIVQVIGPVIDVAFSRGQVPEIMEAIVVDANNLTIEVQAQLGDGVARGIAMGPSEGLKRGLAVTRTGAPISVPVGHATLGRIMNVLGEPVDGKGPVQTEDRQAIHRPAPAFDELAASTEVLETGIKVIDLVCPFAKGGKVGLFGGAGVGKTVLMMELIRNIAIEHTGYSVFAGVGERTREGNDFYHEMTDSGVLDKVALVYGQMNEPPGNRLRAGLTGLTMAEHFRDEGRDILMFIDNIFRYPLAGTEVSALLGRMPSAVGYQPTLAEEMGQLQERITSTKVGSITSVQAVYVPADDLTDPSPATTFAHLDATVVLSRQIAELGIYPALDPLDSFSRQLDPQIVGQEHYDVARSCQKTLQRYKELQDIIAILGMDELSEDDKLLVSRARKIQRYLSQPFFVAEVFTGSPGTYVSLKETIRAFKAIVAGEYDHLPEQAFYMVGTIDEALAKAQKLQQG

SEQ ID NO: 60087 - protein, 196 aa, Shigella boydii
RADERPGKINLGIGVYKDETGKTPVLTSVKKAEQYLLENETTKNYLGIDGIPEFGRCTQELLFGKGSTLINDKRARTAQTPGGTGALRVAADFLAKNTSVKRVWVSNPSWPNHKSVFNSAGLEVREYAYYDAENHTLDFDALINSLNEAQAGDVVLFHGCCHNPTGIDPTLEQWQTLAQLSVEKGWLPLFDFAYQG

SEQ ID NO: 60088 - protein, 336 aa, Triticum aestivum
  misc_feature (297)..(297): Xaa can be any naturally occurring amino acid
DPRVPHYLALACLCLDPAVGAAATLSARRPLRGNDTLVSAQGKFELGLFSPAGSSDGRFYLGIWYKNIPGQTVVWVGNRATPLSGLASAELRVSADDGNLELVGATSASASPVVVWSSNLSSSSSPSSNNTAEIRDNGNLVLVDGGNSSNVLWQSFDHPTDTYLPGAWLGENKLTGEYQALTSWRNAQDPAPGMFYDTLDPNGTAEFFMLWNRSRMYWRGGVWTGGRWKGDVGAATGRGTNLYNTTFVDTPAFRGTTTVLTDNATITRLVLDLNGQKKQFVWGAASRSWQLFWAAPXVQCDAYALCGAFGVCNRGPAAVPCPPGFVGVREGLDLHD

SEQ ID NO: 60089 - protein, 193 aa, Shigella boydii
DERPGKINLGIGVYKDETGKTPVLTSVKKAEQYLLENETTKNYLGIDGIPEFGRCTQELLFGKGSALINDKRARMAQTPGGTGALRVAADFLAKNTSVKRVWVSNPSWPNHKSVFNSAGLEVREYAYYDAENHTLDFDALINSLNEAQAGDVVLFHGCCHNPTGIDPTLEQWQTLAQLSVEKGWLPLFDFAYQ

SEQ ID NO: 60090 - protein, 356 aa, Acidobacteria bacterium Ellin345
MKIAVIGGGINGVMSAWQLAADGHKVTLFERDELMSATSSASTKLLHGGLRYLENGQLMLVREALQERTWWIENAPQLAHRLQIVIPLYRDSKRPAWMLKIGLATYDLLAGSRNLGRHRRLSREALLELAPELKSDGLLGGFAFYDGQMNDAALGRWAAEKAIAAGVEVRQHEPVERVSKDGEVSWASTTESFDRVVNVSGPWAKQLLAQSGIATKYDLDLVRGSHLILDRPIHAGFMLQVPGEERVCFALPYEGKTLLGTTEVRQSLEEPIRCSAEEKAYLIKVFNHYLQPAIDGKNVVRTFAGLRPLIRSAENPTHATREYHIWREGKLINVFGGKWTTSRILGQKVAKIAGKE

SEQ ID NO: 60091 - protein, 492 aa, Ustilago maydis 521
MSSQAVADIGLIGLAVMGQNLILNMNDKGFTVCAYNRTTSKVDDFLANEAKGTNVVGAKSIEEFVAKLKRPRKMILLVKAGPAVDAFIEQLLPHLEQGDIVIDGGNSHYPDSIRRCKELEAKGILFVGSGVSGGEEGARHGPSLMPGGSDAAWPHIKEIFQKTAAQSDGEPCCDWVGQTGAGHYVKMVHNGIEYGDMQLICEAYDILKHGLGLKEGEIGDIFTKWNTGVLDSFLIEITRDILKYNDEDGAPLLTKIMDSAGQKGTGKWTAINALDLGQPVTLIGEAVFARCLSSLKGERTRASKILGGPQIKPFEGNKEQFIADLEQALYASKIVSYAQGFMLMREAAKEYDWKLNNPSIALMWRGGCIIRSVFLKDITAAFRKNPELENLLFDDFFNKAIHNAQEGWRRVVAQAILWGIPTPAFSTALAFFDGYRRELLPANLLQAQRDYFGAHTFRVLPQFASEKLPEGQDIHINWTGRGGNVSASTYQA

SEQ ID NO: 60092 - protein, 215 aa, Kluyveromyces lactis NRRL Y-1140
MDQEQERNISRLWRAFKTVKEMVRDRGYFITQEEIDLSLEDFKAKYCDSMGKPQRKMMSFQSNPTEESIEKFPEMGSLWVEFCDEASVGVKTMKNFVVHITEKNFQTGIFIYQSGITPSANKILPTAAPAVIETFPEASLVVNITHHELVPKHIRLSEAEKKELLKRYRLKESQLPRIQRMDPVALYLGLKRGEVIKIIRKSETSGRYASYRICL

SEQ ID NO: 60093 - protein, 2152 aa, Candida glabrata CBS 138
MLSSDPYDPMEDAYETSGNIPDYAHDELYHNSENKSWGQVVPGKVGLYDPDYEHDACGVGFVANVNGLQSHKIVSDARSLLCNMTHRGAVSSDGNGDGAGILVGIPHGFIKREFKLDLGIEVPERGQYAVGNVFFKKDDSDDETLSEKSKAEIRVMQQKFEDTARNFNLNVVGWRNVPHDSSILGDVALSREPVILQTLVVPLDSNELVEFNETVFKTNLYLFRKFITKQFKPEDCFYVCSLSNSTIVYKGQLTPNQVYNYYHDLTNAHFESHMALVHSRFSTNTFPSWDRAQPLRWVAHNGEINTLRGNKNWMRSREGVMVSETFKDKLDSLYPIIEEGGSDSAALDNVLELLTINGTLSLPEAIMMMVPEAYHSDMDSDLKAWYDWAACLMEPWDGPALLTFTDGRYCGAILDRNGLRPCRYYVTSDDRVICASEVGVIPIDNSLVLQKGKLKPGDVFLVDTQQGQIVDTKKLKSDFSKREDFKSWLSKVIKLEDLLQKTENCEPEDFVLNAPSLKVQSDPRLLAHGYTFEQFSMLLTPMALTGKEALGSMGNDAPLACLNQDPVLLYEYFRQLFAQVTNPPIDPIREANVMSLDCYVGPQGNLLEMHPSQCERLLLKSPILKWNEFKAIQNIEKVNPSWSVANIDITFEKSEGIEGYINAVERITKDASIAIEEGKKILIISDRRMGEHRVALSSLLAVSSIHHHLIRNKQRTEVALILETGEAREIHHFCVLLGYGCDGIFPYLAMETLIRMNREGLVRNVNNDDHDLTDQELVENYKHAIDSGILKVMSKMGISTLASYKGAQIFEALGIDSSVIDLCFTGTSSRIKGVTFEYIAQDAFSFHEKGYPSRMTITRSVNLPETGEYHWRDGGYKHVNDPTAIAALQDSVRHKNDDAWSLYVKKEMEAIKDCTLRGLLELDFENSTPIPIEQVEPWTEIARRFASGAMSYGSISMEAHSTLAIAMNRLGAKSNCGEGGEDAERSLVHPNGDTMRSAIKQVASARFGVTSHYLSDADEIQIKIAQGAKPGEGGELPAHKVSKSIAKTRHSTPNVGLISPPPHHDIYSIEDLKQLVYDLKCANPRAGVSVKLVSEVGVGIVASGVAKAKADHILISGHDGGTGASRWTSIKYAGLPWELGLAETHQTLVLNDLRRNVVVQTDGQLRTGFDIAVAVLLGAESFTLATIPLIVMGCVMLRRCHTNTCAVGIATQDPYLRSKFKGQPEHVINFFYYLIQDLRQIMARLGFRTIDEMVGHSEKLRRRADANPKVINIDLTPILTPAHTIRPGVATRFTKKQDHKLHTRLDNKLIDEAEVTLDKGLPVNIDANIVNTDRALGSTLSYRVSKRFGENGLPRDTIVANINGSAGQSFGAFLASGITFILDGDANDYVGKGLSGGIIVVRPPKNSKFKSDENVIVGNTCFYGATSGTAFIAGSAGERFAVRNSGATIVVERVKGNNAFEYMTGGRALVLSQLESINAFSGATGGIAYCLTSDYDAFLSKINKETIELEHLEDPVEIAYVKNLIQEHYNFTKSELASNILGNFNHYLKKFVKVIPSDYKKVLLKEAEEKAKEKENATAEYLKKLGSPAEPGLDATNGEVAKMQAAKRQAISRAVISNKSTLHEPKVLDLEEAVPDAKQMEKNAEKVVKMNGFMKYNVRHEGHRDPATRTKDWKEFTKPVSKRDAKYQTARCMDCGTPFCQSDTGCPLSNIIPKFNELVFKNQWKLALDKLLETNNFPEFTGRVCPAPCEGACTLGIIEDPVGIKSIERIIIDNGFKEGWIIPTPPSTRTGRRVAIIGSGPAGMACADMLNRAGHSVTVFERADRCGGLLMYGIPNMKLDKSIVQRRLDLLSAEGIEFVTNTEIGKDITVDELKSNYDSVVYAIGSTIPRDLPIKGRELKNIDYAMNLLTENTKALLSNDLETIRKQIEGKRVLVIGGGDTGNDCLGTSVRHGAKSVVNFELLPQPPNERAKDNPWPQWPRIMRVDYGHAEVKEHYGRDPREYCILSKEFIGDEEGNVTGIKTARVEWKKSQSGVWQMVEVPNSEELYEADIVLLSMGFVGPELLNNDTNIKKTRRGTIETLSHSSYNIDGGKMFAAGDCRRGQSLIVWAIQEGRKCAAAVDEFLMGDTYLPGSGGIVKRDYRLLEELAATV

SEQ ID NO: 60094 - protein, 317 aa, Lilium longiflorum
MASFPVINMENLEGEGRSKVMELLHDACGNWGFFELLNHGIPDELLDKVEKLTKDHYKKCMEQRFREFASKTLEDPSKVDPDNLDWESTFYLRHLPTSNMEEIPDLTDEYRETMREFVKRLGELADQLLDLLCENLGLEKGYLKKAFSGTKGLTFGTKVSNYPPSPKPELIKGLRAHTDAGGLILLFQDDKVSGLQLLKDGEWVDVPPMHHSIVINLGDQLEVITNGKYKSVLHRVVSQPDGTRMSIASFYNPGGDAVIYPASALVKEAEKESEIYPKFVFEDYMKLYRIQKFQAKEPRFETMKTLEAAISPQLIAT

SEQ ID NO: 60095 - protein, 381 aa, Candida glabrata CBS 138
MTEGKPIECLAAVAYEAGKPQVVEQIVVDPPKAHEVRIKIVNTAVCHTDAYTLSGADPEGLFPCVLGHEGAGIVESVGDGVTNVKPGDHVIALYTAECQKCKFCLSGKTNLCGAVRATQGKGVMPDGTSRFHNKKGESLYHFMGCSTFSEYTVVADVSVVAIDQTAPLESVCLLGCGVTTGYGAAVKTANVQKGDTVAVFGCGTVGLSVLQGAHQRGASRIIAIDTNDQKKDFCTQFGATDFINPTKDLKENETIVAKLIEMTDGGLDHTFDCTGNVNVMRSALEACHKGWGQSVIIGVAAAGQEISTRPFQLVTGRVWKGSAFGGVKGRSEMAGLIEQYKKGELKVDEFITHRRSFNEINEAFDDLHNGLCLRTVLSFSK

SEQ ID NO: 60096 - protein, 295 aa, Pseudomonas putida
MAGKSPLINLNNGVKMPALGLGVFAASAEETASAIASAISSGYRLIDTARSYNNEAQVGEGIRNSVDRAEMFVTTKLFNCDYGYERALRAFDESLGRLGLDYVDLYLLHWPTKDWNATIQSWKAAEKILGDGRARAIGVCNFLEDQLDELIAASDVVPAVNQIELHPYFAQKPLLAKNRALGIVTEAWSPIGCHQRWQDGDNHGGRKHPLTDPVITTIAEAHGRSAAQVILRWHFQNDVVAIPKSVNPERIAKNIDVFDFALSDAEMAQLDELDTGVRIGPDPRDVDTSSFAEFV

SEQ ID NO: 60097 - protein, 511 aa, Desulfovibrio vulgaris subsp. vulgaris str. Hildenborough
MSLKPTLLLILDGWGKAPAGPGNAVTLAGMPHLSSLLRQAGCTELACSGRAVGLPEGFMGNSEVGHMNIGAGRVVYQDMTRIDIAVERGELASNPALTGLFEAVRATGGRVHLMGLLSDGGVHSHIAHVEALALAARDAGVEVVVHAFLDGRDTAPTSGVGYVKRLASFLESNRAGRIGSLVGRYYAMDRDKRWDRNLLAWAMLTRGEGAPADDPVGAVEAAYAAGETDEFVKPRVVVEGGSPIGTIRDGDGVFFFNFRADRARQLSHMFVDGTFEHGDRGHVPSLAGFATMTSYDPALGLPVAFDKQPLDGTLGEVVANQGLRQLRIAETEKYAHVTYFLNCGREEPFPGEERRLLPSPRDVATYDLKPEMSAEAVTDTLLEEWAGGGYTLAVCNVANLDMVGHTGVIPAAVRACETVDACVRRIADAVLASGGRLVITADHGNAEELLDESGNPQTAHSMNRVPFTVVEQGRVHTFREGGVLGDIAPTILGLWGVPASAGMTGTSLITE

SEQ ID NO: 60098 - protein, 483 aa, Burkholderia sp. RP007
MDTQLIIDNADVPATAAATFERRSPTTGELVTRAAAASVADAIAAADSAAAAYRSWSTTGPTERRRILLKAADLLEARTPEFSRVMALEVGASDLWAGVNVMLAANLFREAAALTTQIQGETIPTDKAGVLSMTVRQPVGVILSIAPWNGPVVLAARAIAYPLVCGNTVVFRASELSPKTHMLIVDVLRDAGLPPGVLNAVTNAPQDAPEVVDALIAHPAVRRINFTGSTRVGRVIAEKAARHLKRCLLELGGKAPLVVLDDADIDEAVKAAVFGAFLYQGQICMSTERIVVDEKIADTFVARFAARARELPVGDPATCGGCVVGPMIVRESGDRINAMINDAVNQGANVVAGGFADGAVMPATIVDRVTPAMRIYDEETFGPITTVVRAKDADDAVRIANDTAYGLSSAVFGRDVTRALSVAMRIEAGSCHINGSTVQNEAQAPYGGTKASGYGRFDGRAVIDEFTELKWITIEPTPQSYPF

SEQ ID NO: 60099 - protein, 536 aa, Shigella flexneri 2a str. 301
MLAGVDGVGGIPFDNYPFAYMVSNLALAIILLDGGMRTQASSFRVALGPALSLATLGVLITSGLTGMMAAWLFNLDLIEGLLIGAIVGSTDAAAVFSLLGGKGLNERVGSTLEIESGSNDPMAVFLTITLIAMIQQHESSVSWMFVVDILQQFGLGIVIGLGGGYLLLQMINRIALPAGLYPLLALSGGILIFALTTALEGSGILAVYLCGFLLGNRPIRNRYGILQNFDGLAWLAQIAMFLVLGLLVNPSDLLPIAIPALILSAWMIFFARPLSVFAGLLPFRGFNLRERVFISWVGLRGAVPIILAVFPMMAGLENARLFFNVAFFVVLVSLLLQGTSLSWAAKKAKVVVPPVGRPVSRVGLDIHPENLWEQFVYQLSADKWCVGAALRDLHMPKETRIAALFRDNQLLHPTGSTRLREGDVLCVIGRERDLPALGKLFSQSPPVALDQRFFGDFILEASAKYADVALIYGLEDGREYRDKQQTLGEIVQQLLGAAPVVGDQVEFAGMIWTVAEKEDNEVLKIGVRVAEEEAES

SEQ ID NO: 60100 - protein, 363 aa, Gloeobacter violaceus PCC 7421
MQGTHGATGGQKSALLFCNAILPRVSRTFAISIRFLPGRLGRAVLTAYLLCRIADTIEDDPAASAGEKVRLLGEFMAGFDEVETARKFPTLAQSVSGEAAHVELVHHTDLVFELFEGVPAPSRQIVKRWVGEMVEGMQKFVALYPHGIRIQTLEEYNEYCYYVAGTVGHLLTDLWHAHAPSVDRAKYTALLEHCEAFGEALQTVNILKDIAWDAEHENSIYVPEQSLREHGSSQQTLLSPHCLEQNRAAIASLVALAWADLDAALVYLLAIPRRAVPIRLFCILPLLFAYATLREITRSTAMLTSGGTVKISREEVKALMVAGVATILSNRGIERLVARVRADTYGLGWGGSPPCPPLGKGGS

SEQ ID NO: 60101 - protein, 716 aa, Pisum sativum
MHQLILPFLKPWKGLVDGKTGYLYFWNPETNVTQYERPLSSAAPPKPSAVPSSSVQVQQSSQGRGRSPDFSDRYDRNGNGGSDESGSRSHQSSKGGTNSSHNNVANGTHVTGNVSSIKGLVASDTGPALTPEAYRRRHEITVTGDNVPPPVMSFASSGFPSEIHKEVQNAGFSAPTPIQAQSWPIALQSKDIVAIAKTGSGKTLGYLLPAFITSSALIITPKWGPTILVLHQQGELATQIQDEAVKFSKTSRIACTCLYGGAPKGPQLRDIDRGADIVVATPGRLNDILEMRRISLHQVSYLVLDEADRMLDMGFEPQIRKIVNGVPARRQTLMFTATWPKEVRKIAADLLVNPVQVNIGNVDELVANKSITQHIEVLAHMEKQRRLESILQSQDQGSKIIIFCSTKKMCDQLARNLTRQFGAAAIRGDKSQADRDHVLNQFRSGRTPVLVATDVAARGLDVKDIRVVVNYTFPTGVEDYLHRIGRTGRAGATGIAYTFFGDQDAKHASDLIKILEGANQKVPPELRELSSRGGGGFGRSRRYGSGGRGDSGFGAKSYDSGSGYGGRGNDSGYGGRGSDSSYGRKGGYGSSAAFGRGGGRGFDYDSQRNERDRSPDRGSSWSDRFKTRERSRSPVKAAPSQYNAPVSFHQAMMERNGGGSDRNKSFNRERSRSHSPYRHDKGKRSPSPLAVVGPTVVQVLEETVVLILTMENWRKG

SEQ ID NO: 60102 - protein, 452 aa, Pseudomonas fluorescens PfO-1
MRLERTSFAKRLSTYAEATEIAGAPILEGRLLRMVGLTLEAEGLRAAMGTRCMVINDDTYHPSQVEAEVMGFSGSKVFLMPVGSVAGIAPGARVVPLADTGRLPMGMSMLGRVLDGAGRALDGKGGMKAEDWVPMDGPTINPLNRDPISVPLDVGIRSINGLLTVGRGQRLGLFAGTGVGKSVLLGMMTRFTEADIIVVGLIGERGREVKEFIEHILGEEGLKRSVVVASPADDAPLMRLRAAMYCTRIAEYFRDKGKNVLLLMDSLTRFAQAQREIALAIGEPPATKGYPPSVFAKLPKLVERAGNAEKGGGSITAFYTVLSEGDDQQDPIADSARGVLDGHIVLSRRLAEEGHYPAIDIEASISRVMPAVVAPEHMQRAQYFKQLWSRYQQSRDLISVGAYVAGGDRETDLAINLQPQLVRYLRQGLNDKISLGESEAYLETIFAPAAGG

SEQ ID NO: 60103 - protein, 294 aa, Zea mays
MEQYEKVEKIGEGTYGVVYKALDKATNETIALKKIRLEQEDEGVPSTAIREISLLKEMNHGNIVRLHDVVHSEKRIYLVFEYLDLDLKKFMDSCPEFAKNPTLIKSYLYQILHGVAYCHSHRVLHRDLKPQNLLIDRRTNALKLADFGLARAFGIPVRTFTHEVVTLWYRAPEILLGARQYSTPVDVWSVGCIFAEMVNQKPLFPGDSEIDELFKIFRILGTPNEQSWPGVSCLPDFKTAFPRWQAQDLATVVPNLDPAGLDLLSKMLRYEPSKRITARQALEHEYFKDLEVVQ

SEQ ID NO: 60104 - protein, 163 aa, Triticum aestivum
  misc_feature (77)..(77): Xaa can be any naturally occurring amino acid
MTSSASSSPSRKVLSKIACLRLQKELGEWQASPPGGFTYKVSDNLQRWVIEVSGAEGTLYAGETYRLQVDFPEQYPXEAPQVIFMHPAPMHPHIYSNGHICLDILYDSWSPAMTVSSVCISILSMLSSSPAKERPSDNDRYVRNCRNGRSPKETRWWFHDDKV

SEQ ID NO: 60105 - protein, 258 aa, Clostridium difficile 630
MVKDKVVFVTGAASGIGKQIAESFLKNGAKVMFSDINQEALNNTITELQKKGYDCMSVKCDVTKEEEINHAIDKTVEKYGRLDILINNAGLQHVSMIEDFPTDKFEFMIKIMLTAPFIATKKAFPIMKKQGFGRIINMASINGVIGFAGKAAYNSAKHGLIGLTKVAALEAADSGITVNALCPGYVDTPLVRGQFNDLSKTRNIPLENVLEEVLYPLVPQKRLLDVQEIADYAMFLASDNAKGITGQACLLDGGYTAQ

SEQ ID NO: 60106 - protein, 204 aa, Zea mays
MASASRVRLGTLVPLTKDNAGSSNGSVSSIPIFQGPNVVGRDHLVVVDKRISRKHLSLHASTDGSIEVVVEGPNPIIVRSKGQRRKVCAKETAKIAHGDVLELIPGDYFVKYVDMGDEHVPMHLSDLMKGKRYSEEHGAAVKRIRQIMEDEALAKTLQESFAADDAAVSGMPSGQKISSHDSAGSSRRDNDRTHSVGPLKICSL

SEQ ID NO: 60107 - protein, 193 aa, Shigella boydii
ADGRPGKINLGIGVYKDETGKTPVLTSVKKAEQYLLENETTKNYLGIDGIPEFGRCTQELLFGKGSTLINDKRARTAQTPGGTGALRVAADFLAKNTSVKRVWVSNPSWPNHKSVFNSAGLEVREYAYYDAENHTLDFDALINSLNEAQAGDVVLFHGCCHNPTGIDPTLEQWQTLAQLSVEKGWLPLFDFAY

SEQ ID NO: 60108 - protein, 192 aa, Shigella sonnei
DERPGKINLGIGVYKDETGKTPVLTSVKKAEQYLLENETTKNYLGIDGIPEFGRCTQELLFGKGSSLINDKRARTAQTPGGTGALRVAADFLAKNTSVKRVWVSNPSWPNHKSVFNSAGLEVREYAYYDAENHTLDFDALINSLNEAQAGDVVLFHGCCHNPTGIDPTLEQWQTLAQLSVEKGWLPLFDFAY

SEQ ID NO: 60109 - protein, 222 aa, Listeria monocytogenes str. 1/2a F6854
MKMIAASIMCADSLHLADELRALEQANVKMLHCDVMDGVFVENAAMGAYVLQDIKNNTKMLLDIHLATVNPDKFVDLYAAIKPAYMSFHVEASRDVNATINHIRELGIRPSIAISPDTEIEQIYPFLDKVDMVLMMTVNPGFAGQKFQHHVLEKIKKLQKELESHTNKPLIEVDGNIFEETVRLLEPIGADVYVVGTAALFNEKAGSYTEKLAPLREIIQER

SEQ ID NO: 60110 - protein, 305 aa, Burkholderia xenovorans LB400
MPAHTVRFKQIDVFTSVPFKGNPLAVVFDADALDTEQMQTIAHWTNLSETTFLLKPGDPAADYRVRIFTTRGELPFAGHPTLGTAHALLESGYRPKQAGKLVQQCGVGLVELEALPEADGAWAFAAPPARVTPLAEDRYAALSTALRSDAIDFSATPCAVDNGAPWLVVRVDSARACLALEPDAAALADIVHSVNTHGLAVYGPHDANGPATFEVRCLMAGGRFGVGEDPVTGSANAALAGLLSAQQLRPGARYSVRQGTALGRAGQVRVHYDEARPEGDPLRARGKTWIGGPSVTIVDGTFRLP

SEQ ID NO: 60111 - protein, 228 aa, Gossypium robinsonii
FTSLCHTDVYFWEAKGQTPLFPRIFGHEAGGIVESVGEGVAHLKPGDHVLPVFTGECGNCRHCKSKESNMCDLLRINTDRGVMLSDGKTRFSINGKPIYHFVGTSTFSEYTVAHVGSVAKINPAAPLDKVCILSCGISTGLGATLNVAKPTKGSTVAIFGLGAVGLAAAEGARIAGASRIIGVDLNPNRFEEAKKFGCTEFVNPKDHNKPVQKVLAEMTNGGVDRSVE

SEQ ID NO: 60112 - protein, 222 aa, Picea sitchensis
MGQQSLIYSFVARGTVVLAEYTEFKGNFTTIAAQCLQKLPASNNKFTYNCDNHTFNYLVEDGFAYCVVADESVGRQVPMAFLERVKEDFKRRYGGGRADTAVGNSLNRDFGSKLKEHMQYCVDHPEEISKLAKVKAQVSEVKGVMMENIEKVLDRGEKIELLVDKTENLRFQAQDFQKQGTQLRRKMWFQNMKVKLIVLGIVVALILIIVLSVCHGFNCSKK

SEQ ID NO: 60113 - protein, 310 aa, Carica papaya
MENFPVINMEGLNGEERAATMKKIEDACENWGFFELVNHGIPIELLDTVERLTKGHYRKCMEQRFKEIMASKGLDGIQTEVTDMDWESTFFIRHLPEPNIAEIPDLDDEYRKVMKEFALKLEKIAEELLDLLCENLGLEKGYLKKAFYGSRGPTFGTKVSNYPPCPKPNLIKGLRAHTDAGGIILLFQDDKVSGLQLLKDGKWVDVPPMRHSIVVNLGDQLEVITNGKYKSVEHRVVAQTDGTRMSIASFYNPGSDAVIYPAPILVEKETEEKKTAYPKFVFEDYMKLYAGLKFQAKEPRFDAMKAAAKA

SEQ ID NO: 60114 - protein, 499 aa, Oryza sativa Indica Group
MTKIVGTLGPKSRAVDTISSCLKAGMSVARFDFSWGDAEYHQETLENLKLAIKSTKKLCAVMLDTVGPELQVVNKSEAAISLEANGTVVLTPDQGQEASSELLPINFSGLAKALKPGATIFVGQYLFTGSETTSVWLEVSEVKGDDVVCVIKNSATLAGSLFTLHCSQIHIDLPTLSDEDKEVIRRWGAPNKIDFLSLSYTRHAEDVRQAREFLSKLGDLSQTQIFAKIENVEGLNHFDEILQEADGIILSRGNLGIDLPPEKVFLFQKSALHKCNMAGKPAVVTRVVDSMTDNLRPTRAEATDVANAVLDGSDAILLGAETLRGLYPVETISIVGKICAEAEKVFNQDLYFKRTVKYVGEPMTHLESIASSAVRAAIKVKASVIICFTSSGRAARLIAKYRPTMPVLSVVIPRLKTNQLRWSFTGAFEARQSLIVRGLFPMLADPRHPAESTSATNESVLKVALDHGKASGVIKSHDRVVVCQKVGDSSVVKIIELDD

SEQ ID NO: 60115 - protein, 228 aa, Gossypium bickii
FTSLCHTDVYFWEAKGQTPLFPRIFGHEAGGIVESVGEGVTHLKPGDHVLPVFTGECGNCRHCKSKESNMCDLLRINTDRGVMLSDGKTRFSINGKPIYHFVGTSTFSEYTVAHVGSVAKINPAAPLDKVCILSCGISTGLGATLNVAKPTKGSTVAIFGLGAVGLAAAEGARIAGASRIIGVDLNPNRFEEAKKFGCTEFVNPKDHNKPVQEVLAEMTNGGVDRSVE

SEQ ID NO: 60116 - protein, 228 aa, Gossypium bickii
  misc_feature (174)..(175): Xaa can be any naturally occurring amino acid
FTSLCHTDVYFWEAKGQTPLFPRIFGHEAGGIVESVGEGVTHLKPGDHVLPVFTGECGNCRHCKSKESNMCDLLRINTDRGVMLSDGKTRFSINGKPIYHFVGTSTFSEYTVAHVGSVAKINPAAPLDKVCILSCGISTGLGATLNVAKPTKGSTVAIFGLGAVGLAAAEGARXXGASRIIGVDLNPNRFEEAKKFGCTEFVNPKDHNKPVQEVLAEMTNGGVDRSVE

SEQ ID NO: 60117 - protein, 642 aa, Caulobacter crescentus CB15
MAQDAKTLDLIAVGRSSVDLYGQQVGGRLEDMGSFAKYLGGSPTNTAAGGARLGLKTGLLTRVGADHMGRFIREQLEREGVDVAGVLSDPDRLTALVILGIRDRVNFPLIFYRENCADMALEPSDVDEAWFAQAGAVLINGTHLSQPNVYETSLKAARAVKAAGGRVAFDIDYRPVLWGLTGKDAGENRFVENQQVTAKLQEVVALCDLIVGTEEEIHILGGSTDTIAALRAIRRASDALLVCKRGPEGCVAFPGAIPDALDEGVSARGFKVEVFNVLGAGDAFMAGFLRGWLRHESVETCCEWGNACGAIVVSRHGCTPAMPTWIELQAFLSERERPFRLREDAELEHIHWATTRERVYDELTVLAIDHRSQFEDLIAETGGDAERIPDFKRLALRAVQMVAGRDETRFGMLLDGRFGFEALAEAADHDYWIARPIELPKSRPLEFECSADVATELLEWPLNQVVKCLAFYHPDDESDLRERQERQLLRLADACRKTRHELLLELILPRGMSSDSRTVARAIRRLYALGIRPDWWKLEPLTDPDAWREIEIAIAENDPLCRGVVLLGLSAPEAELVASFEVVAPFPIVKGFAVGRTIFYDVARAWLSNQIDDDAAVTALAAKFKVLVDAWRRLRGSVEKAA

SEQ ID NO: 60118 - protein, 227 aa, Gossypium bickii
FTSLCHTDVYFWEAKGQTPLFPRIFGHEAGGIVESVGEGVTHLKPGDHVLPVFTGECGNCRHCKSKESNMCDLLRINTDRGVMLSDGKTRFSINGKPIYHFVGTSTFSEYTVAHVGSVAKINPAAPLDKVCILSCGISTGLGATLNVAKPTKGSTVAIFGLGAVGLAAAEGARIAGASRIIGVDLNPNRFEEAKKFGCTEFVNPKDHNKPVQEVLAEMTNGGVDRSV

SEQ ID NO: 60119 - protein, 195 aa, Brassica napus
MVEPCETRNNGEAYQMVRCQNHHNSRSRIPSSLLELRVFYVRISNLKVDESTPEVLTITHIPLDPDTLVEINGVRTSIVSSQLRRDRVDKNSEAATFISTDNIRLSGNVKLEVYDKDELVLSGTLEMSGGGSNSVKQRWGMNCEATGYGFLKELSSPLPIVEVVYVTGCFSGTPIILTKTLQLGSRKKKSRRTGL

SEQ ID NO: 60120 - protein, 367 aa, Liquidambar styraciflua
MGSTSETKMSPSEAAAAEEEAFVFAMQLTSASVLPMVLKSAIELDVLEIMAKAGPGAHISTSDIASKLPTKNPDAAVMLDRMLRLLASYSVLTCSLRTLPDGKIERLYGLAPVCKFLTRNDDGVSIAALSLMNQDKVLMESWYHLTEAVLEGGIPFNKAYGMTAFEYHGTDPRFNTVFNNGMSNHSTITMKKILETYKGFEGLGSVVDVGGGTGAHLNMIIAKYPMIKGINFDLPHVIEEAPSYPGVEHVGGDMFVSVPKGDAIFMKWICHDWSDEHCLKFLKKCYEALPTNGKVILAECILPVAPDASLPTKAVVHIDVIMLAHNPGGKERTEKEFEALAKGAGFEGFRVALCAYNTWIIEFLKKI

SEQ ID NO: 60121 - protein, 454 aa, Klebsiella pneumoniae
MSRELYPKQFLRLYGQNSMLQETITRLSGLEIHEPMVICNEEHRFLVAEQLRQLNKLSNNIILEPVGRNTAPAIALAALQATRHGDDPLMLVLAADHIINNQPVFHDAIRVAEQYADEGHLVTFGIVPNAPETGYGYIQRGVALTDSAHTPYQVARFVEKPDRERAEAYLASGEYYWNSGMFMFRAKKYLSELAKFRPDILEACQAAVNAADNGSDFISIPHDIFCECPDESVDYAVMEKTADAVVVGLDADWSDVGSWSALWEVSPKDEQGNVLSGDAWVHNSENCYINSDEKLVAAIGVENLVIVSTKDAVLVMNRERSQDVKKAVEFLKQNQRSEYKRHREIYRPWGRCDVVVQTPRFNVNRITVKPGGAFSMQMHHHRAEHWVILAGTGQVTVNGKQFLLTENQSTFIPIGAEHSLENPGRIPLEVLEIQSGSYLGEDDIIRIKDQYGRC

SEQ ID NO: 60122 - protein, 459 aa, Vitis vinifera
MVKICCIGAGYVGGPTMAVIALKCPSIEVAVVDISVSRITAWNSDQLPIYEPGLDGVVKQCRGKNLFFSTDVEKHVSEADIVFVSVNTPTKTRGLGAGKAADLTYWESAARMIADVSKSDKIVVEKSTVPVKTAEAIEKILTHNSKGIKFQILSNPEFLAEGTAIQDLLKPDRVLIGGRETPEGQKAIQALKDVYAHWVPEDRILTTNLWSAELSKLAANAFLAQRISSVNAMSALCEATGADVTQVSYAVGTDTRIGPKFLNASVGFGGSCFQKDILNLVYICECNGLPEVAEYWKQVIKVNDYQKNRFVNRVVSSMFNTVSNKKIAILGFAFKKDTGDTRETPAIDVCKGLLGDKARLSIYDPQVTEDQIQRDLTMNNMVWDAYSATKDAHGICILTEWDEFKTLDYKKIYDNMQKPAFVFDGRNIVNAEKLREIGFIVYSIGKPLDPWLKDMPAVA

SEQ ID NO: 60123 - protein, 375 aa, Arabidopsis thaliana
MAAAMASHVSTARSPALSFSSSSSSFFPGTTLRRFSAVSLPSPALPRLRVSCQASSVTSPSSPSDVKGKSDLKDFLAIDDFDTATIKTILDKASEVKALLKSGERNYLPFKGKSMSMIFAKPSMRTRVSFETGFFLLGGHALYLGPNDIQMGKREETRDVARVLSRYNDIIMARVFAHQDILDLANYSSVPVVNGLTDHNHPCQIMADALTMIEHIGQVEGTKVVYVGDGNNMVHSWLELASVIPFHFVCACPKGYEPDKERVSKAKQAGLSKIEITNDPKEAVIGADVVYSDVWASMGQKDEAEARRKAFQGFQVDEALMKLAGQKAYFMHCLPAERGVEVTNGVVEAPYSIVFPQAENRMHAQNAIMLHLLGF

SEQ ID NO: 60124 - protein, 327 aa, Ralstonia eutropha JMP134
MPMTKAIRIEQTGGPEVMQWVDVEVGEPGPGEVRVRHEAVGLNFIDVYFRTGLYKQPLPGGLGMEGAGVVEAVGEGVAHLSVGDRVAYAGRPNGAYSQVRVMPADIVVRLPESISFEQGAAMMLQGLTVQYLIRDSYRVQAGDTVLLHAAAGGVGLIACQWLKALGVTVIGTVGSDEKAELARAHGCTHTVVYTRESFVDRVKEITGGKGVPAVYDSIGADTFRGSLDCLAPRGTMVSFGSASGPVPPFDISVLGNKGSLRLTRPTLMTYVVHRELLEPMVADLFDVVSSGKVKIDVRQRYALADVAQAHRDLESRKTTGSTILLPR

SEQ ID NO: 60125 - protein, 157 aa, Zea mays
MANALDHLNSGRTRIEWLSQLNTEYTPAREYRRTSIICTIGPKTNSAEKINALRKVGLNVVRMNFSHGSYEYHQSVIDNAREAERTQPGRPVAIALDTKGPEIRTGNTVGDADIPIKAGSIINMTTDEQYATGCDDKNMYVDYKNITKGIVPGRTIY

SEQ ID NO: 60126 - protein, 306 aa, Triticum aestivum
  misc_feature (114)..(114): Xaa can be any naturally occurring amino acid
  misc_feature (124)..(124): Xaa can be any naturally occurring amino acid
  misc_feature (157)..(157): Xaa can be any naturally occurring amino acid
KSFPPSSSNFIVFKHQYVVVDAFTAQPFKGNPAAVCFLEDDAAAPAGDGRWMQSVAVEFNLSQTAFFSRDSSCAADATTPRFHLRWFTPVTEVALCGHATLATAHFLFTSVLAXAMGVVEFATXSGVLTAKKVPAPEAEEKGKLFIELDFPMSDYVXCDPAGELPSIPETLNGASVVSVHKSLTTTDFIVELSSGKEVTDHLPNIEEIRKCAGRGVIVTGPAPPGSGYDFFSRFFCPKFGIDEDPVCGSAHCVLAPYWGEKLGKQKLIAFQASPRSGTLYLELDVANKRVLIQGEAVTIMSGTLFA

SEQ ID NO: 60127 - protein, 853 aa, Azoarcus sp. EbN1
MEAVQTSEIRWWKASRPVDMPEFGAPVQLSIDGVDVEAPAGASILNAATAAGLYIPALCAHPDLPPAGQRGAGDGGCNLCMVEVEGEEGLRKACSMPVRAGLVVKTQSPAIQQSRQASLAKVLGPHPHVCLTCPQREGCSRSQCSYGNPQETRCCSIFSSCELRKVSDYIGIPNTTPPYKPAQLPIVLDEPFFDRDYNLCIDCRRCLVACNDVRGVGCLEVKEVETPQGKRTYVGTIAPTLIESGCTFCQACVTVCPTGALMDRTLDPARREESMVPCKSACPAGIDVPRYVQLAAEGKYGEAIAVVREKLPFPGILGRACFAMCESACRRKDLDDPLSIRNLKRIAADNDTGIWREFAKKLPATGKKAGVIGAGPAGLTVAYYLAKQGHAVTIFDAQPAAGGMARYGIPSYRVPAEVIDDEVSEVAALGVEFRYGAKVENVDELFNDGYGAVFVGIGAQGGDRLGIPGDDLPGVVDSPTYLKAVTMGLVNTPEGIQTGKKVAVIGGGNVATDNARSSRRYGAEVDMVYRRTREEMPARLEEFEGCVEEGVNIRYLLAPKKIEPGTNGYRLQITYAKMALGEADASGRRRPVETGEEIVEGVDLVIGAIGQFPNRFEGFGVETDRKGRITVREDSMLTSRPKVYAGGDCVLGPSTLIESVAQGRVAASAMDKALGGDGDISEVLLRDGWETNPWIGRKDGFNTTRKFHPIMLAPEQRTGWDEVELGFDDATARLEAARCFKCNLAPKIAEAVLPPESSLTFDAAAIAAVPTEAGVFQLLDGDKNVLMIKGVENLREGLTEQLERGTSGDNCATNFVFEEAAMFTSRESQMIQAYLQQYGKMPGGGSDELDDLF

SEQ ID NO: 60128 - protein, 305 aa, Oryza sativa Indica Group
MAALAEHLLGLSSAPVDWEAESYPGYGDFAVLPFLVAFFPAVRFLLDRFVFELLARRLVLGKGYDKFAETDESRKKINKFKESAWKFIYFLSAELLSLSVTYNEPWFKNTRNFWVGPGEQIWPDQKTKLKLKAVYMFAAGFYTYSIFALLFWETRRSDFGVSMSHHLATVVLIVLSYIFRFARVGSVVLALHDASDIFLEIGKMSKYSSCEGLAVVAFLLFVASWILLRLIIFPFWILRSTSYEVLLTLDKEKHKFYGPIYYYVFNSLLFSLLVLHIYWWVLIYRMLVKQIQSRGRIGDDVRSDD

SEQ ID NO: 60129 - protein, 429 aa, Bordetella petrii
MSDSPTHALPSYLDAAHLGPWGIYLQQVDRVTPYLGPLARWVETLKRPKRALIVDVPIELDNGSVAHFEGYRVQHNTSRGPGKGGVRFHQDVTLSEVMALAAWMSVKNAAVNLPYGGAKGGIRVDPRQLSQAEIERMTRRYTSEIGVIIGPSKDIPAPDVNTNAQTMAWMMDTYSMNEGSTATGVVTGKPIALGGSLGRVEATGRGVFVTACEAARDCNIDVSQARVIVQGFGNVGGTAARLFHETGAKVIAVQDHTGTVYNPAGLDVHKLLSHVSQKGGVGGFSGAEALDNAQFWELETDFLIPAALEGQINQSNAHKVRAKIVVEGANGPTTPEADDVLRENGVYVVPDVLANAGGVTVSYFEWVQDFSSFFWSEDEINHRLERLMREAYSAVSQVAKEHKVTLRTAAFIVACTRILQARQVRGLYP

SEQ ID NO: 60130 - protein, 413 aa, Cryptococcus neoformans var. neoformans JEC21
MSSLALPTIQPSQSHTPSPSAPAPSAPQPATSQRTRKRSTPPLEEDSDEEEEEDKRRGTGPSKKKASGVWGWEDMGDYKYMVEIRQMMFVFGEVQTPLPETVKLVEDIVRGQIIEIVTRARLLTHLRSSRFLSAEDLIFLIRDDRGKVNRLRTYLSWKDVRKRAKEEAERAGEDIDLDVDEDKAMKGRKQMVKLPWELLTPFTSFLRSMPGKEEEDDEDDDELQAHEDSMQRLREADEITKKMTKNEYAQYSECRQASFTYRRARRFREFINFSAYLDVRPNDDIVDILGFLAFEMVRSLCVTALDLRERLEKTKTTGGGEVGSTIGSAGTSAQKQDGNKRSSAEPGAISQNKTPSSSNPPSLFAPPPSARQPLQPCHVLEAFAQIQRAQAANRVGGMGNFRGGVGKKRMALV

SEQ ID NO: 60131 - protein, 348 aa, Listeria monocytogenes str. 1/2a F6854
MKALKLYGKRDLRYEEADMPTIEEPDDVILKVKTVGICGSDISRYSKLGPYVPGMVWGHEFSGEVIEVGSEVTDIEIGDRAAGCPALYCGECEYCKKGEFARCRKLTVIGARHPGAYAEYIKLPAENVVKIPDELDYEAAALVEPSAVVVHGFYHTKLQAGDDVVVVGSGNIGLLAIQWAKVFGARRVIAIDVDDKKLALAKEVGADVVINSLKEDPLEVVAAHTDGLNADLVVEAAGSPITSAQVFAYAKKGGGVVFLGIPYADVTIERFYFEKIVRSELTVWGSWNAISAPFPGKEWQTTIHFLANKQINIEPMITHRLSLAEGPEVFERIYERNEFFGKVLFFPE

SEQ ID NO: 60132 - protein, 474 aa, Haemophilus somnus 2336
MNKEIKTQVVVLGAGPAGYSAAFRCADLGLETVIVERFSTLGGVCLNVGCIPSKALLHVAKVIEEARSLSAHGIVFGEPTTDIDKIRGWKEKVINQLTSGLAGMAKQRKVQVVNGYGKFSGPNAIIVAGDEGETKITFDNAIIAAGSRPIQLPFIPHEDPRIWDSTDALKLKEVPENLLIMGGGIIGLEMGTVYHALGSKIDVVEMFDQVIPAADKDMVQIYTKRIEKKFNLLLETKVTAVEAKEDGIYVSMEGKAASETRRYDAVLVAIGRVPNGKLIDAGIAGVEVDDRGFIRTDKQMRTNVPHIFAIGDVVGQPMLAHKGVHEGHVAAEVIAGQKHYFDPKVIPSIAYTEPEVAWVGKTEKECKAEGINYEVAKFPWAASGRAIASDCADGMTKLIFDKDTHRVIGGAIVGTNGGELLGEIGLAIEMGCDAEDLALTIHAHPTLHESVGLAAEVFEGSITDLPNPKAKKKK

SEQ ID NO: 60133 - protein, 628 aa, Haemophilus somnus 2336
MAKEIQIPDIGGDEVTVTEVMVKAGDTIIVDQSVINVEGDKASMEVPSPEAGVIKEVLVKVGDKVSTGTPMFVLENAELASTETASESMQTEKTQSAVASIIEIYVPDIGGDEVNVTDIMVSVGETVAEEQSILNVEGDKASMEVPAPTAGIVKEILIKVGDKVSTGSLVMKFEVAGVVSVAETAQVSSSAQVTGESAVQDVHVPDIGGDEVNVTEIMVAVGDSVTEEQSLITVEGDKASMEVPAPFAGVVKEILVKSGDKVSTGSLIMRFEVQGKAPTPKASSAVTEAKVAPSPAAQENQMTPVSQADVTASAVFAHATPVVRRLAREFGVNLDKVKGTGRKGRILKEDVQAYVKAAIKAVESGNVSPTSAGNGAVNGAGLGLLPWPKVDFSKFGDIEQVELGRIQKISGANLHRNWVMIPHVTQWDKADITELEKFRKEQNVLAEKQKLDVKITPLVFIMKAVAKALENYPRFNSSLSEDAQSLILKKYINIGVAVDTPNGLVVPVFKDVNKKGIIELSRELAEISKKARAGKLTASDMQGGCFTISSLGGIGGTHFTPIVNAPEVAILGVSKSEMTPVWNGKDFTPRLMLPLSLSYDHRVIDGADGARFITFINSVLSDLRRLVM

SEQ ID NO: 60134 - protein, 311 aa, Listeria monocytogenes str. 1/2a F6854
MAGKMKLFSVTSERPLATKIADYLDIPLCEVELQKFSDGEVKINIEESIRGTNAYVVQSMNSNVNERLMELLIMVDALKRASVHSINIIMPYYGYARQDRKARSREPITAKLMANLIQRAGANRLITVDLHAAQIQGFFNIPIDHLSAIPLIGDYLIENYGEKDVVVVAPDHSGVVRARRIADRLNAPIAILNRKPRPHEDEIMSVIGDVKGKVAIVVDDIIDTGVRATTSADILLEKGAVEVIACATHSVMAGNATERLQNSSIKEVITSDSIDLPEDKQFDKLTTISIGRILGRAIEGVQENRSLHPLF

SEQ ID NO: 60135 - protein, 228 aa, Gossypium nelsonii
FTSLCHTDVYFWEAKGQTPLFPRIFGHEAGGIVESVGEGVTHLKPGDHVLPVFTGECGNCRHCKSKESNMCDLLRINTDRGVMLSDGKTRFSINGKPIYHFVGTSTFSEYTVAHVGSVAEINPAAPLDKVCILSCGISTGLGAALNVAKPTKGSTVAIFGLGAVGLAAAEGARIAGASRIIGVDLNPNRFEEAKKFGCTEFVNPNDHNKPVQEVLAEMTNGGVDRSVE

SEQ ID NO: 60136 - protein, 192 aa, Shigella boydii
ERPGKINLGIGVYKDETGKTPVLTSVKKAEQYLLENETTKNYLGIDGIPEFGRCTQELLFGKGSALINDKRARMAQTPGGTGALRVAADFLAKNTSVKRVWVSNPSWPNHKSVFNSAGLEVREYAYYDAENHTLDFDALINSLNEAQAGDVVLFHGCCHNPTGIDPTLEQWQTLAQLSVEKGWLPLFDFAYQ

SEQ ID NO: 60137 - protein, 575 aa, Haemophilus somnus 2336
MISGITASPGIVFGKALVLKEEKIVLDTQKIKDEQIDIEVARFYSGRTAAIEQLIAIKDRALVSLGEEKAAIFEGHLMILEDEELEEEILDYLRSNKVNAGVAASKIIDQQVAMLSEIDDEYLQERAGDIRDIGNRLIKNILGMKIVDLGDINEEAILVAYDLTPSETAQLNLDKVLGFITDIGGRTSHTSIMARSLELPAIVGTNDITSKVNTGDYLVLDAVNNAIYVNPTQEEIERLKALERQLAEEKAELAKLKDLPALTLDGHQVDVVANIGTIRDCEGADRNGAEGVGLYRTEFLFMDRDQLPTEEEQFIAYKEVVEAMNGRLVVLRTMDIGGDKDLPYLNLPKEMNPFLGWRAIRIGMDRREILHAQLRAVLRASAFGKLAVMFPMIISVEEIRELKSVIESLKQELRDEGKAFDENLQVGVMVETPAAAINAKFLAKEVDFFSIGTNDLTQYTLAVDRGNELISHLYNPMTPAVLNLIKHVIDASHEEGKWTGMCGELAGDENATLLLLGMGLDEFSMSAISIPRIKKLIRNVNYQDAKLLAEQALQQPTAAGILSLVNDFLVEKALN

SEQ ID NO: 60138 - protein, 145 aa, Vitis vinifera
  misc_feature (9)..(9): Xaa can be any naturally occurring amino acid
  misc_feature (22)..(22): Xaa can be any naturally occurring amino acid
  misc_feature (41)..(41): Xaa can be any naturally occurring amino acid
  misc_feature (82)..(82): Xaa can be any naturally occurring amino acid
MGANKMCEXAVVVAVVVAVMMXGVGEAQNTASCASELTACXDYLNSTSPPANCCTPLKNAVENDKDCLCNLYNNPSLLQSLXINVTDALQLPKNCGITEELNCNGGSPSPTGSPPATPGKDGGGASMVAWTGMSSLLLLCASLML

SEQ ID NO: 60139 - protein, 499 aa, Caulobacter crescentus CB15
MRDIPHFIGGQKVDGASGRFGEVFDPNTGKVQARVALASAGELNTAIANAKVAQAAWAATNPQRRARVMFEFKRLLEVHMDELAALLSSEHGKVIADSKGDIQRGLEVIEFACGVPHLLKGEYTQGAGPGIDVYSMRQPLGVVAGITPFNFPAMIPMWMFGPAIATGNAFILKPSERDPSVPVRLAELMIEAGLPPGVLNVVHGDKDCVEAILDHPDIKAVSFVGSSDIAQSVFQRAGAAGKRVQAMGGAKNHGLVMPDADLDQAVADIIGAAYGSAGERCMALPVVVPVGEKTATALREKLVAAIGGLRVGVSTDPDAHYGPVVSAAHKARIESYIQMGVDEGAELVVDGRGFSLQGHEEGFFVGPTLFDHVKPTSRSYHDEIFGPVLQMVRAESLEEGIALASRHQYGNGVAIFTRNGDAAREFADQVEVGMVGINVPIPVPVAYHSFGGWKRSGFGDLNQYGMDGVRFYTRTKTVTQRWPKGGAVLDQSFVIPTMR

SEQ ID NO: 60140 - protein, 476 aa, Physcomitrella patens subsp. patens
MVSSSTTSLLVLGAGALVGSALTLALISWRTSKTSNRQLAIPSLVKNPTYEPFVDTSKNANGVIETTYDTLSSLPKLSNNLPVEDFLRDEIVNEQFTRNVQFFGDAGQLKVHRAFVVVVGLGGVGSHAAAMLLRSGVGKLRLIDFDQVSLSSLNRHAVATRADVGMSKAVCLQNHFQRIFPECQVEARVQMYDASAQDELLSGSPDYVLDCIDNIDTKVALLAACVKKGLKVLSATGAGARLDPTRIRIADLKESSNDPLSRSVRHRLRREHDIHGGIPVVFSLEKPKMKLLPFKSPNEDDARPEDYQVVPGFRVRIIPVMGTIPAIFGQIMATYVVTQLAGMPVQTEPVVNLDVEHYGLLHQRLIEREELQFGSADAVEVDKEEVAYVVRELWRGRSARDQDSTNVGRGMWRSINNLTLTRWDQTRPPSIDNLVLLTFDEAEAHEATTLEDLAFDEWEYYSMVESVLARAVRDLS

SEQ ID NO: 60141 - protein, 259 aa, bacterium SB2
MCMHFIELNSTTLHFSKTNSESAAPALVLINSLGTDFRIWDEFLVHLGHQGEVLTYDKRGHGLSSVGDERYSIDLHMRDLAALMDSQSIKNAVICGVSVGGMIAMALQAARPDLVSGLILCDTAPRIGDAQTWQERINAIEANGMEGIADTVMSRWFSSGFQAKWPEAVAGYRNLLCRTPLDGYTGTCAAIRDADLTCQAAQIDVPVLCVAGEDDQSTPPELVEEMACLIPNAKYERVGNCGHLPSLEQPEYLAHLVRQ

SEQ ID NO: 60142 - protein, 480 aa, Acidobacteria bacterium Ellin345
MSNTERSQHDDEHLVRGLSLGGATALNMIDVIGIGPFITIPLIISAMGGPQAMLGWIFGALLSLCDGLCWAELGAAMPGSGGSYRYLNEIYGRQKWGRLLSFLFIWQLSFSAPLSIASGCIGFSQYASYLKPSLEHAWISHPRFMVGPVTVMSIATVIVVVFLLYRGVVQIEKISKFLWVGVMGTMAWIIFAGLTHFQPSRAFDFPPGAFTLSHNFFLGLGAAMLIATYDFWGYYNIAFLGGEVRDPERNIPRAMLYSIVIVGVLYVVMNISILGVMPWRELAQTAQSNTRYYIVATMMERLYGHWAGVLVALLIMWTAFASVFSLLLGYSRVPYAAARDGNYFKPFARIHPTQKFPTVSLLVLGGVAILCCFLRLADVIAALVVIRILLQFVVQILGLLYWRWSRPDAPRPFKMWIYPVPAVLALVGFIYVLFVRTNSWQQVRYAVVIVVIGLAIYLVRAWRRGEWPMPGRSAASDVAV

SEQ ID NO: 60143 - protein, 313 aa, Ashbya gossypii ATCC 10895
MGVAKYTKWGLQLRRAFHGGFKLVDIEAREPVKCACESEVASYNGALPPDCRLDTSIPLPSKPPAYSKHVLLVSPRADAWVADWQSKLELNPHWPYNAVSTFKRALRTAYRGDGILVNAVCFQGSTLLPKLRHGHAQFLVLPEFQVYDVYQDSIEEFAYFIGGGKGKEAPSRLGFLDYAEGSGNQAARREQGPGCAAAGPIFQGQPFNRNLLLVCGHLQRDARCGLIAPELVDALKGEPYLAETEIGIVSHIGGHKLAGNLIYYSRADPSHVDKPLVDALWFGKVLPAMIPTLVDALSQKKIVSANYRGGISF

SEQ ID NO: 60144 - protein, 228 aa, Gossypium australe
  misc_feature (178)..(193): Xaa can be any naturally occurring amino acid
FTSLCHTDVYFWEAKGQTPLFPRIFGHEAGGIVESVGEGVTHLKPGDHVLPVFTGECGNCRHCKSKESNMCDLLRINTDRGVMLSDGKTRFSINGKPIYHFVGTSTFSEYTVAHVGSVAKINPAASLDKVCILSCGISTGLGAALNVAKPTKGSTVAIFGLGAVGLAAAEGARIAGAXXXXXXXXXXXXXXXXKKFGCTEFVNPNDHNKPVQEVLAEMTNGGVDRSVE

SEQ ID NO: 60145 - protein, 90 aa, Triticum aestivum
DLELVFGECMSTRIFAAYLNKLGKKARQYDAFDLGFITTDDFTNADILEATYPAVAKRLHGDWIDDPAIPNVVTAHDFHPFPRKPVTTGI

SEQ ID NO: 60146 - protein, 341 aa, Caulobacter crescentus CB15
MGKVLKYQAHRFSVAPMMDWTDRHCRSLHRGLSSRALLYTEMVTSGAVVHGDRNKLLGYDPGQHPVAVQLGGSDPAELAQAARIAEDYGYDEVNLNVGCPSDRVQSGRFGACLMREPDLVAECMAAIKNAVRVPATVKCRIGVDDQDPEESLFTLVDRCAAAGIDTFVVHARKAWLQGLSPKENRDIPPLDYALVYRLKRERPALTIAINGGVPSVDAALEHLANGVDGVMLGRAAYHEAGLLGEVDRRVFGLDVADVDSFEAVERYRPYLARELAAGTHLAAMSRHMLGLFHGLPGARAWRRILTVEGVKSGAGLDVVDRALDAVRAALASREERSVPAA

SEQ ID NO: 60147 - protein, 228 aa, Gossypium australe
FTSLCHTDVYFWEAKGQTPLFPRIFGHEAGGIVESVGEGVTHLKPGDHVLPVFTGECGNCRHCKSKESNMCDLLRINTDRGVMLSDGKTRFSINGKPIYHFVGTSTFSEYTVAHVGSVAKINPAAPLDKVCILSCGISTGLGAALNVAKPTKGSTVAIFGLGAVGLAAAEGARIAGASRIIGVDLNPNRFEEAKKFGCTEFVNPNDHNKPVQEVLAEMTNGGVDRSVE

SEQ ID NO: 60148 - protein, 387 aa, Methanocaldococcus jannaschii DSM 2661
MVMILIKLEIDRRAYNSIKNFSRLVYTKAIKNRGDLPKKEEIVTLTYNGKFVAKALYNPKSVILKILTTEDEEIDYDFFYKRIFNAKIYRENILNYKNTYRWIYAEGDELPTIIFDKYNELGAMQLMSKLIEKEYLKDIVDILFELSDLETIYVKRGKKGERIRDKIFGDKNKFETVIKEGDAKFKVNVRGHKTGFFLDQRENRLYLEKFIKEGDRVLDICCYTGGFSVHAAIRGAEVVGVDLSKKALKLAEENIELNNIPKDRYEFIEGNAFEVMKEMIEDKEKFDVVILDPPAFTQTEDDIKNALRAYASLNYLGIKLAKRIFVTCSCSHHVDKEMFKRTVISSAFRAKKELIMIDYKGQAPDHPISIGNKNLEYLKCIFFYVKN

SEQ ID NO: 60149 - protein, 228 aa, Gossypium australe
FTSLCHTDVYFWEAKGQTPLFPRIFGHEAGGIVESVGEGVTHLKPGDHVLPVFTGECGNCRHCKSKESNMCDLLRINTDRGVMLSDGKTRFSINGKPIYHFVGTSTFSEYTVAHVGSVAKINPAASLDKVCILSCGISTGLGAALNVAKPTKGSTVAIFGLGAVGLAAAEGTRIAGASRIIGVDLNPNRFEEAKKFGCTEFVNPNDHNKPVQEVLAEMTNGGVDRSVE

SEQ ID NO: 60150 - protein, 311 aa, Ashbya gossypii ATCC 10895
MDLAVSGLVSRYFFVAMKIFCDAMSRIMSIGAAVEEDTNRYCEDMVAPTALKKSGTDGQTAPGPTGSRIVGTDNTRSIEDDDDILIDQEDSGAAAAEQAEGAREQQGVVLDAEGKPRFAAAASVAETRVKAESRKVPVPPHRMTPLRNSWTKIYPPLVDHLKLQVRMNLKTKSVELRTHPRHTTDPGALQKGADFIKAFTLGFDLDDSISLLRLDDLYIETFEIKDVKTLHGDHLSRAIGRIAGKDGKSKFAIENATRTRIVLADSKIHILGGFTHIRMAREAVVSLILGSPPGKVYGNLRTVASRLKERY

SEQ ID NO: 60151 - protein, 385 aa, Methanocaldococcus jannaschii DSM 2661
MTTKLYVDFGGYSAIEKGNLIIPRDNILNKEDFDSIEIGEVVDIYSKRGKFLGRGFKNPKEVRIMTLRKEDLDENYIREKIIKANEYRLKLGFKDTYRMVYTQSDWLNGLVIDKYNDIATVQIFNYGIEKMKDVVVETLLDLGIDSIYEKSSGRNRKRAGLPEVEGILAGEKTETIIQEGEAKFKVTFDGQKTGFFLDQRENRLELEKFIKEGDRVLDICCYTGGFSVHAAIRGAEVVGVDLSKKALKLAEENMELNNIPKDRYEFIEGNAFKVMEEFIEDGEKFDVVILDPPAFAQSKKALKSAIKGYHMLNRFGAKLADRLLVTCSCSQPLEPDAFKALVIDACLKAKKWAKIIKYGSQSPDHPITSKGTEYLKCLFLSVEEI

SEQ ID NO: 60152 - protein, 433 aa, Arabidopsis thaliana
MGGSSSKESPRGGGSGRRYERSVSGSSSYSSAWDQSSYYQTPNHPSASPVSSYNSGRQTPKNLERKYSRIADNYRSIDEVTAALSHAGLESSNLIVGIDVTKSNEWTGARSFGRKSLHFIGTTPNPYQQAISIIGKTLSVFDEDNLIPCYGFGDATTHDQDVFSFNPNDTYCNGFEEVLMCYREIVPQLRLSGPTSFAPIIERAMTIVEESGGQYHVLLIIADGQVTRSVDTDNGGFSPQEQQTIDAIVRASEYPLSIVLVGVGDGPWDTMRQFDDNIPARAFDNFQFVNFTDIMSKNIDPARKEAEFALSALMEIPSQYKATLELGLLGQRTGHCPDRIALPPPTYATQSMRNSPRTSRSTSFQNKPYDNGVSSTPPSTTHNESQQQFCPVCLVSAKNMAFNCGHQTCAGCGEDLHVCPICRSSISVRIKLY

SEQ ID NO: 60153 - protein, 617 aa, Vitis vinifera
MEAVLQTKGLLSLPSNPKFRVFNSQQGLRQRLFVQKPKTLGGLSLPLNGFQKFQGFVAKPHDFCRQNRGFICRAEAAAAADGQSLFAEPEKPKFLGIETATFKKIVPLGLMFFCILFNYTILRDTKDVLVVTAPGSSAEIIPFLKTWVNLPMAVGFMLLYTKLANVLSKQALFYTVIVPFIAFFGAFGFVLYPLSNFFHPTALADKLLAALGPRFLGPLAILRIWSFCLFYVMAELWGSVVISVLFWGFANQIAKRFYPLFGLGANVALIFSGRTVKYFSNLRQNLGPGVDGWAISLKGMMSIVVLMGLAICFIYWWVNKSVPLPTRSKKKKEKVRLGTMESLKFLVSSRYIRDLATLVVAYGISINLVEVTWKSKLKAQFPSPNEYSSFMGDFSTATGIATFTMMLLSQWIFNKYGWGAAAKITPTVLLLTGVGFFSLILFGDPFAPALAKFGLTPLLAAVYVGAMQNIFSKSAKYSLFDPCKEMAYIPLDEDTKVKGKAAIDVVCNPLGKSGGALIQQFMILTFGSLANSTPYLGGILMVIVVAWLAAAKSLDTQFTALRREEELEKEMERATVKIPVVAQDESGNGSLASDPALNPAGGDSSSSSSETTPRNIS

SEQ ID NO: 60154 - protein, 160 aa, Glycine max
AKWKADHTGRCRAMPHIKTFARYKNQSLAWFLLTSANLSKAAWGALQKNNTQLMIRSYELGVLFLPSLFKRHESVFSCTSNVTVSEDKCPARESSEMKKTKLVTLTGIKKESMHSSSEVIIPLPLPYELPPLPYSSQDIPWSWDRQYNKKDVYGHVWPRM

SEQ ID NO: 60155 - protein, 273 aa, Flavobacteria bacterium BBFL7
MQKSILITGSTDGIGKLTALKLAKEGHNIYIHGRSEDKVNLVVSDIKQASNNENIKGYVADFSNLKAVKQLADLINKEIPSLDILINNAGIFKTPVSKTDTGLDIRMSVNYLAPYLLTENILPVLEKGTHTRIVNLSSAAQSTVKKGILTGDVSINASDSYAQSKLALTMWSFHFAQQHSNITTIAVNPGSLLNTKMAKEAYGQHWSPAEKGVNILFDLATSDAYQDATGKYFDNDKGETIGHFATAHPDAYDRDKILMLEAMTNEVLSDLGE

SEQ ID NO: 60156 - protein, 210 aa, Oryza sativa Indica Group
MRKGAAGMACTCSAAAAASALVKLLVLVVAVAATTSAGAADEPTYETKSIDPSLAVMTLPAPVTGPESLAFDGRGDGPYTGGSDGRILRWRGGRLGWTEFAYNSRHKSVGVCSPEKKLVVPESVCGRPLGLQFHHASGDLYVADAYLGLLRVPARGGLAELVATEAAGVPFNFLNGLDVDQRTGDVYFTDSSTTYRRRLPARPASCLRKI

SEQ ID NO: 60157 - protein, 281 aa, Oryza sativa Indica Group
MAFTCSAAAAAASSLVKLLVLVAAVAATTSAGGGDEPTYETKSIDPSLAVMMLPAPVTGPESLAFDGRGDGPYTGGSDGRILRWRGGRLGWTEFAYNSRHKAPARGGLAEVVATEAAGVPFNFLNGLDVDQRTGDVYFTDSSTTYRRSLHLLVVATGDETGRLLRYDARRRRVTVLHSGLPYPNGIVVSDDGTHVVVAHTGLCELRRYWLRGPRAGKSETFAEVPGYPDNMRRDGAGGYWVALSLGADSDDVVPTVAVRVAAAKNGGAAVVAEALFRGFTL

SEQ ID NO: 60158 - protein, 460 aa, Oryza sativa
MGERARQWLLVAGAGAAVGALSTAAVMRILSRSKRREGYVRSLLESNGVASGGAGSSVGTRVVATSDLLDDEVVSEQLTRNIQFFGMESQKKVTGSFVVVIGLGGVGSHAASMLLRSGVGRLLLVDFDQVSLSSLNRHAVATRDDVGTPKALCLKKHFSMIYPECQIEAKVQLYDPSCEDEILSGQPDFVLDCIDNIDTKVALLAACVRRGLRVLSAMGAGARADPTRIRVADLRESSNDPLSRAVRYRLKKDHGIEGGIPVVFSLEKPKAKLLPFQASKEEETPSDYQIVPGFRVRIIPVLGTIPAIFGQVMASYVITQLAKLDFQTEPIVNMDLDHYRILHHRLLEHEELIYGSAEQVLLTVDAEEVMYIVKELWRGRSARDQNLKDTGRKMWRSVNELMLVRWDKSKPAGVSNLILLKFNEADAHESTTLDQIKEEEPEFYNMVSRVLKQAEAEFAL

SEQ ID NO: 60159 - protein, 732 aa, Oryza sativa Japonica Group
MATHERKTIDLEQGWEFMQKGITKLKNILEGKPEPQFSSEDYMMLYTTIYNMCTQKPPHDYSQQLYEKYRESFEEYITSMVLPSLREKHDEFMLRELVKRWSNHKVMVRWLSRFFHYLDRYFISRRSLPQLSEVGLSCFRDLVYQEIKGKVKSAVISLIDQEREGEQIDRALLKNVLDIFVEIGLTSMDYYENDFEDFLLKDTADYYSIKAQTWILEDSCPDYMLKAEECLKREKERVAHYLHSSSEQKLLEKVQHELLTQYASQLLEKEHSGCHALLRDDKVDDLSRMYRLFSRITRGLEPVSQIFKQHVTNEGTALVKQAEDAASNKKVFVRKIIELHDKYVAYVTDCFQGHTLFHKALKEAFEVFCNKGVSGSSSAELLATFCDNILKKGGSEKLSDEAIEDTLEKVVRLLAYISDKDLFAEFYRKKLARRLLFDKSANDEHERSILTKLKQQCGGQFTSKMEGMVTDLTVARDHQAKFEEFISTHSELNPGIALAVTVLTTGFWPSYKSFDINLPAEMVKCVEVFKEFYQTRTKHRKLTWIYSLGTCNINAKFEAKTIELIVTTYQAALLLLFNGVDRLSYSEIVTQLNLSDDDVVRLLHSLSCAKYKILSKEPNNRSISPNDVFEFNSKFTDKLRRLKIPLPPVDEKKKVVEDVDKDRRYAIDASIVRIMKSRKVLGHQQLVMECVEQLGRMFKPDFKAIKKRIEDLITRDYLERDKDNPNVYRYLA

SEQ ID NO: 60160 - protein, 961 aa, Photobacterium profundum SS9
MNNVFDLDELKLASNIPVVHELYDLTPDELLLSQEHYESEVRSYPRRLPLAIAKAAGVMVEDTRGQLFIDCLAGAGTLALGYNHPEINQAIIDQLQAGLPYQTLDLTTPTKDKFIREVMSFLPDEFANNACIQFCGPSGADAVEAAIKLAKQTTGRNTMAAFHGAYHGMTNGTMAMMGNLSTKSRRQGLMSDVHFLPFPYSLRCPFGLKGDEGAKQSLRYIERMLSDDESGVQKPAAIIVEPVQGEGGVIPAPAFWLQELRRITKEQGILLILDEIQCGIGKTGHNFAFEEAGITPDILCLSKAVGGGLPMSLLIFNKSIDTWLPGEHTGTFRGNQLAMATGATTLQIIRRDNLVDHAQKAGQYLREGIERIAQYTDCIAEVRGKGLMLGVEIVKPNGAKNKFGEPEADPELTVNIQRAALERGLIIEKGGRQGSVLRFLPPLIITFEQIDFVLDALSKAIIATAGPAKIVEPVTANDQDDWRSYFIHTGEGGADQFEKVLNQTTQVLKNVFEGTTAPYSGLDPEVLKSMIYNIDLDHQQLPIETVIEQTGELIAKNSIMVQHPHCIAHLHTPPLLPAVAAEAFIASLNQSMDSWDQASSATFVEQKVVDWLCGVYNLGEQADGVFTSGGTQSNLMGLLLARDWAADTISGHNIQKDGLPEYASKMRILCSKKSHFTVQKSASLMGLGEHAVECVDTNPDGTIKIAALIKTVETLKNEGLLPFALVGTAGTTDHGAIDDLANMADIAEQHNLWLHVDGAYGGALILSRHKTRLHGIEKADSVSVDFHKLFFQPISCGAVLLKDKENFKYLLHHADYLNREDDLLPNLVDKSIATTKRFDALKVLMTMQCVGTQALGGMYDHLLGQTQQVADLVNNRNEFELLADPALSTVLFRYVGETADTDTDLLNKKIRMEALVKGVAVLGETVVDGKVALKFTILNPCLTMADFELLLNNINQLALTL

SEQ ID NO: 60161 - protein, 361 aa, Oryza sativa Indica Group
MWPCLSPRAAVLIALLLLPAAMAAAAAAAGGHGEEMKSIYAGPKVVPVRLGRPAFGPESLAFDHRGGGPYTGVSNGRVLRWRADRRRPGWTEFAHNYKHATVAECAARKKAAAAESVCGRPLGVQFDRRTGEMYIADAYLGLMRVGRRGGMAEVVAAEAGGVALNFVNGVDVDQATGDVYFTDSSTTYKRSDYLLVVLSGDATGRLLRYEPRTGNVTVLESGLAFPNGVAVSADGTHLVVAETASCRLLRHWLRGSNAGATEVLADLPGYPDNVRPAAADGGRGASYWVALNRDKAWTVNGTTPASVAAVRVVVDDGGGKVDVALRGFGGATVSEVVERNGSLWFGSVDTPYVGLLKLTSL

SEQ ID NO: 60162 - protein, 479 aa, Oryza sativa Indica Group
MAHRLLLPTNPLLPPGTGTATPRRRPVAATVRAALATSAEKARAAVGAEVVRSIRARQIVDSRGNPTVEVDLVAGDGRLHRSAVPSGASTGIYEALELRDGDGAAYGGKGVLNAVRNINEVIAPKLVGVDVRNQSDVDAIMLDIDGTPNKSKLGANAILGVSLSVCRAGAGAKEVPLYKHIQELAGTKELVMPVPAFNVINGGSHAGNNLAMQEFMLLPVGASSFSEALRMGSEVYHALKGIIKAKYGQDACNVGDEGGFAPNVQDNREGLVLLMDAIEKAGYSGKIKIGMDVAASEFLTKDGSYDLNFKNQPNDGAHVLSAQRLCDLYKEFVKDFPIVSIEDPFDQDDWSSWASLQSSVNIQIVGDDLLVTNPNRIAEAIGKKACNALLLKVNQIGTVTESIQAALDSKAAGWGVMVSHRSGETEDNFIADLAVGLASGQIKTGAPCRSERLAKYNQLLRIEEELGNVRYAGEAFRSP

SEQ ID NO: 60163 - protein, 185 aa, Photobacterium profundum SS9
MRLSIPNILSFIRLILIPFFVIAFYLPYEWSAFATALIFFIAGATDWFDGYLARKLNQTTRFGAFIDPVADKLMVITAMVLVVEDYHSIWVTIPAVTMIGREIIISALREWMAELGKRASVAVSWIGKVKTASQMFALLLLLWHPHEWVTWLGYVSLYVAMVLTYWSMYQYLKAAKGDLLNAEHH

SEQ ID NO: 60164 - protein, 276 aa, Oryza sativa Japonica Group
MSQEQPRRPSEKAAGGGGGEQGIRYGDVFPVTGSLAAKPIAPRDAATMQSAENLVLGKTVKGGPAAAMESAASRNEEMGVVGHDQATDAAAEQGVNVSDTLVPGGGRIVTEFVAGQAVGHYVEQDDGAAVVAGVVGAAPGAVRVEEPAKITIGEALEAAALAAGGTPVERSDAAAIQAAEAKATGTDTYMPGGLAAQAQSAAVANLWTARDADKTKLGDVLSNATAKLAADKEVESGDAARVAGAEMRNKPGAAARPGGVAASMAAAARLNRGPTT

SEQ ID NO: 60165 - protein, 131 aa, Triticum aestivum
MATISAAAATTVVARAAIARPQALGLPHLRTRSERVRCSYSKDAKEATPAAAVRGAGASLLAAAGAVTASAGPALALVDERMSTEGTGLSLGLSNNLPGWILLGVFGLIWSLYTVYTSGLDEDEESGGLSL

SEQ ID NO: 60166 - protein, 274 aa, Streptomyces avermitilis MA-4680
MGNAELHSIHIHPVKAFRGQSPREAVVEPWGLAGDRRWVLVDDGGKVVTQRQEPRLALATAELLPGGGVRLSAPGHEPVSVPVPEPAVTTTLDIFGDKVEAVVADDTAHAWCSTYLGADVRLVHMDDPATRRPVDPDYARPGETVSFADGYPLLVTTLASLDSLNDLIAQGDHPDEGPLPMNRFRPNVVVAGTAAWAEDDWSRIAIGEVTFRVTKMCGRCVVTTTDQSTAGRGKEPLRTLGRHRRFGKDLAFGQNLVPESPGTVRVGDRVRILE

SEQ ID NO: 60167 - protein, 228 aa, Gossypium anapoides
FTSLCHTDVYFWEAKGQTPLFPRIFGHEAGGIVESVGEGVTHLKPGDHVLPVFTGECGNCRHCKSKESNMCDLLRINTDRGVMLSDGKTRFSINGKPIYHFVGTSTFSEYTVAHVGSVAKINPAAPLDKVCILSCGISTGLGATLNVAKPAKGSTVAIFGLGAVGLAAAEGARIAGASRIIGVDLNPNRFEEAKKFGCTEFVNPKDHNKPVQEVLAEMTNGGVDRSVE

SEQ ID NO: 60168 - protein, 978 aa, Acidithiobacillus ferrooxidans
MAEPYVIKMPQLSDTMTEGVLVSWEKPAGARVERGDVVATVETDKAIMDVEVFRSGYWRAPAEANSVIPVGGTIGYITDSAVETVAAPVPAAPAVVPTGPASATPPAPEGYAVKMPQLSDTMTEGVLVSWEKAPGDRIQRGDVVATVETDKAIMDVEVFREGYLSGPLVAVDAVVPVGEAIAWLVESPEQVSHENAVHDGGLRQPDATSAPVATPLPAAAMSGPVPGADPAPRPQQGAASPFARQLAGQRGVDINGLRGTGPAGVIVAADVLGAAGGRAAPVASSVLPSPRCPVTPRHDGHRKSDQPGDGRFPEYSGFSCHRAGQARGADPRRQGTQAFRHGGDRKAASQALHRHPLVNAAYQPVDKIVERSQHDIGIAATTEDGGLIVPVLRGVEGKTPEQLQTEWTSLLEKARKRRLSPPEYTNPTFTISNMGDVRIAQFDAIVTPGTAAIIAIAGNGPEGMPITITADHRVVNGAEAALFLNDLKQAIEHPENWLGSGGPVIPEGDYDVQVLVIGAGPGGEDCARELAENGIRVAMVNDAPAGRECLWRGCIPSKAWRAAADRIRPGARRAMGITLGTPRLDWAQLEQHRRGILQTRGRNGPENRSGCENSGAGRLCRFTGDHSVEISGKDARTLTFGACVIATGAPAFVPPIPGIQDALKSGAAVTSDTVWNLKQPPARLCVIGAGAIGMEMAQMFHDFGAEVRVLEALPRPVAEMEKEVAEQLMKAIAHNSLRLQVLTGVKVTEVAGATRPVGGALQSGDEAANYACDLLLVATGKRPDTSGLNLAAAGVALGDRAVIAVDASGRTNVPHIYAVGDVIGGYMLAHTAGQQGRVAAASLLGHSARYEAAKDCGVTFTRPQCAFVGLSLEQARAEGIDAVEVKVPLSIDAKAMMTGETDGLIKIVADKISHRIVGVHFLADHADTLVGEAVMMVSAGLTLEQVAGAIHPHPTQTELFGEMARRLLSRLRSARAAS

SEQ ID NO: 60169 - protein, 380 aa, Pichia methanolica
MSTAGKTITCKAAVAWEAGKDLSIETIEVAPPKAHEVRVKIAYTGVCHTDAFTLSGKDAEGEFPVIFGHEGAGIVESIGEGVTSVKVGDHVVCLYTPECKECKFCKSGKTNLCGKIRATQGKGLMPDGTSRFTCKGKKLLHYMGCSTFSQYTVLADISVVAVDPKAPMDRTCLLGCGITTGYGAATNTAKISPGDNIAIFGAGCIGLSVIQGAVERKAGKIIVVDINDDKKEWADKFGATDFVNPTKLPAGVTIVDKLVEMTDGGCDFTFDCTGNVGVMRNALEACHKGWGESIVIGVAPAGAEISTRPFQLVTGRVWKGCAFGGVKGRSQMPGLVQDYLQGKIKVDEFITHRHPLEDINDAFHDMHAGDCIRAVITMDE

SEQ ID NO: 60170 - protein, 228 aa, Gossypium anapoides
  misc_feature (133)..(133): Xaa can be any naturally occurring amino acid
FTSLCHTDVYFWEAKGQTPLFPRIFGHEAGGIVESVGEGVTHLKPGDHVLPVFTGECGNCRHCKSKESNMCDLLRINTDRGVMLSDGKTRFSINGKPIYHFVGTSTFSEYTVAHVGSVAKINPAAPLDKVCIXSCGISTGLGATLNVAKPAKGSTVAIFGLGAVGLAAAEGARIAGASRIIGVDLNPNRFEEAKKFGCTEFVNPKDHNKPVQEVLAEMTNGGVDRSVE

SEQ ID NO: 60171 - protein, 440 aa, Oceanicola granulosus HTCC2516
MNRPLTPNDMSSFWMPFTPNRDFAADPRLVVAADGMHYTSSDGRQIIDGAAGLWCVNAGHNSPRIVEAVKKQVSTLDYAPHFNFGTPQAYELSARLAALFPAGLEHVFFTNSGSESVDTALKIALHYHRMRGDAARTRLIGRERGYHGVGFGGISVGGMVKNRMHFGTMLAGVDHIRHTHDPERNAFSRGCPEHGAEFADDLIRLAELHDPSTIAAVIVEPMAGSTGVLLPPKGYLQRLREICDRYGILLIFDEVITAYGRLGKASAAEKFGVTPDIITTAKGLTNGTIPMGAVMVSEKIYDSAMENADAPIELFHGYTYSAHPIATAAALATLETYREDQLFERADALAPVWEDLVHGLKGLPHVKDLRNLGLVAAIELESREGAVGARATEAMKAAWAKGLMVRVTGDTIALSPPLIVTEAQIAEIFDILSGILRDLA

SEQ ID NO: 60172 - protein, 191 aa, Listeria monocytogenes str. 4b F2365
MQLIFVRHGETDWNVAKKYCGQLDVALNENGIRQMEQLREKLENYSIDLVVTSDLMRVKQSANILSNAKTLRFPALNEMNFGDFEGYTYQEISTKFPKAWNEYCNNWQTALFSNGESFPIFYERVVAILEEEMEKWQQLDTVLLVGHLGVLRVIALFLQKQTIAQYWDIDFKQGCYSLWDNKSQHFLISNQ

SEQ ID NO: 60173 - protein, 228 aa, Gossypium costulatum
FTSLCHTDVYFWEAKGQTPLFPRIFGHEAGGIVESVGEGVTHLKPGDHVLPVFTGECGNCRHCKSKESNMCDLLRINTDRGVMLSDGKTRFSINGKPIYHFVGTSTFSEYTVAHAGSVAKINPAAPLDKVCILSCGISTGLGATLNVAKPAKGSTVAIFGLGAVGLAAAEGARIAGAFRIIGVDLNPNRFEEAKKFGCTEFVNPKDHNKPVQEVLAEMTNGGVDRSVE

SEQ ID NO: 60174 - protein, 273 aa, Ehrlichia canis str. Jake
MHLFCFGYGYTAKFLAQKLLPLKWKISGTSFNKISQDKNVNLLNYNFPLPESIFSDVTHVLISIPPEGDNVLQKYYKYLKEIKWLGYLSATNVYGDHNGNWVDETSATNPSTVSGINRLKQEKIWYNSNLPSHIFRLSGIYGPNRNVLCNLIQNNVKYIISDTIFSRIHVEDIANILFTSINNPNPGSIYNCADDLPTSYSNIIKYGSQLLNIKTPEPVLLEDLSDNMKKFYSERKLVSNFKIKNALNISLLYPSYIQGLQNLIKIEKPLSQQ

SEQ ID NO: 60175 - protein, 530 aa, Triticum aestivum
MQGGNHMLLEEPVRLASVLAPAKPKVFPSLTKIVGTLGPNSHSVEVIEECLTAGMSVARFDFSWKDATYHQETLDNLRKAAQNVKKLCPIMLDTVGPEIQVHNSTGGAIELIGGNHVTITPDLSKAPSADILPIKFGDLAKVVKKGDTLFIGQYLFTGSETTSLWLEVTETSGAEVICYVKNTATLSGPIFTLHVSQVHISMPTLSEYDKQVISTWGLQNSVDIISLSHTRSSEDVRELRAFLKSHDLQDTQIYAKVENAEGLEHFDEILQEADGIIISRGDLGIDLPPERVFMSQKTGIHKCNMAGKPVIITRVVDSMIDNLRPTRAEATDVANAVLDGTDGILLGAETLRGQYPVDAVRTVGRICAEAETVYNQSLHFKKVVRHVGEPMVHEESVASSAVRSAMKVKAAAIVVFTFSGRAARLIAKYRAPMPVLAVVFPREGSDPSKWRSYGTTQARQCFSVRGVYPLMGSTDEAETGGLTKEEYGIKLALNYGRSVGIIKPYDRVIIFEKIGDSSVVKIIECDDSER

SEQ ID NO: 60176 - protein, 228 aa, Gossypium costulatum
  misc_feature (129)..(129): Xaa can be any naturally occurring amino acid
FTSLCHTDVYFWEAKGQTPLFPRIFGHEAGGIVESVGEGVTHLKPGDHVLPVFTGECGNCRHCKSKESNMCDLLRINTDRGVMLSDGKTRFSINGKPIYHFVGTSTFSEYTVAHVGSVAKINPAAPLDXVCILSCGISTGLGATLNVAKPAKGSTVAIFGLGAVGLAAAEGARIAGASRIIGVDLNPNRFEEAKKFGCTEFVNPKDHNKPVQEVLAEMTNGGVDRSVE

SEQ ID NO: 60177 - protein, 335 aa, Ashbya gossypii ATCC 10895
MTVSESEQIPVWLDCDPGHDDAVAILLAAFSPKFRLLGVSASYGNAAPEHTTYNALALLTALGKTDIKVYQGAKRPWVREPVYAEDIHGESGLEGSSLLPVPRIELEKESYLDAMERAILKYSGRISLICTGALTSAATLLRDRPHLKKHIKFISVMGGGIDQGNCNPRKSAEFNIWVDPHAAESVLCDEDIRDRCILVPLDLTHKAIATAEIQERVLGNGCNIRRLYYELFLFFGATYKNVQGFERGPPVHDPLTLLPLMAFYDPSFAATVGFVYRRMDLRVTTALSEDEGKLIGVVPDTEGKGVIVGFDLNFEFFWQQIYNALAAAEGTSTIE

SEQ ID NO: 60178 - protein, 491 aa, Ehrlichia ruminantium str. Welgevonden
MLHLQTTVLFFIITEFSFKVINMNKHEFLIIGSGPGGYIAAIRAAQLGYNVAIIEKENTLGGVCLNWGCIPTKSLLHSALIYHNIKKADVFGINVTNVTCNFTKIIERSRNVVEKLSNGISGLMKKNNIKVYSGTAKLLGEGTVEVLDNNNDKINITSKHIIIATGSHPRNLPNINFDNNIIWNAKNAMTPNILPKSLAIIGTGAIGIEFASFYNTFGTQVTMIELRDNILPLEDHEVSKSMHQILNQKGIKIYTKSSVTKLEKSNNNARIQISNTIDLEVDKVILAVGIQPNTDNLGLDNTKIQIDQAGFIITDKYCCTSESGVYAIGDVAGPPCLAHKASHEAILCVENIAAQEKKITDRNIHHINKENIPSCIFSIPQIASIGLTEHQAKSMGYDIKIGKFNANCSGKAIAIDETEGFVKVIINKTTGELLGAHMIGAEVTEMINGYIIGKQLEATDRDIISSIFPHPTLSEMIHEAVLASNNESLNS

SEQ ID NO: 60179 - protein, 544 aa, Phytophthora megasperma
QQELVGMLNTAKIPANVEVVVAPSQVHAATVKASLRADVRVSGQDVWTQGNGAFTGETSAEMLKDLGAEYTLVGHSERRGKGESNTDVAKKAAYALEKGLAVIACIGESKETREANETVSYITKQLDAYAAEINDWTNVVIAYEPIWAIGTGLTASPEQAQDVHASIRAWLKEKVSPEAAEKTRVIYGGSVGAKNAPELSQKEDIDGFLVGGASLKPDFLQIINAQNPTTNVGGAVNVAINGFGRIGRLVLRAAATNPLINIVAINDPFISTTYMEYMLEYDTVHGKFGGSLSHDEKHIFVNGKPIRVFNEMNPENIKWGEEQVQYVVESTGAFKTIETASAHMKNGVEKVVISAPSSDAPMFVMGVNHELYEKNMHVVSNASCTTNCLAPLAKVVHDKFGIKEGLMTTVHAVTATQKTVDGPSKKDWRGGRGACFNIIPSSTGAAKAVGKVIPSLNGKLTGMSFRVPTADVSVVDLTARLVNPASYDEIKAAIKSASENEMKGILGYTEKAVVSSDFIGDSHSSIFDASAGIALTDDFVKLVS

SEQ ID NO: 60180 - protein, 485 aa, Acidobacteria bacterium Ellin345
MEAIISPTPKSAPSNTPQLARDLRVSHATAVVVGTIIGSGIFLVPAEMMRAVGTAKLVYLAWIVGGILSFLGALTYAELGAMKPQSGGEYVYVRDAYGPLMSFLYAWSWFVIAKPGSMATIATGMMQILGGYPALSFLPKNVVSGVPFTYAQLAAVALIIFISAVNYIGVKKAGQFQVVFTVLKLAIIFGVIVVGFFAGHGSWSNFTTSFTGATGGIAGFMIALVAALWAYDGWNDINMVAEEIDHPERNVPIALIVGVGIVAALYMLLNAAVQYALPAQAIAMSKRAASDAVLVSIGAGAASIFAALMAIQMLATINGTTLSGARIPYALARDGYFFEAIGKVHPRYLTPANAIVFQGALAVILVSLVGKFQQLFSLTIFAEWLFYMIATSTVFVFRRREPNANRPYKTWGYPVVPAVFIAAAAMLLCYTFVDNLKYAMIPTTLIGPPLNSISTGGALVILLGVPVFWWFARQKSLTTKGTKEL

SEQ ID NO: 60181 - protein, 535 aa, Phytophthora multivesiculata
QQELVGMLNTAKIPANVEVVVAPSQVHAATVKASLRPDVRVSGQDVWKQGNGAFTGETSAEMLKDLGAEYTLVGHSERREKGETNEVVAKKAAYALEKGLGVIACIGETKKHREANQTVAYITEQLDAYAAEIKDWTDVVIAYEPIWAIGTGLTASPEQAQEVHASIRSWLKEKVSPEAAEKTRVIYGGSVSAKNAPELSQKEDIDGFLVGGASLKPDFLQIINAQSPTTNVGGAVNVAINGFGRIGRLVLRAAATNPLINIVAINDPFISTTYMEYMLKYDTVHGKFAGSLSHDEKHIYVNGKPIRVFNEMNPANIKWSEEQVQYVVESTGAFKTIETASAHMKNGVEKVVISAPSSDAPMFVMGVNHELYEKNMHVVSNASCTTNCLAPLAKVVNDKFGIKEGLMTTVHAVTATQKTVDGPSKKDWRGGRGACFNIIPSSTGAAKAVGKVIPSLNGKLTGMSFRVPTADVSVVDLTARLVNPASYDEIKAAIKSASENEMKGILGYTEEAVVSSDFIGDSHSSIFDAEAGIAL

SEQ ID NO: 60182 - protein, 235 aa, Vitis vinifera
MSSQICRSASRAARSLLSASKSSNLLAEGRAVAAVAALSSRGKPFLSSFGNAGSGNAYRGWLSSVLALPAAAYMMQEQELHATEMERTFIAIKPDGVQRGLIAEILSRFERKGFKLVAIKIVVPSKDFAQKHYHDLKERPFFNGLCDFLSSGPVVAMVWEGEGVIKYGRKLIGATDPQKSEPGTIRGDLAVVVGRNIIHGSDGPETAKDEINLWFKPEELVNYSSNAEKWIYGVN

SEQ ID NO: 60183 - protein, 546 aa, Phytophthora hedraiandra
  misc_feature (337)..(337): Xaa can be any naturally occurring amino acid
QELVGMLNTAKIPANVEVVVAPSQVHAATVKAALRSDVRVSGQDVWKQGNGAFTGETSAEMLKDLGAEYTLVGHSERREKGETNEIVAKKAAYALEKGLAVIACIGETKELREANQTVAYITEQLDAYAAEINDWTNVVIAYEPIWAIGTGLTASPEQAQEVHASIRAWLKEKVSPEAGDKTRVIYGGSVGAKNAPELSQKEDIDGFLVGGASLKPDFLHIINAQNPTTNVGGAVNVAINGFGRIGRLVLRAAAKNPLINIVAINDPFITTTYMEYMLEYDTVHGKFDGSLSHDEKHIFVNGKPIRVFNEMNPANITWGEEQVQYVVESTGAFTTLXKASAHLKNGVEKVVISAPSSDAPMFVMGVNHELYEKNMHVVSNASCTTNCLAPLAKVVNDKFGIKEGLMTTVHAVTATQKTVDGPSKKDWRGGRGACFNIIPSSTGAAKAVGKVIPSLNGKLTGMSFRVPTADVSVVDLTARLVNPASYDEIKAAIKSASENEMKGILGYTEKAVVSSDFIGDSHSSIFDASAGIALTDDFVKLVSWYD

SEQ ID NO: 60184 - protein, 546 aa, Phytophthora cajani
QELVGMLNTAKIPANVEVVVAPSQVHAATVKAALRPDVRVSGQDVWKQGNGAFTGETSAEMLKDLGAEYTLVGHSERREKGETNEVVAKKAAYALEKGLAVIACIGETKELREANQTVAFITEQLDAYAAEIKDWTNVVIAYEPIWAIGTGLTASPDQAQEVHASIRAWLKEKVSPEAAEKTRVIYGGSVGAKNAPELSQKADIDGFLVGGASLKPDFLQIINAQNPTDNVGGAVNVAINGFGRIGRLVLRAAAKNPLINIVAINDPFISTTYMEYMLEYDTVHGKFDGTLSHDEQHIFVNGKPIRVFNEMNPANIKWGEEQVQYVVESTGAFTTTEKASAHLQNGVEKVVISAPSSDAPMFVMGVNHELYEKNMHVVSNASCTTNCLAPLAKVVHDKFGIKEGLMTTVHAVTATQKTVDGPSKKDWRGGRGACFNIIPSSTGAAKAVGKVIPDLNGKLTGMSFRVPTADVSVVDLTARLVNPASYDEIKAAIKSASEKEMKGILGYTEKAVVSSDFIGDSHSSIFDASAGIALTDDFVKLVSWYD

SEQ ID NO: 60185 - protein, 388 aa, Desulfovibrio vulgaris subsp. vulgaris str. Hildenborough
MAAFKLADRLATLPPYLFAGIDKVKAEVAARGVDIISLGIGDPDMATPGFIIEAMKEAIARPANHQYPSYVGMLAFRQEVANWYDRRFGVSLDPATEVIGLIGSKEGIAHFPFAFINPGDLVLVCTPNYPVYHIATGFAGGEVQFVPLLEENDFLPDLDAIPEDTWKRAKMIFVNYPNNPTAATAPLGFYEKLVDICRRFDVIIAHDTAYTEIYYDEDNRPPSILSVPGAKDVAIEFHSLSKTYNMTGWRVGMAVGNPTLVAGLGKIKENMDSGIFQAVQEASIVALRDGDDFCRELRGIYRQRRDTVINALHKAGIQCRVPQATFYVWARVPQGHTSADFVTRVLQETGVVVTPGNGFGTPGEGFFRISLTVDNARLEEAVSRIAKL

SEQ ID NO: 60186 - protein, 422 aa, Xenorhabdus nematophila
MRPSDIEFDLRHIWHPYTSMIRPFPAYPVVSATGVELVLSDGRKLIDGMSSWWAAIHGYNHPVLNEAAKSQIDKMSHVMFGGITHPPAVELCKQLVALTPDSLECVFLADSGSVAVEVALKMALQYWQARGEKRQRFLTLRHGYHGDTFGAMSVCDPDNSMHSLYNGYLPNHLFADAPTCQFDDEWQPEDIDSFKRLLRQYHAEITAVVLEPIVQGAGGMRIYHPEYLRQVRQLCDEHQILLIADEIATGFGRTGKLFACEHAQIEPDILCLGKALTGGYMTLSATLTTRHVAEIISQGEAGCFMHGPTFMGNPLACAVASASLKLLSESSWQQHIQSIETQLKTELLPLKIHHSVKDVRVLGAIGVVEMKQPVDVASLQRHFVQQGVWIRPFGRLIYLMPPYIIQSEQLSQLTTAIVDAIN

SEQ ID NO: 60187 - protein, 498 aa, Cicer arietinum
MGILSLLCYSLFYLSFFFIIRLLFQSRKFKNLPPGPPSLPIIGNLHHLKRPLHRTFKGLSKTYGDIISLWFGSRLVVVVSSLSEFQQCFTKNDVVLANRPRFLSGKYIFYNYTTLGSTSYSEHWRNLRRITSLDVLSNHRINNFSGVRRDETQRLITKLAEDSSTSFAEVELSFRFYDMTFNNIMRMIPGKRYYGEDCDMSDLQEASQFRDMVTELLQLSGANNKTDFMPLLKFFDFENLEKRVKNIADKTDAFLRGLLQEQRNKKERTNTMIDHLLNLQESQPEYYTDQIIKGLALAMLLAGTDSSAVTLEWSMSNLLNHPEILKKVKDELDIHVGQDRLVDESDLPKLTYLKNVIYETLRLCTPAPLLLPHSTSDDCIIGGYKVPRDTIVLINAWAIHRDPKSWSEATSFKPERFDKKGEIEKVIAFGMGRRVCPGEALALRTISMTLALLVQCFDWKRTSDDKIDMAERDGFVLTKLIPLKAMCKTRPVVNKVFK

SEQ ID NO: 60188 - protein, 487 aa, Mycobacterium sp. JLS
MTELIPHVIDGEETESASRACFDTVDPWTRQPWARVALGGHEEAARAVTAARRAFDDGPWPRMGLAERGAVLHRLADLIIEHRDELALADTTDMGKPITDTRGNDVPRSAQNFRFFADHARLSAGEALPMDTGHHAYTRFEPAGVVAAIAPWNFPLMLETWKVAPALAWGNTVVLKPAEDTPASATILARLALQAGMPDGVLNVVHGYGPGSVGSALTGDPRVDRITFTGETGTGRTIAAAAAAHLTPVSLELGGKGANLVFADADLDSAVSWSIRAIFSNAGQVCLAGSRLYVQREIYDEFLSRFVNAAESLIAGDPKLAGTQLGPLASEEHWKKVRSYVEGIPADGGTMRTGGPGEGWLIRPTVVTDLPATARLCREEIFGPVAVVAPFDTEADGIAAANNTPYGLNAMLFTENLSRAHRVAAALNAGTVWVNCFFVRDLRAPFGGVGDSGIGREGGTFSREFFTEPKAVVMAISDIASAHVQSD

SEQ ID NO: 60189 - protein, 181 aa, Galdieria sulphuraria
MKHTLSVLVEDESGVLTRISGLFARRGFNIDSLAVGPAEKAGISRITMVIRGDNRIIEQITKHLYKLVNVLKIQDITNIPCVERELMLIKVKTGENKRNEILEIANIFRARVVDLSESFIILEITGDPGKIAAIEKLLEKYGICEIARTGKIALTRESKINTEILRLNTMINNDKIRGGGT

SEQ ID NO: 60190 - protein, 453 aa, Cryptococcus neoformans var. neoformans B-3501A
MGVSDYFIAFSAKFWERLRFPSKFTRDLVWGIILGITVSLSSTSAALILQEWRRKRAVQRIPPRPIELRSDEIVPGVTGLIGTGNTPLIRINSLSDALGVEILGKAEFLNPGGSVKDRVALQIIEDAEAQGLLYPNTGSVLFEGTVGSTGISLATVGKAKGYESCIIMPDDVAIEKVQILEKLGARVERVRPASIVDQKQFVNLARKRALEFGKSELTNIPGHGEEIAVSTAAEPSEINHHHLFPSAFEHKPRGFFADQFENDSNFMAHYKGTGPEILRQTSGHLDGFVSGAGTGCFLKKALPDLKIVLSDPEGSGLFNKVRFNVMFDPKESEGKKRRHQVDTVVEGIGINRITYNFSLGLPVIDDAYRVSDEEAVAMSRYLVQHDGLFLGSSSACNLIACIRLAKTMSRGSRIATILCDSGSRHQSKFWSDDYLRANNIAIDPSIVDRLLES

SEQ ID NO: 60191 - protein, 218 aa, Oryza sativa Japonica Group
MARIVLVVAFAAVVVVQAAMAQRPGMPPAVVPPSLPTTTPPAPTVVAPPLPTTPPPAVVAPSPPLPPLTPPPAIVPPALPPPPPLPAIVVPPALPPTPAIAVPPALPPIPAIVPPSLPPTPEANLPCVAELAPCSEFYRNATAKPTGACCAPLKKAYESELGCLCSVLTNPAMAATVGVDTKKGLDLFGRCDVKVPADVCSSHAPAPGTSSQQSSHSV

SEQ ID NO: 60192 - protein, 306 aa, Haemophilus somnus 2336
MDIAVIGSNMVDLISYINDMPKMGETLEAHDFKMGCGGKGANQAIAAAKLGASVMMMTKVGDDVFADNTINNFKQYGVNTDFVEKVVGVSSGVAPIFVDRSSQNRILIIKGANSYLKPADIDHAEVQLKNCKLLILQLEIPLETVYYAIDFANKHQIPVILNPAPASKELDISYACKCDFFMPNETELEILTGMPVDNMEQIQAAANSLFLKGLKNLIVTLGEKGSVWFHRDQVTHVSSHKVNAIDTSGAGDAFIGCFAHFYIQTNDVKQAMQMASAYSAYSVTGQGTQSSYPDKAQFEQFLQSLK

SEQ ID NO: 60193 - protein, 228 aa, Gossypium costulatum
FTSLCHTDVYFWEAKGQTPLFPRIFGHEAGGIVESVGEGVTHLKPGDHVLPVFTGECGNCRHCKSKESNMCDLLRINTDRGVMLSDGKTRFSINGKPIYHFVGTSTFSEYTVAHVGSVAKINPVAPLDKVCILSCGISTGLGATLNVAKPAKGSTVAIFGLGAVGLAAAEGARIAGASRIIGVDLNPNRFEEAKKFGCTEFVNPKDHNKPVQEVLAEMTNGGVDRSVE

SEQ ID NO: 60194 - protein, 228 aa, Gossypium cunninghamii
FTSLCHTDVYFWEAKGQTPLFPRIFGHEAGGIVESVGEGVTHLKPGDHALPVFTGECGNCRHCKSKESNMCGLLRINTDRGVMLSDGKTRFSINGKPIYHFVGTSTFSEYTVAHVGSVAKINPAAPLDKVCILSCGISTGLGATLNVAKPAKGSTVAIFGLGAVGLAAAEGARIAGASRIIGVDLNPNRFEEAKKFGCTEFVNPKDHNKPVQEVLAEMTNGGVDRSVE

SEQ ID NO: 60195 - protein, 376 aa, Coccidioides immitis RS
MPSPCTAKTTLSIGIQRARGANRYTWKNPSFVLEAVKKVKFEDRPVPTIQHPHDVMINVKYTGVCGSDVHYWDHGAIGHLVLKEPMVLGHESSGIVISVGPGVRSLKPGDRVALEPGVPCRQCEACKGGKYNLCDDMRFAATPPYDGTLAKYYILPEDFCYKIPESMNLQEAALMEPLSVAVHITKQGGVKPGDQVVVFGAGPVGLLCCAVARAFGASKVIAVDVQQVRLHFARKYAATATFMPGSIPAAENAQRLKEQCGLGRGADVVLDASGAEPSAQTGIHALRPGGTYVQGGMGRAEFSVPIMVVCTREISVKGSFRYSSGDYKLALELVQTGKINVRDLITKVVRFTDAEQAIIEVKAGKGIKTLISGVED

SEQ ID NO: 60196 - protein, 118 aa, Triticum aestivum
  misc_feature (60)..(60): Xaa can be any naturally occurring amino acid
MAATTHATAPSPSLSSLLSRPRSAAPQLRLRPAAHRRVRCATDAAVPAPAATNKPRRAAXEDIREEAARHRAPANGFSAWYEPFPPGPAGAGSTYERYSLDEIVYRSSSGGLLDVRHD

SEQ ID NO: 60197 - protein, 63 aa, Brassica napus
MVKVFPSFGMPLGAFPFWQSMDKVPVWIAFPQAENQKRMEKEPEVNRVKVDLLRKVKKEDPFA

SEQ ID NO: 60198 - protein, 415 aa, Hevea brasiliensis
MAESWVIMVTAQTPTNIAVIKYWGKRDEKLILPVNDSISVTLDPVHLCTTTTVAVSPSFAQDRMWLNGKEISLSGGRYQNCLREIRARACDVEDKERGIKISKKDWEKLHVHIASYNNFPTAAGLASSAAGFACLVFALAKLMNAKEDHSELSAIARQGSGSACRSLFGGFVKWKMGKVEDGSDSLAVQVVDEKHWDDLVIIIAVVSSRQKETSSTTGMRETVETSLLLQHRAKEIVPKRIVQMEESIKNRNFASFAHLTCADSNQFHAVCMDTCPPIFYMNDTSHRIISCVEKWNRSVGTPQVAYTFDAGPNAVLIAHNRKAAAQLLQKLLFYFPPNSDTELNSYVLGDKSILKDAGIEDLKDVEALPPPPEIKDAPRYKGDVSYFICTRPGRGPVLLSDESQALLSPETGLPK

SEQ ID NO: 60199 - protein, 253 aa, Glycine max
MGRKFFVGGNWKCNGTTEEVKKIVTTLNEAKVPGEDVVEVVVSPPFVFLPVVKSLLRPDFHVSAQNCWVRKGGAYTGEVSAEMLVNLGIPWVIIGHSERRQLLNESNEFVGDKVAYALQQGLKVIACIGETLEQREAGTTTAVVSEQTKAIAAKISNWDNVVLAYEPVWAIGTGKVATPAQAQEVHADLRKWVHDNVSAEVAASVRIIYGGSVNGGNCKELAAQPDVDGFLVGGASLKPEFVDIINAATVKKN

SEQ ID NO: 60200 - protein, 391 aa, Desulfovibrio vulgaris subsp. vulgaris str. Hildenborough
MSAPEPVNGTPPDVAQRLQAIRVTIDGLDRDLLALLNRRAALSLEVGRIKATDPGIVFRPFREREVFDNLEAANEGPLPDEHLRAIWREIISSSRSLQRPQRVAYLGPEGTFSYFAGMEFLGRAMDYRPQPGLPDVFRAVHDRQCELGIVPLENSLQGTVGQSLDLFLQHEVFIQAELFCRISHCLLGTAAALADIDTVYSHPQPLAQCGGWLRAHLPNARIIPTESTAAAARRAAGEAGAAAIGHRSLADLLGLNVLERGIEDQPDNWTRFVVIAPAPADQQGREKTSMLFSLPDKAGALAGVLELLAREGINMKKLESRPLRGEKWQYVFFVDVECDLGTERYARLVEELRTLCHTLRILGSYPVGPHFDMAAHEALPGLPDQIGQGGL

SEQ ID NO: 60201 - protein, 429 aa, Magnaporthe grisea 70-15
MASALFFLDLKGKTLLARNYRGDIPMSAVEKFPILLSEAEEESSAVPPCFSHEGINYLYIRHNNLYLLALTKRNTNAAEILLFLHKIVEVFTEYFKALEEESIRDNFVIIYELLDEMMDFGYPQTTESKILQEYITQESHKLEIQARPPIAVTNAVSWRSEGIRYRKNEVFLDVVESLNLLVSSNGNVLRSEILGAIKMKCYLSGMPELRLGLNDKVMFETTGRTTRGKAIEMEDVKFHQCVRLSRFENDRTISFIPPDGEFELMSYRLNTQVKPLIWVECVVESHSGSRIEYMLKAKAQFKRRSTANNVEIVVPVPDDADTPRFRTNIGSVHYAPEQSAIVWKIKQFGGGKEFLMRAELGLPSVRGDDEHGGGKRPIQVKFEIPYFTTSGIQVRYLKITEPKLQYPSLPWVRYITQSGDIAVRLPDAV

SEQ ID NO: 60202 - protein, 555 aa, Phytophthora iranica
KCNGSLGQAQELVGMLNTAKIPANVEVVVAPSQVHVATVKASLRSDVRVSGQDVWKQGNGAFTGETSAEMLKDLGAEYTLVGHSERREKGETNEIVAKKAAYALEKGLGVIACIGETKNLREANQTVAYITEQLDAYAAEIKDWTNVVIAYEPIWAIGTGLTASPEQAQEVHASIRAWLKEKVSPDAAEKTRVIYGGSVGAKNAPELSQKEDIDGFLVGGASLKPDFLQIINAQNPTTNVGGAVNVAINGFGRIGRLVLRAAAKNPFINIVAINDPFISTTYMEYMLEYDTVHGKFDGSLSHDEKHILVNGKPIRVFNEMNPENIKWGEEQVQYVVESTGAFTTLEKASAHMKNGVEKVVISAPSSDAPMFVMGVNHELYEKNMHVVSNASCTTNCLAPLAKVVNDKFGIKEGLMTTVHAVTATQKTVDGPSKKDWRGGRGACFNIIPSSTGAAKAVGKVIPSLNGKLTGMSFRVPTADVSVVDLTARLVNPASYEEIKAAIKSASENEMKGILGYTEEAVVSSDFIGDSHSSIFDAEAGIALTDDFVKLVSWYD

SEQ ID NO: 60203 - protein, 337 aa, Arabidopsis thaliana
MGDDQLDFELPEEVLSVIPMDPFEQLDLARKITSMAIASRVSNLDSEVVELRQKLLGKESVVRELEEKASRLERDCREADSRLKVVLEDNIQDFLGVTGYLRMNLTKEKDSLAMTVTKLTRDLAKLETFKRQLIKSLSDESGPQTEPVDIRTCDQPGSYPGKDGRINAHSIKQAYSGSTDTNNPVVEASKYTGNKFSMTSYISPRLTPTATPKIISTSVSPRGYSAAGSPKRTSGAVSPTKATLWYPSSQQSSAANSPPRNRTLPARTPRMDGKEFFRQARSRLSYEQFSSFLANIKELNAQKQTREETLRKADEIFGEENKDLYLSFQGLLNRNMR

SEQ ID NO: 60204 - protein, 546 aa, Phytophthora idaei
QELVGMLNTAKIPANVEVVVAPSQVHAATVKAALRSDVRVSGQDVWKQGNGAFTGETSAEMLKDLGAEYTLVGHSERREKGETNEIVAKKAAYALEKGLAVIACIGETKELREANQTVAYITEQLDAYAAEINDWTNVVIAYEPIWAIGTGLTASPEQAQEVHASIRAWLKEKVSPEAGDKTRVIYGGSVGAKNAPELSQKEDIDGFLVGGASLKPDFLHIINAQNPTTNVGGAVNVAINGFGRIGRLVLRAAAKNPLINIVAINDPFITTTYMEYMLEYDTVHGKFDGSLSHDEKHIFVNGKPIRVFNEMKPENITWGEEQVQYVVESTGAFTTLEKASAHLKNGVEKVVISAPSSDAPMFVMGVNHELYEKNMHVVSNASCTTNCLAPLAKVVNDKFGIKEGLMTTVHAVTATQKTVDGPSKKDWRGGRGACFNIIPSSTGAAKAVGKVIPSLNGKLTGMSFRVPTADVSVVDLTARLVNPASYDEIKAAIKSASENEMKGILGYTEEAVVSSDFIGDSHSSIFDAEAGIALTDDFVKLVSWYD

SEQ ID NO: 60205 - protein, 545 aa, Phytophthora trifolii
ELVGMLNTAKIPADVEVVVAPSQVHAATVKASLRADVRVSGQDVWKQGNGAFTGETSAEMLKDLGAEYTLVGHSERREKGETNDIVAKKAAYALEKGLAVIACIGESKETREANETVAYITEQLNAYAAEIKDWTNVVIAYEPIWAIGTGLTASPEQAQDVHASIRAWLKEKVSPEAAEKTRVIYGGSVGAKNAPELSQKEDIDGFLVGGASLKPDFLQIINAQNPTENVGGAVNVAINGFGRIGRLVLRAAAKNPLINIVAINDPFISTTYMEYMLEYDTVHGKFDGALSHDEQHIFVNGKPIRVFNEMDPSNIKWGEEQVQYVVESTGAFTTLEKASTHLQNGVEKVVISAPSSDAPMFVMGVNHELYEKNMHVVSNASCTTNCLAPLAKVVNDKFGIKEGLMTTVHAVTATQKTVDGPSKKDWRGGRGACFNIIPSSTGAAKAVGKVIPSLNGKLTGMSFRVPTADVSVVDLTARLVNPASYDEIKAAIKSASENEMKGILGYTEKAVVSSDFIGDSHSSIFDAEAGIALTDDFVKLVSWYD

SEQ ID NO: 60206 - protein, 540 aa, Prochlorococcus marinus str. MIT 9312
MSKIRSKSINKLSKPQSPVVLAILDGWGYREAISDNAIKSAKTPIMDSLWHAYPHTLISASGSEVGLPDGQMGNSEVGHLTIGSGRIIQQELVRISNVVKNNQLCIVNELKEMADSLKRNKSTLHITGLCSDGGVHSHIDHLLGLIKWASDNGIKKVAIHIITDGRDTPAKSASKYLNQIESCIKKFDTGEIASICGRYWIMDRNLLWDRTEKAYANLTDPDIKVSNISPQDYIKQSYDKNITDEFIEPIRISENYLKDGDSLICFNFRPDRARQIIKSLSEKKFSDFKRKVVPNLDLVTFTQYDQNFSVKVAFPPESLNNFIGQIVSENGLKQYRTAETEKYPHVTYFFNGGVEIPLPGEERHLIPSPRVATYDMEPEMSAEELTISCSKAIKSGDYAFVVINFANPDMVGHTGNMNATIKAIETVDKCIGQIVNATGEMGGSILITADHGNAEVMKGPAGEPWTAHTINKVPLIFIEGEKRKIPNMGNEIYLRDNAGLADIAPTLLQLLNLPIPKEMTGKSLIKEIELKGYNKVVQHV

SEQ ID NO: 60207 - protein, 373 aa, Zea mays
MGSIQLGGSGGRSTPPAVGMYKNQLQELAQRSCFSLPSYVCTREGPDHAPRFRAAVTFNGETFEGPSGCTTLRQAEHAAAEVALARLSLRGPSTTLAARVIDETGVYKNLLQETAHRAGLKLPAYTTVRSGPGHSPVFSSTVELAGLSFAGDPARTKKQAEKNAAMAAWSSLKQMPEARKEPGAGDEQEHVAVARALAALKPRDGGDGKAAPPLQKHSSNGSSSSALPNPSLYRHQWRPRTSTPAQAQPLPPRTGALPLQPPAGPRILPPLHLLQRPACGSRDAAAAELVRMLERAMVRDREATPPSPCYYAAPAASAYRHGSAPRTFAAGGFHAPAVSVRSVIPVCAAPPPQTPVKEERNGPATPSGACKRA

SEQ ID NO: 60208 - protein, 490 aa, Arabidopsis thaliana
MFKKALELSTLCNIEVCVIYYGRDGELFKTWPEDESKVRDMAERFTKLNERERRKKRTNLSLFLRKKILDDNKLSGKVLEMKDSLERGLRVLQDKLLLLQPENQTKSLTRSVSSLDYLRTGNMKKKRCILSSQIKLIVENEFCSKQNLTKKKSTKIFEKQNFLKCFFIYGVIFSYEIKPTAQFVSLGLVKSISNIIWKYKNFTILYNPEPCKKTKLSVRNQTCFKKSSLSSSSTAKKTTNLSMREQTMFKKALELSTLCNIDVCVIYYGRDGKLIKTWPEDQSKVRDMAERFSRLHERERCKKRTNLSLFLRKKILDDTKLSEKVLEMEDSLESGLRVLQDKLLLLQPEKNQTEFGQTRAVSSTTNPLSPPPSLIEDHRHQQWTEPLMSGVSNTEQDLSTSSLSQNQSRISVFLYNHDNRSFYQVPDSVSSFDQSALLGEQGSGLGSNFDLPPMVFPPQMQTQTPLVPFDQFAAWNQAPSFADPMMFPYN

SEQ ID NO: 60209 - protein, 546 aa, Phytophthora boehmeriae
QDLVGMLNTAKIPANVEVVVAPSQVHAATVKASLRSDVRVSGQDVWSQGNGAFTGETSAEMLKDLGAEYTLVGHSERREKGETNEIVAKKAAYALEKGLAVIACIGESKETREANETVAWITKQLDAYAAEIDDWTNVVIAYEPIWAIGTGLTASPEQAQDVHASIRAWLKEKVSPEASEKTRIIYGGSVGAKNAPELSQKADIDGFLVGGASLKPDFLQIINAQNPTGKVGGAVNVAINGFGRIGRLVLRAAAKNPLINIVAINDPFISTTYMEYMLEYDTVHGKFDGSLSHDEKHIFVNGKPIRVFNEMNPENIKWGEEQVQYVVESTGAFTKLDNASAHLKNSVEKVVISAPSSDAPMFVMGVNHELYEKNMHVVSNASCTTNCLAPLAKVVHDKFGIKEGLMTTVHAVTATQKTVDGPSKKDWRGGRGACFNIIPSSTGAAKAVGKVIPSLNGKLTGMSFRVPTADVSVVDLTARLTNPASYDEIKAAIKSASENEMKGILGYTEKAVVSSDFIGDSHSSIFDASAGIALTDDFVKLVSWYD

SEQ ID NO: 60210 - protein, 216 aa, Desulfovibrio vulgaris subsp. vulgaris str. Hildenborough
MSSTLVLETTAYTLEQLIHLDAPQIALAGRSNVGKSSLVNALARRKQLAKTSSTPGKTRSVNYYRVEPEGFYIVDLPGYGYAQCSKEERKKWAKLIEKYIVSCKSLRGLAVLLDCRLDPQRLDVDLTSYARANNIPLLPVLTKGDKCKLRERSDRQKQWAVLLGGRKPLVTASMTGLGIADLWRELRALAAGGLSADDEAEDAPSDTSDAIDDVTA

SEQ ID NO: 60211 - protein, 546 aa, Phytophthora humicola
QELVGMLNTAKIPANVEVVVAPSQVHAATVKASLRADVRVSGQDVWTQGNGAFTGETSAEMLKDLGAEYTLVGHSERRGKGESNVDVAKKAAYALEKGLGVIACIGESKETREANETVAFITKQLDAYAAEINDWTNVVIAYEPIWAIGTGLTASPEQAQEVHASIRAWLKEKISPEAAEKTRVIYGGSVGAKNAPELSQKEDIDGFLVGGASLKPDFLQIINAQNPTTNVGGAVNVAINGFGRIGRLVLRAAATNPLINIVAINDPFISTTYMEYMLEYDTVHGKFGGSLSHDEKHIIVNGKPIRVFNEMKPENIKWGEEQVQYVVESTGAFKTIETASAHMKNGVEKVVISAPSADAPMFVMGVNHELYEKNMHVVSNASCTTNCLAPLAKVVNDKFGIKEGLMTTVHSVTASQKTVDGPSKKDWRGGRGACFNIIPSSTGAAKAVGKVIPSLNGKLTGMSFRVPTADVSVVDLTARLVNPASYDEIKAAIKSASENEMKGILGYTEKAVVSSDFIGDSHSSIFDANAGIALTDDFVKLVSWYD

SEQ ID NO: 60212 - protein, 672 aa, Oryza sativa Indica Group
MASHANASGGGGDEEMVEASTLRHRHGAGKDANGVGTERQLAAAAAEGEEEGPSSVERAFVDRAVPSWREQLTVRAFVVSFFLSIMFSIIVMKLNLTTGIIPSLNVSAGLLGFFFVRLWTAAIERVGLLRQPFTRQENTVIQTCVVAAYGIAFSGGFGTYLFGMSETIAKQATEANNAQNVKNPHIGWMIGFLFLVSFIGLLALVPLRKIMIVDYKLTYPSGTATAYLINGFHTPEGAKLAKFYFDFSPTYVGVGMICPHIVNVSVLLGGILSWGIMWPLIRNKKGSWYAASLSETSLHGLQGYRVFISIALILGDGLYNFVKVLIRTTAGFVVMMKKNSTLPVSNNGSPMVATEAISFDDERRTELFLKDQIPKKVAFGGYVAVAAVSIGTLPQIFPQLKWYYILVAYVFAPVLAFCNAYGAGLTDWSLASTYGKLAIFIFGAWAGASNGGVLVGLAACGVMMSIVSTASDLMQDFKTGYLTLASPRSMFVSQVIGTAMGCVIAPCVFWLFYKAFADIGVSGTEYPAPYAIVYRNMAILGVDGFSSLPKHCLTLCYIFFAAAIAINLARDLAPSKVARFIPLPMAMAIPFYIGSYFAIDMFIGTVILFVWEMVNKAKAEAFAPAVASGLICGDGIWTLPQSILALAKVKPPICMKFLSRSVNAQVDGFLGN

SEQ ID NO: 60213 - protein, 619 aa, Arabidopsis thaliana
MALSFSQTSFTRPNHVLGSSGSVFSTPRSLRFCGLRREAFGFSTSNQLAIRSNRIQFLSRKSFQVSASASSNGNGAPPKSFDYDLIIIGAGVGGHGAALHAVEKGLKTAIIEGDVVGGTCVNRGCVPSKALLAVSGRMRELQNEHHMKSFGLQVSAAGYDRQGVADHANNLATKIRNNLTNSMKAIGVDILTGFGSVLGPQKVKYGKDNIITAKDIIIATGSVPFVPKGIEVDGKTVITSDHALKLESVPEWIAIVGSGYIGLEFSDVYTALGSEVTFIEALDQLMPGFDPEISKLAQRVLINPRKIDYHTGVFASKITPARDGKPVLIELIDAKTKEPKDTLEVDAALIATGRAPFTNGLGLENVNVVTQRGFIPVDERMRVIDGKGTLVPNLYCIGDANGKLMLAHAASAQGISVVEQVSGRDHVLNHLSIPAACFTHPEISMVGLTEPQAKEKGEKEGFKVSVVKTSFKANTKALAENEGEGIAKMIYRPDNGEILGVHIFGLHAADLIHEASNAIALGTRIQDIKLAVHAHPTLSEVLDELFKAAKVESHATTRTGDAKIKLNTNQEDRKGRRRGGDDEKQPSVSKDLKDISTRPSSFFENISVGVLSLLSLIFV

SEQ ID NO: 60214 - protein, 333 aa, Pseudomonas putida GB-1
MTLRIAINGFGRIGRNVLRALYTQGYRQDLQVVAINDLGDSAMNAHLLKYDSVHGTFDASVEADHESLTVNGDRIAVSAIRNPAELPWKAEAIDVVFECTGLFTDRAKAAAHLAAGAGKVIVSAPAKGADATVVYGVNHDILRASHQVISNASCTTNCLAPIAQVLHREFGIEQGLMTTIHAYTNDQVLTDMYHSDPYRARSATQSMIPSKTGAAEAVGLVLPELAGKLTGMAVRVPVINVSLVDLTVNLKREATAEQVNQLFLEASKHSKVLGYNALPLVSCDFNHNPLSSIFDANHTRANGRMLKVLAWYDNEWGFSNRMLDNCLALSNAR

SEQ ID NO: 60215 - protein, 263 aa, Treponema pallidum subsp. pallidum str. Nichols
MNVGFLGFGAMGRALAEGLVHAGALQAAQVYACALNQEKLRAQCTSLGIGACASVQELVQKSEWIFLAVKPSQISTVLRDRQSFQGKVLISLAAGMSCAAYEALFAADPHQGIRHLSLLPNLPCQVARGVIIAEARHTLHHDEHAALLAVLRTVAQVEVVDTAYFAIAGVIAGCAPAFAAQFIEALADAGVRYGLARDQAYRLAAHMLEGTAALIQHSGVHPAQLKDRVCSPAGSTIRGVLALEEQGLRRAVIHAVRAALSSS

SEQ ID NO: 60216 - protein, 175 aa, Triticum aestivum
  misc_feature (125)..(125): Xaa can be any naturally occurring amino acid
MAPAVMASSATTVAPFQGLKSTAGLPVSRRSGSAGLSSVSNGGRIRCMQVWPIEGIKKFETLSYLPPLSTEALLKQVDYLIRSKWVPCLEFSKVGFVFREHNSSPGYYDGRYWTMWKLPMFGCTXATQVLNEVEEVKKEYPDAYVRVIGFDNMRQVQCVSFIAFRPPGCEESGKA

SEQ ID NO: 60217 - protein, 483 aa, Alkalilimnicola ehrlichei MLHE-1
MFESPLLSNLHGYIDGSWTPADSGERFPVHNPVNGDELGRVAAMGAEETRRAIDAAHAALRRGSELEERQAWLDGIVDALKAHKSELGRVLTMEHGKPLKEAQGEVLYAAGFFEFCAKNVYSLGPRTLPERPREATWTIHNRPAGVVGLVTPWNFPIGMIAKKLSAAIAAGCPSVIKPSSKTPLTMLALFTLMEREVDLPPGFVNLVTGPSGPIGDTLMADDRVRVVSFTGSTEVGRKLITASAPGVKKLALELGGNAPFIVFADTDLDRAADHLIANKFRGGGQTCVCANRILVEASVEESFADKVAERAARLKVGDGMAPDTDLGPLIDRNGYEKVRRHFNNALEQGATAVLGEDPGPIPNDWGGFFPPAVLRGVKPGMDCTREETFGPLVPIMPFRDEAQALEMANDTEFGLAAYLFTADEARAQRLIAGLEFAHVGHNTGTGPTPEAPFGGMKCSGWGREGGTEGLFEFVEPQTVPRGN

SEQ ID NO: 60218 - protein, 70 aa, Triticum aestivum
MVNAIKGLFISCDIPMAQFIVNMNASMPASEKFIVHILDPTHMFIQPNMGDYIKSKMAEFRDQNSYEKPT

SEQ ID NO: 60219 - protein, 407 aa, Arabidopsis thaliana
MTMMSDLSEDLVEEILCRVSITSLGAVRSTCKGWYVLSKTRVLCKAETKHQFLGFMKKNYKLCSMRFDLHGNFNEEGGEEFMNPSIKKSGNLLDQLDICKVFQCDGLLLCVTKEENTRLVVWNPYSGQIRWIKCNNSYHRYEGYAIGYNNNRKHKILRFSDMSFSTYKIYDFISNSWRVLDIAPNWHINPDQRGASLKGNTYFFAREKREDEEDEDILWQPVEYLLCFDFTTENFGQLHPLPFEQYIDDAGALSSFGEEKLAALFQSFASSVVEIWVTSMIEANAVSWIPFLKVDMKPHCSFRFRLPFDGGSFFIDEEKKVAVVIHVDVVAESEMNRYEDVAYIIGENGYVKKVCLVEAVNQGGSLNLSKRSCCNYPHVCCSSYVPSLAQINQSVEFENEREEEEAN

SEQ ID NO: 60220 - protein, 417 aa, Alkalilimnicola ehrlichei MLHE-1
MGRRSPVIRSRCIGGSGMVADPVELEYSETPEPMWNPALRALPIPGIRRMVNMAAEMDDVIHLSIGQPDFPVPDHVIEAHIDALRHGQTGYTMDAGLPELLETIAEYYADRYQRPIAPENVLVTTGATEAIYLALAATAAPGRQFLVPDPSFPLYAPLIRMNGGEVKAIPTRAENGHQLDPQEVIDNIGMRTFGIILNSPSNPTGTVYPRETVEAIVQEAAYRGVYVYSDEVYDHLLLDDLQYASVLNCTSDLDHVMMMSSFSKTYSMSGLRIGWIISSQGAIKKLRRFHIFTTTVANTPAQWAGVAALRGEKTCLDSMVAEYRRRRDRVVQLVSDAPHLTGYWPQGAFYIFPSLPPNTDATTVAIRMLQETGVCVVPGDAFGDSCPNSLRISFSASMDDIEEAFERVIPWLAKQRF

SEQ ID NO: 60221 - protein, 459 aa, Zea mays
  misc_feature (155)..(155): Xaa can be any naturally occurring amino acid
MASAAAGAPKRCYYEVLGLSRDCSPTDIKLAFRRLALSLHPDKQPPGSDLALATAAFQELQHAHSVLSDPQERAYYDSHRSQIIFSDPASAGAKSASTVPDLFAFFSSSAFSGFSDTGRGFYKVYGDVFDRVFAQELAYARRMVVPEPAAPPVIXGTLDSPYAQVTAFYSYWLGFGSGMDFGWAAAWDAARGESRRVRRLMEEDNKKAMRKARREYNDAVRGLAAFCKKRDKRVVDMVLKKKLEEEKRKAEEKERRKEEDKRKKERAMAYQEHEWARAEEGLYDEDEEEEMRAKKELSYCAACNKKFKSDKQWKNHEQSKKHRNKIAELRKAFREEESLKKAEEGEGDWNEVDMGFDFKPTQESDDASAFSDAAEELAEEFESNYAGNGHHGKCEVQPEGSVHVNDVDDIMEGPSSFNVNNGAVIMCYNGCSISGVILRAGQPSLEQNCPDLVWKQWEH

SEQ ID NO: 60222 - protein, 253 aa, Triticum aestivum
  misc_feature (130)..(130): Xaa can be any naturally occurring amino acid
MSQSQMDDADDIDSILLPVGHRPSIDATSLTPASQETDLPDEDDDVDDLLEQQLNEEIRLLDTRPLMKAPPAPSLPEKNFYEILEEFVPTIPDEVTTYHLNCAGFNNPYPELKKVVALAVQRFVSDIANXDAINYARFTAQANSNLNRIARKEPKLMLTLEDLTHSLRDYGVALSKPEYWAETPQPKVPVEKKEKTKDRVKEKRKKGGDPTASPAPKEAKIEKVATMAPASTKDSVKKEKKRSHKASKGDKAY

SEQ ID NO: 60223 - protein, 720 aa, Hevea brasiliensis
MALSACSFPAHVDKATISDLQKYGYVPSRSLWRTDLLAQSLGRLNQAKSKKGPGGICASLSERGEYHSQRPPTPLLDTTNYPIHMKNLSIKELKQLADELRSDVIFNVSRTGGHLGSSLGVVELTVALHYVFSAPRDKILWDVGHQSYPHKILTGRREKMYTIRQTNGLSGFTKRSESEYDCFGTGHSSTTISAGLGMAVGRDLKGKKNNVVAVIGDGAMTAGQAYEAMNNAGYLDSDMIVILNDNKQVSLPTATLDGPIPPVGALSSALSRLQSNRPLRELREVAKGVTKQIGGPMHEWAAKVDEYARGMISGSGSTLFEELGLYYIGPVDGHNIDDLIAILKEVKSTKTTGPVLIHVVTEKGRGYPYAEKAADKYHGVTKFDPATGKQFKGSAITQSYTTYFAEALIAEAEVDKDIVAIHAAMGGGTGLNLFLRRFPTRCFDVGIAEQHAVTFAAGLACEGLKPFCAIYSSFMQRAYDQVVHDVDLQKLPVRFAMDRAGLVGADGPTHCGAFDVTFMACLPNMVVMAPSDEAELFHMVATAAAIDDRPSCFRYPRGNGVGVQLPPGNKGIPLEVGKGRILIEGERVALLGYGTAVQSCLAAASLVEPHGLLITVADARFCKPLDHTLIRSLAKSHEVLITVEEGSIGGFGSHVAHFLALDGLLDGKLKWRPLVLPDRYIDHGSPSVQLIEAGLTPSHVAATVLNILGNKREALQIMSS

SEQ ID NO: 60224 - protein, 134 aa, Zea mays
MNHGQQSGEAKHEDDPALTEFLGSLMDYTPTIPDDLMEHYLAKSGFQCPDVRLIRLVAVATQKFVADVASDALQHCKARPAPVVKDKKQQKDKRLVLTMEDLSKALREYGVNVKHPEYFADSPSTGIDPATREE

SEQ ID NO: 60225 - protein, 280 aa, Gibberella zeae PH-1
MSRPEDTLAADVHYDDTEARKYTTSSRIQNIQASMTRRALELLDLKSPSLILDIGCGSGLSGEILSSVEPEEGGPHTWIGMDVSPSMLDIALQRDVEGDLMLADIGQGVPFRAGTFDAAISISAIQWLCSAETSDTSPVGRLTRFFNGLYASLKRGGRAVCQFYPKNDDQRNMITQAAVKAGFGAGMLEDDPGTKNQKLYLVLTVGGGDLQKKGGDITGVVDGMEGVDVEDARRSIKTHAPNMSKGSKQWIVKKKEQMERKGKIVKATSKYTGRKRRIQF

SEQ ID NO: 60226 - protein, 572 aa, Oryza sativa Japonica Group
MLRRFAARRLRPPATAGYPSSAAAAAAAYAHGGGASVLPDGLDRASDAHARNAAAVGGLLSDLRARVSQVLAGGGAEAVRRNKARGKLLPRERIDRLLDPGASFLELSQLAGSGVYEEALPSGGIITGIGPVHGRLCMFVANDPTTKGGTYYPITVKKHLRAQEIASECKLPCIYLVDSGGANLPRQAEVFPDRDNFGRIFYNQAKMSSDSIPQIALVLGSCTAGGAYIPAMADESVIVKGNGTIFLAGPPLVKAATGEEISAEDLGGASVHCKISGVSDHFAQDELHGLTLGRNIVKNLHLAAKVPNVQNSACDYQEPLYDVQELRSIAPADMKQSFDIRQVIARIVDGSEFDEFKKLYGTTLVTGFARICGQPVGIIGNNGILFTESALKGSHFIELCAQRNIPLIFLQNITGFMVGSKSEASGIAKAGAKMVMAVSCSKVPKITIIVGGSFGAGNYGMCGRAYSPNFLFMWPTARISVMGGIQAAGVLAQIEKNNRKRQGVEWTKDEEEAFKAKVVEAYDKEGSPYYSTARLWDDGIIDPADTRRVLSLCLSAAAKPVPEDTKYGVFRM

SEQ ID NO: 60227 - protein, 473 aa, Oceanicola granulosus HTCC2516
MIHPILLCGGSGTRLWPLSRKSFPKQFSRLMGEESLFQASARRLSGEGFAAPVILTAEPFRFIVTEQLAQIEQAPQAILIEPEGRNTAPAICAAALWLAGQDPEALMLVAPSDHVIPDAEGFRAAIHAAAPRAAAGDLVTFGIAPDRPETGYGYLELAAGADARAEAPQPLARFVEKPERARAEEMLAAGNFLWNAGIFLMSARAAAEAFRTHAPDIVAAVSEALAGAERDLGFTRLAAEPWSRAPDISVDYAIMEKADNLAVKRYAGPWSDVGGWDAVWQQSGPDAQGNVCSEHATAIDCSDTLLRSETDQVEVVGIGLEGIVAIATSDAVLVAKKDEAQRVKAAVSALKAKGAKQAVQFPRDHRPWGWFESLVIGGRFQVKRIVVHPGAALSLQSHHHRSEHWIVVEGTAKVTVGEEVKLVTENESVYIPLGATHRMENPGKVPMVLIEVQTGSYLGEDDIIRYEDVYARS

SEQ ID NO: 60228 - protein, 261 aa, Porphyromonas gingivalis W83
MIYLKTDEEIALMREANQLVGKTLAEVAKNIRPGVSTLMLDKVAEEFIRDHGAEPAFLGYGGFPNSICVSVNENVVHGIPSAKAIIKEGDIVSVDCGTSLNGFTGDSAYTFAVGEVAPEVIRLLKTTKESLYEGIAVAIEGYRIGDIGSAVQKYCESRGYSVVRELVGHGIGRQMHESPEVPNYGRPGTGPLLKNGMCICIEPMINLGSKNVVTERDGWTIRTKDRKPSAHFEHCIAIQGGRAQILSSFDFIHDVLGDKEF

SEQ ID NO: 60229 - protein, 539 aa, Phytophthora insolita
ELVGMLNTARIPKDVEVVVAPSQVHAATVKSQLRADVRVSGQDVWQQGNGAFTGETSAEMLKDLGAEYTLVGHSERRGKGETNEIVAKKAAYALEKGLGVIACIGESKETREANETVAFITKQLDAYAAEINDWTNVVIAYEPIWAIGTGLTASPEQAQEVHASIRAWLKNKVSPEASEKTRVIYGGSVGAKNAPELSQKEDIDGFLVGGASLKPDFLKIINAQNPTDKVGGAVNVAINGFGRIGRLVLRAAAKNPLINIVAINDPFISTTYMEYMLEFDTVHGKFPAPVSHDEKHIIVNGKPIRVFNEMKPENIKWGEEQVQYVVESTGAFKTIETASAHLKNGVEKVVISAPSNDAPMFVMGVNHELYEKNMHVVSNASCTTNCLAPLAKVVNDKFGIKEGLMTTVHAVTASQKTVDGPSKKDWRGGRGACFNIIPSSTGAAKAVGKVIPDLNGKLTGMSFRVPTADVSVVDLTARLVNPASYDEIKAAIKSASENEMKGILGYTEKSVVSSDFIGDSHSSIFDANAGIALTDDFVK

SEQ ID NO: 60230 - protein, 545 aa, Phytophthora andina
  misc_feature (130)..(130): Xaa can be any naturally occurring amino acid
  misc_feature (132)..(132): Xaa can be any naturally occurring amino acid
  misc_feature (318)..(318): Xaa can be any naturally occurring amino acid
  misc_feature (340)..(340): Xaa can be any naturally occurring amino acid
  misc_feature (450)..(450): Xaa can be any naturally occurring amino acid
ELVGMLNTAKIPVNVEVVVAPSQVHAATVKASLRSDVRVSGQDVWKQGNGAFTGETSAEMLKDLGAEYTLVGHSERREKGETNEVVAKKAAYALEKGLGVIACIGETKDHREANQTVAYITEQLDAYAAXIXDWTNVVIAYEPIWAIGTGLTASPEQAQEVHASIRAWLKEKVSPEAAEQTRVIYGGSVGAKNAPELSQKEDIDGFLVGGASLKPDFLQIINAQNPTANVGGAVNVAINGFGRIGRLVLRAAAKNPLINIVAINDPFVSTTYMEYMLEYDTVHGKFDGSLSHDETHIFVNGKPIRVFNEMNPENIKWXEEQVQYVVESTGAFTTLEKASXHLKNGVEKVVISAPSSDAPMFVMGVNHELYEKNMHVVSNASCTTNCLAPLAKVVNDKFGIKEGLMTTVHAVTATQKTVDGPSKKDWRGGRGACFNIIPSSTGAAKAVGKXIPSLNGKLTGMSFRVPTADVSVVDLTARLVNPASYDEIKAAIKSASENEMKGILGYTEEAVVSSDFIGDSHSSIFDAEAGIALTDDFVKLVSWYD

SEQ ID NO: 60231 - protein, 172 aa, Porphyromonas gingivalis W83
MAIVYNRVKSTNDLELKDRLVAINRVTKVTKGGRTFTFAAIVVVGNEDGVIGWGLGKAGEVPAAIAKGVEAAKKNLIRVPVHNGTIPHEQAASYGGASVFLKPATTGTGVKAGGAMRAVLDSVGVTDVLAKSKGSSNPHNLVKATIQALAEMRSPLMVAQNRGISVEKVFKG

SEQ ID NO: 60232 - protein, 141 aa, Heliobacillus mobilis
MERTYLMIKPDAVQRGLIGEIVSRFEKKGFKLVAMKFLRLTKEMAEKHYAEHVGKPFFAGLVEYIISGPVVAMCWEGKDVVTVSREMMGATNPAKAAPGTIRGTFAVDLPLALRRRVLRRFLEPENPGSEKTDAILEQLQQ

SEQ ID NO: 60233 - protein, 392 aa, Gloeobacter violaceus PCC 7421
MKTAARLDRIPPYLFAEIDRRRDEAVARGVDIINMGIGDPDKPTPPVVLEAMHAAIDDPSTHNYPPYKGTKAYREAAAAWFERRFGVGGFHPDTEVISSIGSKEAIHNTFLAFVDPGDYTLIPDPAYPVYRTSTIFAGGEFFAMPLLPENQLLPDLEAVPETVARKAKLLWLNYPNNPTGAVASLEFFEKVVHFAKKHDILVCHDNAYSEMAYDGYKPPSILQVPGARDVAIEFLSCSKAYNMTGWRVGFVIGNRTGIAGLGQVKTNIDSGVFKAIQQAAIAAFGLDDERLHALMAVYQNRRNIIVEGLRSLGWPLEAPKATLYVWAPIPKSFGSSVEFVGALLDKCGIIVPPGNGYGEHGEGFFRIALTVPDERMREAIGRMEAAGIRFEG

SEQ ID NO: 60234 - protein, 531 aa, Phytophthora insolita
VEVVVAPSQVHAATVKSQLRADVRVSGQDVWQQGNGAFTGETSAEMLKDLGAEYTLVGHSERRGKGETNEIVAKKAAYALEKGLGVIACIGESKETREANETVAFITKQLDAYAAEINDWTNVVIAYEPIWAIGTGLTASPEQAQEVHASIRAWLKNKVSPEASEKTRVIYGGSVGAKNAPELSQKEDIDGFLVGGASLKPDFLKIINAQNPTDKVGGAVNVAINGFGRIGRLVLRAAAKNPLINIVAINDPFISTTYMEYMLEFDTVHGKFPAPVSHDEKHIIVNGKPIRVFNEMKPENIKWGEEQVQYVVESTGAFKTIETASAHLKNGVEKVVISAPSNDAPMFVMGVNHELYEKNMHVVSNASCTTNCLAPLAKVVNDKFGIKEGLMTTVHAVTASQKTVDGPSKKDWRGGRGACFNIIPSSTGAAKAVGKVIPDLNGKLTGMSFRVPTADVSVVDLTARLVNPASYDEIKAAIKSASENEMKGILGYTEKSVVSSDFIGDSHSSIFDANAGIALTDDFVKLVSWYD

SEQ ID NO: 60235 - protein, 291 aa, Zea mays
MSQEQPRRPSGHEETSGGGEQGAVRYGDVFPAVSGGLAEKPVAPQDAATMQSAENLVFGQTLKGGPAAAMQSAATANERMGAVGHDQATDATAVQGVTVSETRVPGGGRIVTEFVAGQAVGQYLARDDDDGAAATAGGGIAGPGAGAGGGASAGVAGKDITKVTIGEALEATALAAGDAPVERSDAARIQAAEARATGLDANVPGGLARQAQSAAAANSWAWGDEDKATLGDVLANATARLVADKPVESADALGVAGAENRNRNDGTARPGGVAASMAAAARLNRNEAVWE

SEQ ID NO: 60236 - protein, 251 aa, Desulfovibrio vulgaris subsp. vulgaris str. Hildenborough
MKKLIAANWKMYKTIDEARATGRELVSAVAGSLPADREVLVCPPFTALHALHDTFKDVEGFAIGGQDVYPATEGAYTGEIAPGMLLDAGCGWVLTGHSERRHILGEDDETVARKTAFSLKAGLRVVLCIGEKLDEREAGRLEDVLAHQLQVGLADVDATYVPQSLVVAYEPVWAIGTGKVAGPAEVVEAHALVRSLLEARYGRDGAAIRILYGGSVKPDNAAELLSLDNVDGLLVGGASLQAVSFSRIILA

SEQ ID NO: 60237 - protein, 436 aa, Symbiobacterium thermophilum IAM 14863
MPWTKLRRAVEHVELLPVVGRVTGAAGLIIESAGPRAKMNELCWLQGDGRRVPAEVVGFREDRLLLMPLGETDGLRPGWDVIATGGPLQAPVGMGLLGRVIDGLGNPIDDKGPLMGCGFRPILGPAPDPLARQRIHRPLSLGVRALDALITVGMGQRIGIFAGSGVGKSTLLGMVARATAADCNVIALVGERGREVREFIEKDLGEEGLRRSVVVVATSEQPSLVRIRAALMATAIAEYFRDAHGLDVILMMDSVTRLAHAQREVGLAVGEPPATRGYTPSVFAMLPRVLERSGTGPAGSVTGVYTVLVDGDDMNEPVADAVRSILDGHVVLSRKLANAGHYPAIDPLQSVSRVMPDVTTPEHRKQAQRLRALLSAYQEAEDLIQIGAYQQGTNPLVDEALAKMDQIKRFLIQPADQPSTMEEALRGLAALCGEDA

SEQ ID NO: 60238 - protein, 141 aa, Physcomitrella patens subsp. patens
MLKYLSKVRVEFNALDKRASSALEFLAQCNSRKARSSNPNCEVVVKRRTDNAPPVVAVTFTNGREEVMDGTSMAANQIRTKILEQAELMETEKMFRDAGYDWPVIIPMEEVEASRREMAMKAEKKAEKKIVSKTGTETKLS

SEQ ID NO: 60239 - protein, 657 aa, Oryza sativa Japonica Group
MGSGSAANGGGGGAGAARVPMPAAKPFLETLGGNMKETFLPDDPFRVVRRERGCGRRAAAALRYVFPFMEWAPSYTLGTLKSDLIAGITIASLAIPQGISYAKLANLPPVLGLYSSFVPPLVYAMMGSSRDLAVGTVAVASLLIGSMLSEEVSAAEDPALYLHVALTATFFAGVFQALLGVLRLGFIVDFLSHATIVGFMGGAATVVCLQQLKGMFGLDHFTTATDLVSVMSSVFSQTHLWRWESVVMGCGFLFFLLITRFFSKRRPRFFWVSAAAPLASVIIGSLLVYLTHAENHGIQVIGYLKKGLNPPSATSLNFSSPYMMLALKTGIITGVIALAEGIAVGRSFAMFKNYHIDGNKEMIAFGTMNIVGSLTSCYLTTGPFSRSAVNYNAGCKTAMSNVIMSVAVMITLLFLTPLFHYTPLVVLSAIIMSAMLGLIDYPAAVHLWQVDKVDFCVCLGAYLGVVFGSVEIGLVVAVGISILRVLLFVARPRTTVLGNIPNTMIYRRMDQYTAAQRVPGVLVLRVDSPIYFTNASYLRERIARWIDDEEDQCKEKGEMGIQYVVLDMGAVGSIDTSGTSMLDELRKTLDRRGLQIVLANPGSEIMKKLDSSKVLEAIGHEWIFPTVGEAVAECDFVMHSQKPGMVMGSGAPHENLV

SEQ ID NO: 60240 - protein, 370 aa, Zea mays
MGLEAAVEATVEFLNKAVKPVLVAGPKLRVAKAGKAFVDMVDASGYAYAVMPSAKGLVPETHPHFIGTYWGAVSTAFCAEIVESADAYLFAGPIFNDYSSVGYSFLLKKEKAIIVQPERVIVGNGPAFGCVMMKEFLSELAKRVNKNTTAYENYKRIFVPEGQPLESEPNEPLRVNVLFKHVQKMLTGDSAVIAETGDSWFNCQKLKLPEGCGYEFQMQYGSIGWSVGALLGYPQGANHKRVIAFIGDGSFQVTAQDVSTILRCEQNSIIFLINNGGYTIEVEIHDGPYNVIKNWNYTGFVDAIHNGLGKCWTSKVKSEEDLTAAIETALGEKDCLCFIEVIAHKDDTSKELLEWGSRVSAANSRPPNPQ

SEQ ID NO: 60241 - protein, 532 aa, Thermobifida fusca YX
MIIASDLELRVGARLLLAPASFQVGPGDRIGLVGRNGAGKTTLTKVLAGEAIPAAGKVTRTGTVGYLPQDPRTGDLDVVARDRILSARGIDEVLRQLRVAEQKMASEVPKIRDQGVRAYARLEERLHVLGGYAAEAEAASIASSLGLEQRILTQPLRTLSGGQRRRVELARILFSGADTLLLDEPTNHLDGDSIAWLRDFLKSYQGGLVVISHDVDLIEHVVNKVFYLDASRSTLDIYNMGWRAYLEQREADERRRKRERANAEKQAAALQRQAERFRAKASRARAAQQMLHRAERLLESVEEERGPDRVAKLRLPDPAPCGRTPLAAEGLSKSYGSLEVFSGVDLAVDRGSRVVVLGLNGAGKTTLLRLLAGIEQPDTGRVIRGHGLRLGYYAQEHEELDLDRTVLENMVSAAPDLPEVEVRRVLGSFLFSGDDVYKPVRVLSGGEKTRLALATLVVSSANVLLLDEPTNNLDPASRDEVLNALRTYRGAIVLVTHDEGAVEALQPERVVFLPDGVEDFWDAEFTDLVALA

SEQ ID NO: 60242 - protein, 491 aa, Arabidopsis thaliana; identical to SEQ ID NO: 1131

SEQ ID NO: 60243 - protein, 366 aa, Carica papaya
QMGLAENQLCFNLIHEWLLKNPEASICTAQGAAEFRDIAIFQDYHGLAEFREAVAKFMGKVRRNRASFDPDRIVMSGGATGAHEMIAFCLADPGDAFLVPTPYYPGFDRDLRWRTGVKLIPVVCESSNDYQITIEALEAAYETAQEADIKVKGLLITNPSNPLGTIITKDTLEALVTFANHKNIHLVCDEIYAATVFSQPEFTSIAEIIEEDKICCNRDLIHIIYSLSKDMGFPGFRVGIVYSYNDAVVSCARKMSSFGLVSSQTQYLIASMLADDEFVDKFIVESRKRLAMRHSFFTQRLAQVGINCLKSNAGLFVWMDLRRLLKEQTFEAEMVLWRVIINEIKLNVSPGSPFHCSEPGWFRVCF

SEQ ID NO: 60244 - protein, 370 aa, Rhodopseudomonas palustris CGA009
MATHKLLLLPGDGIGTEVMAEVSRLIDWLNKAGIASFETEHGLVGGAAYDADKVAITDATMALAQASDAVIFGAVGGPKWDGVPYDARPEAGLLRLRKDLGLFANLRPAVCYPALADSSSLKRDVVEGLDIMIVRELTGGVYFGEPKTITDLGNGQKRAVDTQVYDTYEIERIGRVAFDLARKRRNKVTSMEKRNVMKTGVLWNEVITAVHDREYKDVQLDHQLADSGGMNLVKWPKQFDVIVTDNLFGDMLSDIAAMLTGSLGMLPSASLGEVDAKTGKRKSMYEPVHGSAPDIAGKGMANPVAMLASFGMALRYSLDMGALADKLDEAIAAVLAKGLRTADIKSEGTTVISTSQMGEAIVTELQALHA

SEQ ID NO: 60245 - protein, 273 aa, Bordetella petrii
MGLVTNPADLDKMRAACQDAAKILDFITPYVKPGVTTGELDRLCLEYLTDELKVKSATVGYAPPGYPPFPGAICTSVNHQVCHGIPGDKVLKNGDALNIDVTIIKDGWFGDTSRMYHVGEPSIQSRRLAEITFECMWKGIQQVRNGATLGDVGHAIQKHAESNGYSVVREFCGHGIGQRFHEDPQVLHYGKPGSGVRLTTGMIFTIEPMINAGRREIRQLADGWTVVTRDHSLSAQWEHTICVTDTGYEVLTLSPGVRQPPAFITEPLTLPAT

SEQ ID NO: 60246 - protein, 80 aa, Sonneratia alba
CFGLFAFSWLILRLIFFPFWVIRASSNDLLEYLPLHETYGTLLYYIFNTMLLTLLVFHIYWWFLICSMITKQLKNRGKVG

SEQ ID NO: 60247 - protein, 80 aa, Sonneratia caseolaris
CFGLFAFSWLILRLIFFPFWVIRASSDDLLECLPLHETYGTLLYYIFNTMLLTLLVFHIYWWFLICSMITRQLKNRGKVG

SEQ ID NO: 60248 - protein, 380 aa, Desulfovibrio vulgaris subsp. vulgaris str. Hildenborough
MRKTVYWIEGDGIGPEVWKAARPVIDAAVEKSYGDSRSIEWKELLAGEKAHRETGEYLPQSTLDTLATAELAIKGPLGTPVGKGFRSLNVTMRQTLDLYACIRPIRYFDGIMSPVKRPDLVDMVVFRENTEDVYAGIEYRAGTPEAKRLIAFLRDELGAKVDIEAAVGIKPMTEKGSKRLVRRALRFAIDQKRPNLTLVHKGNIMKFTEGGFREWGYEVARDEFADLTTTETEGTAGRLVVKDRIADAMFQEVLIRPQQYSVIATSNLNGDYISDALAAQVGGLGLAPGVNMSDSLAFFEATHGTAPTIAGQDKANPGSLILCGALMLEHMGWNEAAERIYKAVNEAIASRRVTVDLATQMENATTVGTVAFGDIVTAGL

SEQ ID NO: 60249 - protein, 348 aa, Ashbya gossypii ATCC 10895
MTAEPLFKKQRSHRDEPEESKPWVEKYRPRKLDDVASQAHAITVLKRTLESANLPHMLFYGPPGTGKTSTILALTKELFGPSLMKSRVLELNASDERGISIVREKVKNFARLTVTNPTKEDLEQYPCPPYKIIILDEADSMTADAQSALRRTMETYSSVTRFCLICNYVTRIIDPLASRCSKFRFKPLDNVNALGRLEQIAQQEALSYEAGALEKVLHIAEGDLRKAITLLQTAAKMTSYMAAEKITIAQVEELAGVVPDDIIKGLVEKIESKDLTEITKFVNKVVKSGWCGSSIISQLHDYYAENNELDAEKKTKIFLLLFKTDSRLSNGTDEHIQLLDLAMKITQV

SEQ ID NO: 60250 - protein, 80 aa, Sonneratia ovata
CFGLFAFSWLILRLIFFPFWVIRASSNDLLEYLPLHETYGTSLYYIFNTMLLTLLVFHIYWWFLICSMITRQLKNRGKVG

SEQ ID NO: 60251 - protein, 378 aa, Gibberella zeae PH-1
MLSRGSLRSAQLLRGVAKQQPQLARSFATVQSDIFKPAKYGGKYTVTLIPGDGIGTEVAESVKTVFKADNVPVEWEQIEVSGLEGAGRTEDAFRESVASLKRNKLGLKGILHTPISRSGHQSFNVAMRQELDIYASISLIKNIPGYETRHKDVDLCIIRENTEGEYSGLEHQSVEGVVESLKIITRAKSERIARFAFSFALANGRSKVTCIHKANIMKLADGLFRSTFHQVAKDYPTLETNDMIVDNASMQAVSRPQQFDVMVMPNLYGGILSNIGAALVGGPGIVPGCNMGREVAVFEPGCRHVGLDIKGKDQANPTAMLLSGSMLLRHLGLDEHANRISKATYAVIADGKVRTPDMGGKSTTHEFTRAILDKLETV

SEQ ID NO: 60252 - protein, 237 aa, Hevea brasiliensis
MNSMAMATHLYTSYSPITSKTITTNYNSNKALSVPLHKSIASPSLSLRTTARLSISAAAGATALQVDGPPTSSKGPKSLPFRVGHGFDLHRLEPGYPLIIGGINIPHERGCEAHSDGDVLLHCVVDAILGALGLPDIGQIFPDSDPKWKGAPSSVFIKEAVRLMHEAGYDIGNLDATLILQRPKLSPHKEVIRDNLCQLLGADPSVINLKAKTHEKVDSLGENRSIAAHTVVLLMKK

SEQ ID NO: 60253 - protein, 199 aa, Oryza sativa Japonica Group
MGRAKSKGPKFAAVKKIITKKTIQKYKEDVLNPKKKDNEKEKLGRNVPQVSSALFFSYNTALGPPYRVIVDTNFINFSIQNKLDLEKGMMDCLYAKCTPCITDCVMAELEKLGQKYRVALRIAKDPRFQRLACTHKGTYADDCIVERVTQHKCYIVATCDRDLKRRIRKVPGVPIMYITRHRYSIERLPEATIGGAPRI

SEQ ID NO: 60254 - protein, 80 aa, Sonneratia apetala
CFGLFAFSWLILRLIFFPFWVIRASSNDLLEYLPLHETYGTLLYYIFNTMLLTLLVFHIYWWFLICSMITRQLKNRGKVG

SEQ ID NO: 60255 - protein, 241 aa, Hevea brasiliensis
MNSMAMATHLYTSYSPITTKTISSNNNSDKVLSLPLQPRHAISIASPSLSLRTTTRFSISAAAGTTAVQVDGPTTSNKGPKSLPFRVGHGFDLHRLEPGYPLIIGGINIPHERGCEAHSDGDVLLHCVVDAILGALGLPDIGQIFPDSDPKWKGAPSSVFIKEAVRLMHEAGYDIGNLDATLILQRPKLSPHKEAIRDNLCQLLGADPSVINLKAKTHEKVDSLGENRSIAAHTVVLLMKK

SEQ ID NO: 60256 - protein, 339 aa, Gloeobacter violaceus PCC 7421
MTKMRAMIVPEAGAKFQMIERDLPVPGPREVRLSVSACGVCHSDSVTVEGTMRGIAYPRVPGHEVIGTIEALGPEVLGWEVSMRVGVGWFGGSCGYCAHCRRGSAFACETVSAVTGVTRDGGYATHMLADVSALAHVPTDLDVVESAPLLCAGITTFNALRNCGAGPGELVAIHGIGGLGHLGIQFAARQGFRTVAVNRGRDKEELARSLGAHEYIDSEEGDPAAALLAMGGAKAILATVTSEKAMQALVGGLGPNGTMMLIGAVPTLTVNPTELLLKRAAVKGWYSGTAADSEDTLLFSHRNGITSMNEIYPFENAQAAYDRMMSGKARFRVVLSMGV

SEQ ID NO: 60257 - protein, 545 aa, Phytophthora glovera
  misc_feature (71)..(71): Xaa can be any naturally occurring amino acid
  misc_feature (101)..(101): Xaa can be any naturally occurring amino acid
  misc_feature (128)..(128): Xaa can be any naturally occurring amino acid
ELVGMLNTAKIPANVEVVVAPSQVHAATVKASLRSDVRVSGQDVWKQGNGAFTGETSAEMLKDLGAEYTLXGHSERREKGETNEVVAKKAAYALEKGLGVXACIGETKELREANQTVAYITEQLDAYXAEIKDWTNVVIAYEPIWAIGTGLTASPEQAQEVHASIRAWLKEKVSSDAAQKTRVIYGGSVGTKNAPELSQKEDIDGFLVGGASLKPDFLQIINAQNPTDNVGGAVNVAINGFGRIGRLVLRAAATNPLINIVAINDPFVSTTYMEYMLEYDTVHGKFAGSLSHDEQHIFVNGKPIRVFNEMNPANIKWGEEQVQYVVESTGAFTTTEKASAHLQNGVEKVVISAPSSDAPMFVMGVNHELYEKNMHVVSNASCTTNCLAPLAKVVNDKFGIKEGLMTTVHAVTATQKTVDGPSKKDWRGGRGACFNIIPSSTGAAKAVGKVIPSLNGKLTGMSFRVPTADVSVVDLTARLVNPASYDEIKAAIKSASENEMKGILGYTEKAVVSSDFIGDSRSSIFDAEAGIALTDDFVKLVSWYD

SEQ ID NO: 60258 - protein, 545 aa, Phytophthora glovera
ELVGMLNTAKIPANVEVVVAPSQVHAATVKASLRSDVRVSGQDVWKQGNGAFTGETSAEMLKDLGAEYTLVGHSERREKGETNEVVAKKAAYALEKGLGVIACIGETKELREANQTVAYITEQLDAYAAEIKDWTNVVIAYEPIWAIGTGLTASPEQAQEVHASIRAWLKEKVSSDAAQKTRVIYGGSVGTKNAPELSQKEDIDGFLVGGASLKPDFLQIINAQNPTDNVGGAVNVAINGFGRIGRLVLRAAATNPLINIVAINDPFVSTTYMEYMLEYDTVHGKFAGSLSHDEQHIFVNGKPIRVFNEMNPANIKWGEEQVQYVVESTGAFTTTEKASAHLQNGVEKVVISAPSSDAPMFVMGVNHELYEKNMHVVSNASCTTNCLAPLAKVVNDKFGIKEGLMTTVHAVTATQKTVDGPSKKDWRGGRGACFNIIPSSTGAAKAVGKVIPSLNGKLTGMSFRVPTADVSVVDLTARLVNPASYDEIKAAIKSASENEMKGILGYTEKAVVSSDFIGDSRSSIFDAEAGIALTDDFVKLVSWYD

SEQ ID NO: 60259 - protein, 546 aa, Phytophthora niederhauserii
QELVGMLNTAKIPANVEVVVAPSQVHAATVKAALRPDVRVSGQDVWKQGNGAFTGETSAEMLKDLGAEYTLVGHSERREKGETNEVVAKKAAYALEKGLAVIACIGETKELREANQTVAFITEQLDAYAAEIKDWTNVVIAYEPIWAIGTGLTASPDQAQEVHASIRAWLKEKVSPEAAEKTRVIYGGSVGAKNAPELSQKADIDGFLVGGASLKPDFLQIINAQNPTDNVGGAVNVAINGFGRIGRLVLRAAAKNPLINIVAINDPFISTTYMEYMLEYDTVHGKFDGTLSHDEQHIFVNGKPIRVFNEMNPANIKWGEEQVQYVVESTGAFTTTEKASAHLQNGVEKVVISAPSSDAPMFVMGVNHELYEKNMHVVSNASCTTNCLAPLAKVVHDKFGIKEGLMTTVHAVTATQKTVDGPSKKDWRGGRGACFNIIPSSTGAAKAVGKVIPDLNGKLTGMSFRVPTADVSVVDLTARLVNPASYDEIKAAIKSASENEMKGILGYTEKAVVSSDFIGDSHSSIFDASAGIALTDDFVKLVSWYD

SEQ ID NO: 60260 - protein, 182 aa, Brassica napus
  misc_feature (146)..(146): Xaa can be any naturally occurring amino acid
  misc_feature (159)..(159): Xaa can be any naturally occurring amino acid
  misc_feature (174)..(174): Xaa can be any naturally occurring amino acid
  misc_feature (178)..(178): Xaa can be any naturally occurring amino acid
  misc_feature (181)..(181): Xaa can be any naturally occurring amino acid
MASLSFVSSSHLTLRAPSPNLRSSSPRPTSVSFSVKAQSVALSQDDLKKLAAEKAVESIKPGMVLGLGTGSTAAFAVDQIGKLLSSGQLHDIVGIPTSKRTEDQARSLGIPLVALDTHPRIDLAIDGADEVDPNLDLVKGRGGALXLRREEMVEAVAEXFIVVADDTKLVKGLXGGSXLAXP

SEQ ID NO: 60261 - protein, 537 aa, Phytophthora citricola
ELVGMLNTAKIPADVEVVVAPSQVHAATVKASLRADVRVSGQDVWKQGNGAFTGETSAEMLKDLGAEYTLVGHSERREKGESNEVVAKKAAYALEKGLGVIACIGETKELREANQTVAYITEQLDAYAAEIKDWTNVVIAYEPIWAIGTGLTASPEQAQDVHASIRAWLKEKVSPEAAEKTRVIYGGSVGAKNAPELSQKEDIDGFLVGGASLKPDFLQIINAQNPTDNVGGAVNVAINGFGRIGRLVLRAAATNPLINIVAINDPFISTTYMEYMLEYDTVHGKFAGSLSHDEKHIFVNGKPIRVFNEMNPANIKWGEEQVQYVVESTGAFTTTETASTHLKNGVEKVVISAPSSDAPMFVMGVNHELYEKNMHVVSNASCTTNCLAPLAKVVNDKFGIKEGLMTTVHAVTATQKTVDGPSKKDWRGGRGACFNIIPSSTGAAKAVGKVIPSLNGKLTGMSFRVPTADVSVVDLTARLVNPASYDEIKAAIKSASENEMKGILGYTEKAVVSSDFIGDSHSSIFDASAGIALTDDF

SEQ ID NO: 60262 - protein, 535 aa, Phytophthora niederhauserii
ELVGMLNTAKIPANVEVVVAPSQVHAATVKAALRPDVRVSGQDVWKQGNGAFTGETSAEMLKDLGAEYTLVGHSERREKGETNEVVAKKAAYALEKGLAVIACIGETKELREANQTVAFITEQLDAYAAEIKDWTNVVIAYEPIWAIGTGLTASPDQAQEVHASIRAWLKEKVSPEAAEKTRVIYGGSVGAKNAPELSQKADIDGFLVGGASLKPDFLQIINAQNPTDNVGGAVNVAINGFGRIGRLVLRAAAKNPLINIVAINDPFISTTYMEYMLEYDTVHGKFDGTLSHDEQHIFVNGKPIRVFNEMNPANIKWGEEQVQYVVESTGAFTTTEKASAHLQNGVEKVVISAPSSDAPMFVMGVNHELYEKNMHVVSNASCTTNCLAPLAKVVHDKFGIKEGLMTTVHAVTATQKTVDGPSKKDWRGGRGACFNIIPSSTGAAKAVGKVIPDLNGKLTGMSFRVPTADVSVVDLTARLVNPASYDEIKAAIKSASENEMKGILGYTEKAVVSSDFIGDSHSSIFDASAGIALTD

SEQ ID NO: 60263 - protein, 482 aa, Synechocystis sp. PCC 6803
MQFNVAIMTKRTFGVIGLAVMGENLALNVESRGFPIAVFNRSPNKTEKFMAERAVGKDIKAAYTVEEFVQLLERPRKILVMVKAGGPVDAVINELKPLLEEGDMIIDGGNSLYEDTERRTKDLEATGLGFVGMGVSGGEEGALLGPSLMPGGTPAAYKELEPILTKIAAQVEDPDNPACVTFIGPGGAGHYVKMVHNGIEYGDMQLIAEAYDILKNGLGLSNEQLHEVFGQWNQTDELNSFLIEISTDIFAKKDPETGGHLIDYILDAAGQKGTGRWTVMSGLELGVPIPTIYAAVNARVMSSLKEERVAASGQLSGPSKTFSGDVEAWIPKVRDALYCSKMCSYAQGMALIAKASQEFGYDVNLPEIARIWKGGCIIRAGFLDKIKKAFKDNPQLPNLLLAPEFKQSILDRQGPWREVLMLANEMGIAVPAFSSSLDYFDSYRRAVLPQNLTQAQRDYFGAHTYERTDKPRGEFFHTEWLD

SEQ ID NO: 60264 - protein, 480 aa, Physcomitrella patens subsp. patens
SEDEGSDEYRRGGYHAIRIGDWFHNGRYVVYRKLGWGHFSTVWLAWDTLDKKYVALKVQKSAQHYTEAALDEITILKQIADGDVEDRKGVVKLLDHFKHTGQNGTHVCMVFEYLGDNLLTLIKAYNYRGIPLQMVKQIAKETLVGLDYLHRQLSIIHTDLKPENILLLFPLDRSKDPRNSDHVPLEIPGPGEKSQTLSGFDKPLSPNLSKNQKKKAKRKAKKAGGNGNDRERENCDPDPRVSKFGKEESEKVACEPAEIINATERLRGSKEESVDACDEEHDVKGDRPLCASAPKRGRSLPLTEDLSKMELRCKIVDLGNACWTYKQFTADIQTRQYRCPEVLLGSKYSTPADMWSFACIIFELATGDVLFDPRSGDDFGRDEDHLALMMELLGRMPRKIALSGKYSRDYFNRHGDLRHIRRLRYWPLDNVLIEKYDFSEQEAQELAEFLVPLLDFVPEKRPTAGRCLQHPWLSSVSRSV

SEQ ID NO: 60265 - protein, 375 aa, Brucella ovis
MKIDYYEALGVTRTADDKTLKAAFRKLAMQYHPDRNPDDPEAERKFKEIGEAYETLKDPQKRAAYDRFGHAAFENGGMGGGFGNGFAGAGGFADIFEDIFGEMMGGRRRRNGAERGADLRYNMEVTLEEAYAGKTAQIRVPTSITCDECSGSGAKPGSQPTTCTMCSGSGRCRAAQGFFSVERTCPGCNGRGQIIKDPCKKCHGQGRVDRGRSLSVNIPAVSRTEPRIRLAGEGEAGLRGGPAGDLYILLSVKPHEFFQRDGADLYCKVPISMTTAALGGQFEVSTLDGTQTRVKVPEGTQNGKQFRLKGKGMPGLRQSVTGDLYIQIDIETPQNLSKRQRELLEEFEKLSWQENSPKSAGLFSRMKEFFEGIGE

SEQ ID NO: 60266 - protein, 480 aa, Azoarcus sp. EbN1
MKEYKLFIDGEWVGSSTETILDDLNPATSEVWGRVHQASAADLERAIAAAYRARESWGNTLANEREAILLRAADALQKRIPDVAAVLIDEAGSTYGKAMFEASFVVNLLRSAAGECRRITGETMPSDSPGVFSMSVRRPLGVIAGIAPFNFPFLLATKKVALALAAGNTFILKPASYTPVTGLKIAEIFEAAGLPKGVLNVVPVQGSVLGNTFVADPRVRMITFTGSTEVGRELSAEAGRHFKRITLELGGKSPMIVLKDADVDYAVNAAAFGIFLHQGQVCMANSRLIVEAPIFDVFCDKLATKIAGFKVGDPRDPQTVIGPLIDRKQCAVLDRHVADAVAKGAKLLHGGKSDGAFYQPTILAGVTPDMVVFREESFGPAVSVIRAADSEDALRLANDSCYGLSSGLITNDLQKAFDLSLRLEAGMVHINDSSIMDEPHVPFGGVKDSGFGREGGHHSMDEMTELKWITVQMGQRQFPF

SEQ ID NO: 60267 - protein, 565 aa, Solanum ptychanthum
PRKGCDVLVEALEREGVTDVFAYPGGASMEIHQALTRSNIIRNVLPRHEQGGVFAAEGYARATGFPGVCIATSGPGATNLVSGLADALLDSIPIVAITGQVPRRMIGTDAFQETPIVEVTRSITKHNYLVMDVEDIPRIVREAFFLAKSGRPGPVLIDVPKDIQQQLVIPNWDQPMRLPGYMSRLPKLPNEMLLEQIVRLISESKKPVLYVGGGCSQSSEELRRFVELTGIPVASTLMGLGAFPTGDELSLQMLGMHGTVYANYAVDSSDLLLAFGVRFDDRVTGKLEAFASRAKIVHIDIDSAEIGKNKLPHASICADIKLALQGLNSILEGKEGKLKLDFSAWRQELNEQKVKYPLNFKTFGEAIPPQYAIQVLDELTNGNAIISTGVGQHQMWAAQFYKYKKPRQWLTSGGLGAMGFGLPAAMGAAVGRPGEIVVDIDGDGSFMMNVQELATIKVENLPVKIMLLNNQHLGMVVQWEDRFYKANRAHTYLGDPANEEEIFPNMLKFAEACGVPAARVTHRDELRAAIQKMLDTPGPYLLDVIVPHQEHVLPMIPSGGAFKDV

SEQ ID NO: 60268 - protein, 564 aa, Thermobifida fusca YX
MPSAPTPTGRPARKTTRPRRGEGQWALGYREPLNKNEEIKKNDDGLNVRKRIIDIYSKQGFDSIDPADLRGRFRWYGLYTQRAPGIDGGKTAVLEPEELDDRYFMMRVRTDGGQLNVAQLRVLAEVSTAYGRDTADITDRQNIQMHWVRIEDVPTIWERLESVGLTTTEACGDTPRGLLGCPLAGIAEDEIIDATPQLRQIVADHIGSPLFSNLPRKFKTAIDGCAVHCTNYEVNDVAFVGVIGPDGTPGYDLFVGGGLSTNPMFAQRLGAFVRPEQVSEVWAGVCSVFRDYGYRRLRHRARIKFLIKDWGPQKFREVLEKEYLGYSLPDGPEPVLDPGTRRDHVGIHRQKDGRFFVGFAPRVGRVSGTILGRIADIAEAHGSNRVRTTADQKLAILDITEDRLDSVVAALEAEDLQVNPSVFRRQTMACTGIEYCKLAIVETKNRAMALIDELERRLPDFTEPLTINVNGCPNACARTQIADIGLKGQLVTDAHGNQVEGFQIHLGGGLGLQAGFGRKVRGLKTTAAELPDYIERVVRRFAEQRQAEETFAEWVARADEADLK

SEQ ID NO: 60269 - protein, 565 aa, Solanum ptychanthum
PRKGCDVLVEALEREGVTDVFAYPGGASMEIHQALTRSNIIRNVLPRHEQGGVFAAEGYARATGFPGVCIATSGPGATNLVSGLADALLDSIPIVAITGQVPRRMIGTDVFQETPIVEVTRSITKHNYLVMDVEDIPRIVREAFFLAKSGRPGPVLIDVPKDIQQQLVIPNWDQPMRLPGYMSRLPKLPNEMLLEQIVRLISESKKPVLYVGGGCSQSSEELRRFVELTGIPVASTLMGLGAFPTGDELSLQMLGMHGTVYANYAVDSSDLLLAFGVRFDDRVTGKLEAFASRAKIVHIDIDSAEIGKNKLPHASICADIKLALQGLNSILEGKEGKLKLDFSAWRQELNEQKVKYPLNFKTFGEAIPPQYAIQVLDELTNGNAIISTGVGQHQMWAAQFYKYKKPRQWLTSGGLGAMGFGLPAAMGAAVGRPGEIVVDIDGDGSFMMNVQELATIKVENLPVKIMLLNNQHLGMVVQWEDRFYKANRAHTYLGDPANEEEIFPNMLKFAEACGVPAARVTHRDELRAAIQKMLDTPGPYLLDVIVPHQEHVLPMIPSGGAFKDV

SEQ ID NO: 60270 - protein, 241 aa, Bordetella petrii
MLQNREGQRVPNVTFPIRQDNEWKQVSTDDLFKNKTVVVFSLPGAFTPTCSSTHLPRYNELASTFASVGVDAVVCVSVNDTFVMNEWAKDQEAGNITLLPDGNGDFTEGMGMLVDKRDLGFGKRSWRYSMLVKDGVIEKMFIEPQKEGDPFEVSDADTMLAYIAPQAKKPDQVVVFSKPGCPFCIEAKALLADKGYDPIEIPLEHKVRGRVIGAISGKGTAPQVFINGTLVGGLEDLKAYL

SEQ ID NO: 60271 - protein, 554 aa, Solanum ptychanthum
LEREGVTDVFAYPGGTSMEIHQALTRSNIIRNVLPRHEQGGVFAAEGYARATGFPGVCIATSGPGATNLVSGLADALLDSIPIVAITGQVPRRMIGTDAFQETPIVEVTRSITKHNYLVMDVEDIPRIVREAFFLAKSGRPGPVLIDVPKDIQQQLVIPNWDQPMRLPGYMSRLPKLPNEMLLEQIVRLISESKKPVLYVGGGCSQSSEELRRFVELTGIPVASTLMGLGAFPTGDELSLQMLGMHGTVYANYAVDSSDLLLAFGVRFDDRVTGKLEAFASRAKIVHIDIDSAEIGKNKLPHASICADIKLALQGLNSILEGKEGKLKLDFSAWRQELNEQKVKYPLNFKTFGEAIPPQYAIQVLDELTNGNAIISTGVGQHQMWAAQFYKYKKPRQWLTSGGLGAMGFGLPAAMGAAVGRPGEIVVDIDGDGSFMMNVQELATIKVENLPVKIMLLNNQHLGMVVQWEDRFYKANRAHTYLGDPANEEEIFPNMLKFAEACGVPAARVTHRDELRAAIQKMLDTPGPYLLDVIVPHQEHVLPMIPSGGAFKDV

SEQ ID NO: 60272 - protein, 88 aa, Sonneratia alba
FGLFAFSWLILRLIFFPFWVIRASSNDLLEYLPLHETYGTLLYYIFNTMLLTLLVFHIYWWFLICSMITKQLKNRGKVGEDIRSDSED

SEQ ID NO: 60273 - protein, 88 aa, Sonneratia caseolaris
FGLFAFSWLILRLIFFPFWVIRASSDDLLECLPLHETYGTLLYYIFNTMLLTLLVFHIYWWFLICSMITRQLKNRGKVGEDIRSDSED

SEQ ID NO: 60274 - protein, 88 aa, Sonneratia ovata
FGLFAFSWLILRLIFFPFWVIRASSNDLLEYLPLHETYGTSLYYIFNTMLLTLLVFHIYWWFLICSMITRQLKNRGKVGEDIRSDSED

SEQ ID NO: 60275 - protein, 88 aa, Sonneratia apetala
FGLFAFSWLILRLIFFPFWVIRASSNDLLEYLPLHETYGTLLYYIFNTMLLTLLVFHIYWWFLICSMITRQLKNRGKVGEDIRSDSED

SEQ ID NO: 60276 - protein, 264 aa, Staphylococcus aureus subsp. aureus Mu50
MQLYYLGPKGTFSYLACRQYFSENEATFQPKSNLFEVIKAVADDDTSIGVVPIENSIEGTINIVADALAQQDVFAHGEIRLDINFALYGNGTDSISDIKKVYSIAPAISQTTNYIHQHQFDYDYVDSTIQSLTKIENGVAAIAPLGSGEAYGFTPIDTHIEDYPHNVTRFLVIKNQQQFDQNATSLMFLITPMHDKPGLLASVLNTFALFNINLSWIESRPLKTQLGMYRFFVQADSAITTDIKKVIAILETLDFKVEMIGAFN

SEQ ID NO: 60277 - protein, 520 aa, Staphylococcus aureus subsp. aureus Mu50
MAYFNQHQSMISKRYLTFFSKSKKKKPFSAGQLIGLILGPLLFLLTLLFFHPQDLPWKGVYVLAITLWIATWWITEAIPIAATSLLPIVLLPLGHILTPEQVSSEYGNDIIFLFLGGFILAIAMERWNLHTRVALTIINLIGASTSKILLGFMVATGFLSMFVSNTAAVMIMIPIGLAIIKEAHDLQEANTNQTSIQKFEKSLVLAIGYAGTIGGLGTLIGTPPLIILKGQYMQHFGHEISFAKWMIVGIPTVIVLLGITWLYLRYVAFRHDLKYLPGGQTLIKQKLDELGKMKYEEKVVQTIFVLASLLWITREFLLKKWEVTSSVADGTIAIFISILLFIIPAKNTEKHRRIIDWEVAKELPWGVLILFGGGLALAKGISESGLAKWLGEQLKSLNGVSPILIVIVITIFVLFLTEVTSNTATATMILPILATLSVAVGVHPLLLMAPAAMAANCAYMLPVGTPPNAIIFGSGKISIKQMASVGFWVNLISAIIIILVVYYVMPIVLGIDINQPLPLK

SEQ ID NO: 60278 - protein, 77 aa, Sonneratia alba
LVKSSLRPDFHVSAQNCWVKKGGAYTGEVSAEMLVNLDVPWVILGHSERRLILGESNEFVGDKVAYALSKGLKVIAC

SEQ ID NO: 60279 - protein, 197 aa, Gossypium marchantii
IVESVGEGVTHLKPGDHVLPVFTGECGNCRHCKSKESNMCDLLRINTDRGVMLSDGKTRFSINGKPIYHFVGTSTFSEYTVAHVGSVAKINPAAPLDKVCILSCGISTGLGATLNVAKPAKGSTVAIFGLGAVGLAAAEGARIAGASRIIGVDLNPNRFEEAKKFGCTEFVNPKDHNKPVQEVLAEMTNGGVDRSVE

SEQ ID NO: 60280 - protein, 405 aa, Coxiella burnetii
MAIEIKVPTLPESVSDATVAKWYKKEGDSISRDENLVDLETDKVMLEVPAPKDGVVEKIVAKEGEVVKADQILALLKEGGSVAKEKAKKDEKETKKEKEKKEEKKDKEKKEKTEEKESDLSPAVRRMVSEKDVDVEEIEGSGKGGRITKKDVEDYLEKQKEKPSEGKEGPADERTEKRVPLSRIRQRVAERLVQVQQEAALLTTFNEINMQLVMELRKKYREEFEKKFKVRLGFMSFFTKAVVEALKRFPMVNASIDGSDIIYHNYYDIGIAIGTERGLIVPILRNAEKMNMADIEKQIREYASRAQEGRLNIEELTGGTFTITNGGTYGTLLSTPIINPPQTAILGMHKIMDRPTVENGEVVVRPIMQVALSYDHRVIDGREAVLFLVTIKELLEDPARMILEC

SEQ ID NO: 60281 - protein, 466 aa, Oceanicola granulosus HTCC2516
MTNATLGLYGLGTMGSALALNILDNGYPLHVSNRTDKVVDDFVAEAGPLAEKLTPARSLVAMAQAMEAPRAIILMVPAGRPVDESIAELVPHLEHGDVIVDAGNADFNDTMRRTRELEAQGLAFLGMGVSGGEEGARRGPSIMVGGTEAVWEGLREVIEAIAAKFEGDPCAARLGPDGAGHFVKTVHNGIEYADMQLIAETYGLMRYGRGMAPARIGEVFAGWNKGRLQSYLVEITAEVLAATDRETGAPALDDILDRAGQKGTGRWTVIEALRMGQSASAIEAAVAARSWSAEKPTREAGAVLLGFTRGAVELTDAELEAALLAGRIVAYAQGFRILRAASDEFGWSLDFARVAEIWRAGCIIRSSLLDDISGAFRGDLPEGQLIFAPAFAQMLQQSAPALRKVVAAAALAGHAAPAFSGALAFLDTMSTARGTTDLIQGQRDFFGRHGFERLDGRAGQHGPWWD

SEQ ID NO: 60282 - protein, 367 aa, Zymomonas mobilis
MIWGRGFGATGAKVGEVCFHTAMTGYEEIMTDPSFASQIINFTFPHIGNVGANREDVEAKTLHALGCIVREDVTAPSNFRSLWRFDSWLKDHDRIGLAGVDTRALTGLLRKKGAQNAVIAHDPKGQFDIPALIETARSWAGLQGMDLARSVSTHQSYNWQEGIWSLQNGYSVVDNQKGPHVVAIDYGLKHNILRNLVEAGARVTVVKATASFDEVMAHKPDGVFLSNGPGDPAATAEYAVPVIRQLLDIKMPIFGICLGHQLLALAVGATTYKMHQGHRGANHPVKRLDDSKVEITSMNHGFAVATDSLPEQARPTHLSLFDGSLAGLELTDRPAFSVQYHPEASPGPQDSYYLFTKFIDLIAKERP

SEQ ID NO: 60283 - protein, 547 aa, Phytophthora cactorum
QAQELVGMLNTAKIPANVEVVVAPSQVHAATVKAALRSDVRVSGQDVWKQGNGAFTGETSAEMLKDLGAEYTLVGHSERREKGETNEIVAKKAAYALEKGLAVIACIGETKELREANQTVAYITEQLDAYAAEINDWTNVVIAYEPIWAIGTGLTASPEQAQEVHASIRAWLKEKVSPEAGDKTRVIYGGSVGAKNAPELSQKEDIDGFLVGGASLKPDFLHIINAQNPTTNVGGAVNVAINGFGRIGRLVLRAAAKNPLINIVAINDPFITTTYMEYMLEYDTVHGKFDGSLSHDEKHIFVNGKPIRVFNEMNPANITWGEEQVQYVVESTGAFTTLEKASAHLKNGVEKVVISAPSSDAPMFVMGVNHELYEKNMHVVSNASCTTNCLAPLAKVVNDKFGIKEGLMTTVHAVTATQKTVDGPSKKDWRGGRGACFNIIPSSTGAAKAVGKVIPSLNGKLTGMSFRVPTADVSVVDLTARLVNPASYDEIKAAIKSASENEMKGILGYTEKAVVSSDFIGDSHSSIFDASAGIALTDDFVKLVSWY

SEQ ID NO: 60284 - protein, 468 aa, Synechocystis sp. PCC 6803
MNPSSSPSQSTANVKFVLLISGVAALGGFLFGFDTAVINGAVAALQKHFQTDSLLTGLSVSLALLGSALGAFGAGPIADRHGRIKTMILAAVLFTLSSIGSGLPFTIWDFIFWRVLGGIGVGAASVIAPAYIAEVSPAHLRGRLGSLQQLAIVSGIFIALLSNWFIALMAGGSAQNPWLFGAAAWRWMFWTELIPALLYGVCAFLIPESPRYLVAQGQGEKAAAILWKVEGGDVPSRIEEIQATVSLDHKPRFSDLLSRRGGLLPIVWIGMGLSALQQFVGINVIFYYSSVLWRSVGFTEEKSLLITVITGFINILTTLVAIAFVDKFGRKPLLLMGSIGMTITLGILSVVFGGATVVNGQPTLTGAAGIIALVTANLYVFSFGFSWGPIVWVLLGEMFNNKIRAAALSVAAGVQWIANFIISTTFPPLLDTVGLGPAYGLYATSAAISIFFIWFFVKETKGKTLEQM

SEQ ID NO: 60285 - protein, 140 aa, Thermobifida fusca YX
MSEQNPPVQRSEEEWRAILDPEAFAVLRLGATEPPWSGEYVSTTAQGVYRCRACGAELFRSEHKFDAQCGWPSFYDPVDSSAVTLHEDLSHGMVRTEVRCARCGSHLGHVFYGEGYPTPTDARYCINSIALTLEAEDTVE

SEQ ID NO: 60286 - protein, 310 aa, Symbiobacterium thermophilum IAM 14863
MTTLKGRDFISLHDWSRDELEEVLELAMWQKARLKAGIRDEPLKGKQLGMYFAKPSTRTRLSFEVGIRQLGGDALFLSAHDLQLQRGESIADTARVMSRFLDGIMIRTFSHREVVELAEWATIPVINGLTDEEHPCQVVADLLTALERFGTLPGLKLAYVGDGNNVAHSLMDGGAKFGMHVVVASPEGYQPDPARVARAQVTAARYGGLVEVVTDPVLAVTGAQIVYTDVWASMGQEAEAEQRRKAFAGYQVTAELMRCAAPEAIFMHCLPAHRGEEVAAEVIDGPQSAVFDEAENRLHAQKAIMTLIMA

SEQ ID NO: 60287 - protein, 433 aa, Prochlorococcus marinus str. MIT 9312
MKSLDSNTPNQDWHPNIWPPFTQINTSKPQIEVTHGKDALLFTKDPKKELIDAISSWWVTLHGHSNEYIANAIFDQAKNLEQVIFADFLHPQARKLAERLSKLTKLERLFFSDNGSTAVEVALKIAFQSWQNRGETRSQIVAFDGAYHGDTFGAMALGERNIFNENFDDLMFPVRRVPWPSTWINDDEVENKENEAIQKLETLLKTPTVAVILEPLVQGAGGMNMVRAQFIKKVSETVKNNNSLLIADEVLTGFGRCGSLFAFQKAKIIPDLISISKGLTGGFLPMGITLCKEKIFQSFIDDSPKKTFWHGHSFTANPLGCAAANASLDLLEKEPNKYLSFEEKHLSHLIKFKKLPYIKKIRVSGTIAAFDLEIGNKRGYFNNIGKEIKSLAMEEGLFIRPLGNVIYLLPPLCITDDQLEKSYWIISKILDNL

SEQ ID NO: 60288 - protein, 159 aa, Leuconostoc mesenteroides subsp. mesenteroides ATCC 8293
MNIKLITVGKLKEKYLTEGIAEYTKRLSRFCKVQVVELIDEKTPENASEAQNNQIMAREGERIQAKIGSRDYVIVLAIEGKQFPSEEFSQKLEAIAVNGYSDITFIIGGSLGLSKAIKQRANLKMSFGLLTLPHQLMRLVLIEQIYRAFMIQQGSPYHK

SEQ ID NO: 60289 - protein, 334 aa, Xanthomonas oryzae pv. oryzae KACC10331
MTASADRYAASLRLSVAPMMDWTDRHCRVFHRLLAPSARLYTEMVHANAVIHGDRARLLGFDAVEHPLALQLGGSDPALLAQAAAIAQEWGFDEINLNCGCPSDRVQAGRFGACLMREPALVAECVAAMCTATHVPITVKCRLGVDDDDDYALFARFVDQVVAAGAAMVVVHARNAWLKGLSPKENREVPPLRYDWAYRLNQERPGLPVVLNGGIVAVDAAMAHLQHTDGVMLGRAAYHDPYVLHCLDAALNQRPEQPRESLLRALQPYVASQLAQGLALKHMTRHVLGLFHGQPGGRSFRQVLSEGAHRPGAGWELVEQALQRTDTRSWRVVA

SEQ ID NO: 60290 - protein, 219 aa, Oryza sativa
MSASAAPTHIRFSSAALPSAAALRRPRRRCATPVRCSLAAAPGLRAPPELIDSILSKVKGTDRGVLLPKDGHQEVADVALQLAKYCIDDPVKSPLIFGEWEVVYCSVPTSPGGLYRTPLGRLIFKTDEMAQVVQAPDVVKNKVSFSVFGFDGAVSLKGKLNVLDGKWIQVIFEPPEVKVGSLGFQYGGESEVKLEITYVDEKIRLGKGSRGSLFVFMRR

SEQ ID NO: 60291 - protein, 102 aa, Zea mays
MSVEGSKSGPTVLDTMSAQEPFVHIPEETIREALKVVLDVRNQPVLIHCKRGEHRTGCVVGCLRKLQKWCLSSVFDEYLHFAAAKARTTDQRFMELFDAQSL

SEQ ID NO: 60292 - protein, 193 aa, Brassica napus
  misc_feature (59)..(59): Xaa can be any naturally occurring amino acid
LVYLKAALSETLRLYPSVPEDSKHVVNDDILPDGTFVPAGSSVTYSIYAAGRMKTTWGXEDCLEFKPERWISPEDGKFVNHDQYRFVAFNAGPRICLGKDLAYLQMKTIAAAVLLRHRLTVAPGHKVEQKMSLTLFMKNGLVVNVHKRDLEGIMKSLVSKERNDVVAATLNGKCNGVIGEDVSSVNAAVAVAV

SEQ ID NO: 60293 - protein, 287 aa, Glycine max
MAKDVEVAERGSFSGKDYQDPPPAPLIDAEELTKWSFYRALIAEFIATLLFLYITVLTVIGYNHQTDLKENGEICGGVGILGIAWAFGGMIFILVYCTAGISGGHINPAVTFGLFLARKVSLIRAIMYMVAQCLGAICGVGLVKAFQKSYFNKYGGGANSLAAGYSTGTGLGAEIIGTFVLVYTVFSATDPKRNARDSHVPVLAPLPIGFAVFMVHLATIPVTGTGINPARSLGAAVIYNQDKPWDDHWIFWVGPFIGAAIAAFYHQFILRAGAAKALGSFRSNPHN

SEQ ID NO: 60294 - protein, 82 aa, Sonneratia caseolaris
LVKSSLRPDFHVSAQNCWVKKGGAYTGEVSAEMLVNLDVPWVILGHSERRLILGESNEFVGDKVAYALSKGLKVIACVGETL

SEQ ID NO: 60295 - protein, 459 aa, Staphylococcus aureus subsp. aureus Mu50
MNIIEQKFYDSKAFFNTQQTKDISFRKDQLKKLSKAIKSYESDILEALYTDLGKNKVEAYATEIGITLKSIKNARKELKNWTKTKNVDTPLYLFPTKSYIKKEPYGTVLIIAPFNYPFQLVFEPLIGAIAAGNTAIIKPSELTPNVARVIKRLINETFDANYIEVIEGGIEETQTLIHLPFDYVFFTGSENVGKIVYQAASENLVPVTLEMGGKSPVIVDETANIKVASERICFGKFTNAGQTCVAPDYILVHESVKDDLITALSKTLREFYGQNIQQSPDYGRIVNLKHYHRLTSLLNSAQMNIVFGGHSDEDERYIEPTLLDHVTSDSAIMQEEIFGPILPILTYQSLDEAIAFIHQRPKPLSLYLFSEDENATQRVINELSFGGGAINDTLMHLANPKLPFGGVGASGMGRYHGKYSFDTFTHEKSYIFKSTRLESGVHLPPYKGKFKYIKAFFKN

SEQ ID NO: 60296 - protein, 280 aa, Brassica napus
  misc_feature (33)..(33): Xaa can be any naturally occurring amino acid
  misc_feature (52)..(52): Xaa can be any naturally occurring amino acid
  misc_feature (167)..(167): Xaa can be any naturally occurring amino acid
  misc_feature (209)..(209): Xaa can be any naturally occurring amino acid
FYIPVYFLRNGGPVVEAKNRCALGYIVNIASLXGVEEEKLNRPLNRDFVPSXLENANKKKINVAKKPEAVQKKARAVVKPQVILISPDTDVVAKAKQDQRHDVASKKKVTYSSILNARSKAAASRTLDIDSTDKDNDLGAVEYVEDMYAFYKEVEMYMQTHIEINEXMRSILLDWLIDVHVKFDLSPETLYLTINIIDLFLSLKTIPRXELQLLGVSALLIASKYEEIWPPQVNDLLYITDNSYQSMQILLMEKTIMGSLEWYLTVPTQYVFLARSIKAA

SEQ ID NO: 60297 - protein, 224 aa, Bartonella quintana str. Toulouse
MPRSHLISPSLLAADFSKLGQEVLDIVDAGADWLHLDIMDGHFVPNITFGPNVVKALRPLTRAIFDVHLMISPADPYLEAFAQAGSDIITIHAEAGPHLHRSLQKIKGMGKKAGLAINPSTPEHVLEYLLDQLDLILIMTVNPGFGEQSFIPEMKDKIKRVKSMIAHRPIDLVVDGGITVDTIGITAKAGANVFVAGSAIYKDGNKELYKTRISALRQAASLSQ

SEQ ID NO: 60298 - protein, 549 aa, Oryza sativa
MATTATLPFSCSSTLQTLTRTIPLRLRLHRRRFLHHLPSLAALPRLPLPRPPLLPHARRHVSASAAPNGASSEGEYDYDLFTIGAGSGGVRASRFASTLYGARAAVCEMPFATVASDDLGGVGGTCVLRGCVPKKLLVYGSKYSHEFEESHGFGWVYETDPKHDWNTLIANKNTELQRLVGIYKNILNNSGVTLIEGRGKIVDPHTVSVDGKLYTARNILIAVGGRPSMPNIPGIEHVIDSDAALDLPSKPEKIAIVGGGYIALEFAGIFNGLKSEVRDFIAEQMSLRGITFHTEQSPQAITKSNDGLLSLKTNKETIGGFSHVMFATGRKPNTKNLGLEEVGVKLDKNGAIMVDEYSRTSVDSIWAVGDVTDRVNLTPVALMEGGAFAKTVFGDEPTKPDYRAVPSAVFSQPPIGQVGLTEEQAIEEYGDVDIYTANFRPLRATLSGLPDRIFMKLIVCATTNKVVGVHMCGEDAPEIIQGVAIAVKAGLTKQDFDATIGIHPTSAEEFVTMRNATRKVRRSTTDEAFSEGLLYFRAADLHWADNFFL

SEQ ID NO: 60299 - protein, 228 aa, Gossypium nobile
  misc_feature (93)..(93): Xaa can be any naturally occurring amino acid
FTSLCHTDVYFWEAKGQTPLFPRIFGHEAGGIVESVGEGVTHLKPGDHVLPVFTGECGNCRHCKSKESNMCDLLRINTDRGVMLSDGKTRFSXNGKPIYHFVGTSTFSEYTVAHVGSVAKINPAAPLDKVCILSCGISTGLGATLNVAKPAKGSTVAIFGLGAVGLAAAEGARIAGASRIIGVDLNPNRFEEAKKFGCTEFVNPKDHNKPVQEVLAEMTNGGVDRSVE

SEQ ID NO: 60300 - protein, 572 aa, Physcomitrella patens subsp. patens
MGPGYEDATHFDPVANQNLALISVGEHGLKPTPRKKKKVVKRWRDEWAETYKWAYVSVHEGSHRIFCSVCKEYGRKHRRNPYGNEGSRNMQMSALEEHNNSLLHKEALRLQMASRDKGMGVIERPLYVKVSILSAILRRDPHEMEFIQSVQEVVHSLEPVLTKYPQYVHVLERLVEPERVVIFKVSWVDDKGEAHVNRGFRVQFNQALGPYKGGLRFHPTVNLSVMKFLAFEQTLKNSLSSLSLGGGKGGSDFNPKGKSENEIMRFCYSFMEELYRHIGPNQDTPSGDIGVGPREIGYLFGQYRRLTSQYEVRGMLGPKGIQWGTSNLHPEATGYGVVYYAKEVLTDLHRDLKDLRCVVSGAGKVALYAVEKLISFGAVPVTISDTRGYLLDEEGFDRVKLSLIREIKAHNKNLREYTKSYPKAKYLDDTKPWAVKCDIAFPCATQNELNHADAMSLINVGCQIIIEGANMPCTAEAIDIFRKSKIWFGPGKAANAGGVAIQGLEMAQNSSRVQWTAEEVDMRLQEVMKDIYQKSMKAAQEYGIGNPEALLHGANIASFLRVAQAMLEQGCV

SEQ ID NO: 60301 - protein, 441 aa, Ashbya gossypii ATCC 10895
MGKVVQLFTHPLELKAALKLKFLREPLYPADDTQGSAELKRCYQLLQRTSRSFAAVIMELHPELRNAVMLFYLILRALDTVEDDMTISPKVKVPLLREFDQKLKLDTWSFDGNAKTEKDRDVLVEFSTILAEFHKLKPEYQQVIADITHKMGNGMADYILDEKFNLSGLETIQDYDRYCHYVAGLVGDGLTHLIMLAKFSSPGLYYDSPDLYESMGLFLQKTNIIRDYAEDLADGRSFWPKEIWSHYADDLASFSKPENATAGVYCINHLVLNALGHVQHVLTYLASLREQSSFQFCAIPQVMAIATLALVFGNERVLQTSVKIRKGTTCYLILKSRTFQGCVEIFEHYLRDIRKRLTVADPNYLKLNIEIAKLDKFIEEMYQDKLPVGAKPQETEIYKKVRERSAYDLEVLPREQEEEFKFNVLLSILFTVFGALYWYAK

SEQ ID NO: 60302 - protein, 236 aa, Arabidopsis thaliana
MASLPVQFTRNQISSPFFSVNLRREPRSLVTVHCSAGENRENGEGVKKSLFPLKELGSIACAALCACTLTIASPVIAANQRLPPLSTEPDRCEKAFVGNTIGQANGVYDKPLDLRFCDYTNDQTNLKGKTLSAALMVGAKFDGADMTEVVMSKAYAVEASFKGVNFTNAVIDRVNFGKSNLKGAVFRNTVLSGSTFEEANLEDVVFEDTIIGYIDLQKICRNESINEEGRLVLGCR

SEQ ID NO: 60303 - protein, 275 aa, Vibrio parahaemolyticus RIMD 2210633
MPMTKDLSHLLPQVIEIARSAGQMILDIYEKKQYEAYTKSDETPVTSADIAAHKLITERLSELTPDIPVLSEEAADISLEQRAQWQRYWLVDPLDGTQEFIARSGDFATIIALIDNNKPAMGVVYGPVSGVTYYAYSGKGAWKIPDMSESVKIHTHKHEQAGQNIAIAISRRQDINRITSRMSSAWNYDLIPLGSAALKACLVAEGAVDCYLRLGPTGEWDTAATQCIVEEAGGRILSTHLEPLSYNERETLENPNFIVLGDTNLPWDDILQRKD

SEQ ID NO: 60304 - protein, 228 aa, Gossypium pilosum
  misc_feature (200)..(200): Xaa can be any naturally occurring amino acid
FTSLCHTDVYFWEAKGQTPLFPRIFGHEAGGIVESVGEGVTHLKPGDHVLPVFTGECGNCRHCKSKESNMCDLLRINTDRGVMLSDGKTRFSINGKPIYHFVGTSTFSEYTVAHVGSVAKINPAAPLDKVCILSCGISTGLGATLNVAKPAKGSTVAIFGLGAVGLAAAEGARIAGASRIIGVDLNPNRFEEAKKFGCTXFVNPKDHNKPVQEVLAEMTNGGVDRSVE

SEQ ID NO: 60305 - protein, 484 aa, Zea mays
MPAVASLWAPPAAARRRRFSPVVSSSLRRVASGGGSSWRSERRLMSELERTVTAGATERVIRSYVGTKSERAALAALSRLLMDSDPLAIPFYEAVTQARWFKWSSIHAAAVAALLEANGRAGESRSLIADSVSQHLQQSTDEVALFYCDLIAAFSSRGLKDRATEFHMELRSMPPLSGRKAYAAMVKSLCLLGMPAEAEAALREMVSRGHRPEAAQFGAVARCYGRAGSPADMERVIASMADAGGIRLGAGAADAVLSCYSACRDHARTLAWLKRMRKLRVAVTAKGYNLVLNSCPSLASVVRELGPELPLSTAGLVGWLRSASTTPAPAAEVEVVRELLASSASVLDRAMEWSEAEAKLNLHGFSTVAAYVLVLQWVDAVRGRARALPLEVSVVCGVGKHSDVRGESRVRELAQEVLGRMGSPLKLSARNRGRLVAKRDRVEQWLASLPVPEDGTDPSPDAANEEPFVFALFRKLGQFFSNLM

SEQ ID NO: 60306 - protein, 547 aa, Phytophthora cactorum
  misc_feature (339)..(339): Xaa can be any naturally occurring amino acid
QAQELVGMLNTAKIPANVEVVVAPSQVHAATVKAALRSDVRVSGQDVWKQGNGAFTGETSAEMLKDLGAEYTLVGHSERREKGETNEIVAKKAAYALEKGLAVIACIGETKELREANQTVAYITEQLDAYAAEINDWTNVVIAYEPIWAIGTGLTASPEQAQEVHASIRAWLKEKVSPEAGDKTRVIYGGSVGAKNAPELSQKEDIDGFLVGGASLKPDFLHIINAQNPTTNVGGAVNVAINGFGRIGRLVLRAAAKNPLINIVAINDPFITTTYMEYMLEYDTVHGKFDGSLSHDEKHIFVNGKPIRVFNEMNPANITWGEEQVQYVVESTGAFTTLXKASAHLKNGVEKVVISAPSSDAPMFVMGVNHELYEKNMHVVSNASCTTNCLAPLAKVVNDKFGIKEGLMTTVHAVTATQKTVDGPSKKDWRGGRGACFNIIPSSTGAAKAVGKVIPSLNGKLTGMSFRVPTADVSVVDLTARLVNPASYDEIKAAIKSASENEMKGILGYTEKAVVSSDFIGDSHSSIFDASAGIALTDDFVKLVSWY

SEQ ID NO: 60307 - protein, 535 aa, Phytophthora tropicalis
  misc_feature (509)..(509): Xaa can be any naturally occurring amino acid
ELVGMLNTAKIPANVEVVVAPSQVHAATVKASLRSDVRVSGQDVWKQGNGAFTGETSAEMLKDLGAEYTLVGHSERREKGETNEVVAKKAAYALEKGLGVIACIGETKELREANQTVAYITEQLDAYAAEIKDWTNVVIAYEPIWAIGTGLTASPEQAQEVHASIRAWLKEKVSTDAAEKTRVIYGGSVGAKNAPELSQKEDIDGFLVGGASLKPDFLQIINAQNPTDNVGGAVNVAINGFGRIGRLVLRAAATNPLINIVAINDPFISTTYMEYMLEYDTVHGKFAGSLSHDEQHIFVNGKPIRVFNEMNPANIKWGEQQVQYVVESTGAFTTTEKASAHLQNGVEKVVISAPSSDAPMFVMGVNHELYEKNMHVVSNASCTTNCLAPLAKVVNDKFGIKEGLMTTVHAVTATQKTVDGPSKKDWRGGRGACFNIIPSSTGAAKAVGKVIPSLNGKLTGMSFRVPTADVSVVDLTARLVNPASYDEIKAAIKSASENEMKGILGYTEXAVVSSDFIGDSHSSIFDAEAGIALTD

SEQ ID NO: 60308 - protein, 288 aa, Oryza sativa Japonica Group
MEGKEEDVRLGANKFSERQPIGTAAQGSDDKDYKEPPPAPLFEPGELKSWSFYRAGIAEFMATFLFLYITVLTVMGVNNSTSKCATVGIQGIAWSFGGMIFALVYCTAGISGGHINPAVTFGLFLARKLSLTRALFYMVMQCLGAICGAGVVKGFQKGLYETTGGGANVVAPGYTKGDGLGAEIVGTFILVYTVFSATDAKRNARDSHVPILAPLPIGFAVFLVHLATIPITGTGINPARSLGAAIIYNRGHAWDDHWIFWVGPFIGAALAAIYHQVVIRAIPFKSRS

SEQ ID NO: 60309 - protein, 326 aa, Leuconostoc mesenteroides subsp. mesenteroides ATCC 8293
MPEPKLKLFSLSSNEPLAQKIADSVGVPLSRISVKRFADGEVQINIEESIRGDNVFVIQSTSAPVNDNLMELLIMIDALRRASANQINVVLPYYGYARQDRKARSREPITAKLVANMLERAGATRVLALDLHAAQIQGFFDIPMDHLQGAPLLADYLIESGIADKKNAVVVSPDHGGMTRARNLNNMLELESPVAVIDKRRPKPNVAEVGSIVGDVEGKTAIMIDDMIDTAGTITQGAQLVMEHGAKEVYVVASHAVFSGPAIERLQNSVFKKVILTDSINLPEDKKFEKLEIVSVGELIGEAITRISKNEAISSLFKNRFYRRGH

SEQ ID NO: 60310 - protein, 502 aa, Xylella fastidiosa Ann-1
MHNGFDALQLHANRLRGVTIPDLLAAELKRPEQYARQVGPLYFNFARQKYDCVALEALFALARNHNVTGAFQRMFCGEQVNVTEGRAVLHTALRGDLSGTSVAVAAYTAAAKVRERMYALIAGLDASEVTDIVSVGIGGSDLGPRLVVDALRPISQGRFRVHFVSNVDGAAMRRTLDMLDPSRTAGILISKTFGTQETLLNGRILYDWLGGSERLYAVSANPERAAHAFDIVSTQVLPIWDWVGGRYSLWSAVGFPIALAIGSQRFEELLAGAAEFDAYALRVPLEENVAVLHGLTAVWNRNFLGCATYAVMAYDQRLALLPAYLQQLVMESLGKRVKCDGTPVDRDTVPVWWGGVGTDVQHSFFQALHQGTNIVPADFIGTIRNDDLYTENHFALNANLLAQIEVLANGQLSDNPHRVYPGGNPSTLILLDALTPQALGGLIAMYEHSVYVQSVIWGINAFDQFGVELGKHLAVQLLPALKGESVEVADPVTRAVLLRLRG

SEQ ID NO: 60311 - protein, 331 aa, Flavobacteria bacterium BBFL7
MKQKVVTIGEVLMRLTVPDYKRLFQTVNFDVTFGGSEANVGVSLAHFGLDCTHITALPDHNLGERVERFLKLNGVSGEGIVRKEGRLGVYYLETGAMQRPSRIVYDRFDSTFVHLKEDEINWDVVFKDASWFHYSGITPAISQNAADITLRALKEARKRGVTTSGDINYRRNLWQYGKQPLDIMPGLVELTDVVIGGRVDLENCLGIQDEDWQANCDKVLQKYPHIKAFSKTVRNAMTASRNELSGLLYTNGTLYTSKNYDMKNIVDRIGGGDAFMAGLIYGFLNLEPQDTVEFGVAASVLKHSTIGDVNLSSKEEVEELVKGDNVGRLLR

SEQ ID NO: 60312 - protein, 166 aa, Oryza sativa
  misc_feature (107)..(107): Xaa can be any naturally occurring amino acid
MMSSRERKKAAALQEKLQILRSITHSHALSNTSILMDASKYIKELKQKVVRLNQEIACAQDALRQNRVTVETLRHGFLVNVFSGKSCPGLLVSILEAFDELGLSVLXEATASCTDTFRLEAIGSENLMEKVDEHVVKQAVLRAIRSCSGSGGDHHDDDDDDDEDDE

SEQ ID NO: 60313 - protein, 421 aa, Leuconostoc mesenteroides subsp. mesenteroides ATCC 8293
MTTEGKLTAEEIDEAHRVLSKVVTHTPLAYDDYLSKKYRANVYLKREDMQRVRSFKIRGAYYNIIKAEKEKLNNGVVAASAGNHAQGVADTCHNLKIQATIFMPVITPNQKVEAVKRFGGQYVTVILVGDTFDEAQSAAFEYTEKHNMFFVAPFDDRRTMAGQGTVAVEVFEDAVEQNINVDYLIASVGGGGLIGGLSTYSKKVSPQTTVVGVEPETAQSMKAAFQAQKPTTVENIDHFVDGAAVARVSQFTYNQAQQYVDKLLAIPEGKVAQAVLDLYTYEAIVAEPAGAMPIASLDFMASDIVGKNVVLVVSGGNNDIGRMQEMEQKALMYKGRQQFYLVEFPQRPGALRQFVNDVLGPNDDITRFEYTKKINSETGSVMVGILLDPVTKVDDLTARLAAFFPKYINLQENTVLFNMLV

SEQ ID NO: 60314 - protein, 144 aa, Oryza sativa Indica Group
MDALTRLHRALAGGDDDEEQPEDSILGDTEGICSLSPVQRVYGFAACLVAGLALMILSLVVFVRPIKFAVMFTFGNILAVGSTAFLIGPSQQLRMMLDPVRVYATAIYGGFVFLALIFALWIHSKVLTLIAIICEICALFWCSY

SEQ ID NO: 60315 - protein, 338 aa, Sordaria macrospora
MVVKVGINGFGRIGRIVFRNAIEHDDIQIVAVNDPFIEPKYAEYMLRYDSTHGNFKGTIAVEGSDLVVNGKKVKFYTERDPSAIPWSETGADYIVESTGVFTTTEKASAHLKGGAKKVIISAPSADAPMYVMGVNNESYDGSANVISNASCTTNCLAPLAKVIHDNFTIVEGLMTTVHSYTATQKTVDGPSSKDWRGGRTAAQNIIPSSTGAAKAVGKVIPDLNGKLTGMSMRVPTANVSVVDLTVRIEKGASYDEIKEVVKKASEGPLAGILAYTEDEVVSSDMNGNPASSIFDAKAGISLNKNFVKLVSWYDNEWGYSRRVLDLISYVAKVDASKA

SEQ ID NO: 60316 - protein, 1363 aa, Trichodesmium erythraeum IMS101
MAKFISDTESSAHGEEGNDLEPKDLSIDTDKTVDSDEGDDDSKEETSAEGNEPAPAVEESDTQEGEEGNNTDSGEDADETVDSDEGDDDSEEETSAEGNDPTLAAEESDTQEGEEGNDTDSGAGEDADETVDSDEGDDDSKEETSAEGNEPAPAVEESNTEEGEEGNNTGSGEDADETVNSDEGDDDSKEEMSADGNDPAPATEESDTQKGEGENERLIISGTEGNDRLLGVEVNEEIKGKAGDDKLFGGGGDDLVLGGEGKDFLRGDGGHDTLSGGEGDDIIDGGDGDDDIKGEAGDDKLFGGKGNDLVSGKEGNDLLRGDGGTDTLTGGEGDDIINGGADNDDIKGEAGDDKLFGGDGDDLVSGAEGNDLLKGDGGTDTLTGGEGDDIIAGGDGDDEIKGEADNDKLFAGDGDDLVSGGEGNDLLKGDGGTDTLTGGEGDDIIAGGDGDDDIKGEADNDKLFAGDGDDLVSGGEGNDLLTGDGGTDTLTGGEGDDIINGGADNDDIKGEAGDDKLFGGDGDDLVSGAEGNDLLKGDGGTDTLTGGEGDDIIAGGDGDDDIKGEADNDKLFAGDGDDLVSGGEGNDLLTGDGGTDTLTGGEGDDIINGGADNDDIKGEAGDDKLFGGDGDDLVSGAEGNDLLKGDGGTDTLTGGEGDDIIAGGDGDDDIKGEADNDKLFAGDGDDLVSGGEGNDLLTGDGGTDTLTGGEGDDIINGGADNDDIKGEAGDDKLFGGDGDDLVSGAEGNDLLKGDGGTDTLTGGEGNDIIAGGDGDDDIKGEADDDKLFGGKGNDLVSGGEGNDLLRGDGGNDTLSGGEGDDIIAGGEGNDEIKGETGNNQLFAGEGNDLVSSAEGNDLLRGDGGADTLTAGEGDDTIDGGADNDDIKGEAGDDKLFGGDGDDTVLGAEGNDLLRGDGGNDTLSGGEGDDIIAGGDGDDEIKGETGNNKLFAGEGNDLVSSAEGNDLLRGDGGADTLTAGEGDDTIDGGADNDDIKGEAGDDQLFGGDGDDIVLGAEGNDLLRGDGGNDTLTGGEGDDIIAGGEGNDEIKGETGNNQLFAGKGNDLVSSAEGNDLLRGDEGNDTLTAGGGDDKLFGGDGDDELTGEAGDDQLFAAEGNDLISGGEGNDLLKGEGGNDTLSGGEGDDTIFGCHGSDEIKGDAGDDLIISYSDAGEPDIAQDTDQPKVYSEQPFLEAHDTLTGGTGADTFEFKLLINAKDNIIQKHADPVTGKINWQGVAGENDNPHDHWVDAIGNDVILDFNKSEGDKIQILGHTVQVREIENLDDGNGSIIHLISNQGGNGGAHDQDELGTITVYGDLVEQSDLTVRAGVTFGVLHSIPISEINAEQIATPMSNSTHLGDCGCC

SEQ ID NO: 60317 - protein, 412 aa, Chlamydomonas reinhardtii
PTALMDIEHVPLGPGEQPLPLLQLPSLCLTRIMHLLPFQSCLLLSVVCRELRDLVQREILRGVRSLAFDNLPGTHVGEALAWTFRSSNAPHLPFLRSVSASGSAALQPLLAAAASQAAVLRQLTSLQLDCVKQLQETQLEAILTACPNLEVLSLPRCGRLGDAAAQAVGRLLPRLRVANCSDWSALGDGGVAALALGCSGLEDVALDGCLRELLLRQCPRVSLVGLLGRCRALTSLDLSGCPRVETSALRSMLAGCGGGLTSLQLNGCVGVGGEALVGLGAACPRLARLNLRGLTLQDCHLRDLSLSLAWCTKITDAGLAPLVERNPGLQDLDMEALYLCSDALLGRLAAAAPRLDRLCIRMCHRLSAAAIVDLVRATRMSALLVSGIMDEAGTLDLVARVKAARPGCTMHW

SEQ ID NO: 60318 - protein, 401 aa, Methanosarcina acetivorans C2A
MFFYRGVCLRPPCDPSKFVAEAVKSIPPSGIRRFFDLVSGLEDIISLGVGEPDFITPWHIREMCIHSLEKGQTSYTSNYGLPELRDELARTYYKRYGLDYDPASEILVTTGVSEALDIAVRAVVNPGEEVIVVQPSYVAYVPSVILAGGKPVIVSTSRDDDFSLTAEALKPAITSKTKAIILNFPNNPTGAIMEQEGMEDIADLVVENDLFVISDEVYECLTYGGTHVPFSSLEGLKDRTVMLNGFSKAYAMTGLRLGFAMGAPDIIHSMMMIHQYSMLCAPITAQVGAIEALRNGKEEMERMVREYDRRRRFIVKGFNSIGLECGNPKGAFYAFPYIGGTGLSSSDFAERLLEEKKVVTIPGDVFGEAGEGFLRCAYAASLDDIRKSIERMGDFVEELKQ

SEQ ID NO: 60319 - protein, 329 aa, Rhodopseudomonas palustris CGA009
MGSLNSIAVLGGGAWGTALAQTAARAGRKVTLWEHDAGNAEHLIAARESRFLPGVRLEPSIQVTRDLAEAARADALLLVVPAQVLRQVVTSLQPLIAPRTPLVACAKGIEHGTHRFMTEIIAEAAPAAIPAILSGPSFAADVARGLPTAVTIAATDAACAQALAQAMNSGSFRPYHSTDVRGVELGGATKNVLAIAAGIVEGRQLGASALAAMTTRGFVELVRFGKAYGARIETMHGLSGLGDLTMCCSTPQSRNFSFGMALGRGEGIESAAHGKLAEGYYTAPVLLEMAQAKDIDMPISTAVAAVLGGKLSVDAAIEGLLTRPLKAEE

SEQ ID NO: 60320 - protein, 470 aa, Alkalilimnicola ehrlichei MLHE-1
MVGGAVKEQHYDAVVIGSGPGGEGAALALSKSGRDVVVVESHGEVGGGCTHWGTIPSKALRHNVRRMMEYNTNPLFHDVAAPKRLSFPRVLKFAERVINRQVNLRAGYYSRNEIPVLHGRARFLDAHTVEVHGAEGKVLRLRAGHFLIATGSRPYRPEGVPFDHPRVCDSDKILSLDHTPRTIAIYGAGVIGCEYASIFRGLGVKVDLIDTRERLLTFLDNEISDALSYHLRELGVLIRHDEAFTQVVPRDDHVVVHLDSGKQIKVDILLWANGRSGNSEDMGLEALGIEPNSRGQIQVNDNYQTAQEHIYAVGDVIGYPSLASAAFDQGRFAASHMLCGQRDYRLVQDIPTGIYTIPEISSLGKTEQELTAAKVPYEVGHAFFKDLARAQIANQGVGMLKLLFHPETLEILGIHCFGDQAAEIVHIGQAIMAQTGEANTLMYFLNTTFNYPTMAEAYRVAALNGYNRLG

SEQ ID NO: 60321 - protein, 630 aa, Candida albicans SC5314
MLKVARLQIRFNSSTAASAAAVAAKTAEVRTRTVKTPVGIKAAIESLKPKATRLSMDGPVECALSGFSLLNSPQFNKGSAFSKEERESFDLTGLLPSQVNSLDEQVERAYRQFSYLKTPLAKNDFCTSMRLQNKVLYYELVRRHIREMLPIIYTPTEGDAIASYSDRFRKPEGCFLDINDPDGIDKRLSAYGEDKDIDYIVVSDGEGILGIGDQGVGAIRIAIAKLGLMTLCGGIHPARVLPIALDVGTNNDRLLNDELYMGNKFPRVRDEKYWDFVDKVIQAIKKRFPSSVLHYEDFGVSTGRDLLYKYREELPSFNDDIQGTGAVVMASITAALKFSKRDLKDIQVLVYGAGSAGLGIADQITNHLVSHGATEEQARARIHCMDRYGLITNESTNASPAQLKYADPASEWDGVDTKSLLACVNKIKPTVLVGCSTQPGAFTEEIVREMYKHNPQPIIFPLSNPTRLHEAVPSDLMKWTDNNALIATGSPFEPVDGYYISENNNCFTFPGIGLGAVLSRCTTISDTMISAAVDRLASMSPKMENPKNGLLPRLEEIDEVSAHVATAVILQSLKEGTARVESEEKPDGGFVEVPRDYEGCLKWVQSQMWKPVYRPYVKVEYVSEIHTYQY

SEQ ID NO: 60322 - protein, 562 aa, Alkalilimnicola ehrlichei MLHE-1
MGRNRETLQEAIWLRLRTSVSGWRSAGPRHLGVAMRFRNPHPSRRSPVMADNVVATSQPLAAQAGLQAMAEGGNAVDAALAAAITLTVVEPTGNGVGGDAFALVHDGRQLHGLNASGRAPAGWSPAFFAGRDGMPPVGWHSVTTPGAVSAWTALSRRFGALPFARLFQRAVALAESGFLVTPAVATLWAMGARQLERQPGFADTFLPGGRAPRTGERFRNPDLAATLQRIAETGGEAFYRGELARRIAAEARRHGAALTEADLDAHRPAWVCPLSLPYRGVEAHELPPNGQGIAALIALGILAHTEMPEVAPDSIPGLHLQIEAMKLALADTQAHVADPEAMTVEPAALLDPGYLAARAATIDRQAAGDPGYGVPRPGGTVYVTAADAQGRMVSYIQSNYLGFGSGVVIPGTGISLQNRGAGFTLQPGHPNRVGPRKRPFHTIIPGFLTTPDGGPLTSYGVMGGPMQAQGHVQVGVRLVDFDQDPQTACDAPRWRVLGGRRVAVEATLPARTLEGLSELGHELTVTAPEAAFGFGGAQVAQRLSGGYVAGSDPRKDGQAVGF

SEQ ID NO: 60323 - protein, 73 aa, Sonneratia alba
EAWNEQLQKSNDSKKLMVIDFTASWCGPCRVIAPILAEFARKMPNVMFLKVDVDEMRTVAEDWAVEAMPTFMF

SEQ ID NO: 60324 - protein, 121 aa, Zea mays
AIANSRRKTKIVCTIGPSTNTREMIWKLAETGMNVARLNMSHGDHQSHQKVIDLVKEYNAQNTDGNVIAIMLDTKGPEVRSGDVPEPLSSVVYTICVYKRGTSEATAGTLPGGHPYSHAVL

SEQ ID NO: 60325 - protein, 931 aa, Ostreococcus tauri
MALARGRGRAFASTPVTTRRGRARARVRASAARDVSPDRVAASATGAKTGKRVFRFGAGAADGARDAKGSLGGKGANLAEMSRVGLSVPPGFTVTTETCADYHENGSELPPGAWEEMVEGLGHIEQALDKKLGDAENPLLVSVRSGAAVSMPGMMDTVLNLGLNDACVEGLAKKAGGRFAFDSYRRFLDMYGNVVMGVDHHKFENALERMKKDVGAKSDEDLTEANLRDLVEIYKGVYASEGVAFPQDPYEQLKLATFAVFDSWNSDRAKKYMSINKITGLRGTAVNIQAMVFGNMGETSGTGVLFTRNPSTGENKLYGEYLVNAQGEDVVAGIRTPSDISTMAEALPQAYDQLVKNCELLESHYKDMQDIEFTVQEGTLYMLQCRSGKRTGAGAVKIAVDLVKDGFVTEEEAVQMVEPTHVDQLLHPQFKDEKAYKPDVIGSGLPASPGASVGQIVFTTEDAEVAKAEGRKVILVRVETSPEDVGGMDAAEGILTARGGMTSHAAVVARGWGKTCVSGCTDLTVDERGKTLTLGGVTLVENDWLSLNGTTGEIIRGRAELAPPSVTEDLGLFMSWVDKFRTMKVFTNADTPEDAAAARANGAEGIGLVRTEHMFFGSGERIRAVRRMIMAKDTPSRETALDELLPYQREDFKGIFVAMSGLPVTIRLLDPPLHEFLPDGELDDVISLLSEDTGEDEDSIVDRIEKLAEVNPMLGFRGCRLAITYPEIARMQVRAIFEAAIEAEKEGSTAIPDIMVPLVGTVAELEDQVALIRQTASVVFAEQGKTIDYRVGTMIEIPRAALLADQIAAHAEFFSFGTNDLTQMTFGYSRDDVGKFLPTYLEKGILKHDPFQVIDRDGVGQLIKMSVKNGRSARSDLKVGICGEHGGEPMSVEFFAQSGLDYVSCSPFRVPIARLSAAQAAIRAKKDVSPP

SEQ ID NO: 60326 - protein, 73 aa, Sonneratia caseolaris
EAWNEQLQKGNDSKKLVVIDFTASWCGPCRVIAPILAEFARKMPNVMFLKVDVDELKTVAEDWAVEAMPTFMF

SEQ ID NO: 60327 - protein, 228 aa, Gossypium pilosum
  misc_feature (152)..(152): Xaa can be any naturally occurring amino acid
FTSLCHTDVYFWEAKGQTPLFPRIFGHEAGGIVESVGEGVTHLKPGDHVLPVFTGECGNCRHCKSKESNMCDLLRINTDRGVMLSDGKTRFSINGKPIYHFVGTSTFSEYTVAHVGSVAKINPAAPLDKVCILSCGISTGLGATLNVAKPAXGSTVAIFGLGAVGLAAAEGARIAGASRIIGVDLNPNRFEEAKKFGCTEFVNPKDHNKPVQEVLAEMTNGGVDRSVE

SEQ ID NO: 60328 - protein, 548 aa, Oryza sativa Japonica Group
MSAAHLLRHSRKLRTLRDALDYDRSALVRYFSAASASFPTKGGAAAGVEKRIGGARFPQCKQPGKELETFKVSLGGLNGRYACRRAPNNCIPTTITGLNGSLSCGQVSSARSFSSSADLPPHQEIGMPSLSPTMTEGNIARWLKKEGDKVSPGEVLCEVETDKATVEMECMEEGYLAKIIHGDGAKEIKVGEIIAVTVEEEGDLEKFKDYKPSTSAAPAAPSEPKAQPEPAEPKVKETEPSRTPEPKAPKTEEASQPGGRIFSSPLARKLAEDNNVPLSSVMGTGPDGRILKADIEDYLASVAKGGKREALAAPGLSYTDVPNTQIRKVTANRLLSSKQTIPHYYLTVDARVDNLIKLRGELNPLQESSGGKKISINDLVIKAAALALRKVPQCNSSWMSDFIRQYHNVNINVAVQTEHGLFVPVIRDADKKGLGTIAEEVKQVAQRARDNSLKPEDYEGGTFTISNLGGPFGIKQFCAIINPPQSAILAIGTAEKRVIPGSVDGQYEFGSFMSATMSCDHRVIDGAIGAEFLKAFKGYIENPNSMLL

SEQ ID NO: 60329 - protein, 73 aa, Sonneratia ovata
EAWNEQLQKGNDSKKLVVIDFTASWCGPCRVIAPILAEFARKMPNVMFLKVDVDELRTVAEDWAVEAMPTFMF

SEQ ID NO: 60330 - protein, 228 aa, Gossypium pilosum
  misc_feature (95)..(95): Xaa can be any naturally occurring amino acid
FTSLCHTDVYFWEAKGQTPLFPRIFGHEAGGIVESVGEGVTHLKPGDHVLPVFTGECGNCRHCKSKESNMCDLLRINTDRGVMLSDGKTRFSINXKPIYHFVGTSTFSEYTVAHVGSVAKINPAAPLDKVCILSCGISTGLGATLNVAKPAKGSTVAIFGLGAVGLAAAEGARIAGASRIIGVDLNPNRFEEAKKFGCTEFVNPKDHNKPVQEVLAEMTNGGVDRSVE

SEQ ID NO: 60331 - protein, 548 aa, Phytophthora pistaciae
QAQELVGMLNTAKIPANVEVVVAPSQVHAATVKAALRPDVRVSGQDVWKQGNGAFTGETSAEMLKDLGAEYTLVGHSERREKGETNEVVAKKAAYALEKGLAVIACIGETKELREANQTVAFITEQLDAYAAEIKDWTNVVIAYEPIWAIGTGLTASPDQAQEVHASIRAWLKEKVSPEAAEKTRVIYGGSVGAKNAPELSQKADIDGFLVGGASLKPDFLQIINAQNPTDNVGGAVNVAINGFGRIGRLVLRAAAKNPLINIVAINDPFISTTYMEYMLEYDTVHGKFDGTLSHDEQHIFVDGKPIRVFNEMNPANIKWGEEQVQYVVESTGAFTTTEKASAHLQNGVEKVVISAPSSDAPMFVMGVNHELYEKNMHVVSNASCTTNCLAPLAKVVHDKFGIKEGLMTTVHAVTATQKTVDGPSKKDWRGGRGACFNIIPSSTGAAKAVGKVIPDLNGKLTGMSFRVPTADVSVVDLTARLVNPASYDEIKAAIKSASENEMQGILGYTEKAVVSSDFIGDSHSSIFDASAGIALTDHFVKLVSWYD

SEQ ID NO: 60332 - protein, 536 aa, Phytophthora palmivora
QAQELVGMLNTAKIPSNVEVVVAPSQVHAATVKASLRADVRVSGQDVWKQGNGAFTGETSAEMLKDLGAEYTLVGHSERREKGETNEIVAKKAAYALEKGLGVIACIGETKEHREANQTVAYITEQLDAYAAEIKDWTNVVIAYEPIWAIGTGLTASPEQAQEVHASIRAWLKEKVSPDAADKTRVIYGGSVGAKNAPELSQKEDIDGFLVGGASLKPDFLQIINAQNPTDNVGGAVNVAINGFGRIGRLVLRAAATNPLINIVAINDPFISTTYMEYMLEYDTVHGKFAGSLSHDEKHIIVNGKAIRVFNEMNPANINWSEEQVQYVVESTGAFTTTEKASAHLKNGVEKVVISAPSSDAPMFVMGVNHELYEKNMHVVSNASCTTNCLAPLAKVVNDKFGIKEGLMTTVHAVTATQKTVDGPSKKDWRGGRGACFNIIPSSTGAAKAVGKVIPSLNGKLTGMSFRVPTADVSVVDLTARLVNPASYEEIKAAIKSASENEMKGILGYTEKAVVSSDFIGDSHSSIFDAEAGIAL

SEQ ID NO: 60333 - protein, 439 aa, Pasteurella multocida subsp. multocida str. Pm70
MEVIMNSSIVKLPNKYELVKDTLVLILAGGRGSRLYELTDKRAKPALYFGGNRRIIDFALSNCLNSGLNRIGVVTQYAAHSLLRHLQNGWSFLPAERGEFIDMLPARQQIDDSTWYRGTADAVYQNMAIIRDHYCPKYILILAGDHIYKQDYSQMLLDHIHSGAKCTVGCIEVEREKATEFGVMAVNENLKVKSFVEKPKDPPAMVGKPNTSLASMGIYVFDADYLYDVLEREVSSPYTSHDFGKDILPKALEEGVLYAHPFSRSCMGRNTEGEIYWRDVGTLDSFWQSNIDLVCENPQLDIYDQSWPIRGNPVQTYPSKFFYKKENARPVDNSLISGGCVITDASISYSVLFDRIKINEGSQIDHCVVLPQVTIGKNCKLKRCIIDRHSVIPDGMEIGVDLELDRQRFRVSSGGVVLVTPSMLKKLNGEEVASEAHLD

SEQ ID NO: 60334 - protein, 578 aa, Physcomitrella patens subsp. patens
MEEIDLEIGPGYDDATHFDPGATQNLALIAVNDHGMKPTPRKKKKVVKRWRDEWAETYKWAHVAVHEGSHRIFCSVCKEYGRKHRRNPYGNEGSRNMQMSALEEHNNSLLHKEALRLQMASRDKGLGFIERPLYVKVAFIVAAILRRDPYEVEFIQSVQEVLHSLEPVLAKVPQYVHVLERLVEPERVVIFKVPWVDDKGEAHVNRGFRVQFNQALGPYKGGLRFHPTVNLSVVKFLAFEQTLKNSLSSLSLGGGKGGSDFNPKGKSENEIMRFCYSFMDELYRHIGPNQDTPSGDIGVGPREIGYLFGQYRRLTSQYEGMLGPKGIQWGLSNLHPEATGYGVVYFAKEVLANLEKDLKDLRCVVSGAGKVALYAVEKLIAFGAVPITISDTRGYLLDEDGFDRTKLGLIREIKAHNNSLGEYTKLYPRAKYFDDMKPWTVKCDIAFPCATQNELNHADAMSLINLGCQVIIEGANMPCTAEAIDVFRKSKVWFGPGKAANAGGVTIQGLEMAQNTSYVQWTAEEVDMRLQEVMRDIHQKIIKAAQDYGIGNPEALLHGANIASFLRVAQAMLEQGCV

SEQ ID NO: 60335 - protein, 421 aa, Ehrlichia canis str. Jake
MSPSITQFRNNFTIITDTMPHVESISINIWINVGSRYENTNITGISHFLEHMAFKGTKTRTALDIAQIFDDIGGNFNAHTDREHTVYHVKTLKRDIKIAIEVLADIILNSQFPQEEIDREKGVVLQEIYQTNDSPTSIIFDKYIEAAYPNQIFGKSILGTPESVTNLSKEDLQTYMSEYYHAGNMLLSVAGNITHEEVIDLVSQHFSNMKKSEPKTAAPSVYYSGEYREIRNLEQVHLVIGFPSVSYKDDLFYTIQILDSILGNGMSSRLFQKIREQLGLVYTISSFNSSYSDNGIFSIYAATDKNNLIQLLTTIASEVKSITMNLEENEITRAKGKLISEILMSRESTTARAESLGYYYSHYNRYILKEELIKKISEITLTDLQNCIHNLLGSNNKITLAAIGQIENLPSYGDIVQMFHT

SEQ ID NO: 60336 - protein, 368 aa, Symbiobacterium thermophilum IAM 14863
MAQPTYHIACLPGDGIGPEVTRGAVTVLQAAAAAYGFRLEFSEYLVGGAAYDAVGTPFPDETRDACDRADAILFGAVGGPRYEGLPWDLRPEAGLLAIRKRYDLYANLRPILLYPPLKDASPLKNEIIGGGVDFIIVRELVGGIYFGEPRGIETLPDGTRRGVNTEVYTDAEIARIARMGFEIARGRRRRLTSVDKGNVMEAGKLWRTVVDEVAREFPDVEVEHLLADNAAMQILRRPGDFDVMLASNLFGDFLSDEAAMLTGSIGLLPSASLGAARNRFGLPKGFYEPIHGSAPDIAGQDRANPLAAILCGAMLLRHSLGREDAARAVEQAVAAVLEEGLRTADITVPGTAVLGTAAMARAVADRVH

SEQ ID NO: 60337 - protein, 200 aa, Synechocystis sp. PCC 6803
MTEVLRVGQPAPDFTATAIVDQSFQTVKLSTYRGKYLVLFFYPLDFTFVCPTEIIAFSDRHSEFTALDTEVVGISVDSEFSHLAWIQTERKMGGIGNINYPLVSDLKKEISQAYNVLEPDAGIALRGLFIIDREGILQYATVNNLSFGRSVDETLRVLKAIRHVQSHPNEVCPVDWQEGDKTMIPDPEKAKTYFETVAEP

SEQ ID NO: 60338 - protein, 237 aa, Prochlorococcus marinus str. MIT 9312
MNSQTQMKQIVAEAAIEEVKSDMILGLGSGSTAVLMIKSLADAIRSGKLQNIKGVATSFQSEVLALELDIPLIDLASVSQIDLAIDGADEVDPGFQLIKGGGACHVREKLVASKANQLLIVVDETKLVRKLNQSFPLPVEVLPNAWKQVQEVISEMNGISTLRMATKKAGPVVTDQGNLILDVLFNDGIKNPKDIEKSINNIPGVLENGLFIDLTDKVLVGKIENNIPVAYSPAKVG

SEQ ID NO: 60339 - protein, 209 aa, Glycine max
MMASESQNWVFMVTAQTPTNIAVIKYWGKRDETLILPLNDSISVTLDPSHLCTITPAAGSPAFPPNPMWLNGKEISLFFSPPPQGEKGRSPLLLFILNQSTNDNKILTARGGPTQRTQFLSNPHLLTPSQRLPSHPRNTHHLSHPPLRFYAIARSPRTQPFRTLTTQAPCYPPPPTPPPHNSHLDTPSSHKPKDPTAPRLPSVHNSPTP

SEQ ID NO: 60340 - protein, 408 aa, Triticum aestivum
  misc_feature (202)..(202): Xaa can be any naturally occurring amino acid
MAMVTAKLSSPATARLAPVRSAQPARRASLVRVRASGGSYADELVSTAKTVASPGRGILAIDESSATCGKRLASIGLDNTEVNRQAYRQLLLTTAGLGEYISGAILFEETLYQSTTDGKTFVDVLKDQNIMPGIKVDKGLVPLPGSNNESWCQGLDGLASRCAEYYKQGARFAKNRPEFPGYRRPTRPGRCTVRKVADCGSXPCGPTALAVKEAAWGLARYAAIAQDNGLVPIVEPEILLDGDHGIERTLEVAEKVWSEVFFYLAENNVLFEGILLKPSMVTPGAEHKEKASPEAIAKNTLTMLRRRVPPAVPGIMFLSGGQSELEATMNLNAMNQSANPWHVSFSYARALQNSVLKTWQGQPENIEAAQKALLVRAKANSLAQLGSYTGEGESDEAKKGMFQKGYTY

SEQ ID NO: 60341 - protein, 574 aa, Alkalilimnicola ehrlichei MLHE-1
MDFTSQVIFFGSLLLLVSVMASVISNRIGAPLLLVFLVIGMLLGEEGLGGLYFDDFQTAHLIGSLALAVILFDGGLRTRTSSFRVGLRPAVVLATVGVVITAGLTGLVARYALGLGWLEAALIGAIVGSTDAAAVFSLLHSKGLELKQRVAATLEIESGSNDPMAIFLTVALIELLMGQHTSIGWGMALEFVQQMGLGALIGVLGGFLLAYTINGLSLTPGLYPLLALGGGLVVFGATGVAGGSGFLAVYLAGLIVGNRRIQAAQNIQRFNDGMAWLSQITMFVMLGVLVTPSELLPVAPKAAIVGVALILVARPLAVFTCLAPFRFPWREQLFIAWVGLRGAVPIILGIFPLVAGLAGAEQFFNVAFFVVLLSLVVQGWTIAPAARLLGLELPPDSGQTERVELDVPQQADYEFVSYRVKSDSPALFKPLHNLRLPDSAQVLTLFRQGAPVREEDGDILQPGDQVYLLSLPDDLPLLDRMFVAPAGPAYLEEQRFFGEFTLDGETRLGDLAAVYGFNLPPGVDPGQSLDEYLLHLFRGKAVVGDRVRLDHLQFTVREMEGNRILKVGLKLGRG

SEQ ID NO: 60342 - protein, 366 aa, Hyphomonas neptunium ATCC 15444
MKAAVMRAPKAPLSIEDVTISKPGPREVLVRLKAIGVCHSDVHFWDGAFPAELPVILGHESAGVVEQVGSMVSAVKPGDHVISILSPFCGTCEYCLTGHMSVCHTVNRELFQRDLTEAPRLSIGKEKVGQFLNLSSFAEQILVHENALCVVDKDMPMDRACLIGCGVITGVGSVFHSAQVEPGSTVAVLGCGGVGLAAINGAAIAGASRVIAVDLSDEKLQLAKRFGATDLVNPGKVNAIEAVKELTKGGVHYSFECVGLKQTAEQAYHMLRPRGVATIIGMIPPGVNIEIPGIELLVTEKRLQGAVMGSNRFRVDFPRLVELYKQGRLHLDDLISDRIGLDGITAAMQNLKDNKGTVARQVVVLD

SEQ ID NO: 60343 - protein, 141 aa, Andrographis paniculata
LRRGKPTNHKVYGEDVAVLAGDALLAFAFEHLATATEDVPTNMVVSAIGELSRCIGAEGLVAGQVVDICSEGISEVGLELLEFIHLHKTAALLEGSVVLGAILGGATESEVERLRKFARCIGLLFQVVDDILDVTKCSEEL

SEQ ID NO: 60344 - protein, 140 aa, Andrographis paniculata
LRRGRPTNHKVFGEDTAVLAGDALLSLAFNHVAEKTKNVEHCRVVRAIAELALAIGSEGLVAGQIVDLDSEGEKISLNELEYIHVHKTSMLLEAAAVCGGILGGGESTEVESLRKYARCIGLLFQVVDDILDVTKSSEQL

SEQ ID NO: 60345 - protein, 377 aa, Gibberella zeae PH-1
MSEAQVPIWLDCDPGHDDAFAILLAAYHPQMRLLGVSTVFGNASLENTTHNAASILTAIGMHDIPLYIGLGKALERPALHAPTDIHGVSGLDGTDLLPTPLVTPSTMPAVEAMATALRAQQPGTAWIVATGALTNVGALFRAYPELISHVKGVSLMGGSIGDNFSDAPLGEVDGRPRIGNYTPWAEFNILVDPEAAATVFHNKEIAAKTTIVPLDLSHQVLATPEVRDMLLYGPGAEKSGSGKTTLRTMLVELLYFFAQTYADTFGITAGPPLHDPIAVAAILIGTESEIPFFEWDAKHSQPPQHDERFEVTVVTEGTFEEATEGGKQTGRTIAKLLPPGEQGVRIPRGVDTAKFWQVIEECIERADAKNAALALAL

SEQ ID NO: 60346 - protein, 73 aa, Sonneratia apetala
EAWNEQLQKGNDSKKLVVIDFTASWCGPCRVIAPILAEFARKMPNVMFLKVDVDELTTVAEDWAVEAMPTFMF

SEQ ID NO: 60347 - protein, 638 aa, Cryptococcus neoformans var. neoformans B-3501A
MNRNCSSSTPTSSHSPQQSEHKRRWWDDLTFTKCKKMFLRHLHFVGPGLVSSVAYIDPGNWATDLEAGADYGYKLLFVVLLASLAAVVLQLLSVRLGTTTGLSLPAQTRLLFLRLKTRYPRYRIPLTIALWTLYALAEIAIIATDLAELLGSAIALHLLFPKLPLFAGVLITAVDVLVVLVFFRSSSGRQGMMFFEIIIVSLVLAVFISFMILLKLTSPVWRDVFLGLVPSETLVKPGALYLGVGIIGATVMPHALFLGSFLSGVDRLNMIPQPPSMRKPRNVTMPSFNPFRRTRSIRSDSEQGEGVSTGISPVLLQAPRPSSGSEAAVLENDGAKDEVHLQDSVVELTKEEKLFAIEQKEYERNVRMFDRIKWVDVHLFHSTIDTAISLLSFALTINASILTLAGAVYYYNESPPSEGADLFGAFDLIKSYISHAAAIVFALALLCAGQSASITATLAGQVVSEGFINWKTSPFLRRLITRLLGVIPSAVVASAVGTKGLNTMLVASQVLLSIVLPTVVFPLVYLCSKHEIMTVQGPEVESIEMERIANSGTSVSDPFALAATTPSLSPTTLGDDLAALGIESTTVRVEPDHSVDRPSRRSKSYVSPKWVTVLGYVLFVVIVLANVYVIVELCLGNG

SEQ ID NO: 60348 - protein, 367 aa, Alkalilimnicola ehrlichei MLHE-1
MSDEQTSPDDQAALQAVRARIDALDDEILRLISERARMAEEVARVKREAGHSNDFYRPEREAQVLRRVRQSNPGPLGEEAVTRLFREIMSACLAIQLPLQVAFLGPEGTYTQEAALKHFGHAMGTAPLSTIAAVFREVESGAAHYGVVPVENSTEGVVTHTVDRFLNSPLQIVGEVQLPIHHALASREQDWNAIRRIYSHQQGLAQCRAWVDTHLPGVERVPVTSTAEAARLAAAERGAAAIASEAACELYDLPVLATHIEDEPGNTTRFLVVGPESPPPSGDDKTSLVISRANQPGGLYRLLEPLARNGVNMTRIESRPAPQGVWEYVFFVDLLGHVEDEPVRQALAEIREQASLCRVLGSYPRAL

SEQ ID NO: 60349 - protein, 364 aa, Gibberella zeae PH-1
MPSHKFIESIEYHTLFPHYRLRTLISGATHFLLISNFSIYNLYSRLIHPLIFGSKVQVVAAGGIAGLVSRFVVAPLDVIKIRLQLQPHSLPSQVAALRNGPAYRGAFATLKHILKHEGLTGLWKGNVPAELLYVCYGAVQFTAYRSTTVFLRTAFPSRLPDSAESFIAGAASGAAATSVTYPLDLLRTRFAAQGQHRVYQSLRSAIWDIKRDEGWRGFFRGIGPGLAQIMPFMGIFFVTYESLRSSLEGLHMPWGSGDATAGMCASVISKTVVFPLDLVRKRIQVQGPARSQYVYGNIPEYSTARGAIKTILRTEGFRGLYKGLTISLLKSAPASAVTLWTYEQSLKVMLDWDSSSKETIPNDL

SEQ ID NO: 60350 - protein, 745 aa, Methanosarcina mazei Go1
MAPVETTERLGRSLGFFSTFAIGTGTMIGAGIFLLPGIAMANAGSGAIISFLLGGLITIATSISMAELATGMPLAGGSYYYISRTMGAAFGAVIGLGSWLALIFKGTFALIGLAEYAQIFHPMPIYLVAAVTGVLLLIINFRGAKSSGSLQNFIVVILLLILFVFIGKVSFEVRPENLLPVAPHGVVSIFTTAGMIFISYLGLAEAAAVAEEVKNPSKNLPRAFIASAVVVTLFYAGIMAVVAGFSGPEGGASTVTPLADIAGFIAGDSGKFFIAFSALLATLSTANGAILSSSRFPFAMSRDALMPKWFVSIHKKYETPHNAILVTGSVMVLLLFLFDIEQLARLGGAFNILIFILLNMAVIILRKRTLPGYEPTFRDPFFPFTQIFGVVGSMLLLPLLGGLPLLFSVLMIFAGAGWYMFYGKDKAMPAYNLFDLLENNVERVSAEPEPVGRVLVPVSNPGHERDLLKLADLLGNEIICLHVVEVPSQISLTVGQELYHEKQIEIDSRFRDYFEQYPAKFGNKRDYIVAFDHTISNSIIEQAEIENADIIIMGWHDSKRFKYSFGDVTNDVLLSSKSQIALLKGHLPDSIKKVLVAYNGRENSVHGLSLAKKIAENTGASIRIISIVSPDEDPEKKAKIAEELEGLVKKIPSTPASFKLLERYSIEDAILEVSNGYDLTIIGDSSERFKISLLGTLSQRIARHARKPVMIVKKSKPISKESLNYLLKKYARKAYAKFRKEKGRD

SEQ ID NO: 60351 - protein, 220 aa, Aspergillus fumigatus
MDEEYTSSAEADREMTRLWRTWRTVFEMLADRPRSTRLTHFLQPYSRTKMKISARPTAAMQAKYTPLPTPANPDPQPDCGTIYVEFCADSTGVGTKQVRAFNHFVDENNFHTGVFITQTPISPSAVRLLSGIPGRICEHFQEQDLLVNITRHELVPKHVLLSPEEKKNLLQRYRLKESQLPRIQVSDPVARYLGLRRGQVVKIIRKSETAGRYASYRWVI

SEQ ID NO: 60352 - protein, 545 aa, Glycine max
MATSLSVSPSLSLNTLFFAKALPLSRPSLLSLPLPKSLLSLSTRRRTFAVRAESQNGRDAAPAHYDFDRFTIGAGSGGVRARRFAANYGASVAICELPFSTISSETTGGVGGTCVIRGCVPKKLLVYASKFSHEFEESNGFGWRYDSEPKHDWSSLIANKNAELQRLTGIYKNILNNAGVKLIEGHGKIIDPHTVDVNGKLYSAKHILVTVGGRPFIPDIPGNEYAIDSDAALDLPTKPEKIAIVGGGYIALEFAGIFNGLKSEVHVFIRQKKVLRGFDEEIRDFVSEQMSVRGIEFHTEESPQAITKSADGSFSLKTNKGTVDGFSHIMFATGRRPNTQNLGLESVGVKIAKDGAIEVDEYSQTSVPSIWAVGDVTNRINLTPVALMEGGALVKTLFQDNPTKPDYRAVPSAVFSQPPIGQVGLTEEQAVQQYGDIDIFTANFRPLKATLSGLPDRVFMKLVVCAKTNEVLGLHMCGDDAPEIVQGFAVALKARLTKADFDATVGIHPSAAEEFVTMRTPTRKIRKSESSEGKSGSEAKTAAGV

SEQ ID NO: 60353 - protein, 844 aa, Oryza sativa
MSHLAFGEKKTLDDVWPVNNRRFFIRTDFERMIEHGTQQPPHVLLTTILRVLQGGGKAIIGCSFGVNKNAVDMKLTPTQRQQALRAFPRHLSTEPLAQLLRKILPETCTVDFAPDCLAAMDQVKKLQRGCVLVLENLRFYKAELSERAEERAEMAAVLERYTDVFVNDVFATLHLRAAATVELPKLLRHGVCGSLMAQEVTYFSQVLTNPQRPLTLVIGSVHIEEKMRLLEALIRKVDKVPISCAVAIPFLQVKGISVGKLSPNICDTAGHIIWEDPSTSPQDFARKIMRLAERYNVKIVLPEDFVCNRTIEPTRFPTVTPTNRVPADLYIVDIGPKTIQRFTAEISDSHTVFWTGRMGCADKADYTNGTTAIAIAVGHSNCVTVVGGKNTVQAVRTAGVEDSINHMTTGPNSMLRVLEGTPLAALNALSDAHPPVASDINVTAPQLLRCCPLFRDLTPQQMRAIVAKAVPRCHAMGDVLAHEGDKISSMFVVARGFLHSAPKSQQGKSIASRIIGVGESTGEFSFLNGKTSTSVVQAGSDDTLTFQITASSLEEAFSESAELTLQVLKCAVEPVRVQHLRSVQERWSEWYLLNATLRSTRKPNPWGNLGGLAEVVASAAPALLLHHVLDRQYTPFKLEAGTCFFARFASGTFMMVAHNVFREICFQNIASAFDEWTPVLATVAATVLATPLRLAATGLPFPAMTRSDLIGTALTSAALSAAPAAAHAPFLFRKSAAEANAWRHRRVLDPLSELFIAVACRVAVSIAALPLVAHRFKSDVTVRSSVAYVLRQVLALLIETAVLKVWRAIAQRRAEARSAKPIAPPETPLALMHQSRVTGDKGIW

SEQ ID NO: 60354 - protein, 74 aa, Physcomitrella patens subsp. patens
VSIDEVEAEEVDTAAEFPCPHCHEEMDASALCAHLEDEHPFTSRAAATCPVCAAKVVKDLVGHISTQHGHYLKI

SEQ ID NO: 60355 - protein, 83 aa, Zea mays
  misc_feature (73)..(73): Xaa can be any naturally occurring amino acid
MSPTESAAAAPGAAAESKPRRLRGYKKGAVTCCVASSARPGGVAASGEDGCPRWPDLRTKDVPSEQGRTTQAXIASICFKPGK

SEQ ID NO: 60356 - protein, 78 aa, Physcomitrella patens subsp. patens
MAPDEEKMTRRSPLDFPIEWDRPRPGRRADIFPQFSPMKTPLPPPLPADPPEEDEEEEEKKEEEEENPDEPEKPDVSF

SEQ ID NO: 60357 - protein, 242 aa, Synechocystis sp. PCC 6803
MRKIIIAGNWKMHKTQAEAQAFLQGFKPLIEDAAESREVVLCVPFTDLSGMSQQLHGGRVRLGAQNVHWEASGAYTGEISAAMLTEIGIHYVVIGHSERRQYFGETDETANLRVLAAQKAGLIPILCVGESKAQRDAGETEQVIVDQVKKGLVNVDQSNLVIAYEPIWAIGTGDTCAATEANRVIGLIREQLTNSQVTIQYGGSVNANNVDEIMAQPEIDGALVGGASLEPQSFARIVNFQP

SEQ ID NO: 60358 - protein, 522 aa, Phytophthora inflata
  misc_feature (434)..(434): Xaa can be any naturally occurring amino acid
  misc_feature (478)..(478): Xaa can be any naturally occurring amino acid
EVVVAPSQVHAATVKASLRSDVRVSGQDVWKQGNGAFTGETSAEMLKDLGAEYTLVGHSERREKGETNEVVAKKAAYALEKGLGVIACIGETKELREANKTVEYITEQLDAYAAEIKDWTNVVIAYEPIWAIGTGLTASPEQAQEVHASIRAWLKEKVSPEAAEKTRVIYGGSVGAKNAPELSQKEDIDGFLVGGASLKPDFLQIINAQNPTDNVGGAVNVAINGFGRIGRLVLRAAATNPLINIVAINDPFISTTYMEYMLEYDTVHGKFAGSLSHDEKHIFVNGKPIRVFHEMNPANIKWGEEQVQYVVESTGAFTTTEKASAHLQNGVEKVVISAPSSDAPMFVMGVNHELYEKNMHVVSNASCTTNCLAPLAKVVNDKFGIKEGLMTTVHAVTATQKTVDGPSKKDWRGGRGACFNIIPSSTGAAKAVGXVIPSLNGKLTGMSFRVPTADVSVVDLTARLVNPASYDEIKAAIXSASENEMKGILGYTEKAVVSSDFIGDSHSSIFDASAGIALTDDF

SEQ ID NO: 60359 - protein, 157 aa, Physcomitrella patens subsp. patens
MAEKRVKLISSDNDEFEVDEAVAFESETLRNMIQDTGTNVPISIPNVSSDILAKVLEYCSYHAETMETHDDKPPITDAQIREWDADFVDVHPATLYSLILAANYLNIKNLLDLICQAVANNIRGKTAVEIRKILHIQDDFTYEEEMEIRRETKWAFD

SEQ ID NO: 60360 - protein, 105 aa, Prochlorococcus marinus str. MIT 9312
MLSIKLEQSVSNNSAVIEKKPAELKNKSPKYRVLLHNDPVNSMEYVTISLREVVPQLSEQDAIAIMLEAHNTGVGLVIVCDLEPAEFYSESLKSKGISSSIEKED

SEQ ID NO: 60361 - protein, 439 aa, Physcomitrella patens subsp. patens
MQIGHGSFKLWSNRGYIRKFRSSLWIEGDAIGVKECSFSTWEGIGCIAYVLYFRARIQKDRLPALQDFNSLWIVRIILIALAILWSLVELLRLPLLRRPNWLFHSLSFRWQANLCRFHILSSLGFLEPCFFLTALFLVHGSLRKAPFTPRKSWNGKVVALILMCCLPVFLFQLFFVVISPRIEFKEGTGYILENEGYGGKVPYYFTQAFEKVIMDAKEVAMCRYPLWSTLVLAGFGILYSAYFLLLGWRMVGVVINRYLQRRLYGLLGALLLLLPLHVMFLGLSVLSKPTHLPFELLSFFGFIMVLLCSTIGEGILVIRPIADALAVTWVMYTPSESGRDSDVPGEGAVSVSMSVFGSDDDEVSLFGNPRLFPKGQPRAADIQDNEHSSARSFGRPLDHIGNFNNHNETSFFNPDSPALPGKPLISHHQPRNPAFYPFL

SEQ ID NO: 60362 - protein, 408 aa, Prochlorococcus marinus str. MIT 9312
MVQVNENYLKLKAGYLFPEIAKRVKIYSQSNKSAEIIKLGIGDVTEPLPRACIDAMSKALDDMGTAEGFRGYGPEQGYSWLREKISEHDFISRGCQILPEEIFVSDGSKCDSSNILDILGKDNSIAVTDPVYPVYVDSNVMTGRTGDALENGTYQGLTYLAINEGNNFLPELPQKKVDILYLCFPNNPTGATITKEELKKWVDYALQNKSLILFDAAYEAFIQDNDIPHSIYEIEGAKDCAIEFRSFSKNAGFTGVRCAFTVIPKNLKGLSSTNEEIDLWPLWNRRQSTKFNGVSYVVQRGAEAVYSLEGKKEVRGLIDFYMENAKIMKNKLQTAGYKVYGGDNAPYIWIKVPDQMTSWNFFDFLLQNVSVVGTPGSGFGLSGEGYFRLSAFNSRSNVLDAMERIINI

SEQ ID NO: 60363 - protein, 75 aa, Oryza sativa
  misc_feature (15)..(15): Xaa can be any naturally occurring amino acid
  misc_feature (48)..(48): Xaa can be any naturally occurring amino acid
QFLYTRLASLPGPYXAFWKEFYGVHQVWKNRKGLKVEALGIVPIFGVXLYAWFCVGEIVGKGFPITGFKVWEGFF

SEQ ID NO: 60364 - protein, 807 aa, Wolinella succinogenes DSM 1740
MKYIKFFKELNNKDVPIVGGKNASIGEMFQELVPMGIKVPNGFAITSDAYWYLLDSAGIRDKIRSLLEDIDVTEIDVLKVRSKKIRDLIFGTPLPADLREEILEAYALLSQEYHMEQADVAVRSSATAEDLPDASFAGQQDTYLSVQGHQELIHYVKSCFASLFTDRAVSYRASRGFDHFKVALSVGVQKMVRSDKGSSGVMFSIDTETGFKDAVFITSSWGLGENVVGGTVNPDEFYVFKPTLAEGKRPIIKRQLGHKHLKMVYAAPGSEHPTKNIPTTEEEFNTFSVSDEEILTLARYATIIEKHYSQEAGEYRPMDMEWAKDGVSGELYIVQARPETVQSQRMKKGGSKLEKYRFLNEETKKEVIITGKAIGGKIGHGKVRVIESIVNMSDIREGEILVTDNTDPDWEPAMKKAAAVITNRGGRTCHAAIVAREIGVPAIVGAIGSTERLETGMEVTVSCAEGEEGFVYAGIHEYEVEVIDLSNLEQPKTKIYMNVGNPEKAFGFAQIPNNGVGLARMEFIINNYIKAHPLALVDLQNGKKDVQDIEQIRSIMAGYENPKDFFTKKIAEGVGMIASAFYPDPVIVRTSDFKSNEYRRMIGGAAYEPHEENPMIGYRGASRYYSEQYRPAFEWECQALASVRSEMGLTNMKVMIPFLRSPEEGKKVLEIMRRNGLVSGENGLEIYVMCELPVNVILADEFLQMFDGFSIGSNDLTQLALGVDRDGELVSHVFDERNPALLKLFAQAIAAAKKAGKYCGICGQAPSDYPEIAEFLVKEGISSISLNPDSVIGTWERVVKLEKELGR

SEQ ID NO: 60365 - protein, 595 aa, Gibberella zeae PH-1
MYFGLQTGWVSIMSMPASLMGFGIFKLLAPHLRFPFSPVENVLLQSVACGMAIMPLGCGFVGVIPALNYLLAADEQGPINLSTWQLIVWSLGLCYFGVVFAVPLRKQVIIRERLKFPSGFSTAVLISVLHGGGRQSTKDELDAAAKGSFASLVPKEEPSQPAAIGPATTDQEHQQDLDNDLASKGDWAANIKLLLLCFGGSGLYTVATYFFPILRNLPVFGSTAAHMWLWTFNPSFAYIGQGIIMGTETTLHMLLGAIVGWGILSPIAKYRGWAPGDVDDWEHGSKGWIIWISLAIMLADAIVSLAYVGFRGVFTSPKVTNIIFSLRQRVYEHGISGLWKPQSHVYSPLLPADTADRTEPRGGEDEDEDEDAPPHQRIGGRMVAIGLLVSIALCVFTIHVVFGDLVPLYATTIAVLMALVLSIMGVRALGETDLNPVSGISKLAQLFFAIIIPQTHKSSVLINLIAGAVSEAGALQAGDLMQDLKTGHLLGAAPKAQFWGQVIGATAGAILSAFIYRIYTNVYTIPGDLFQVPTAYVWIFTARLVTGSGLPYRAKEWAIGAAVLFAFATVIRTLAIGKKWRPMIPGGIAVAVGYR

SEQ ID NO: 60366 - protein, 289 aa, Vibrio vulnificus YJ016
MGFLWYTPRRFYLFFNIRWENRMHPMLNIAIRAARKAGNHIAKSLENVEKIESTLKGTNDFVTNVDKEAETIIIDTIKSSYPEHCIVAEENGLINGKDKDVQWIIDPLDGTTNFVKGLPHFAVSIAVRIKGKTEVACVYDPMLNELFTAQRGAGAQLNNARIRVKQPKDLQGAIIATGFPFKQKQHSESYFKIMSAMFVEVADFRRAGSAALDLCYVAAGRVDGYFELGLKPWDIAAGELIAREAGAIITDFAGGTEYIKSGNVVASSARGVKSLLKHIRENGNEAILK

SEQ ID NO: 60367 - protein, 571 aa, Cryptococcus neoformans var. neoformans B-3501A
MSFHPQNEPASPVSEQTRRTDANPVPESLSPSSTLTLSSAATPAPVPVPAAAATPFSHAHPAFPALPQLGKLPTTPQEIHQILSLPANQFTAKALPLLAKVADGKPFEGASLKAWERRNAGEQLLALYEAGDEVYETADERVKEIGGGLIYVLSARITLGQGNAVVWSDKMLNFAIRLCELADPAQLRICHQRVAAFAWGLLRLSQQLSKVKLVIPAITSLIQKLNYHQTFSPIFGALLEACLVTRQFDHPSLGLVLDIIFLDVKTTAPTYLDILTYYHHAGAVTMAVGDFCKAKEYYLTAVTVPTTTASAIQLACAKRALLCELIVTGKKIVWPKYTPTPVTRIIEKYATSYNELAKEFEAHNWANVRRAHTVAEFEKDCNSGLIEQVVNSIHRHMILRLRKTYMRLTVDSLARRLRVGDDMPKAERVVAILDDMIKSGEVSAILTPSATQPQSHSQAIIEFITATESFTSPAALGRLERASAVAALLQEHLAEGSRRLGASKEYLVKQAQYLESNSKKNKGDEFDQLMEAEETMEPGAGSGKMMGSSGGGGSKSGSLRGVASNMADIGF

SEQ ID NO: 60368 - protein, 299 aa, Mycoplasma penetrans HF-2
MKKRVTKAVIPAAGMGTRFLPATKAMPKEMLPILDKPTIQFIVEEAVASGIEDILIIVSQYKNSIMDHFDYFFELEERLKQKNKVEDYKLVRNISDMAHIHYIRQKEPMGLGHAINMAKRFIGNEPFAILLGDDVIVQNNQSDKPALKQCIELFEEKNVSIVGVQEVEHKEVSKYGIIDPLEQVDLKTQSMRVKNMIEKPDPSISPSNYAILGRYVLTPSIFKELEETQVSPRGEIEITGSLLNLAQKEGVYAKVFTGKRYDIGSKIGYLKATLDISLSKPDVRDELLEYMKLLVETNK

SEQ ID NO: 60369 - protein, 724 aa, Gibberella zeae PH-1
MPATSSLEEQAIDREYPQQQRQHHRRHQELEPEPRQFSFRSPNRNEAVPQSQLDNQQDTGSLSYSQQHYRPQNSSLSHTQSNSRLVVPSVSGVRSTSPAPSVSPLPTPSISPSASVVSIDASYSSRDPSSPIQTPSSTSAEAHDSHPQRDSSEHNSSERGSTDSYSYLRRERNSSNMATWSGQPAIRGNSEAVRMILLCFVTIGITFTWGIEMTYCTPYLLNLGLTKSNTSLVWIAGPLSGLVVQPVVGVIADESKSKWGRRRPLMVVGSIIVAISLLILGFTREIIGYFITDEEAAKRPTIVLAVLAIYVVDFAINAGMIRFLMSCSKSLIVDTLPIEKQQSGAAWSSRMSSIGHMIAYGAGAVDLISIFGKTLGDTQFKQLTVISTVALLSSTALTCWAVTERVLLTSKPAKHEGRFKVFRQIWSTLLNLPPRIQAICWAQFWAWIGWFPFLFYSTTWVGETYFRYDVPADARKSEDTLGAIGRIGSTALVMYSVITFAGAWVLPMLVQSPEDNTFTHRPPQAIAGLLTSFNKLKPDLLTAWVFGHLMFAASMALAPFATSFRFATVLVCLCGIPWTLAMWAPSAFLGVEVNKMSGETGADGTYRRISDEPDIELSEVSHNDAPLHLDHGSEVDLPSTASTGELSGIYFGILNIYTTLPQFVGTFISTIVFAILEPGKSPELADDAKKQPDPDGPNAIAVCLFIGAMSSVVAAYVTRKLKVM

SEQ ID NO: 60370 - protein, 494 aa, Aspergillus fumigatus
MASRRLAFNFNQALRSRAALKAVQPVKRGFASPVALPSTTQSTTLSNGFTVRKLIKIHLNGFAIPLIDDRLPLNTPHGLRHPLLASGSTPAAEQRLTRPTEPHISLSTLLSRTQHQLELEIENMGAHLNAYTSRENTVYYAKSFNNDVPKAVDILADILQNSKLEPAAIERERDVILREQEEVDKQLEEVVFDHLHATAFQNQPLGRTILGPKENIQTISRENLTDYIKTNYTADRMVLVGAGGIPHEQLVKLAEQHFGSLPSKPPTSAALALTAEQKRTPEFIGSEIRIRDDTLPSAHIAVAVEGVSWKDDDYFTALVAQAIVGNWDRAMGNSPYLGSRLSSFVNHHNLANSFMSFSTSYSDTGLWGIYMVSENLTRLNDLVHFALREWSRLCYNVSAAEVERAKAQLKASILLSLDGTTAVAEDIGRQIITTGRRLSPEDVERIIGRITEKDVMDFANRKIWDQDIAISAVGSIEGILDYQRIRSDMSRNSL

SEQ ID NO: 60371 - protein, 168 aa, Physcomitrella patens subsp. patens
MPVLGLVGSKRSGVLCAATKEGKEKEQDTKDIDAETVTKKYGLEAGLWKIFSSKDKENSPEQGTKTNQAKELLKRYGGAYLVTSISLSIVSFSLCYVLVQAGVDVTSLLDKVGIHANDTGEKVGTFALAYAAHKALSPVRFPPTVALTPIVAGWFGKKPEDDNDKTCS

SEQ ID NO: 60372 - protein, 244 aa, Brassica juncea
DETIREKCIEELKKAAMDWGVMHLINHGIPVELMERVKKSGEEFFGLPVEEKEKYANDQASGKIQGYGSKLANNAGGQLEWEDYFFHLVYPEDKRDLSLWPKTPTDYIEATSEYAKCLRLLATKVFKALSIALGLEPDRLENEVGGLEELLLQMKINYYPKCPQPELALGVEAHTDVSALTFILHNMVPGLQLFYEGKWIIAKCVPDSIVMHIGDTLEILSNGRFKSILHRGLVNEEKVRISWA

SEQ ID NO: 60373 - protein, 489 aa, Burkholderia pseudomallei K96243
MTTAHETLALKDPALLRERAFVAGEWQAADGGATLEVRNPATGALIGTVPAMGAAETRRAIDAANAAWPAWRKKTAKERAAILRKWHDLMIAHADDLALILTTEQGKPLVEAKGEIGYAASFLEWFAEEGKRVYGDTIPTPAADKRIVVTKEPVGVCAAITPWNFPAAMITRKVGPALAAGCPIVVKPAEATPFSALAMAVLAERAGVPAGVFSVVTGEPKAIGGELTSNPIVRKLSFTGSTPVGRLLMAQCAATVKKVSLELGGNAPFIVFDDADLDAAVEGAIASKYRNSGQTCVCTNRFYVHEKVYDAFAEKLTAAVAKLKVGPGTEAGVVQGPLINGAAVRKVEAHIADALDKGARVTTGGQRHPLGHGFFEPTVLTGVTPDMKVAKEETFGPLAPLFRFSTEEEAIRYANDTEFGLAAYFYSRDIGRVWRVAEALEYGMVGINAGIISNEVAPFGGVKQSGLGREGSHYGIDDYVVIKYMCVAV

SEQ ID NO: 60374 - protein, 364 aa, Nicotiana tabacum
MAFQIARRLLRSRASSSIRYLDRSFSSESNSNLIRATLFPGDGIGPEIADSVRQIFKTAEVPIEWEEHYVGKEIDPRTNSFLTWESLESVRRNKVGLKGPMATPIGKGHRSLNLTLRKELNLYANVRPCYSLPGYKTRYDDVNLITIRENTEGEYSGVEHQVVRGVVESLKIITRQASLRVAEYAFHYAKAHGRERVSAIHKANIMQKTDGLFLKCCREVAEKYPEIKYEEVVIDNCCMMLVKNPALFDILVMPNLYGDIISDLCAGVIGGLGLTPSCNIGEGGIALAEAVHGSAPDIAGKNLANPTALLLSAVTMLRHLELHDKADRIQGAVLNTIAEGKYRTGDLGGTSSTTDFTNAICDHL

SEQ ID NO: 60375 - protein, 547 aa, Phytophthora primulae
QELVGMLNTAKIPANVEVVVAPSQVHAATVKSALRADVRVSGQDVWQQGNGAFTGETSAEMLKDLGAEYTLVGHSERREKGETNEVVAKKAAYALEKGLAVIACIGESKETREANKTVAYITEQLDAYAAEIKDWTNVVIAYEPIWAIGTGLTASPEQAQDVHASIRAWLKEKVSSDAAEKTRVIYGGSVGAKNAPELSQKEDIDGFLVGGASLKPDFLHIINAQNPTENVGGPVNVAINGFGRIGRLVLRAAAKNPLINIVAINDPFISTTYMEYMLEYDTVHGTFDGSLSHDEKHIFVNGKPIRVFNEMNPANIKWGEEHVQYVVESTGAFTTLEKASTHLQNGVEKVVISAPSSDAPMFVMGVNQELYEKNMHVVSNASCTTNCLAPLAKVVNDKFGIKEGLMTTVHAVTATQKTVDGPSNKDWRGGRGACFNIIPSSTGAAKAVGKVIPSLNGKLTGMSFRVPTADVSVVDLTARLVNPASYDEIKAAIKDASENEMKGILGYTEKAVVSSDFIGDSRSSIFDASAGIALTDDFVKLVSWYDN

SEQ ID NO: 60376 - protein, 510 aa, Nicotiana tabacum
MAASWCIEKRGSLRLDSFRENDNIPETGCLSIIVLGASGDLAKKKTFPALFNLYRQGFLQSNEVHIFGYARTKISDDDLRSRIRGYLSKGKEYEEVSEFLQLIKYVSGSYDSGEGFSLLDKAIAEHEFAKNSTEGSSRRLFYFALPPSVYPSVCRMIKNYCMNKSDLGGWTRIVVEKPFGKDLASAEQLSSQIGELFNEPQIYRIDHYLGKELVQNVLVLRFANRFFLPLWNRDNIDNIQIVFREDFGTEGRGGYFDEYGIIRDIIQNQLLQVLCLVAMEKPVSQKPEHVRDEKVKVLQSMLPIKDEEVVLEQYEGYKDDPTVPGNSNTPTFATMVLRIHNERWEGVPFIMKAGKALNSRKAEIRVQFKDVPGDIFRCKKQGRNEFVIRLQPSEAMYMKLTVKKPGLEMSTVQSELDLSYGQRYQGVVIPEAYERLILDTIRGDQQHFVRRDELKAAWEIFTPLLHRIDDGEIKPIPYKPGSRGPAEADELLQNVGYVQTHGYIWIPPTL

SEQ ID NO: 60377 - protein, 275 aa, Zea mays
  misc_feature (268)..(268): Xaa can be any naturally occurring amino acid
MIRHSLAFHQFPMKKILSRTFATATAQKVTLIPGDGVGHELAESVKAIFKASNAPVEWEQFNLSGHDSSNDDLMKETLASLRRNKVGLKGILYTPVSRLGHASFNVSMRKDLDIYASISLVKNIPGVTSRFNNVDLAIVRENTEGEYSGLEHQSHPGVVESLKIVTRRKTERIARFAFDFALKNHRKKVTCVHKANIMKLGDGLFLRTVKDIYEKEYSQTDILLNDMIVDNASMQLVSRPQQFDVVVLPNLYGNILSNVGAGPDGGPXLIPGSSI

SEQ ID NO: 60378 - protein, 535 aa, Phytophthora capsici
  misc_feature (180)..(180): Xaa can be any naturally occurring amino acid
QELVGMLNTAKIPANVEVVVAPSQVHAATVKASLRSDVRVSGQDVWKQGNGAFTGETSAEMLKDLGAEYTLVGHSERREKGETNEVVAKKAAYALEKGLGVIACIGETKELREANQTVAYITEQLDAYAAEIKDWTNVVIAYEPIWAIGTGLTASPEQAQEVHASIRAWLKEKVSSDAAXKTRVIYGGSVGAKNAPELSQKEDIDGFLVGGASLKPDFLQIINAQNPTDNVGGAVNVAINGFGRIGRLVLRAAATNPLINIVAINDPFISTTYMEYMLEYDTVHGKFAGSLSHDEQHIFVNGKPIRVFNEMNPANIKWGEEQVQYVVESTGAFTTTEKASAHLQNGVEKVVISAPSSDAPMFVMGVNHELYEKNMHVVSNASCTTNCLAPLAKVVNDKFGIKEGLMTTVHAVTATQKTVDGPSKKDWRGGRGACFNIIPSSTGAAKAVGKVIPSLNGKLTGMSFRVPTADVSVVDLTARLVNPASYDEIKAAIKSASENEMKGILGYTEKAVVSSDFIGDSRSSIFDAEAGIALT

SEQ ID NO: 60379 - protein, 281 aa, Prochlorococcus marinus str. MIT 9312
MSKQVAYLGPQGTYAEKAAHILSKLANFQTPIFVPCNGLHSVIKSLAYKNCDAAVVPIENSVEGGVTATLDALWKFPDIFINKAIVLPIKHALISDGELSKISEVLSHPQALAQCSEWLSENLPNAIPLPTNSTSEAVNMVKGSQFRAAIGSKSLIQIEGLKELAFPINDVPGNCTRFVLLSKESNSNSPNLASFAFSLISNKPGALLKAINYIADFGFNMSKIESRPSKRELGEYIIYVDLEINNQNNIENFLELKNHLKPLCNNFVDFGNYFSENIELD

SEQ ID NO: 60380 - protein, 535 aa, Phytophthora capsici
QELVGMLNTAKIPANVEVVVAPSQVHAATVKASLRSDVRVSGQDVWKQGNGAFTGETSAEMLKDLGAEYTLVGHSERREKGETNEVVAKKAAYALEKGLGVIACIGETKELREANQTVAYITEQLDAYAAEIKDWTNVVIAYEPIWAIGTGLTASPEQAQEVHASIRAWLKEKVSSDAAEKTRVIYGGSVGAKNAPELSQKEDIDGFLVGGASLKPDFLQIINAQNPTDNVGGAVNVAINGFGRIGRLVLRAAATNPLINIVAINDPFISTTYMEYMLEYDTVHGKFAGSLSHDEQHIFVNGKPIRVFNEMNPANIKWGEEQVQYVVESTGAFTTTEKASAHLQNGVEKVVISAPSSDAPMFVMGVNHELYEKNMHVVSNASCTTNCLAPLAKVVNDKFGIKEGLMTTVHAVTATQKTVDGPSKKDWRGGRGACFNIIPSSTGAAKAVGKVIPSLNGKLTGMSFRVPTADVSVVDLTARLVNPASYDEIKAAIKSASENEMKGILGYTEKAVVSSDFIGDSHSSIFDASAGIALT

SEQ ID NO: 60381 - protein, 98 aa, Zea mays
MAAAGGGAGGKVSFKIILTSDPKLPFKVFSVPEAAPFTAVLKYAAEEFKVPPQTSAIITNDGIGINPQQSAGNVFLKHGSELRLIPRDRVGAVVMSSG

SEQ ID NO: 60382 - protein, 345 aa, Fulvimarina pelagi HTCC2506
MGRSAAPARHQPGGLRRKTMMATLSPDSLGPTICVGEILVEIMATTIGDGFREPIDLIGPFPSGAPAIFISQCARIGGMAAMIGAVGEDDFGRINTERLADDGADISAIAVDLDYPTGSAFVRYRSDGSRDFVYNIATSAAARFGWIGNVEALVSRAGHLHVMGSGLSMQSAVDVIERALPIIRERGGSLSVDPNLRKEITYDADTKKRFRNLIATADLLLPSGEELELAAGIEGEDAAIERLFEMGVKEIALKRGSAGATVFRPGAEPVSAAAFEVEEIDPTGAGDCFGGAYVASRRLGLSVEEALTYANAAGARNVTRRGPMEGAGTREELDRFIAETPRLGG

SEQ ID NO: 60383 - protein, 199 aa, Physcomitrella patens subsp. patens
MARNTTPQQFHLQTGSRVTLSGLLNFTDGLWSCCGSERIIIFTTNHVEKLDKALLRAGRMDRHILMSWCEYPAFRTLAANNLGLEWHDLFPEIENAIAGKAISPADVSELLLKKKRNPTAALEGLLEVLGKAPLSEEKPVMKIDLDELQLTEAIAIDDDAADEPTSSADSSAVESRIEPSHANGEPTPASAATEDPKTE

SEQ ID NO: 60384 - protein, 806 aa, Physcomitrella patens subsp. patens
MAMDDDHRMDVENALLGPYQKDSKTFSSLKNKPFWLVQTALRVDKRVYYLLALFTVLSLFYIGSRSSPIILFVFIVCTGSLAYAVYLASWVLAKDEGPPEMSEISDAIRDGAEGFFRTQYGSISRMAGVLAFVIFGIYMFRKSTPEQDAAGLEKSTLAFITVLSFLLGALCSGIAGYIGMWVSVRANVRVSSAARRSAREALLVAVRAGGFSALIVIGMTVMGVAVLFASFYVFLGVDTVNNMKMTELPLLLVGYGFGASFVALFAQLGGGIYTKAADVGADLVGKVEQGIPEDDARNPAVIADLVGDNVGDCAARGADLFESIAAEIISAMILGGTMAKRCKLEDPSGFILFPLVVHSFDLVVSAIGIASIKGTRDPSSKSILEDPMIILQKGYSVTLFLAVLAFGGSTRWLLYTEQAPSAWFHFALCGLVGIITAYAFVWISQYYTDYKYDPVRQVALASTTGHGTNVIAGVGLGLESTAMPVLVISVSVVITYWLGKTSGLQDSRGMPTGGLFGTAVATMGMLSTAGYVLTMDMFGPIADNAGGIVEMSQQPQNVREITDLLDAVGNTTKATTKGFAIGSAALASFLLFSAYMDEVSSFSGVPFTTVDIAIPEVFVGGLLGSMLIYLFSAWACAAVGRTAQEVVSEVRRQFAERPGIMTYQEKPDYARCVSIVAAASLREMIKPGALAVISPIAIGILFRLVGQATNQPLLGAKAVAGMLMFATVSGILMALFLNTAGGAWDNAKKYIESGAYGGKGSDAHKAAVTGDTVGDPFKDTAGPSLHVLIKMLATITLVMAPLFLDN

SEQ ID NO: 60385 - protein, 194 aa, Physcomitrella patens subsp. patens
MARNTTPQQFHLQTGSRVTLSGLLNFTDGLWSCCGSERIIIFTTNHVEKLDKALLRAGRMDRHILMSWCEYPAFRTLAANNLGLEWHDLFPEIENAIAGKAISPADVSELLLKKKRNPTAALEGLLEVLGKAPLSEEKPVMKIDLDELQLTEAIAIDDDAADEPTSSADSSAVESRIEPSHANGEPKTDGGTEN

SEQ ID NO: 60386 - protein, 327 aa, Triticum aestivum
MLLCHRILPRLLSLPSSATSKLLIRPSRLPPRRPFLPRCAVLSQLAAPQTVDHADAEESADHLDAEEPQEPQEPQEVLVKLPLDRLFLPPGASVTPGDEEVVTARVLKGSNIVLGTYARGDAQVVNADFIKSSVRPDDCPRDGLPEFALVGRSNVGKSSLLNSLVRRKRLALTSKKPGKTQCINHFKINDSWYLVDLPGYGYASAPQVARKDWDEFTRNYFLSRDNLVSVFLLIDASIPAKKIDLDYASWLGQNKVPMTLVFTKCDKRKKKKNGGKRPEENVECFQSLIREYFEAAPPWIMTSSVTNQGRDEILLHMSQLRNYWRKH

SEQ ID NO: 60387 - protein, 305 aa, Mycoplasma penetrans HF-2
MREKILITNWKMNADYVSISKFFKNIPNFENVKVMVAPSYLGIVPSLGMSKNAKVEVVAQNVSFPSLGNHTGSVSWLELKDYGIKTAFLGHPDVKVDFKEKNYQVNAKLQKLLKNGMNAVLFIEETKVDLSEESTKENLRLQINQIFNGIDALDIVDRVYIVYKPTFMGEINSKFDNEFIFGTIRVIREFLRTKFGYYVANNLPILYGGEIINDDIEEICKNNDVDGILIEDERALSNKYISILYKHLFNGSTYAYKQHYDHKVALDIPTEEERIKNATQVSDFDMYDITSETYFDDIKINEENM

SEQ ID NO: 60388 - protein, 107 aa, Zea mays
  misc_feature (84)..(84): Xaa can be any naturally occurring amino acid
MFRWRGLVFYLYTITVMFCGVFQDILCAGIPRVSKLKSIVRYMFHNPDDVKWFKPIEWWTKHGRRGRIKETVGTHGAMKCLFNXQHDAVCMSLYKHAYLKWPEQLYH

SEQ ID NO: 60389 - protein, 219 aa, Rhodopseudomonas palustris CGA009
MSAAANLAAVEAEIASACKDARRERSEVTLIAVSKTFEAEAIRPVLSAGQRVFGENRVQEAKGKWPVLVDEYPGTELHLIGPLQSNKAKDAIALFDAIHSVDRDSLCEALSKVLPQAGRKVELFVQINTGEEPQKAGIAPQDADAFLVACRERWGLTISGLMCIPPVDEAPAPHFALSAKIAKRNGLVKLSMGMSADFATAIQFGATHVRVGSAIFGHR

SEQ ID NO: 60390 - protein, 428 aa, Photobacterium profundum SS9
MQKTTSKIDLEFDQQHVWHPYTSTINPLPCYPVESANGVYLTLEDGRKLIDGMSSWWSTIHGYNHPALNQAAKDQIDKMSHVMFGGITHEPAVELCRKLIAITPEPLQHVFLADSGSVAVEVSLKMALQYWHAKGQRRPKFLTVRHGYHGDTFAAMSVTDPDNSMHSLYKGFLPEHIFAESSERGFYEEWCESDIADFKEKLNNNKEQLAAVIIEPIVQGAGGMRIYHPMYLKRIRELCDEHDVLLIADEIATGFGRTGKMFACEHAGISPDIMCVGKALTGGYMTLSATLATKHVADTVCSGEAACFMHGPTFMGNPLACAVGNASLEILMQGNWQQQVLSIEQQLSELLPEIGQLDCVKAVRWLGAIGVVELYEPVNMAEIQKSFVDAGVWIRPFGKLIYIMPPFIITPQELSCLTVAILRTLKTQ

SEQ ID NO: 60391 - protein, 276 aa, Arabidopsis thaliana
MEILPIPAESFKVGFIGAGKMAESIARGVVASGVLPPNRICTAVHSNLNRRDVFESFGVNVFSTSEEVVKESDVVIFSVKPQVVKKAVTELKSKLSKNKILVSVAAGIKLNDLQEWSGQDRFIRVMPNTPAAVGEAASVMSLGTGATEEDGAIVAMLFGAVGKILKADEKMFDAVTGLSGSGPAYIFLAIEALADGGVAAGLPRELALSLASQTVLGAATMVSKTGKHPGVLKDDVTSPGGTTIAGVHELEKGSFRATLMNAVVAAAKRSRELSQS

SEQ ID NO: 60392 - protein, 813 aa, Oryza sativa Indica Group
MACSFLCKPWLPLTESAKPARSPAPSSRARTVVQQLAVLLLLLGGVGGGGGALLAAAASTTDTILPGESITGNQTLVSKNGEFELGFFNPGVGIHYFLGVRLRKLAAYSPTFWIGDRVYVVDLPRAALELFGDSLYIKEDGASLWWSSPSSSSSSSGGGRGGGAAVAILLDTGDLVVRDQRNSSLVLWRSFDYPGDALLPGGRLGLDVATGENVSLTFEGFTHNGSLRADASRRNGFVLTTDGRDTRGAFPDWMVTTQDNGGSLVLNHPDATNSTEFLQLKVGQVSLVRWSGADAGWVPRWTFPSGCKSGGGFFCGDFGVCTTATGGECRCVDGFAPSDTKEWGLGYFVTGCSRSLPLSCDANGQTEHGDSFAILDNLQGLPYNAQDEPATTDEDCREACLNKCYCVAYSTETGCKLWYYDLYNLSSADKPPYSKIYVRLGSKLKSKRGLATRWMVLLVVGSVAVASAMLAVLLLCRYRRDLFGSSKFVVEGSLVVYSYAQIKKATENFSDKLGEGGFGSVFRGTLPGSTTVVAVKNLKGLGYAEKQFRAEVQTVGMIRHTNLVRLLGFCVKGNRKLLVYEYMPNGSLDAHIFSQKSSPLSWQVRYQIAIGIARGLAYLHEECEHCIIHCDIKPENILLDEEFRPKIADFGMAKLLGREFNAALTTIRGTRGYLAPEWLYGQPITKKADVYSFGIVLFEMISGIRSTVTMKFGSHRYYPSYAAAQMHEGDVLCLLDSRLEGNANVEELDITCRVACWCIQDREGDRPSMGHVVRMLEGVVDTEMPPIPASFQNLVDGDDSDIYEENWRLRTQD

SEQ ID NO: 60393 - protein, 204 aa, Ostreococcus tauri
MATMTFHPEHRSSSVRTRASSASTSPTSADAIERAKNALLAAIEGTERGILASDEEKRKIDDLARALEALNPNPKSLSASCINGEWELVYTTSASILGTNKPSFLRPSGKIYQTIDADALRARNRETFPFYNAVEAELTPTSDSAVKVQFKKFYVLNGLIKVTAPDRARGALDITFVDDTVRVSRGDKGNLFILVMHDKMKRLS

SEQ ID NO: 60394 - protein, 178 aa, Sonneratia ovata
LSSATMAVNRTAPAQASMAAPFTGLKSSSAFPTTRKTADITSLASNGGRVQCMQVWPPEGLKKFETLSYLPDLTREQLIKEIEYLIRNGWFPCLEFSCPAFAYPYRENHRSPGYYDGRYWTMWKLPMFGCTDPIQVIKELDEGIKAYPTYFFRIAGFSARRQVQCISFIAYKPPLLSM

SEQ ID NO: 60395 - protein, 511 aa, Nicotiana tabacum
MAASWCIEKRGSIRLDSFRDNDNIPETGCLSIIVLGASGDLAKKKTFPALFNLYRQGFLQSNEVHIFGYARTKISDDDLRGRIRGYLSQGKENEEEVSEFLQLIKYVSGSYDSGEGFSLLDKAIAEHEIAKNSTEGSSRRLFYFALPPSVYPSVCRMIKNYCMNKSDLGGWTRIVVEKPFGKDLASAEQLSSQIGELFDEPQIYRIDHYLGKELVQNLLVLRFANRFFLPLWNRDNIDNIQIVFREDFGTEGRCGYFDEYGIIRDIIQNQLLQVLCLVAMEKPVSQKPEHIRDEKVKVLQSMLPIKDEEVVLGQYEGYKDDPTVPDNSNTPTFATMVLRIHNERWEGVPFIMKAGKALNSRKAEIRVQFKDVPGDIFRCKKQGRNEFVIRLQPSEAMYMKLTVKKPGLEMSTVQSELDLSYRQRYQGVVIPEAYERLILDTIRGDQQHFVRRDELKAAWEIFTPLLHRIDDGEVKPIPYKPGSRGPAEADELLQNVGYVQTHGYICIPPTL

SEQ ID NO: 60396 - protein, 308 aa, Frankia sp. EAN1pec
MQNTIDLTGRLAVVTGASSGLGLGLATRLAAAGAKVLLPVRDEAKGEAALSHIRAEAPGADVSLRELDLASLKSVEALGDTLNAEGRPIHILINNAGLMTPATRHTTADGLELQFGTNHIGHFALTGWLLPLLNAGHARVTTMTSSAARHAKLNWEDLQSDQAYAPIRAYNQSKLANLLFALELDRRSRAGGWGIVSNAAHPGTTLTGLYAAGPNLGREKSSPIEAAMKRLARWGVLVQGVDRGLLPALYAATSPDAEGGHFYGPDGFGQFTGGPAELEIYRPARDEDAATRLWDVSQRLAGVEFAAV

SEQ ID NO: 60397 - protein, 533 aa, Phytophthora pseudotsugae
ELVGMLNTAKIPANVEVVVAPSQVHAATVKAALRSDVRVSGQDVWKQGNGAFTGETSAEMLKDLGAEYTLVGHSERREKGETNEIVAKKAAYALEKGLAVIACIGETKELREANQTVAYITEQLDAYAAEINDWTNVVIAYEPIWAIGTGLTASPEQAQEVHASIRTWLKEKVSPEAADKTRVIYGGSVGAKNAPELSQKEDIDGFLVGGASLKPDFLHIINAQNPTTNVGGAVNVAINGFGRIGRLVLRAAAKNPLINIVAINDPFITTTYMEYMLEYDTVHGKFDGSLSHDEKHIFVNGKPIRVFNEMNPANITWGEEQVQYVVESTGAFTTLEKASAHLKNGVEKVVISAPSSDAPMFVMGVNHELYEKNMHVVSNASCTTNCLAPLAKVVNDKFGIKEGLMTTVHAVTATQKTVDGPSKKDWRGGRGACFNIIPSSTGAAKAVGKVIPSLNGKLTGMSFRVPTADVSVVDLTARLVNPASYDEIKAAIKSASENEMKGILGYTEEAVVSSDFIGDSHSSIFDAEAGIAL

SEQ ID NO: 60398 - protein, 396 aa, Phytophthora erythroseptica
AYITEQLDAYAAEIKDWTNVVIAYEPIWAIGTGLTASPEQAQDVHANIRAWLKEKVSPEAAEKTRVIYGGSVGAKNAPELSQKEDIDGFLVGGASLKPDFLQIINAQNPTENVGGAVNVAINGFGRIGRLVLRAAAKNPLINIVAINDPFISTTYMEYMLEYDTVHGKFDGALSHDEQHIFVDDKPIRVFNEMNPSNIKWGEEQVQYVVESTGAFTTLEKASTHLQNGVEKVVISAPSSDAPMFVMGVNHELYEKNMHVVSNASCTTNCLAPLAKVVNDKFGIKEGLMTTVHAVTATQKTVDGPSKKDWRGGRGACFNIIPSSTGAAKAVGKVIPSLNGKLTGMSFRVPTADVSVVDLTARLVNPASYDEIKAAIKSASENEMKGILGYTEKAVVS

SEQ ID NO: 60399 - protein, 574 aa, Prochlorococcus marinus str. AS9601
MKETSPKSNNGTILDINESFKIEFDPISDALAAIRNGECIIVVDDERRENEGDLICAAQFATPQQINFMATEGRGLICLAMQGEKLDSLDLPLMVDRNTDENQTAFTISIDAGPENNVTTGISAEDRAKTIQVAINPKTKPDDLRRPGHIFPLRAKKGGVLKRAGHTEAAVDIAAMSGLYPAGVICEIQNPDGSMSRLPQLKEYAKQWGMKLISIADLISYRFQTERFVFRKSDAVLPSIFGNFKAYGYVNELDGSEHVALVKQKSFKLSEPVLVRMHSECLTGDAFGSLRCDCRPQLEAALSRIEKEEEGVVVYLRQEGRGIGLINKLKAYSLQDGGLDTVEANEKLGFPADLRNYGVGAQILTDLGIKKLKLLTNNPRKIAGLGGYGIEVIERVPLVICPNDNNAEYLSVKKTKLGHMIDEDNSNSRNIDPFISIFLDGKYKSIDLVPIKNNVIKFCSDKKINIKLESTPRLLAFWNRPKLVWRILHDKNRTNSNITNEEIKNIELFIQFLSNYENSTKIGIIVSRNIEQALHPKSSIKLINTKFSINNEILYSSTRKFNLDKETFSIVFES

SEQ ID NO: 60400 - protein, 545 aa, Phytophthora undulata
  misc_feature (66)..(66): Xaa can be any naturally occurring amino acid
DLVGLLNTAKIPKNVEVVVAPSAIHASEVSKNLRGDVRVSGQDVWVQGNGAFTGETSAEMLKDIGXQYTLVGHSERREKGESNELVAKKAAYALEKGLSVIACIGETKDQREAKKTLEVVTEQLDAYAKHIKDWTNVVIAYEPVWAIGTGLTASPEQAQEVHASIRKWLASKVSANAADSTRVIYGGSVTADSAPELSQKNDIDGFLVGGASLKPDFLKIINCHDQSGRVGGPVNVAINGFGRIGRMVLRAAQSNPLINIVAINDPFIPTHYMEYMLKYDTVHGVFNGSVSHDEENLYVNGKPIKVFSERDPKDIKWGQAAAQYVVEATGAFTTTEKASAHLANGVEKVVISAPSADAPMFVIGVNEEGYKKDMNIVSNASCTTNCLAPLAKVVHDQFGITEGLMTTVHAVTATQLTVDGPSKKDWRGGRGACFNIIPSSTGAAKAVGKVIPSLNGKLTGMSFRVPTANVSVVDLTVRLNKKASYDDIKAAVKDASENDFKGILGYTEEMVVSSDFIGDSRSSIFDAGAGIALTDDFVKLVSWYD

SEQ ID NO: 60401 - protein, 385 aa, Magnaporthe grisea 70-15
MASEQTFRATTTAPVNIAVVKYWGKRDPKLNLPTNSSLSVTLAQSDLRTLTTATCSSDRPAAQGDSLILNGEESDVSGARTQACFRELRARRRVLEDADSSLPKLSTFALKIVTENNFPTAAGLASSAAGFAALVRAIADLYQLPDSPAELSKIARQGSGSACRSLFGGYVAWREGTAADGSDSLAEQVAPASHWPEMRAIVLVASAMKKGVSSTSGMQQTVATSTLFKQRIAEVVPANMKTMEEAIQNRDFASFAEVTMRDSNSFHATCADTYPPIFYMNDTSRAAIRAVEAINAAAGRTIAAYTFDAGPNAVVYFLEQDAKVVVGSFAKIVGSVDGWKEGAKDFAAQGVEIDEAVAGLLKNGISRVIMTSVGEGPVKSDQHLA

SEQ ID NO: 60402 - protein, 546 aa, Phytophthora cryptogea
QELVGMLNTARIPADVEVVVAPSQVHAATVKASLRADVRVSGQDVWKQGNGAFTGETSAEMLKDLGAEYTLVGHSERREKGESNEIVAKKAAYALEKGLAVIACIGESKETREANETVAYITEQLDAYAAEIKDWTNVVIAYEPIWAIGTGLTASPEQAQDVHASIRAWLKEKVSPEAAEKTRVIYGGSVGAKNAPELSQKEDIDGFLVGGASLKPDFLQIINAQNPTENVGGAVNVAINGFGRIGRLVLRAAAKNPLINIVAINDPFISTTYMEYMLEYDTVHGKFDGTLSHDEQHIFVNGKPIRVFNEMNPSNIKWGEEQVQYVVESTGAFTTLEKASTHLQNGVEKVVISAPSSDAPMFVMGVNHELYEKNMHVVSNASCTTNCLAPLAKVVNDKFGIKEGLMTTVHAVTATQKTVDGPSKKDWRGGRGACFNIIPSSTGAAKAVGKVIPSLNGKLTGMSFRVPTADVSVVDLTARLVNPASYDEIKAAIKSASENEMKGILGYTEKAVVSSDFIGDSHSSIFDASAGIALTDDFVKLVSWYD

SEQ ID NO: 60403 - protein, 527 aa, Prochlorococcus marinus str. AS9601
MNGDLNSWDKFCNYLWFDKKLNIWLDISKINFTSKEIKNLEDKFKDVFSSIKELENGAISNIDENRQVGHYWLRNPSISPSSKIGEEIRADINSISEFGKQILNGDIKNKNNQQYTDVLWIGIGGSGLGPLLITESLQKCSKGLNFSYIDNVDPFLISEKLEELSEKLSTTLFVVVSKSGGTPEPRIAMEIIKSHCENNSLEWNSNAIAITMKGSKLFKKATSENWLKIFNLQDWVGGRTSITSSVGLLPLALINENISEFIRGASLMDETTRIRDFKNNPAALLSSAWYLTGDGIGKRDMVVLPYRDRLQVFSKYLQQLVMESLGKKFNRNGQVVNQGISVFGNKGSTDQHAYVQQLRDGIDNFFCIFIELLDSPSTNIFDEKENPKEYLSGFLQGTRSALSSENRQSITITLEKLNCFSLGALIALFERAVSFYAELVNINAYDQPGVEAGKKAAANIIEYQQKVSHLLDEGGEYSINDITSLFDNSVSEPIFFILREMCFGNDNYLVKGDWSNPNSLVIQKINS

SEQ ID NO: 60404 - protein, 428 aa, Phytophthora cinnamomi
AYITEQLDAYAAEIKDWTNVVIAYEPIWAIGTGLTASPEQAQDVHASIRAWLKEKVSPEAADKTRVIYGGSVGAKNAPELSQKADIDGFLVGGASLKPDFLQIINAQNPHANVGGAVNVAINGFGRIGRLVLRAAAKNPLINIVAINDPFISTTYMEYMLEYDTVHGKFDGTLSHDEQHIFVBGKPIRVFNEMNPANIKWGEEQVQYVVESTGAFTTTEKASAHLQNGVEKVVISAPSSDAPMFVMGVNHELYEKDMHVVSNASCTTNCLAPLAKVVHDKFGIKEGLMTTVHAVTATQKTVDGPSKKDWRGGRGACFNIIPSSTGAAKAVGKVIPDLNGKLTGMSFRVPTADVSVVDLTARLVNPASYDEIKAAIKSASENEMKGILGYTEKAVVSSDFVGDSHSSIFDASAGIALTDDFVKLVSWYD

SEQ ID NO: 60405 - protein, 192 aa, Arabidopsis thaliana
MTEQEICVRVTRAAAKRKASTAMGIDGDRVNKKRVVLGELLNVSNVNLLANLNQKKETQKPKRNLKPPPAKQIKSAPVAIIDLESKSDIDSRSDDPQMCGPYVADIYEYLRQLEVKPKQRPLPDYIEKVQKDVTPSMRGVLVDWLVEVAEEYKLGSETLYLTVSHIDRFLSLKTVNKQKLQLVGVSAMLIAS

SEQ ID NO: 60406 - protein, 598 aa, Xanthomonas oryzae pv. oryzae KACC10331
MSEQATTPPCIIVVFGARGDLTKRLVMPALYNLRRAGALGEQFAIVGMDHGDISERAWRSNMGQSMTQLLSSRDAEFQAGEFDTAPWDLLRERMHYLCGDFTDLGAYQALGGLLDKLHKRYGTQGNVLFYLATAARFFEPVLLNLGEAGLVKQRENDGWRRVIVEKPFGHDLPSAKHLNATVAKVLHEDQVFRIDHFLGKETVQNILAFRFANGLFEPVWNRDRIDHVQITAAETIGVEGRGRFYDPTGCLRDMVPNHLFQLLAMIAMEPPAAFTTEAMHRRRAEVIEAVRPIKPEDVVRGQYASGAVSRSAVPGYREEDTVPEDSETETYVAMKLQVDTWRWAGVPFYLRTGKRLRERTTEIAIRFKPAPLAPFRSTEVGGYGPDWLVLHIQPDEGISLQFDVKRPGAQVALAPVRMDFRYRDWFPKEYTVGYERLLQDCMNGEAGLFQDAAMVEGAWRIVQPILDAWKQPPSDFPNYAAGSAGPSAADALLAMNGGHAWRALTPGRKPPPRRPPETRAGAATPVKKAVKKAANKPSKVPAKRTTSAAAAASNVAQTAPKRVAKTGATPAKAVGKPAAGRSGAKKSVRKSTAPKSRS

SEQ ID NO: 60407 - protein, 605 aa, Xanthomonas oryzae pv. oryzae KACC10331
MHSGGLELALVLMLAAIVAVPVFKRFGLGAVLAYLVAGVVLGPDGVGVVQDAERISGAAEIGVVMLLFVIGLELSPALLKVMRHSVFGAGATQVLVTAVILGGLLMAARLGWKSALIVGVALALSSTAVGLQLLAERKALNSDYGRLAFAILLFQDLIAIPLLASIPLLGGSKNDALEWQDVAKAIAALALVIVCGRFVLRHLFNVVARTRMPEVFTASALLVVLGTAWIMQEAGLGASLGAFIAGVLLADSEFRHELESQIEPFEGLLLGLFFISVGMGIDLHRVVAEPWVIAAGVAILLVVKFSLLVGIGSVAKLPLRSSLMLGSVLWLGGEFAFVVFNEADRVGLLEPANHDRLVAIVGVSMALTPLLLLGMQRILNRPLRVRVPKTDRPFDTIDAQTPKVLVAGMGRFGQVVARLLTSRHVPFVALEHNPHTVEDLRRFGSQLYYGDPTRPELLRAAGADRIKVFVIAVDDPESNIKTVRLIRRLYPQATVLARARNRQHAWKLMDLGAEPFREVFASSLELSERVLTSLGLGEALAHDHVKRFRQHDEDLLRRQHLVYDDEAKVIQTSRDARADLMNLFEADVKADVDGDDQTVAATREK

SEQ ID NO: 60408 - protein, 123 aa, Zea mays
MESTFIMIKPDGVQRGLIGEIISRFEKKGFYLKALKLVNVERSFAEKHYADLASKPFFQGLVDYINPLASEPGTIRGDFAVDIGRNVIHGSDSIESANKEIVLWFPEGPADWQSSQHPWIYEK

SEQ ID NO: 60409 - protein, 552 aa, Polaromonas sp. JS666
MPDIATILFQTLDNPVMDFNFSNPYTSTRIPLFARNVVSTSHPLGAQAGLRMLLKGGNAVDAAIAAAAAMAIVEPVSNGLGSDSFCILWDGKDMHGLNASGRAPQSWTPEYFKRKYGDSATTPPKRGMDSVSVPGAVASWVALSERFGKLPFADLMEPAIEIAERGYLLSPVVQQKWAAATAELQSQPGFAGAFLPWGRAPKVGELFQFKAAAKALRAIAQTRGAAYYGGEIAHAIEKFSAQNGGSITAKDFEAYQPEWIQPITKDYRGYTLHEIPPNGQGIAALIALGILDKFDVAGLPVDGVDSQHLQIEAMKLAFADVYRYVAEPSSMEVTAAQMLDDAYLASRAKLIDMKKAQDFGAGNPVKGGTIYLTAADEDGMMVSFIQSNYMGFGSGCVEPEFGISLQNRGHGFSVQAGVNQVAPGKRPFHTIIPAFLSKDGQPVMSFGVMGANMQPQGHLQTLVRMLDYRQSPQVACDAPRWRYNEGLEINVEAAMNPATVQGLAGRGHRMEVINDSYQDFGAGQFIWRAGNPKVEGYVSASDARRDGQAVGF

SEQ ID NO: 60410 - protein, 303 aa, Campylobacter coli RM2228
MRHFLTLRDFSKYEILSLVEHASELKKNPKKLLQDKTLAMIFEKNSTRTRMAFELAITELGGKALFLSSNDLQLSRGESIKDTARVIGAMVDFVMMRVNKHESLVEFAKYSKAPVINALSELYHPTQVLGDLLTIKECGKMKDDIAKVAFVGDSNNMCNSWLIAAAILGFDFSVALPKNYEINSEILEFAKEKAKISGAKIFLTHDKFEAIKGKDVVITDTWVSMGEESEKEKKIKDFDGFIIDEEAMNAANQDAILLHCLPAYRGYEVSEESFEKHSKVIFEEAKNRLYVVKALLCFLNKEK

SEQ ID NO: 60411 - protein, 266 aa, Brassica napus
  misc_feature (18)..(18): Xaa can be any naturally occurring amino acid
  misc_feature (30)..(30): Xaa can be any naturally occurring amino acid
  misc_feature (35)..(35): Xaa can be any naturally occurring amino acid
  misc_feature (48)..(49): Xaa can be any naturally occurring amino acid
  misc_feature (80)..(80): Xaa can be any naturally occurring amino acid
  misc_feature (93)..(93): Xaa can be any naturally occurring amino acid
  misc_feature (95)..(95): Xaa can be any naturally occurring amino acid
  misc_feature (104)..(104): Xaa can be any naturally occurring amino acid
  misc_feature (121)..(122): Xaa can be any naturally occurring amino acid
  misc_feature (143)..(143): Xaa can be any naturally occurring amino acid
ARTRLKSDGREATVLISXKELNLYANVRPXYSLPXNKTRYDDVNLITXXENTEGEYSGLEHQVVRGVVESLKIITRQASXRVAEYAFHYAKTXGXERVSAIHKXNIMQKTDGLFLKCCREXXEKYPEITYEEVVIDNCGMMLXVKNPALFDVLVMPNLYGDIISDLCAGLVGGLGLTPSCNIGEDGVALAEAVHGSAPDIAGKNLANPTALLLSGVMMLRHLKLNEQAEQIHSAIINTIAEGKYRTADLGGSSTTTDFTKAICDHL

SEQ ID NO: 60412 - protein, 186 aa, Campylobacter coli RM2228
MDIKISEIANLPSKWGSFQIQSFKEGEKEHLCIFKNTPQDILNLRIHSECLTGDALGSLKCDCGEQLEFSLKYIEKHGGMVIYLRQEGRGIGLFNKVNAYALQDKGFDTIKANHQLGFKADERTYEIVEFILKHYKISKVNLLTNNPQKIHSIQDKIMARVPILINPNRFNANYLEVKQNQMGHLL

SEQ ID NO: 60413 - protein, 182 aa, Bartonella quintana str. Toulouse
MAQKERGERDERDGEFVDRLVHINRVAKVVKGGRRFGFAALVVVGDQKGRVGFGHGKAREVPEAVRKATEAAKRGMIYVPLRSGRTLHHDLEGRHGAGRVLLRSASAGTGIIAGGPMRAIFETLGMQDVVAKSLGSSNPYNMVRATFDALKHQMHPRDIAVQRGIKYSILQARRQHLVDAEG

SEQ ID NO: 60414 - protein, 631 aa, Oryza sativa
MISHLPVDGLPPRSWGAPCRRTPRRQPWRGRSGRSRTCPGRSRRRARTRSRAASSAPSGWRTRCTPASASAPCWGSPARPGRSRGAPSGPRPRLRPGRRRHRRRDPSSSSPGEAWARGRRACGRRWWARGRIRRGSTRSARPCASAAATTPWTPTPPPHPGRSGGVLAPLAGHGDADREGRGGLVAVDWGGGGEGLEGGKGGKKAHREERGERERGGGGGGGIVRGRGGFFGRDLSFGTLPRAMVSDQEIASCVESVLRSSGGAAGEASLAAVLSQAEAKLGVDLAHKATFIRDQMDLFFGPRLQPPLVAKAQAAAAAAPNPPPLVAAPAPAMPQVQVQAQLQQMQQQLAVLQPQLIFQAMPQLPAGVPGGAAGAVSPQPPVPAMAFYPPPPLAFRVTSGLAGVATGGTVSFQQPAPGTGGTASPTAAVQAAGDNKESASKRKRGGPGGLNKVCAISPELQTIVGETVMSRTQIVKQLWQYIRQNNLQDPDDKRKIICNDELRVVFGTDTTDMFKMNKLLAKHITPLDPKDQIREAKKFKPSNVATQPMPLINQPSVVISDALAKFIGMEGTVPQDDALRYLWDYIKANQLEDAITGSILCDSKLQELFGCESIPSSGLSELLAHHFIKET

SEQ ID NO: 60415 - protein, 549 aa, Geobacillus stearothermophilus
MLTFHRIIRKGWVFLLAFWLTASLFCPTGQPAKAAAPFNGTMMQYFEWYLPDDGTLWTKVANEANNLSSLGITALWLPPAYKGTSRSDVGYGVYDLYDLGEFNQKGTVRTKYGTKAQYLQAIQAAHAAGMQVYADVVFDHKGGADGTEWVDAVEVNPSDRNQEISGTYQIQAWTKFDFNGRGNTYSSFKWRWYHFDGVDWDESRKLSRIYKFRGIGKAWDWEVDTENGNYDYLMYADLDMDHPEVVTELKNWGKWYVNTTNIDGFRLDAVKHIKFSFFPDWLSYVRSQTGKPLFTVGEYWSYDINKLHNYITKTNGTMSLFDAPLHNKFYTASKSGGAFDMSTLMNNTLMKDQPTLAVTFVDNHDTEPGQALQSWVDPWFKPLAYAFILTRQEGYPCVFYGDYYGIPQYNIPSLKSKIDPLLIARRDYAYGTQHDYLDHSDIIGWTREGVTEKPGSGLAALITDGPGGSKWMYVGKQHAGKVFYDLTGNRSDTVTINSDGWGEFKVNGGSVSVWVPRKTTVSTIAWPITTRPWTGEFVRWTEPRLVAWP

SEQ ID NO: 60416 - protein, 479 aa, Anisophyllea disticha
  misc_feature (48)..(48): Xaa can be any naturally occurring amino acid
NLGRIAQIIGPVLDVAFPPGKMPNIYNALVVKGRDTVGQQINVTCEVXQLLGNNRVRAVAMSATDGLTRGMEVIDTGAPLSVPVGGATLGRIFNVLGEPIDNLGPVDTRTTSPIHRSAPAFIQLDTKLSFFETGIKVVDLLAPYRRGGKVGLFGGAGVGKTVLIMELINNIAKAHGGVSVFGGVGERTREGNDLYMEMKESGVINEQNIAESKVALVYGQMNEPPGARMRVGLTALTMAEYFRDVNKQDVLLFIDNIFRFVQAGSEVSALLGRMPSAVGYQPTLSTEMGSLQERITSTKKGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLIVARARKIERFLSQPFFVAEVFTGSPGKYVGLSETIRGFQLILSGELDSLPEQAFYLVGNIDEATAKATNLEMGSKLN

SEQ ID NO: 60417 - protein, 201 aa, Haemophilus somnus 2336
MKKALLTALVLGTSLTVTGCFDKDNNVSQQAESTKESVSTAIAETKEAMSKQVTEVKETAAEKVEAAKEAMSEQVTEIKETAAEKVEAAKEAMSEQVTEIKEIAAEKVEAAKEAMSEQVTEVKEMAAEKVEVAKEAMSEQVTEVKEMATEKVEAAKEAMSEQVTEVKAMAAEKVEAAKEAMSEKVMEVKEMATEIKSAVEK

SEQ ID NO: 60418 - protein, 194 aa, Lactobacillus sakei subsp. sakei 23K
MTFPQLDLENFAGPTATFDTNHGEFTVALFPEQAPKTVENFIGLAEKDYYDGIVFHRVINDFMIQGGDPTGTGMGGESLWGQAFGDEFSQELFNLNGALSMANAGPNTNGSQFFIVTNEHINPSMMSQMPGAGYPEEVIAAYEKGGTPWLDHKHTVFGQVLSGMDVVNEINAVETGMQDKPVDPVVINHISIKH

SEQ ID NO: 60419 - protein, 517 aa, Vibrio vulnificus YJ016
MTKNIHDQRILILDFGSQYTQLVARRVREIGVYCELWSWDVEEADIREFNPDGIILSGGPESVTEDNSPRAPQYVFDSGVPVLGVCYGMQTMAEQLGGKVSTSDEREFGYAAVKVSGESAIFKDLEATQDVWMSHGDKVVEIPAGFTKVGETDTCPYAAMANEEKKYYGVQFHPEVTHTKNGLQMLENFVLGVCGCERLWTSESIIEDAVARIKEQVGDDEVILGLSGGVDSSVVAMLVHRAIGDKLTCVFVDNGLLRLNEGQQVMDMFGDKFGLNIIKVDAEERFLKALEGKSDPEEKRKTIGHVFVDVFDEESKKLKNAKWLAQGTIYPDVIESAASKTGKAHVIKSHHNVGGLPDDMEMGLVEPLRELFKDEVRKIGLELGLPYEMLYRHPFPGPGLGVRVLGEIKKEYCDLLRRADAIFIEELHAADLYNKVSQAFTVFLPVRSVGVMGDGRKYDWVVSLRAVETIDFMTAHWAHLPYDFLGKVSNRIINEVNGISRVVYDISGKPPATIEWE

SEQ ID NO: 60420 - protein, 427 aa, Wolinella succinogenes DSM 1740
MRIFEQLESQVRSYIRSFPVIFERSKGAYLYDEQGKAYIDFFAGAGTLNYGHNHPKIIEAMIAYLQNDGILHGLDKATSAKKAFLQTLSETILEPRHMDYKVQFTGPTGTNAIESALKLARMVKGRSNVIAFTNAFHGLTMGSMAVTGNAFYRDEAFVNRANVSFMPFDGYFGEEVDTSLYLRRFLEDGSSGVDLPAAIILETIQAEGGVNVARDEWLRSVEKVCRDFDILLIVDEIQVGNGRTGRFFSFEESGIRPDIITLSKSIGGGLPLALVLLRPELDQWKPGEHTGTFRGNNLAFVAAKEALEYWSDSVLGEWVKHNSAILKEGLEALVQAFPELGMSARGRGLIYGLEIPLSGMAKEVSANCFQKGLVIELAGASDTVLKFLPPLIIEEETLREGLGIIKEAIGEVLREREARMGEVFGDR

SEQ ID NO: 60421 - protein, 257 aa, Thermus thermophilus HB27
MVVTGAGSGLGQALALELLRRGARVAAVDLRSEGLQETMAKAGSLGEGLSLHPLDITDKEKVAALPEEVERVHGQVDGLINNAGIIQPFKRLLDLDEAAMERVMRVNFWGTLHMTRAFLPRLLKRPEAHLVNVSSMGAFVPVPGQALYGASKAAVMLLTEALWAELQGTPVRVTLVLPGAMRTGIAEHSGVEAPRAEGAKVPVLEPEVAAKRLLDAVERDAFRVLLGRDAQTMDLLYRLSPALAARIVQRRMAHLLT

SEQ ID NO: 60422 - protein, 479 aa, Bridelia retusa
FTLENKNLGRIAQIIGPVLDVAFPPGKMPNIYNALAVKGRDTAGQQINVTCEVQQLVGNNRVRAVAMSATDGLMRGMEVIDTGAPLSVPVGGATLGRIFNVLGEPVDDLGPVDTRATYPIHRSAPAFIELDTELSIFETGIKVVDLLAPYRRGGKIGLFGGAGVGKTVLIMELINNIAKAHGGVSVFGGVGERTREGNDLYMEMKDSGVINEENIAESKVALVYGQMNEPPGARMRVGLTALTMAEYFRDVNTQDVLLFIDNIFRFVQAGSEVSALLGRMPSAVGYQPTLSTEMGSLQERITSTKKGSITSIQAVYVPADDLTDPAPATTFAHLDATTVLSRGLAAKGIYPAVDPLDSTSTMLQPEIVGTKHYETAQRVKQTLQRYKELQDIIAILGLDELSEEDRLTVARARKIERFLSQPFFVAEVFTGSPGKYVGLAETIRGFQLILSGELDSLPEQAFYLVGNIDEATAKATNLE

SEQ ID NO: 60423 - protein, 543 aa, Lactobacillus sakei subsp. sakei 23K
MKAQQILNDPFLNKGTAFTAEERAQFGLTGMLPPHVQTIDEQVKQAYAQYQSKANMLEQRIFLMSIFNENRVLFFKLFSQHVAEFMPVVYDPTIADTIENYSALYVNPQHAAFLSIDDPDSMKTTLANAADGREIKLIVVTDGEGILGIGDWGTQGVDISVGKLMVYTAAAGIDPSQVLPVVLDAGTNRESLLNDELYLGNWHERVRGDRYYDFVDQFVQTAEELFPNMYLHFEDFGRSNAANILNKYKDQIVTFNDDIQGTGIITLAGIMGALNISGGKMTDQVYMSFGAGTAGAGITHRIFEEMLQEGLTEEQARSRFYMVDKQGLLFDDDPELTPEQKPFARKRSEFANADELTTLEAAMKAIHPTILVGTSTQPGTFTESIVKEMAAHTERPIIFPLSNPTKLAEATAEDLIKWTDGKALVATGIPAAPVEYNGVTYEIGQANNALVYPGLGLGTIASTAKVLNDEMISKAAHSLGGIVDPTEPGAAVLPPVTKLDVFSQTVANAVAQSAVDQGLNKEEIADVQKAVADMKWEPEYKAL

SEQ ID NO: 60424 - protein, 500 aa, Mycobacterium smegmatis str. MC2 155
MTTDQITVEQLLVNGRRVDGHGEVLDVINPATGQVFARCHCGDAADIDAAVENAQAAFTSGVWRDAPIHHRAKVMNKFADLLEANMEELYRLETLNNGRPITETKAQITRLPEWYRYNAALLLADRTSVVPMAGPYHSYTSRMPLGVVGILSSFNHPLMIASKSLAPALATGNSVVLKPSEQTPLTALVVGQLALEAGIPPGVLNVVPGLGPDAGARLVEHPLVKKAVFTGGTEPGRSIAVATARRFAKATLELGGKSPVVVFDDMDVDVAARGAAFGGFIGAGQTCIAGTRLIVQSTIYQQFVDALVAQAEAIRIGDPALAETQLGPVISERARQRILNYVAIGVEEGATVATGGAAAEVAGMDGFFVKPTVLSNVTNDMRVAREEIFGPVLVVIPFEDEDDAVRIANDSDYGLGSSIWTRDVARAHRVASRFEQGIVWVNDHHRLDPCSPWGGVRESGQGREGGWESFHDFTNVRSVTIRTDSTDVDWYAGVGQERLN

SEQ ID NO: 60425 - protein, 479 aa, Cleistanthus perrieri
STLEKKNLGRIAQIIGPVLDVVFPPGKMPNIYNALVVKGRDTAGQQINVTCEVQQLLGNNRIRAVAMSATDGLMRGMEVIDTGTPLSVPVGGSTLGRIFNVLGEPVDDLGPVDTRATYPIHRSAPAFIQLDTKLSIFETGIKVVDLLAPYRRGGKIGLFGGAGVGKTVLIMELINNIAKAHGGVSVFGGVGERTREGNDLYMEMKESGVINEENIAESKVALVYGQMNEPPGARMRVGLTALTMAEYFRDVNRQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPQIVGEEHYETAQRVKQTLQRYKELQDIISILGLDELSEEDRLTVARARKIERFLSQPFFVAEVFTGSPGKYVGLAETIRGFNLILSGELDSLPEQAFYLVGNIDEATAKATNLE

SEQ ID NO: 60426 - protein, 319 aa, Wolinella succinogenes DSM 1740
MDEPLKNRLTEDSTLSHFEPMSERYKITFAEIGGLEKLKREANLKIIQPFKNPELFKRFKKQAGGGILLYGPPGCGKSYFARAIAGECGATFFNVGIDQILDMYVGNSEKNLKHLFQSARNVKPAILFVDEIDALGRRRDLLRHTNMTSTINAFLAELDGVESDNSDLLIIGATNAPWDVDSAFRRPGRFDRTLFIPPPDEHAREEIFRLLLEGIPSQNLHLSELAKLTPHFSGADLKGVVDRAGEAVIEEILEVEEGRVLLQDDLLKEISDSKPTTMEWFESAKNVVEYANENGIYDELADYLRHHLGSKGSKMGFLR

SEQ ID NO: 60427 - protein, 883 aa, Clostridium thermocellum ATCC 27405
MAKYVYLFSEGNASMRDLLGGKGANLAEMTSLGLPVPRGFTITTEACTRYYQDGKVIAKEIEDEIYRTMEKLEEIVGKKFGDPSNPFLVSVRSGARVSMPGMMDTILNLGLNDEVVVGLAKLTNNERFAYDSYRRFIQMFSDVVMEVEKSKFEAILDAVKEENNCENDCDLSAENLKEVVRRYKELFKKEKGFDFPQDPKTQLMEAVKAVFRSWENPRAIVYRRLNDIPGDWGTAVNVQEMVYGNMGNDSGTGVAFTRNPATGEKKLYGEFLMNAQGEDVVAGIRTPQSIDQLKEVMPDVYNQFVEIAEKLERHYRDMQDMEFTIERGKLFMLQTRNGKRTAAAALKIAVDLVNEGMVTKEEAILKVDPKQLDTLLHPNFEPSALKNAKPIAKGLPASPGAATGKIYFRAEDAVEATKNGEKDIILVRLETSPEDIEGMHVSKGILTGRGGMTSHAAVVARGMGTCCVAGCSEIRINEEEKYFVDKNGKKYVEGDWISLDGSTGNVYGEKLPTVEPEMTGDFATLMQWADEIRTLKIRTNADTPADAIQARKFGAEGIGLCRTEHMFFDSDRIPAMREMIVARTEEQRRKALDKLLPMQRKDFEELFTAMEGYPVTIRFLDPPLHEFLPQEDEDIEALAKEMGITFDELKAIVTGLHEFNPMMGHRGCRLAVTYPEIAEMQTRAVIEAAINVSRKNIKVVPEIMIPLVGDVKELKYVKDVVVRTANELIEKSGVKIEYKVGTMIEIPRAAITADEIAKEAEFFSFGTNDLTQMTFGFSRDDAGKFLEEYYNKKIYEFDPFAKLDQDGVGKLVEMAAKLGRQTRPDIKLGICGEHGGDPSSIEFCHQIGLNYVSCSPFRVPIARLAAAQARVNEIKGTKDLGQK

SEQ ID NO: 60428 - protein, 186 aa, Mycoplasma penetrans HF-2
MPSFIKSCFSSNDWITDDKKEICFIGRSNVGKSSLINALANAKIAKTSNTPGRTQLANFYDFDKFRLIDLPGYGYAKVSKSKHFELSKIISEYIYLRKNLVAVFQIIDISVITDLDLQMSELLSNRFNQHYIVLNKADKEAKSYFDNNFAKIAAKLKKDKENIVCVSAKNKTNIPNLKKLIGSVIL

SEQ ID NO: 60429 - protein, 479 aa, Nicotiana tabacum
MAGTTTAGDTSTSSRSNLAPTKSLSKKENQGLLSGRYEIGKLLGHGTFAKVYHARNVKTNESVAIKVIDKEKILKVGLIDHIKREISILRRVRHPNIVQLYEVMATKAKIYFVMEYVKGGELFNKVAKGRLKEEVARKYFQQLISAVAFCHARGVYHRDLKPENILLDEDGNVKVSDFGLSAISEQIKQDGLFHTFCGTPAYVAPEVLARKGYDAAKVDIWPCGVILFVLMAGYLPFHDQNIMAMYKKIYKGEFRCPRWFSPELTKFLRQLLDTNPETRITIQEVMNNRWFKKGFKHVKFYIEDDKLRSVNDDDYDGGVDYSSDRSESESEMEMRRKPATLPRPASLNAFDIISFSRGFDLSGLFEEGGDGARFVSGAPVPKIISKLEEIAKVVSFAVRKKDCRVSLEGSKEGEKGPLTIAAEIFELTPSLRVVEVKKKAGDRVEYEEFYHKELKPGLQNLTLEVDGPVDSSHLPSDTE

SEQ ID NO: 60430 - protein, 187 aa, marine gamma proteobacterium HTCC2143
MNIPNTLTLLRILLIPVIIAVFYLPYDWSYLASAGIFMLASITDWLDGYLARKLNQSTPFGAFLDPVADKLMVSIALVLLVERFGAWWFTVPAMIIIGREIVISALREWMAELGRRTSVAVSYIGKVKTGFQMVAILVLLAAAPERSGILLNIGIVLLYLSAILTLWSMLVYIRAAWPTFDLGSGTK

SEQ ID NO: 60431 - protein, 415 aa, Spinacia oleracea
MASIGPATTTAVKLRSSIFNPQSSTLSPSQQCITFTKSLHSFPTATRHNVASGVRCMAAVGEAATETKARTRSKYEIETLTGWLLKQEMAGVIDAELTIVLSSISLACKQIASLVQRAGISNLTGIQGAVNIQGEDQKKLDVVSNEVFSSCLRSSGRTGIIASEEEDVPVAVEESYSGNYIVVFDPLDGSSNIDAAVSTGSIFGIYSPNDECIVDSDHDDESQLSAEEQRCVVNVCQPGDNLLAAGYCMYSSSVIFVLTIGKGVYAFTLDPMYGEFVLTSEKIQIPKAGKIYSFNEGNYKMWDDKLKKYMDDLKEPGESQKPYSSRYIGSLVGDFHRTLLYGGIYGYPRDAKSKNGKLRLLYECAPMSFIVEQAGGKGSDGHQRILDIQPTEIHQRVPLYIGSVEEVEKLEKYLA

SEQ ID NO: 60432 - protein, 473 aa, Burkholderia pseudomallei K96243
MAYRNDSLLTSAQQDTRHLLHPWADLSALGRETPTVIVEAQGTRVTDAEGRTYLDAIGGMWCVTLGYGRREIADAIRDQALRMPFYTPFGAMTNEPAAALGARLAALAPGDLKRVHLTTCGSTAVESALRFAHYYFGATGRPHKRHIVTRGDAYHGSTYLAASISGKAWDRTCFHYDSTIVHHLSSPNPYRRPAGMSVDAFCASLVDEFDALIAKLGAEQIACFIAEPILASGGVIVPPPGYLAAMRERCRRHDILYISDEVVTGFGRVGHFFASHAHFGIEPDMIVVAKGLTSGYQPLGAVLISERLVDAVSGEHAYGNGVFTNGFTYSGHPVACAAALANIELMERERICEHVRDVGPYFIRRLDALRRLPIVGDVRGDHLMACIECTSGAGATGALPTPADIAIAQRVDRHCEEMGLLVRPYESMCILSPPLTVTRADIDEICAILAAALERAQRELAQHAPVREENETC

SEQ ID NO: 60433 - protein, 421 aa, Arabidopsis thaliana
MFYQQRVLVSLLRNSIKLALKQLKNWMAPEKAKTSLTTFPASAEIVSEPLGVVLVISAWNYPFLLSIDPVIGAISAGNAVVLKPSELAPASSALLTKLLEQYLDPSAVRVVEGAVTETSALLEQKWDKIFYTGSSKIGRVIMAAAAKHLTPVVLELGGKSPVVVDSDTDLKVTVRRIIVGKWGCNNGQACVSPDYILTTKEYAPKLIDAMKLELEKFYGKNPIESKDMSRIVNSNHFDRLSKLLDEKEVSDKIVYGGEKDRENLKIAPTILLDVPLDSLIMSEEIFGPLLPILTLNNLEESFDVIRSRPKPLAAYLFTHNKKLKERFAATVSAGGIVVNDIAVHLALHTLPFGGVGESGMGAYHGKFSFDAFSHKKAVLYRSLFGDSAVRYPPYSRGKLRLLKALVDSNIFDLFKVLLGLA

SEQ ID NO: 60434 - protein, 1121 aa, Gibberella zeae PH-1
MGTPLTSEELKRYTAIIDDILETSDLETISRKKIRQGLENALGGQDLSEQKNAIKRLIEARFDAVSGADTGITPPTTSDSLAANGTSDVGDTEQSATPEPSRKKVKRSSSAEDADARLAAQLQAQENSLARGRKTRGGDKPTKKKAAPRKKSAKKVKADDDSDLEPADGETGKKRKAGGGFQKPFNLSETLSELVGETQLSRPQVVKKLWEHIKANDLQDPKDKRQIICDDKMHAVFKQARVDMFKMNKDIGSHLYPVEELSRISDHGEPAFILAGDSKLQMTAKREPIKVVNSCIPCSASPYKDYSDTATDSDSIPYQATTSQQFDTSRAAERHKQSSIFDLHPTHDQISPSGSSKLLAMSPPEGDNNTGVSASDSQPQGDGQRNRGRGRGKGNQNRRGGQRRGRGGNNANVPNVPANPAAQDVAAAASRAHALAASKAAEAAEDDDDAEVCFICANPVAHHSIAPCNHTTCHICGLRMRALYKTKDCAHCRTPAPYVIFTDDPEKRFEEYSEKDITTTDSNIGIKYTQEDIVGDTVLLLRYNCPEPSCDFAGLGWPDLHRHVKSAHKKRMCDLCTRNKRVFTHEHELFADKELERHMRHGDDKPGAADQTGFKGHPLCGFCGERFYDDDKLRDSRHPHYYLDYNALEEHFKKDHYLCGDRECMEKKFVVFESELDLQAHQLSDHGGKATSRDARVVNISGFDIRTPYQQERGSGGAGGRDEGRRGGRDGRRGGNRGRDPNAEPVPVSSAQPLRRDEIAFQRQMAIHSAQSVSNRTFGGALSTPTPAQASSQSRGGSSSNTPRASQTNLANPIESATVDPANLSPEERARLVRHGAVVERASNLLGNDTQRMATFRSHISSYRQGSLTAPQLIDAFFTLFADTSSNALGTMVREVADLYEDKSKAENLRKAWQDWRAINEDYPSLPGLSGMHGATSSSSGWAGAASANPAVPNAKVTQKYSNRVLKLKNSTRLGGPAPVSSSGASSSWAGRPAVSAPPASSNAFPSLPSSSKKSSASSSNWTTPTPSSSSQSTTLNRPRPAPRPTGEDAFPALPAAPKPTTTIFGYGNGRAVRRDYGNRETNFQWGSGPSTPADEEPADEEAGGKKKGGKKGKKVLVQWG

SEQ ID NO: 60435 - protein, 423 aa, Ostreococcus tauri
DMSFSKRVARELRGSRGCAIALVAIALVALVGLGGRGDGFGETVRKSGPLSAFSITARVGSSKALLRSCAGSGSGEFGSETYLVTGAAGFVGSHVATALKKRGSGVVGLDNVNDYYPRGLNRTRMAKLSEIGVHVVEADLNDASTVRKILDTCRVTTVVHLAAQAGVRYAVKNPGAYVHSNVAGFVTLLEEITRTTPMPKVIFASSSSVYGLNTKVPFSEKDVTDSPASLYAATKKADELLAHTYNHIHGLALTALRFFTVYGPYGRPDMAYFSFANNIMKDKPVKIFKGPDGGELARDFTYIDDVVKGTIAACDTSEKSGKGSDGSRPPFRVYNLGNTQPVTVSDFVSKLERALGKTANRNYVPMPKTGDVPFTHADISAAKKDLGYNPSISLDEGLDSFVRWYSKYYAGGAHAEDTNYVPM

SEQ ID NO: 60436 - protein, 588 aa, Nicotiana tabacum
MGGQLQLNPCSSSSVATTFHNGAHKFCRNFNILPFKAHSLESSVASTFHNGIYSRIQPRKHFEIMSSNGFHLNAVSLLDGSASKSMPEQVPLTELENAETTVSITVIGASGDLAKKKIFTALFALFYEDCLPENFIVFGYSRTKMSDEELRNMISKTLTCRIDQRENCEAKMDHFLERCFYHSGQYHSEDDFAELDYKLKAKEGSRVSNRLFYLSIPPNIFVDVVRCASLKASSTSGWTRVIVEKPFGRDLESSSELTRCLKKYLTEEQIFRIDHYLGKELVENLSVLRFSNLVFEPLWSRNYIRNVQFIFSEDSGTEGRGGYFDNYGIIRDIMQNHLLQILALFAMETPVSMDAEDIRNEKVKVLRSMRPLQLEDVVLGQYKGHSKGGKLYPAYTDDPTVPNGSVTPTFSAAALFINNARWDGVPFLMKAGKALHTRRAEIRVQFRHVPGNLYKRNFGTDLDKATNELVLRLQPDEAIYLKINNKVPGLGMRLDRSDLNLLYKAKYRGEIPDAYERLLLDAIEGERRLFIRSDELDAAWALFTPLLKELEEKKIAPELYPYGSRGPVGAHYLAAKHNVRWGDLSGDD

SEQ ID NO: 60437 - protein, 288 aa, Pasteurella multocida subsp. multocida str. Pm70
MWKHVSQVLADQFGAYYSIKHKEKIHTGEMHEAWIIDDGIQPVFLKVNDKTFRSMFRAEADQLLLLAKTNTINVPNVYTVGCSHTHSFLLLEALPLDKTNPVDAMGKFGEQLAKLHLIKGADNYGLDFDTWLGPEYQPNGWKENWATFFSEQRIGWQLQICREKNLVFGDIEVLVKKVAELLAKHKPQPALLHGNLWIENCATVKQEIFTYDPACYWGDRECDLAFSELFEPFPRQFYESYDRTYPIDEGYPERKAIYQLYYLLNFSHRFNKHYVELTKKFIHDILSR

SEQ ID NO: 60438 - protein, 865 aa, Thermus thermophilus HB27
MAKRVYLLSEARGLSRDLLGGKGHGLAEMAAAGLPVPPAFVVTTEACRQYLRTGEVPGLWEEVRAGMAALEGLTGKRFGLGEGKAPPLLVSVRSGAPVSMPGMMDTVLNLGLTLEGVEALARATGNPRFAWDSLRRLLAMYGEVVLGERPEVFEGMLSALKAERGVGTDAALGPEDLEELAYRYLRHLEARGTPFPLDPWAQLQGAIEAVFKSWQNPRARTYRRIYGIPEDLGTAVVVQAMVFGNLGEDSGTGVGFTRNPATGEKGLYGEYLRNAQGEDVVAGVRTPEPLERLKGYAPGLYEELLQVAERLERHFRDMQDFEFTVERGRLFLLQTRAGKRTAQAAVRIAVEMAEEGLISREEAVMRVEANALPGLLRPSVDRDQAPRPLLKGLPASPGAAVGHAAFTNEAVERFHAQGLPAVLVRPETTPEDITGMYLAKGILTARGGLTSHAAVVARGLGVPAVVGAEALRVFPGEGRALAEGVEIREGDLLTLDGGTGEVYLGAVPLVEAGGEALLEKLLSWAEPHRRLGVRANADTPEDARRARAFGAEGIGLCRTEHMFFREDRLPWVRRLILAETPEEEALALERLFCFQKEDFKEILRAMDGLPVTVRLLDPPLHEFLPPLEALARRAEEGDEEAGRLLRRAEALKEANPMLGFRGARLLLLRPGVFRMQLRALLEAAKELREEGHDPRPEVMVPLVADPKEVERARALAEELFREYGPIPFGTMVETPRAALLAAEIAPLVDFFSFGTNDLTQMAFGLSRDDAGKFLPRYVEEGLFPFDPTERLDEKGVGRLLRMAAEEGRKANPRLKLGLCGEHGGEAGSVRFVADLLDYTSASPFRVLTARLAAAQAGLSRALKPA

SEQ ID NO: 60439 - protein, 369 aa, delta proteobacterium MLMS-1
MKACIALEDGTVFDGTSFTGHGETTGEVVFNTGMSGYQELLSDPSYKGQIVTMTYPLIGNYGVNEEDMESARVQPEAFIVREYCPFPSNFRATATLAQLLQKYGILGIEGVDTRALTRHIRTAGAMKGIVSTEDLDHASLVAKAQAAPGLVGRDLVREVSCSEPYVWTATGPRPGRDFTGATAGRHRVVAIDYGLKYNQLRMLAERGCQVQVVPCDTDAETILAQNPDGIFLSNGPGDPSGIPGVIDTIRQLLGRKPIFGICLGNQLLGLAYGGKTYKLKFGHRGINQPVKDLTTGRVEITSQNHGFCLDMTSLDEAEVELTHINLNDNSVEGIRHRRYPAFSVQYHPENAPGPRDAVYLFDRFVQMMN

SEQ ID NO: 60440 - protein, 379 aa, Mycobacterium smegmatis str. MC2 155
MMSESELQSAVRAALAKVIDPELRRPITELGMVKSISIEPDHSVHVEIYLTTSACPKKNEISDLVSAAVTDVPGTGAVKVSLDVMNDEQRAELRKMLRGDSREPVIPFAQPNSLTRVYAVASGKGGVGKSSVTVNLAAAMAARGLTVGVLDADIYGHSVPRMMGTTDRPTQVDSMILPPVAHDVKVISIAMFTQGNTPVVWRGPMLHRALQQFLADVYWGDLDVLLLDLPPGTGDVAISIAQLIPGAEILVVTTPQLAAAEVAERAGAIALQTRQRIAGVVENMSGLLMPDGTVMQLFGEGGGRLVAESLTRSIGAEVPLLGQVPLDPALVSAGDAGVPLVLSAPDSPAGKELRKVADALSARKRGLAGMSLGLDPTRR

SEQ ID NO: 60441 - protein, 255 aa, Ipomoea nil
MIRTAAGKAKVVGTILCVGGAMLLSFYHGHNIGIGESSIHWKYADHLSSQNKDNNGSTNAQPNFILGPFLIIVSALSWAIWSIIQTRVSEKYPAPYSSTALMCFMSSIQCVLFAICFDHKPTDWSLRQGIRATSAVYAGIVGTALAYCLMSWCIEKKGPLYVSVFNPLLLVIVAVLSWGLLQDKIYVGTIVGSVLIVVGLYGVLWGKQKELQVIGVVHVDEEEARNEVETKEDHLEELELSAHSIITVDQFPKKN

SEQ ID NO: 60442 - protein, 846 aa, Desulfococcus oleovorans Hxd3
MNEISAQPRIVYIDDDRNQLALVERFLSGPFEVITAENGEDGLRIISETPPDLVLLDINMPKMDGYEVCTRLQATPKTSFIPVVFLTAMEEEKDRARAFAAGASDFLVKPVKKDALLEKVRAQLATGAAWKDLQADNRQWHKKIESADFAGFKEHVAGQLNLAPDKKERLFETTAADIYTVFAEMGLVESTLSRLMSQYMGLPYTTRISPETIRLGAIPTAFCKANHVLPVMTESGEKGFILSNPFNLDLVDMLKKNFALEKTAAISIAEPSRIDLFFIEAPSQQKSSAVGGPQTPSPATAPKITVRNEADTDHPIVQITDTILNAAVAERASDIHIEPKETETTVRFRVDGDLRHAFTLKKATGMMIISRLKAQSGIDIAEKRKPQDGGFVANLGDRVFNFRLSTTSTPNGESLVMRLLEPYGAANSLSELGMMDGQVAAMVAAANRSSGTILIVGSTGSGKTTTIYSLLHAIDHKKRSIMSVEDPVEYRIPFLNQQQVNEKAGVTFDSLLKAAVRQDPDVLFMGEIRDGFSAKMAVDFASTGHLTITTLHTSNATTALFRLHRLGIDRGTMADTIIVIVAQKLLKKLCPHCKQTVPISPQEREMLAAFTDDVPSVVARSVGCPECRSTGYLGREGVYEVLEFDTQIAEMVRSNAPIAEIRSFAKRRGDLLIDTHAITKVKELLFTPKDIFEKVLAEETPVRERQKPRKPEPATADAGPPASAASVLLVEDDADTRMLITRFLETDGYTVTACADGIDALLCLGKQSFDLILSDIDMPNLDGFKLLEMINQKGVSVPVIFLTSRAGHEDETRGLELGAVDYIKKPVQKDLLRLRVKKTIQGRVSP

SEQ ID NO: 60443 - protein, 344 aa, Gibberella zeae PH-1
MPTTTAETLSLVTRNVTVAPLVLLSAVDHYNRTVSTKTKRRVVGVLLGQNDGNDVRVSNSFAVPFEEDDKDPSVWFLDHNYVESMNDMFKKVNAREKLIGWYHTGPKLRASDLEINELFKRYTPNPLLVIVDVQPKESGVPTDAYFAVDEIKDDGTTTARTFVHTPSVIEAEEAEEIGVEHLLRDIRDVAAGTLSTRVTNQLQSLQGLHLRLRDIGAYLQKVLDKQLPINHAILGNLQDVFNLLPNLSTPERDGKSGGGELAYAMSVKTNDQLMAIYLSSLIRAITAFHDLIENKIQNRQQQEEKEAKKEEINNKDEKKEGTNGASTQAKEGGEKDKENKETKK

SEQ ID NO: 60444 - protein, 586 aa, Coccidioides immitis RS
MGVEHKQGSGMIADAEAMRVASWDEGLQKQPEGSFAQRIINSFKRDPNAYISQPISSNTEGFDAEGAAAATAASPLKRRLKSRHLQMIAIGGSIGTGLFVGSGRSLATGGPASVVIAFCLIGIMLYATIHALGELAVMYPVAGAFAHYSTRFLDPAWGFAMGWNYAILWLTLLPLEIVAAAITVGYWEADVSPAAWVAMFYVLIVVINLFGVLGYGEAEFVFSIIKVIAVIGFIILGIVLNCGGGPNGDYIGGRFWHNPGAFNNGFKGLCSVFVTAAFTFGGGELVGLAAAETANPRKSIPTAVKQVFWRIVLFYIVSMVIVGLLVPYTDERLLNGSSTDVKASPFVIAISDAGIKGLDSVMNAVILISVLSVGNAAIYGSSRTLTALAEQHQAPALLAYIDRKGRPLMSILVASCFGLLGFLAATPKQQEAFTWMLAISGLSSVFTWASICLAHIRFRRGWKIQGHSLDELPFRAQGGVITSWIGFIINCIVLVAQFWTGFAPIGYGELSHSERVKTWFSTYLAAPIVLTFYITYKLWYRTSIVHAKDMDLTTGRRDLNLQHLIAEEKAERESWPKWKRVYKAFC

SEQ ID NO: 60445 - protein, 360 aa, Amycolatopsis methanolica
PQTVRGVIARSKGAPVELTDIVIPDPGPSEVTALIATCAVCHTDLTYREGGINDEFPFLLGHEAAGTVESVGEGVDSVQPGDYVVLNWRAVCGQCRACKRGRPQYCFSTFNATQKMTLTDGTELTPALGIGAFADKTLVHAGQCTKVDPAADPAVAGLLGCGVMAGLGAAVNTGAVSRGDSVAVIGCGAVGDAVIAGARLAGANKIIAVDRDAKKLEWATELGATHTVNATETDVVEAVQALTGGFGADVVIDAVGRPETWKQAFYARDLAGTVVLVGVPTPDMRLEMPLLDFFSRGGALKSSWYGDCLPERDFPVLIDLHLQGRLPLDKFVTERISLDDVEKAFHTMHAGEVLRSVVVW

SEQ ID NO: 60446 - protein, 486 aa, Leuconostoc mesenteroides subsp. mesenteroides ATCC 8293
MVSEIKTLVTFFGGTGDLAKRKLYPSVFNLYKKGYLQEHFAIVGTARQQLSDDEFKQLVRDSIKDFTEDQAQAEAFIAHFSYRAHDVTDAASYGILKSAIEEAATKFDIDGNRIFYMSVAPRFFGTIAKYLKSEGLLAETGYNRLMIEKPFGTSYATAEELQSDLENAFDDDQLFRIDHYLGKEMVQNIAALRFGNPIFDAAWNKDYIKNVQVTLAEVLGVEERAGYYDTTGALLDMIQNHTMQIVGWLAMEKPESFNDKDIRAAKNAAFNALKIYNEEEVNKYFVRAQYGAGDTADYKPYLEEADVPADSKNNTFIAGELQFDLPRWEGVPFYVRSGKRLAAKQTRVDIVFKAGTFNFGSEQEAQESVLSIIIDPKGAIELKLNAKSVEDAFNTRTINLDWAVSDEDKKNTPEPYERMIHDTMNGDGSNFADWNGVSIAWKFVDAITAVYDADKAPLETYKSGSMGPEASDKLLAENGDAWVFKG

SEQ ID NO: 60447 - protein, 229 aa, Chlamydophila pneumoniae CWL029
MKKQESVLVGPSIMGADLTCLGVEAKKLEQAGSDFIHIDIMDGHFVPNLTFGPGIIAAINRSTDLFLEVHAMIYNPFEFIESFVRSGADRIIVHFEASEDIKELLSYIKKCGVQAGLAFSPDTSIEFLPSFLPFCDVVVLMSVYPGFTGQSFLPNTIEKIAFARHAIKTLGLKDSCLIEVDGGIDQQSAPLCRDAGADILVTASYLFEADSLAMEDKILLLRGENYGVK

SEQ ID NO: 60448 - protein, 490 aa, Crocosphaera watsonii WH 8501
MVTATRPENKVKIGPTQLLINNKWVESASGKRFETINPSTGEVICDVAEADAADVDKAVIAARNAFNQGDWPKLSATQRGQLLYKLADLIEANIEELARLETLDNGKPYQDSLNADLQLVIACYRYYAGWADKIQGKTIPINGPYFCYTRHEPVGVVGQIIPWNFPLLMQAWKLAPALAAGNTVVMKTAEQTPLSALRLGELILEAGFPPGVVNLLSGYGPTAGQAIARHHDIDKVAFTGSTEVGHLIMEAAAQTNLKRVTLELGGKSPNIVFADANLEQAIEGAHFGLFFNQGQCCCAGSRLFVEEKCYDEFVAKSVERAKQRIVGDPFDDNTAQGSQVDRTQFDKVMEYIESGQREGAKLLCGGGRVGDRGYFIEPTVFAEVKDNMKIAQEEIFGPVMSIIKFKDMDEVIQRTNDTVYGLAAAVWTQDISKGHAIANALRAGTVWVNCYDVFDAAAPFGGFKQSGMGRELGEYGLQQYTEIKTVTVKL

SEQ ID NO: 60449 - protein, 386 aa, Clostridium thermocellum ATCC 27405
MAGKRDYYEILGVDRGASDAEIKKAYRKLAKQYHPDMNPGDKAAEAKFKEINEAYEVLSDPQKRARYDQFGHSAFDPNGFGGGGFGGGFTGGFGDFDFGGFGDIFEAFFGSGFGTRTSSARRGPQKGADLKYSMEVSFEEAAFGTEKEVTVSRLEICPTCSGSGTKPGHQPVTCRQCNGTGQVQYKQRTPFGQIVNVRTCDVCHGEGKIITNPCETCGGKGRVRKHTKLKVRIPAGIDNGETISLRGEGEHGIKGGPSGDLFITIKVKPHPIFKRHGNDVNCEIPITFTQAALGAEIEVPTLDGKEKIVIPEGTQTGTVFKLKGKGIPFLRSSGRGDQYVKVNIEVPRKLNEKQKEVLRQFAELVGDEVHEQRKGFFNKMKDALGM

SEQ ID NO: 60450 - protein, 313 aa, Thermoanaerobacter tengcongensis MB4
MAFNLKGRSLLTLKEYTPQEIRYLLDIAKQVKAERKAGIVHQRFVGKTIALIFEKRSTRTRCAFETAFGEEGGHPVFLSTDDIQLGAKESIEDTARVLGRMFDAIEFRGFKQETVEILAKYAGVPVYNGLTDEYHPTQVLADLMTIEEEFGSLKGRKLVFVGDGRNNMANTLAIGCAKMGMHYVINSPKELWPSESFIKEIKDMAAENGGTFELTSVPGEGLEGADAIYTDVWASMGEEAKAEERERLLRPYQVNEEMMKKTGRDDTIFLHCLPAVKGQEVTFEVIEGKQSRVWDQAENRKHTIKAVLIATLL

SEQ ID NO: 60451 - protein, 758 aa, Oryza sativa
  misc_feature (284)..(284): Xaa can be any naturally occurring amino acid
  misc_feature (292)..(292): Xaa can be any naturally occurring amino acid
  misc_feature (307)..(307): Xaa can be any naturally occurring amino acid
  misc_feature (318)..(318): Xaa can be any naturally occurring amino acid
  misc_feature (332)..(332): Xaa can be any naturally occurring amino acid
  misc_feature (378)..(378): Xaa can be any naturally occurring amino acid
MVLPPRLLLFFLLLIGVHASVSHGSPSLPPTYDPSICSNLDGSKQTPFIQLNGENYTILEIIYDSRTIVLADTDALRGSCPRVRHNVTFGQAYPWLQYTGSRDNLTFFFGCKLNLPPPIDPGLVSLADKHQINCKDFSNWPDSGDSFVFTSGELEAPVESELARCCSQVIVVPVNGSVLNSSNQSALPSGGYGQVLKMGFDLAWNSSKDEQCYKCEQSKGHCSYSQNRAFLGCLCSDGKVSTKDCRNNGASNSSALRSNLKRRKNLCKRLLYLYILLICVPTNXSDNVFIKXDCVHNVERQQNLILXISSKSTMRFQXILCTNHLGSNRSTXLHPIKKPTSKFKPKSWSFMGRIKGVCLYELYSACFGLLIFSQIFCXPYQYSGYAVMDKTRYSILMPFSVPNFLHANIIAGTSSVLLLCLLSFACLFGLKKSRYRRISKGTPRIESFLQRNGTLHPKRYTYTEVKRMTKSFAEKLGHGGFGAVYRGNLSDGRQVAVKMLKDSKGDGEEFINEVASISRTSHVNVVTLLGFCLHGSKRVLIYEYMPNGSLERYAFRNNSEGEHSLTWEKLFDVVVGIARGLEYLHRGCNTRIVHFDIKPHNILLDQEFCPKISDFGMAKLCSNKESIISIAGARGTIGYIAPEVYSKQFGAISSKSDVYSYGMMILEMVGARERNIDANSESSSHYFPQWIYEHLDEYCINSSEIDGETTELVRKMVVVALWCIQVVPTNRPTMTRVVEMLEGSTSGLELPPKVLLSW

SEQ ID NO: 60452 - protein, 465 aa, Xanthomonas campestris pv. campestris str. ATCC 33913
MSEPSSTDAPQFQRSMQVRHLVMLSLGGVIGTGLFFNTGYIIASTGALGTVLAYLIGALVVYLVMQCLGELAVAMPQTGAFHVYAARYLGPATGYVVAWLYWLTWTVALGSSLTAAAFCMQYWFPHSPAWPWCLLFCVLIFSLNMVSARWFAEGEFWFSLINVVTIVVFIVLGGAAVVGWLPLADGSPAPGVRHLRADGWFAHGTVPILMTMVAVNFAFSGTELIGIAAGETAQPARAIPLAIRTTLIRLVVLFVGTVLVLAALLPAHAAAVETSPFVRAFELLGIPYAAGLLNAVILTAILSAANSGLYAAARMLWSLANEGTLPARFARLTRRGIPLPALVLSMLGGLLALLTGVYAADTVFVAISAVSGFAVVVVWLSICASHYCFRRQLLRDGIALDSLAYRAPWYPWTPLIGGALCVLACAGLAFDPQQRIALWCGIPFVALCYGAHAVTQRLAARRVRP

SEQ ID NO: 60453 - protein, 358 aa, Cryphonectria parasitica
MAEFVRAQIFGTTFEITSRYSDLQPVGMGAFGLVCSARDQLTNQNVAIKKIMKPFSTPVLAKRTYRELKLLKHLRHENIISLSDIFISPLEDIYFVTELLGTDLHRLLTSRPLEKQFIQYFLYQIMRGLKYVHSAGVVHRDLKPSNILVNENCDLKICDFGLARIQDPQMTGYVSTRYYRAPEIMLTWQKYDVEVDIWSAGCIFAEMLEGKPLFPGKDHVNQFSIITELLGTPPDDVINTIASENTLRFVKSLPKRERQPLASKFKNADEQAVDLLERMLVFDPKKRITASDALAHEYLAPYHDPTDEPVAEEKFDWSFNDADLPVDTWKIMMYSEILDYHNVDASGASAAMGEFNGQ

SEQ ID NO: 60454 - protein, 812 aa, Gibberella zeae PH-1
MTGQNTLGHGLAKILGIKLEGQKRDQCAQMGDHSVLSSQNGGSFYETEPTSAEWVKEQIPSKEDLITYGASLFPFSNWIGHYNLQWFAGDLVAGITIGAVVVPQGMAYAMLANLEPQFGLYSSFIGALIYWIFGTSKDISIGPVAVLSTVVGNVVHDIQNSGQEIPAHVIASALSISAGFVVLVIGLLRCGWIVDLISITSLSAFMTGSAITICVGQLPALLGLSGFSTRDSPYKVFKNTIEHLGEANSDAIVGLSALAILYCFRQGLTIAAERYPKHKRLLFFTNTMRTVFVIIMYTTISWALNKHRRDNTLFNILGAVPKGFQNIGVPKISPDLISGFSPYLPATVIVLLVEHIAISKSFGRVNNYTIDPSQEMVAIGMANLIGPFLGAFPSTGSFSRTAIQSKAGVRTPAAGIVTGLVVLLATYLLTAVFFYIPNAALAAVIIHAVGDLVTPPNTVYQFWRVSPIEVFIFFTGVIVSIFAHIEAGLYATVLFSGAVFLYRILKAHGRFMGKVKVHSVIGDHVIGDHHRKVVGRFGTTENLDISARNVFLPLDHDDGSNPEVEVGHPYPGIFIYRFSEGFNYPNANSSLDYLTDFIQSNTQRSSPEAFERPGDRPWNNPGPRKSAKRPVHVDADSTLPTLKAVVMDFSSVNNVDITSIQRLIDIRNQLDSYASPDGVDWHFACINNRWTKRALIAAGFGVPCRPEEEGLQRRWKSIFSVAEIGDRDSALAEETDFHGITPRDFDITEEEPLVGGMPSVRSYGSMSHRELEKQRRRGAVVHGQNKPLFHVDLTSALQSAIANVEERPAQEE

SEQ ID NO: 60455 - protein, 1469 aa, Yarrowia lipolytica CLIB122
MEQTPPDYTGLDKNIDAEVRSIAESMYQTRREGVNDSDTDEELQRTNTIQPNLNVNPFLDTSDPQLDPLSKEFNSRKWIKTILGLKARFGNSRSISAGVSFKNLSAFGYGGGNDYQKTFTNSVMAIGPMIKKVLGGNKGSEVQILRHFDGLVRAGETCVVLGRPGSGCTTFLKSVACETYGFHLGEKSEWNYQGVPRDVMQKNARGEIVYNAEVDVHFPHLTVGDTLLFAALARTPQNRLEGVSREQHATHVRDVSMAMLGLTHTMDTKVGNDFVRGVSGGERKRVSIAESVVCGAPLQCWDNSTRGLDAANATEFIRSLRLSAEMTDASMFVSLYQASQEAYDMFDKVCVLYEGRQIYFGKTTEAKQFFLDLGFDCADRQTTGDFLTSLTNPIERIIRPGWESRVPRTPDDFEKCWLESEARQLLLQDIDEFNNEFVLGGPALDNFMGLRKDAQAKHTRVQSPYTISWPMQTRLCLWRGFLRIKGDMSTDIATVFGNFVMALVLSSMFYNMPQTTESFFSRGALLFFAILINAFASILEILSLYEQRPIVDKQNRYAMYHPAADALAAIITTFPTKTLTLVSVNLTIYFMTNLRREVGPFFIFFLFSLLCTMAMSMIFRTIGSVTKTLEQALAPASIIILALVIYTGFSLPISYMHGWARWINWLNPVAYGFEAVMVNEFRNREYECSMFVPSGGAYENVSLDYRSCAAVGAEPGLRFVNGDAFINQSYEYYNAHLWRNMGILFGFIIFFGAFYLFAVEYIQGAKSKGEVLVFRKEHIKKQRKEKNGDIESGVTMAGEKGTQESESSNTSINLQAQRGIYQWKDVCYDIKVKDGERRLLDHVDGFVKPGTLTALMGASGAGKTTLLDVLADRKSTGVVTGEMLVNGEHRDGSFQRKTGYVQQQDLHTATATVRESLEFSALLRQPSSIPESEKLAYVDEVIRILEMETYADAVVGVPGEGLNVEQRKRLTIGVELAAKPELLLFLDEPTSGLDSQTAWSIVKLLKKLAANGQAILCTIHQPSAILFQEFDRLLFLASGGRTVYYGDIGPQSSILTEYFERNGADPCPKQGNPAEWMLEVIGAAPGSTAKRDWPVVWAESPERAAKREELDEMARTVERVQTNTTERDSTGYSDSDQFAVGWWTQFKIVSKRQFQALWRTPSYLWSKVFLCAASAIFIGFSFFKAPNDMQGLQNKMFSFFMLFLIFNTVVEQIIPQFDKMRELYEARERSSKTYSWQVFMGSNMVVELIWQFFMGVIVFFCFYYPVGFQWTAEYNDSVHERGGLFFLYVLLLFLYNSTFAHMLIAGIDNKDTAAQIGTLLFTLMLLFCGVLATKEQMPGFWVFMYRVSPLTYFVGGMMATGMGRAPVTCSPHELVRFPAVPGKSCGEYMDGFISALGDSAGYLVSSSADMCEYCPMKSSDQFLDSVDISYTQRWRNWGILWAYPLFNIFAAFALYYFFRVPKKSKAQKA

SEQ ID NO: 60456 - protein, 364 aa, Pseudomonas syringae pv. syringae B728a
MSAVNRAAVETILRQYTDPYLNQDPVTAGCVRSIDIQGAQVSVQLELGYAADLFRNGWAHVLKTAIENLDGVSSATVAISSVISAHKAQSQIPGLANVKNIVAVASGKGGVGKSTTAANLALALSREGARVGILDADIYGPSQGVMFGIPEGTRPKIKDQKWFVPVEAHGIEVMSMAFLTDDNTPMVWRGPMVSGALLQLVTQTAWNDLDYLVIDMPPGTGDIQLTLAQKVPVAGAVIVTTPQDLALLDAKKGVEMFRKVNIPVLGVVENMAVHICSNCGHAEHLFGEGGGAKLATQYDVELLASLPLSMLIREQADGGKPTAIAEPESQIAMVYQELARHVGARIVLQEAASPAMPTISVSDD

SEQ ID NO: 60457 - protein, 585 aa, Thermus thermophilus HB27
MAGLADRVSGARLDPAAEAEIRYLEAMIARLEAGEEDPEDFRVFRLKNGIYGIRGRPEHHMIRIKLPVGRITPEGLRVLADVAERYAENRLAHVTTRQAVQLHHVHRRDVPKVLRAVNAVGLTTREACGHSIRAITCCPYAGVSPEEPFDVTPYAEAAYRYFLRHPVGQNLPRKFKIAFEGCATDHARTPIHDIGVVAALEGGKRGFRVYVGGGLGAAPMSAELLEAFTPEEDLLPTMLAIVRLFDRYGNRKVLTQARLKFLVKKWGIAAFREAVREERRLVKLTASGEDLEAWAPPPEPEPPRLPSPPKKPFSFAPGFDAWRRTNLFKQKQEGFYTVTVRLPLGDITPEGLRALAAIAETYAAEVRSAISQNLLLRFVPEEALGGLYEALLEAGLALPEAHTLLDITRCPGADTCNLAITRSRGLAQALEAHLSALPLAQDPGAKAIGVKISGCPNSCGQHHIADIGFYGSSRKVGEREVPHYVLLLGGRTREGEARFGQVVGRIPARRVPEAVERILKRYLEERQNGESFQAYLDRVGAASFKPLLQDLQEVPPYEEAPEFYQDLGAEGEAFSVQLGRGECAV

SEQ ID NO: 60458 - protein, 501 aa, Colwellia psychrerythraea 34H
MSLILSNNYQALGESFSQQTLPAPVGQPSLLLWNEPLAKALTIPFTKDNDAELLSQYFSGNQLIEGSKPVAQAYSGHQFGHFNPQLGDGRAHLLGDIADTQGQRWDIQLKGSGVSDFSRQGDGRCALGPALREYIMSEAMFALGVPTTRCLAVVTTGENVYRERPYDGAVVTRIAASHIRVGTFQYFAARGDTDSLKKLTNYAINRHFPELIANSSENSSDNSDALKADNVISSQQVLEFFSAVLSKQIPLVLSWLRVGFIHGVMNTDNTTISGETIDYGPCAMMNAYHPETVFSSIDRNSRYAFGKQISIMQWNMTRLAETLLPLVDSDEDDAVEKIEPLLTQFHQDLQQGYLTMMAAKIGIDEPAEGDGKLINDLITLMKEQKLDYTQTFTALTDSLNDNTTEEPLTDVLNEWLPHWNSRIESFKSSAHTLMVSNNPIVIPRNHHVEAFLDSCQETGDLTALNKFLAVLRQPYTEIAETKNYQDAPVDGDKDYHTFCGT

SEQ ID NO: 60459 - protein, 275 aa, Neptuniibacter caesariensis
MDKQPVLAFIGAGNMARAIIGGLISNGYPANKIWASEPDAERLSDLKVQGLQTTTDNNQAVMAADAVILAVKPQVLKPVTEAMKDAVQAKQPVIISVAAGILSTSIDRWLGGNTAIVRCMPNTPALVGTGASGLYANSQVSDEQRSAAETILKATGITLWVDEESQLDAVTAVSGSGPAYYFLVMESMIQAGKKLGLSEEVATKLTLQTALGAAQMASSSDVDPAELRRRVTSPNGTTEQAIKTFMDEGLPATFEKALQACNDRSEELAKELGDA

SEQ ID NO: 60460 - protein, 236 aa, Neptuniibacter caesariensis
MSSIAKNLEKVRQQIADTAVQSNRQSNEITLLAVSKTRPADDLRSAYEEGQRHFGENYLQESLEKIQSLSDLDICWHFIGPLQSNKTRTVAENFDWMHTVDRLKIAQRLSAQRPEQLAPLNICIQVNISNEDSKSGCSPEQVAELADQISQLPNISLRGLMAIPKASSDPKEQAEAFQKMRLLQLELQQSHPQLDTLSMGMSGDMNEAISAGSTIVRVGTAIFGPRPPKIASSDNH

SEQ ID NO: 60461 - protein, 87 aa, Gossypium herbaceum
TTGAFSRSAVNHNAGAKSAVSNIVMSITVMVTLLFLMPLFQYTPNVVLGAIIVSAVVGLIDIPAACQIWKIDKFDFIVMLCAFFGVI

SEQ ID NO: 60462 - protein, 236 aa, Leuconostoc mesenteroides subsp. mesenteroides ATCC 8293
MTLSPKNTDVKSLFNTIAPEYDKMNNIISLGAHKKWRQKVMDKMVFPRKAQIIDLATGTADWAIALAENSDSDSEIIGLDFSESMLVVGQTKVDISDYSEKITLEQGDVMDLEFPDNSFDIVTIGFGLRNLPDPKQGIKEMYRILKPGGQLVILETSQPDSPLVKPFWQLYFGHVMPLFGRVFAKGKYQEYKYLDETTEHFMDYMTLGQLLLKSGFKKVRISRFNLGAAAAHYATK

SEQ ID NO: 60463 - protein, 314 aa, Medicago truncatula
MPLPPINDLTCIVTGSTSGIGLEIARQLAESGAHVVMAVRNTKRANDLIQKWQIESDGLGLGMALNVEVMEVDLLSLDSVARFAEAWNARATPLHALINNAGIFSIGEPQKFSKDGYEDHLQVNHLAPALLSILLLPSLIRGSPSRIVNVNSIMHHVGFVDTEDMNLTSGKRKFSSLVGYSSSKLAQVMFSSVLFKRLPAEAGISVLCVSPGIVQTNVARDLPKSVQTGYHLIPYFIFNAQEGSRSTLFAATDPQVSEYCELLKSDEWPVCPYISHDCRPANASEEAHNLQTSHEVWEKTLEMIGLLRMPWRSF

SEQ ID NO: 60464 - protein, 97 aa, Synechocystis sp. PCC 6803
MASYTVKLITPDGESSIECSDDTYILDAAEEAGLDLPYSCRAGACSTCAGKITAGSVDQSDQSFLDDDQIEAGYVLTCVAYPTSDCTIETHKEEDLY

SEQ ID NO: 60465 - protein, 87 aa, Gossypium hirsutum
TTGAFSRSAVNHNAGAKSAVSNIVMSIMVMVTLLFLMPLFQYTPNVVLGAIIVSAVVGLIDIPAACQIWKIDKFDFIVMLCAFFGVI

SEQ ID NO: 60466 - protein, 285 aa, Arabidopsis thaliana
MAEEVLSRVPMTSLRRLRFTCKKWNTLSRCRSFAKKHLVCQAKVAAKKREYKVVMMMDFRVYLMRINLQNNVELCIKRERELLFPDASDQIYVRHVFHCDGLLLCIMKDNPRLVVCNPYSGQTRWIETTNNPQRLDAYSYALGYNSSTKSHKILSFGMMFDYVSSTSAEFKIYDFNSDSWRGDIWAAVCLRRPLSGIFKSSLLLSNVRDEQLAVLFQRMDTLQMEIWVTTKIEPNTVSWSSKFFLSVDMRELTGRYSMFSFSDASFFIDEEKKVAVLTSLERMDP

SEQ ID NO: 60467 - protein, 479 aa, Lachnostylis bilocularis
SALEKKNLGRIAQIIGPVLDVAFPPGKMPNIYNALVVKGRDTAGQQINVVCEVQQLLGNNRVRAVAMSATDGLTRGMEVIDTGAPLSVPVGGATLGRIFNVLGEPVDDLGPVDTRTTSPIHRSAPAFIQLDTKLSIFETGIKVVDLLAPYRRGGKIGLFGGAGVGKTVLIMELINNIAKAHGGVSVFGGVGERTREGNDLYMEMKESGVINEANIAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPQIVGEEHYETAQRVKQTLQRYKELQDIIAILGLDELSEEDRLTVARARKIERFLSQPFFVAEVFTGSPGKYVGLTETIRGFKLILSGELDSLPEQAFYLVGNIDEATAKATNLE

SEQ ID NO: 60468 - protein, 630 aa, Thermoanaerobacter tengcongensis MB4
MAVITVNNLTKSYGVDIILQNISFIVNEGDKIGVIGENGAGKSTLFNILAGTLEPDSGSIFVSANKIGYLKQNTLIDSEKSIYEEVKSVFAEIFQLENKIKALEEKISNTKDHNLLEKLFEEYSFLMDKYNELEGYSVESKVRGVLNGLGFDMSQFDTPVSNLSGGQKTRLMLAKILLLNPDVLLLDEPTNHLDIRSLEWLEQYLKFYSGTLLIISHDRYFLDKVVNKIFEIENHHLKVYEGNYTEYLKKKKEEVQAKLKAYEEQQKEIKRIKSIIETQRNRRTEKSVKMAQSKEKLLEKMEIIEKPFLNKNSIKLKFNFDIESGNDVLTVKNLSLKFDRPVFSNVSFDVKKGEKIALLGPNGAGKTSLLRIIAGEIKEFEGEIKFGTNVVTGYYEQEFKSLNPEKTVLDEIWDENPYLTQTEVRTLLASFLFKDEEVFKTVASLSGGEKARLALLKLLLSKANFLLLDEPTNHLDLKAKEVLEESLLGYSGTVLFVSHDRYFIDKIATKVMILSAEGVEVYLGNYSYYIAKKQQLEVQQEEPPKKTKTQIKNERQKERLLRLKLKEQREYLKNLENSIYQAEDRLKELEEKMCNVEIYKTGEIVEIQKEYTALKEKLEEMYREWEKLSG

SEQ ID NO: 60469 - protein, 130 aa, Methanosarcina acetivorans C2A
MTCDPAGGRAINAAGVQFPPVHYNGDIFLPGQANNFYTYPAVGLAVYVTRAKRATDEMFIKAARATANQRTDEQLKKGLLFPPQSSILETEVRTAVQIATLIFNRDLARVDQPEDINVWLRATLYKPQYS

SEQ ID NO: 60470 - protein, 552 aa, Oryza sativa
LFFCVCVCARGSGYNLLRDPRYNKGLAFNERERETHYLRGLLPPAIVSQELQERKIMHNIRQYQLPLQKYMAMMDLQEGNERLFYKLLIDNVEELLPVVYTPTVGEACQKYGSIFSRPQGLYISLKEKGKILEVLKNWPERSIQVIVVTDGERILGLGDLGCQGMGIPVGKLALYTALGGVRPSACLPITLDVGTNNEALLNDEFYIGLRQKRATAQEYADFLHEFMTAVKQNYGEKVLIQFEDFANHNAFELLAKYGTTHLVFNDDIQGTASVVLSGLVAALKLVGGSLSEHSYLFLGAGEAGTGIAELIALEISRQTKAPIEECRKKIWLVDSKGLIVSSRKETLQHFKKPWAHEHEPVGNLLDAVKTIKPTVLIGTSGKGQTFTQEVVEAISSFNERPVIFALSNPTSQSECTAEQAYTWSKGRAVFASGSPFDPVEYDGKIYVPGQANNAYIFPGFGLGVVMSGAIRVHDDMLLAASEALAQQVTQENFDKGLTYPPFSNIRKISAHIAANVAAKAYELGLASRRPRPKDLVKYAESCMYSPLYRNYR

SEQ ID NO: 60471 - protein, 271 aa, Yarrowia lipolytica CLIB122
MSRVGILVLGPAGVGKSTFCNALITHIQSIGRRAHIVNLDPAAEPNEYEFTVDIRDLISLNDVMEEMELGPNGGLMYCFEFLLQNMDWLEEELGEFEDEYLIFDCPGQIELYTHVPVLPTIVKHLQRHMGFSLCACYILEAPFVLDRPKFFSGVLSAMSAMILLETPHINILSKMDLIKDEVPKRELKRFLNPDPLLMVDEANSQTNPKFHQLNLAITNMIEDFGMVQFLPLEAKNPDSVAAILSYLDDVTQWADNQEPKEPKVEEVEEEE

SEQ ID NO: 60472 - protein, 541 aa, Burkholderia pseudomallei K96243
MPAQGNAQRTAPLARPAPTDAGHGKFKKQLSLTDLTFIGLGAIFGSGWLFAASHVSMIAGPAGILSWLLGGFAVLLLGIVYCELGAALPRAGGVVRYPVFSHGPLLGYLMGAITLIAFSSLIAIEVVAARQYAAAWFAGLTVEGSGNPTTLGWLVQAALLCFFFYLNYSSVKTFAKANNVISVFKFVVPLAVIVVLFAFFKPANLTLHGFAPFGMPGVEMAVSAGGIIFAYLGLTPIVSVASEVRDPQRTIPIALILSIVLSTLIYVLLQLAFLGGIPSAMLAGGWHDIGKAFSLPYRDIALALGVGWLAYMVVADAMISPSGCGNIYMNATPRVVYGWAKTGTFFKVFARVDEASGIPRAGLWLTFALALFWTLPFPSWEALINTVSAALVLSYAVAPVSVAALRRTAPGLPRPFRASAFALTGPASFVIAALIVYWSGWRTVSWLLGLQIAMFAVYLACRRRVPTAHLSLAEQVRSCAWLIAFYALMIVASYFGGFGGTGQLAHPYDTFAVAAVALVIYYWGAHTGVPSAKLQLDDDEN

SEQ ID NO: 60473 - protein, 103 aa, Anabaena variabilis
MSVYVGNLSYDVTEDSLNPVFAEYGSVKRVQLPTDRETGRMRGFGFVEMGSDAEETAAIEALDGAEWMGRDLKVNKAKPKEDRGSFGGGNRGGYGGGGGRNRY

SEQ ID NO: 60474 - protein, 183 aa, Bradyrhizobium japonicum USDA 110
MDDKSQPGIPWREDLMANTGRSGVGAAIVALLTSPGFAVITTWRIAKMLRFRTRWGHQITWLLVRALMRRGCYISVLAEIGPGLILPHPTGVVVGEGARIGRSVMLYHNVTLGRRAWDEPGCPTIGDDAVIYTGAVIVGPISIGAGANVAANAVVTRDVPPRSVAAGAPARVVRSEAPDRMRA

SEQ ID NO: 60475 - protein, 368 aa, Neurospora crassa
MATHNIVVFGGDHCGPEVVLEAIKVLKAIETNSPSACKFNLQNHLLGGASIDKHNDPLTDEALNAAKAADAVLLGAIGGPEWGTSSTVRPEQGLLKLRKELGTYGNLRPCNFASESLVDSSPLKAEVCRGTDFIVVRELTGGIYFGDRTEDDGSGYACDTEPYSRAEIVRIARLAGFLALAKNSPAKVWSLDKANVLATSRLWRKTVTDVISKECPQLQLEHQLIDSAAMLLVKNPRALNGVVITSNLFGDIISDEASVIPGSIGLLPSASWGGIPDGKVKCNGIYEPIHGSAPDISGKGIVNPVCTILSVAMMLRYSLNLPKEADAVEAAVKAAIDNGTKTKDLGGNATTSDMGNAVVAELEKILKA

SEQ ID NO: 60476 - protein, 141 aa, Azoarcus sp. BH72
MAIERTLSIIKPDAVAKNVIGKIYQRFEDAGLKIIAAKMVHLSEQEAGQFYAVHKERPFYKDLVSFMTSGPVMIQCLEGENAIAKNRELMGATDPKKADAGTIRADFADSIDANAVHGSDAPETAAVEVAFFFPGMNVYSR

SEQ ID NO: 60477 - protein, 267 aa, Dehalococcoides ethenogenes 195
MKIAFIGGGNMGEAILGALIQKNICPPKDITVSEIKAERRTFLENTYGIKTTPSNPEAIKNAEVVLLAIKPQNLAELSAGLKGKLAETQLVISIIAGATLSKLSGGLEHKAVVRVMPNTPAMIGMGMSVWTALPAVSPAQKEQAKSILSAMGKEIYTGKETMLDAATAISGSGPAYFFLFMESLEKAAQEMGFTPEEATVLVSQTAAGSAVYAEKSGLPLAQLRKNVTSPGGTTAEAIKVFEQAGLETTVIKAAKAAFDRSVELGKG

SEQ ID NO: 60478 - protein, 329 aa, Medicago truncatula
MPLPPINDLTCIVTGSTSGIGLEIARQLAESGAHVVMAVRNTKRANDLIQKWQIESDGLGLGMALNVEVMEVDLLSLDSVARFAEAWNARATPLHALINNAGIFSIGEPQKFSKDGYEDHLQVNHLAPALLSILLLPSLIRGSPSRIVNVNSIMHHVGFVDTEDMNLTSGKRKFSSLVGYSSSKLAQVMFSSVLFKRLPAEAGISVLCVSPGIVQTNVARDLPKSVQTGYHLIPYFIFNAQEGSRSTLFAATDPQVSEYCELLKSDEWPVCPYISHDCRPANASEEAHNLQTSHEVWEKTLEMIGLPSDAVEKFLEGEEVKCRYGQEQQ

SEQ ID NO: 60479 - protein, 87 aa, Gossypium hirsutum
TTGAFSRSAVNHNAGAKSAVSNIVMSITVMVALLFLMPLFQYTPNVVLGAIIVSAVVGLIDIPAACQIWKIDKFDFIEMLCAFFGVI

SEQ ID NO: 60480 - protein, 253 aa, Glycine max
NCVTQVIALTEELLATAKQNEISAPPNNAAASPTLSIHNENQLLDSSSDHQEKLPVGTKVQAVWSEDGEWYDATIEAYTPNGYYVSYDNWGNKEEVDPANVRSIQEGSVDALLEAERVAEATKQAIKRKIAQAASIDLQSRSLPTKLRIEADDPEDVKASKRKKIHAFKSKMRMEQLEVTQNKRQNAWQQFQSTKGKAKKIGFFSGRKRESIFKSPDDPQGKVGVTGSGKGLTEFQKREKHFHLKDGTVENDD

SEQ ID NO: 60481 - protein, 471 aa, Colwellia psychrerythraea 34H
MIEITSQKALTDTFLQQKQHFANNTYPSYQDRLSDLTKLKAILIDNQQAFIDAMSQDFGHRSADDTKLGDILSTVMGINYAIKKLKGWMKPEKKHIGILFQPAKGEVIFQPKGVVGIIAPWNYPVFLAFGPLTTALAAGNTAMIKMSEYTPNTNILLAELVANNFPHKKVAIVCGEADMAAAFSSIAFDHLFFTGSTGVGKLVMKAAAENLVPVTLELGGKSPTIIDDDIDIKTAVSRLILGKTLNSGQTCVAPDYLFCPENKVAELTQAFKGAYQTMYPNTQDNVDCTCIINDAQKARIDSLLTDAKAKGANIIPLIPDSSNGSSRKMPLTILTNVTDDMSVMQQEIFGPLMPIIGYKKIDETIAYINSKPRPLALYICSFNKAFQQKVLLNTHAGGVCINDAAFHVINDDLPFGGIGASGMGQYHGSEGFKTFSHSKAVLSRGRISLGSLLFPPFGKEIHQLVYKLFIR

SEQ ID NO: 60482 - protein, 462 aa, delta proteobacterium MLMS-1
MDAKKRMAIPRQYPRELPVAERISNFNEVVYGYDDAMAQREAERCLQCKKPKCRKGCPINNDIPGFIRLIREGKIEEAYWLDRQTNTLPAICSRVCPHEFQCEGSCLLGKKKEPVAIGMLERYIVDWMVTNGKNMLQSCALPNGHKVAIVGSGPAGMSVAYYLAKEGYECTIFESLPKVGGMLTVGIPAYRLPRSIIAAEFEALSNCGVKVVSGVEIGRDKTLADLKNEGFEAIFLGPGAHASRKLGVDGEELAGVVHGVDYLRRFNLGENIDLGSNVVVVGGGNVAIDCARTALRQGSKNVFILYRRGRDEMPASRAEIHHLEEEGVRIETLAAPVKIHGENGRLNKIECIRMQLGACDASGRCRPEPVEGSNFMIEADAIIPAISQDVDVSAADGQELALSRWGTFEVDEATLQTSVPWIFAAGDAVLGPQTVAKAVYQAKEAAESIHRLIQGRDLKEGR

SEQ ID NO: 60483 - protein, 383 aa, Arabidopsis thaliana
MGGYHVSPGGFMRGAVYREPNKPLTIEEFHIPRPKSNEILIKTKACGVCHSDLHVMKGEIPFASPCVIGHEITGEVVEHGPLTDHKIINRFPIGSRVVGAFIMPCGTCSYCAKGHDDLCEDFFAYNRAKGTLYDGETRLFLRHDDSPVYMYSMGGMAEYCVTPAHGLAPLPESLPYSESAILGCAVFTAYGAMAHAAEIRPGDSIAVIGIGGVGSSCLQIARAFGASDIIAVDVQDDKLQKAKTLGATHIVNAAKEDAVERIREITGGMGVDVAVEALGKPQTFMQCTLSVKDGGKAVMIGLSQAGSVGEIDINRLVRRKIKVIGSYGGRARQDLPKVVKLAESGIFNLTNAVSSKYKFEDAGKAFQDLNEGKIVSRGVVEIL

SEQ ID NO: 60484 - protein, 306 aa, Pseudomonas syringae pv. syringae B728a
MNARHFLSMMDYTPDELLGLIRRGVELKDLRNRGVLFEPLKNRVLGMIFEKSSTRTRLSFEAGMIQLGGQAIFLSHRDTQLGRGEPIADSAKVMSRMLDAVMIRTYAHSNLTEFAANSRVPVINGLSDDLHPCQLLADMQTFLEHRGSIKGKTVAWIGDGNNMCNSYIEAAIQFDFQLRVACPAGYEPNAEFLALAGERVTVVRDPKAAVAGAHLVSTDVWTSMGQEEETARRKKLFAPFQVTRALLDLADKDVLFMHCLPAHRGEEISVDLLDDSRSVAWDQAENRLHAQKALLEFLVAPSCKPA

SEQ ID NO: 60485 - protein, 643 aa, Dehalococcoides ethenogenes 195
MGGRIEQFGSQVSLQIDNVLYVASIISGTRSFKYRLKYFVEETYMAKTKAPADKMEPAEEIKQDGKVVSTKRTAGSEFFWTQSRCTGCNRCASICPVDAIKLDRDKTPTKRVGTAPCTRACPAGLDIPRYVRFVAEGNAPAATAVMREKIPFPSVCGYVCFHPCELECQRQKFDEPIAIRALKRYAAENDDGSWKNNLKIAPSTGKKVAIIGSGPAGLTSAYFLTLLGHEATIFESMEYAGGKMFYSIPEHQLPKDILNKEIKAITDLGVTIHTSCQVQSVQTLLKQGYDSVLLSTGVLGLDEGLLLPCDETVESDLMQGSDFLKNIKSSTKESLGDKVVIIGGGSEAYNSAFAAKSLGVSEVHLVCSRHAGSKEASPEEVDRAIDAGVTVHPSLDFAKLVRLDGKIEGVELFRIRSYGYDKENKLHYEIINDTRRFIAADTVITTVTPNEKPGADYLSVVQPGVFAAGDGISGARSVIEAMAAGRSVAGLIDKYLGGEGNLDETLAPPEKNIKPLNEPKGQNRSQVELSLVKQAGGDKVEIEKTLSPEAAKKEAQRCLRCDIVHQVHDYSLDTSSCTYCGRCVDACYWDAITSGYGYEAAAKKRKAEITALEEKNGVYNYAIRILPVAIGLMIIAAAVAKLF

SEQ ID NO: 60486 - protein, 291 aa, Triticum aestivum
  misc_feature (25)..(25): Xaa can be any naturally occurring amino acid
  misc_feature (62)..(62): Xaa can be any naturally occurring amino acid
VITPVPGPWKHPEVKVEDSRTLLFXGRRKVPVLGSRNPEEIPWAAAGAEYVVESTRVFTRQXKAAAHIKGGAKKVIISAPSKDAPMFVCGVNEKEYKSDIDIVSNASCTTNCLAPLAKVINDRFGIVEGLMTTVHAMTATQKTVDGPSSKDWRGGRAASFNIIPSSTGAAKAVGKVLPELNGKLTGMAFRVPTVDVSVVDLTVRLAKPATYDQIKAAIKEESEGNLKGILGYVDEDLVSTDFQGDNRSSIFDAKAGIALNDNFVKLVSWYDNEWGYSTRVVDLIRHMHSTK

SEQ ID NO: 60487 - protein, 888 aa, Oryza sativa
  misc_feature (107)..(107): Xaa can be any naturally occurring amino acid
  misc_feature (218)..(218): Xaa can be any naturally occurring amino acid
  misc_feature (494)..(494): Xaa can be any naturally occurring amino acid
  misc_feature (600)..(600): Xaa can be any naturally occurring amino acid
MWSSSLPSYLFTLVTGLLPLLVHSQTASLDEGFISIDCGLSSGSSYLDEKTGLNYTSDDGYIYTGENHDISAEYNGQELFKTGLNLRSFPTGGRNCYTLSPATTGQXKYLVRATFMHGNYDGKGNDLVSSPLVFDVHMGLHFWDRISVSNSAKTYIAEVIVVAEVNSISVCLMDIGSGIPFISSLEMRQMKSSLYPAAKANQSIALQERHSMGTSSLXRYPDDPYDRLWWPWQGSSRLLNISTNQTIKRYWNDKFEVSARILQAAVTSPATSIPLNFSWTIPTSWPTIEAVPAYYVDVHYTEFQKPQGREFNTYYNGALWPANENPITPPYLLADYTFSTSQYTSDNGFYNICLVATNTSILPPSLTAFEIYYLVQHNGTMTSLEDVDAMMTLKTEYQVKMNWMGDPCLPENYTWTGLKCQSDGVTSGVTSLDLSNSDLKGAISDKFSLLKSLQYLNLSYNDLNGSVPDSLVNLPLLALDLSGNHLISTIPDAXCTKQSLTLRYDTTNGDPCNGKSQEKKNTVVLFVAIFVPVLIVAILVSTLLVCYFFRKQATTHKEDHEDHIHISDGREFTYTELIEMTNNFSVCIGEGGYGPVFHGXLKEGTQVAVKMHSPTSTIGKGMTEFLAEVESLTTVHHRYLVFLVGYCSNKNHLALIYEYMPNGSLYDHIRGKNAIVQTLGWHDRARIALEAAQGLDYLHTGCMLPIIHRDLKSQNILLGHDMVAKISDFGLSRSYLNDAQSHISVTAAGTLGYIDPEYCLSGRLTISSDVFSFGVVLLEIVTGEPPIISTTVHIVQRVKEKVSMGNIEAIVDPRFGGEYDTNSVWKVVDIALLCTKEASHERPTMSTVVAELKVALALEKARASGSISDISQGGANFELSINSLLSAR

SEQ ID NO: 60488 - protein, 424 aa, Gibberella zeae PH-1
MLSTLRVASRRAARPAQYNLAAIRAASNWANVPQGPPDAILGITEAFKADKFDKKINLGVGAYRDDAGKPYVLPSVREAEMKVVESKLNKEYAGITGVPEFPPAAAKLAYGANSPALDRITITQTISGTGALRVGAAFLAKFFPGEKKIYIPQPSWANHKAVFNHAGLEVEQYRYYDKKTIGLDFEGLIADVKSAPNGSVFLFHACAHNPTGVDPTQEQWKQISDVVKEKGHFAFFDMAYQGFASGDTDKDAFAVRYFVEQGHNIALCQSFAKNMGLYGERIGAFSMVCADADEKKRVDSQLKILIRPLYSNPPIHGARIAAEILNSPTLYKQWLGEVKEMADRIITMRALLKDNLEKLGSKHDWSHITSQIGMFAYTGLTSEEMTRLAEEFSVYATKDGRISVAGITSENVGRLAEAIYKVKG

SEQ ID NO: 60489 - protein, 647 aa, Arabidopsis thaliana
MRLFFTPSMSNLSIFFSILLLSLPLPSIGDLAADKSALLSFRSAVGGRTLLWDVKQTSPCNWTGVLCDGGRVTALRLPGETLSGHIPEGIFGNLTQLRTLSLRLNGLTGSLPLDLGSCSDLRRLYLQGNRFSGEIPEVLFSLSNLVRLNLAENEFSGEISSGFKNLTRLKTLYLENNKLSGSLLDLDLSLDQFNVSNNLLNGSIPKSLQKFDSDSFVGTSLCGKPLVVCSNEGTVPSQPISVGNIPGTVEGSEEKKKRKKLSGGAIAGIVIGCVVGLSLIVMILMVLFRKKGNERTRAIDLATIKHHEVEIPGEKAAVEAPENRSYVNEYSPSAVKAVEVNSSGMKKLVFFGNATKVFDLEDLLRASAEVLGKGTFGTAYKAVLDAVTLVAVKRLKDVTMADREFKEKIEVVGAMDHENLVPLRAYYYSGDEKLLVYDFMPMGSLSALLHGNKGAGRPPLNWEVRSGIALGAARGLDYLHSQDPLSSHGNVKSSNILLTNSHDARVSDFGLAQLVSASSTTPNRATGYRAPEVTDPRRVSQKADVYSFGVVLLELLTGKAPSNSVMNEEGMDLARWVHSVAREEWRNEVFDSELMSIETVVSVEEEMAEMLQLGIDCTEQHPDKRPVMVEVVRRIQELRQSGADRVG

SEQ ID NO: 60490 - protein, 194 aa, Prochlorococcus marinus str. AS9601
MSLRVGQEAPDFSATAVYDQEFKEVTLSGLRGKWVVLFFYPLDFTFVCPTEITAFSDRYQDFSALNTEILGVSVDSKHCHLAWIQTPRNEGGIGDINYPLVSDLKREICQAYNVLNDDGEADRGLFLINPEGVVMHTTVNKAPVGRNVDETLRILQGYQYVAANPDEVCPANWTPGEKTMLEDPKGSKEYFSAL

SEQ ID NO: 60491 - protein, 306 aa, Cryptococcus neoformans var. neoformans B-3501A
MPIELDLDSILQFAIKLALDAGQIIREGQEKRFASESAQEDEKLNSVDLVTEVDKAVEKFIVERIREAYPSHKFIGEESYEGQQITDEPTWIVDPIDGTTNFVHGFPMVATSIGLAHKGIPVVGVIYNPFLDQLWSAAKGRGAYLNQKRKLPITGSSKPLASLGQALIGVEYGMSRSPPALPRKLAAFEKLTAHTDVGGKMCHSLRSMGSAALNIVLVASGGLDIYWEVGCWPWDVCAGICILEESGGRCFGAKTADLSGEVDAKLMAGRKYAMIRSIRATDKETSLDQQKKFIKEFYDCVEDFDP

SEQ ID NO: 60492 - protein, 147 aa, Triticum aestivum
  misc_feature (91)..(91): Xaa can be any naturally occurring amino acid
RRLILTSVAAGGVQNRWALQLSLLTHYVQTLGLSHALTKFMWMCRPIDGLVAQPYVGLYNDKRTCRWRRHTPSIVTGCIHIRIDVVVIGCXADIGADLGDSNEESNLYHEPLWHAINEDDPGYCLLDLSNNTVQGADSALMADDNLT

SEQ ID NO: 60493 - protein, 351 aa, Medicago truncatula
MEKYEVVKDIGSGNFGVARLMRHKDTKQLVAMKYIERGHKIDENVAREIINHRSLRHPNIIRFKEVVLTPTHLGIVMEYAAGGELFDRICSAGRFSEDEARYFFQQLISGVSYCHSMQICHRDLKLENTLLDGSPAPRLKICDFGYSKSSLLHSRPKSTVGTPAYIAPEVLSRREYDGKLADVWSCGVTLYVMLVGAYPFEDQDDPKNFRKTINRIMAVQYKIPDYVHISQECRHLLSRIFVASPARRITIKEIKSHPWFLKNLPRELTEMAQAVYYRKENPTYSLQSIEDIMKIVEEAKNPPQASRSVGGFGWGGEEDDDEINEAEAELEEDEYEKRVKEAQESGEIHVN

SEQ ID NO: 60494 - protein, 368 aa, Nicotiana tabacum
MGIQHNEHNQDQTQSFLLDALYCEEERWEETIEDEILEKEATLPLPLPLLEQDLFWEDEELLSLFTKEKETISNFETIKTDPLLCLSRKEAVKWILKVNAHYGFSTFTAILAINYFDRFLSSLHFQKDKPWMIQLVAVTCLSLAAKVEETQVPLLLDFQVEDAKYVFEAKTIQRMELLVLSSLKWRMNPVTPLSFVDHIIRRLGLKSHIHWEFLKQCERILLLVIADCRFLSYMPSVLATATMLHVIHQVEPCNAADYQNQLLEVLNISKEKVNDCYELITEVSYNSISHKRKYESPINSPSAVIDTFYSSENSNESWDLQTSSSIPSTYSPRDQFLPLFKKSRVQEQQMRLTSLSRVFVDYAVGSPR

SEQ ID NO: 60495 - protein, 337 aa, Streptococcus ratti
MTQVFQGRSFLAEKDFTRAELEYLIDFSAHLKDLKKRGVPHHYLEGKNIALLFEKTSTRTRSAFTTAAIDLGAHPEYLGANDIQLGKKESTEDTAKVLGRMFDGIEFRGFSQRKVEELAEFSGVPVWNGLTDEWHPTQMLADFLTVKENFGKLEGLTLVYCGDGRNNMANSLLVTGAILGVNVRIFSPKELFPADDIVKLAESYAKESGAKLLITEDADEAVRGADVLYTDVWVSMGEESKFEERVKLLKPYQVNMELIKKAGNENLIFLHCLPAFHDTNTVYGKDIEEKFGVKEMEVTDEVFRSSYARQFDQAENRMHTIKAVMAATLGNLFIPKV

SEQ ID NO: 60496 - protein, 749 aa, Schizosaccharomyces pombe
MANSATITSKKGVKSHQKDWKIPLKVLILICIAVASVSSRLFSVIRYESIIHEFDPWFNFRASKILVEQGFYNFLNWFDERSWYPLGRVAGGTLYPGLMVTSGIIFKVLHLLRINVNIRDVCVLLAPAFSGITAIATYYLARELKSDACGLLAAAFMGIAPGYTSRSVAGSYDNEAIAITLLMSTFALWIKAVKSGSSFWGACTGLLYFYMVTAWGGYVFITNMIPLHVFVLLLMGRYTSKLYIAYTTYYVIGTLASMQVPFVGFQPVSTSEHMSALGVFGLLQLFAFYNYVKGLVSSKQFQILIRFALVCLVGLATVVLFALSSTGVIAPWTGRFYSLWDTNYAKIHIPIIASVSEHQPPTWSSLFFDLQFLIWLLPVGVYLCFKELRNEHVFIIIYPVLGTYFCGVMVRLVLTLTPCVCIAAAVAISTLLDTYMGPEVEEDKVSEEAASAKSKNKKGISSILSFFTSGSKNIGIYSLLSRVLVISSTAYFLIMFVYHSSWVTSNAYSSPTVVLSTVLNDGSLMYIDDFREAYDWLRRNTPYDTKVMSWWDYGYQIAGMADRITLVDNNTWNNTHIATVGKAMSSPEEKAYPILRKHDVDYILIIYGGTLGYSSDDMNKFLWMIRISQGLWPDEIVERNFFTPNGEYRTDDAATPTMRESLLYKMSYHGAWKLFPPNQGYDRARNQKLPSKDPQLFTIEEAFTTVHHLVRLYKVKKPDTLGRDLKQVTLFEEGKRKKSAVLQKLTKFL

SEQ ID NO: 60497 - protein, 180 aa, Tolypocladium inflatum
MGNKVFFDIEWEGPVMQGGKPTSTVKEQSGRINFKLYDDVVPKTAENFRALCTGEKGFGYEGSSFHRIIPEFMLQGGDFTRGNGTGGKSIYGEKFADENGQLKHDRPGLLSMANAGPNTNGSQFFVTTVVTSWLNGRHVVFGEVADQESLDVVKALEATGSGSGAVKYNKRATIVKSGEL

SEQ ID NO: 60498 - protein, 348 aa, Cytophaga hutchinsonii ATCC 33406
MSSNNQVLIEEKINETADAVTLVLKQHDSIKNYKSGQFITLLLNIGGEKVRRSYSFSSSPETDSKPSITIKKIQDGKASTYLFNTIKAGDSLEFQQPAGIFTLDKASSESLVFIGAGSGITPLISMIKTALANKKFKKICLIYSNRNEDSVIFKKKLEELKAAYSNFEVIYTYSQPHDTSLPKGRLNQSQFIKIIEHIKDLAVAKTDYFLCGPDGMLEEVKHGLEILQVASSKIHKESFVTTNENDSVFVSVPEHAGDANEVTIMYQGSEYKFTVKPGKTILQSALDEDIDLPYSCMSGLCTACMGKCLSGKVEMGDQDGLSEKEVKNGYVLTCVGRPAVAGTVIEID

SEQ ID NO: 60499 - protein, 570 aa, Pseudomonas syringae pv. phaseolicola 1448A
MGLCGCTRGRPMTQEIGGFAALELHPNIVAAVVATGYEEPSAIQQQSIPIILAGHDMIGQAQTGTGKTAAFALPILHRIDPSKREPQALILAPTRELALQVATAFETYAKQMPGVTVVAVYGGAPMGPQLKAIRNGAQIVVATPGRLCDHLRRDEKVLATVNHLVLDEADEMLKLGFMDDLEVIFKAMPETRQTVLFSATLPQSIRAIAERHLRDPKHVKIQTKTQTVTAIEQAHLLVHADQKTSAVLSLLEVEDFDALIMFVRTKQATLDLASALEAKGYKAAALNGDIAQNQRERVIDSLKDGRLDIVVATDVAARGLDVPRITHVFNVDMPYDPESYVHRIGRTGRAGREGRALLLVTPRERRMLQVIERVTGQKVAEVRLPDAQAVLDARIKKLTNSLSPLVADAESTHGDLLDRLTADIGCSPRALAAALLRKATNGQALTLAAIERERPLVPNNAPRGDRPERSGSSDRGDRPERERRAPVPLAEGRARCRTALGARDGIAAKNLLGAILNEGGLAREAIGRIQVRDSFSLVELPEDGLERLLTKLKDTRVAGKQLKLRRYRED

SEQ ID NO: 60500 - protein, 123 aa, Picea sitchensis
MALLSAQSCVPQQLNIGVNGSNRHLRGISKPNSHAGVSARVAGGRHRINAFFNPPDDPIVQKALKEPIAFFGGVFAGLLRLDLKEDPLREWVARTTEAAGLDEDQDPEPKSEEDTTPQQIEIE

SEQ ID NO: 60501 - protein, 365 aa, Pseudomonas syringae pv. phaseolicola 1448A
MGALLKQEKFLLLAIIAMFVAYPLEHVLLGNGQVVALVSGLALVGFIVCASMRVAHHAEMLAEKVGDPYGTMILTLSAVLVEVVILAIMMSNEPSPTLVRDTIYSAVMLDINGILGLAALMGGIKHGEQSYNDDSARTYSVMIFTAMGVSMVVPEFIPKGDWKIYSAFTIGAMILLYTLFLRMQVGPHSYFFSYSYPEKKKRQGSDQAEQHAEPVNLTRSIVTLVTGVVVIGALAEVMSKTVDLGLEGTGAPPVMTAILVAAISAAPEILTALRAALANRMQSVVNIALGASLSTVILTVPVMEAMALYSGQPFQMAMTPVQTVMIFITLLVSAINLNDGETNAIEGMTHFVLFATFIMLSCLGL

SEQ ID NO: 60502 - protein, 364 aa, Oryza sativa
  misc_feature (107)..(107): Xaa can be any naturally occurring amino acid
  misc_feature (134)..(134): Xaa can be any naturally occurring amino acid
MESDASTSPRRRSTSCYSDSGDSSCSEPFSECGSDDLSFTPAAAAGIHRLLLSCAAEASDGTISSLVAELESPSSSLDSLRRAAMELRLLAKHNPDNRIRIAAAGAXRPLVALLSHADPAPGGSTASRGLLNLXSICDENKAIIVEAGAIRPLVHALKSAASPAARENAACALLRLSQLDGSAAASIGRAGAIPLLVSLLETGGARGKKDAATALYALCSGARENRLRAVEAGAVRPLLDLMADPETGMVDKAAYVLHSLVGIAEGRSAAVEEGGIPVLVEMVEVGSPRQKEIATLSLLQICEDSAAYRTMVAREGAIPPLVALSQSSSARPKLKTKAEALIEMLRQPRSASLRARPTAVVAAE

SEQ ID NO: 60503 - protein, 339 aa, Bradyrhizobium japonicum USDA 110
MTNLRPVIVTGAAGFIGMHVCERLLARGEQVVGIDALTPYYDPALKRARLATLEHRPGFSFHEIDLADFAAVTRVFDEVSPDRVVHLAAQPGVRASIDDPITSIRANCDGFVTVLEAGRRHGVAHLVYASSSSVYGANRTLPYSTEHSVNHPVSLYAASKKANELMAHTYAHVHKLPVTGLRFFTVYGPWGRPDMAAWLFTRAIFANEPIKIFNNGDMWRDFTYVDDIVEGVIRTLDRPATPNPAWNAEAPENSTSYAPYRVYNIGNNRSVNLIEFVETLEKIIGKPAIRKLLPMQAGDVLETRADISALQRDVGFAPSTPLAEGLGRFVEWYRKYHGV

SEQ ID NO: 60504 - protein, 351 aa, Neptuniibacter caesariensis
MSYRVAINGYGRIGQCVLRAIYESGLENLFQVVAINELSDLETVTYLTRYDTTHGRFPVPVGHNGKQLLVNGDTIQILSESDAEDLPWADLGIDLLFECSGSFKARSLAELHLHSGAQRLLFSQPATDEVDATIVFGLNEQLLRPEHTVVSAASCTTNCIIPVLDLLDKHLGIENGVTTTIHSAMNDQPVIDSYHQTDLRLTRSAMHSIVPVDTGLDKGIDRLLPHLAGKFQCLHVRVPTINVSMMDLSINVTQSTSVEEVNQLLQRASMEGPLQGLLGYTEEPHASVDFNRDSRSAVVDGTQTKVSEGRLIKLVCWFDNEWGFANRMLDVAQHWLALKAGPETDPEETNS

SEQ ID NO: 60505 - protein, 267 aa, Zea mays
  misc_feature (228)..(228): Xaa can be any naturally occurring amino acid
MAEHLASIFGTEKDRVNCPFYFKIGACRHGDRCSRIHNRPTISPTIVLMNMYQRPDMITPGVDAQGQPIDPRKMQEHFEDFYEDIFEELSKFGEIETLNVCDNLSDHMIGNVYVQFREEDQAAAAHTALQGRFYSGRLIIVDFSPVTDFREATCRQYEENTCTRGGHCNFMHVKQIGKDLRKKLFGRYRRSQRGRSRSPSPHHRRERRDRDDYRGRDDFRRGGGGGGXDGRGGSSRHERHDDGGRRRYGGSPPRRAKSPVRENSEER

SEQ ID NO: 60506 - protein, 438 aa, Bradyrhizobium japonicum USDA 110
MRIAMIGTGYVGLVSGACFADFGHDVTCVDKDEKKIAALHRGEIPIYEPGLDELVATNVKAKRLDFTTDLSKPVADADAVFIAVGTPSRRGDGHADLSYVYAAAKEIAQSLSGFTVVVTKSTVPVGTGDEVERIIRETNPNADVVVASNPEFLREGAAIRDFKFPDRVVVGTSDERARKVMGDIYRPLSLNQAPLMFTARRTAEMIKYAANAFLATKITFINEIADLSEKVGANVQEVARGIGLDNRIGTKFLHAGPGFGGSCFPKDTKALIKIAQDYDVSLRIVESVLAVNENRKRAMARKVSQALGGSLRGKTIAVLGLTFKPDTDDMRDAPSIPLVTGLIDMGAKVKAFDPVGMEQAKSELPSITYCEDAYSCAQGADALVVVTEWVQFRGLDLDRLKSVMAQPVVVDLRNIYSPEDMHAAGFTYESVGRPSSQA

SEQ ID NO: 60507 - protein, 387 aa, Neptuniibacter caesariensis
MSVLKMSELDLSGKRVLIREDLNVPVKNGEVTSDARIRASLPTIELALKAGAKVMVMSHLGRPTEGEYNEEFSLQPVANHIGKLLGREVPLIKEWLDGGFDVAEGELVLLENVRFNVGEKKDNEALSQKMAALCDVYVMDAFGTAHRAQASTHGVAKFAEVACAGPLLAGELDALGKALDKPARPLAAIVGGSKVSTKLEVLTALSDQVDQLIVGGGIANTFLAAAGKPVGKSLCEHDLIPVAQDLMKKVNIPMPVDVVVAKEFAETAEATVKSVDDVAEDDMILDIGPQSSQNLAELLKDAGTIIWNGPVGVFEFDQFGEGTKTLSLAIAENQGFSIAGGGDTLAAVDKYDIADKVSYISTGGGAFLEFVEGKKLPAVAALEAKNS

SEQ ID NO: 60508 - protein, 512 aa, Pseudomonas syringae pv. syringae B728a
MPHTNVPTPPLSEVYDIAVIGGGINGVGIAADAAGRGLSVFLCEKDDLASHTSSASSKLIHGGLRYLEHYEFRLVREALAEREVLLAKAPHIVKPMRFVLPHRPHLRPAWMIRAGMFLYDNLGKREKLPASRTIHFGADSPLNPSITRGFEYSDCWVDDARLVVLNAMSARENGAHIHTQTRCVSARRIKGMWHLHLERSDGSLFSIHAKALVNAAGPWVAKFIREDLKLDSAYGIRLIQGSHLIVPKLYEGEHAFILQNEDKRIVFTIPYLEHFTIVGTTDREYQGDPNKVDITEGEMDYVLKVANDHFKKQLSRADVLHTFSGVRPLCNDESDNPSAITRDYTLSLSGGADEAPILSVFGGKLTTYRKLAESAMAQLAPFFKQMKPSWTAKAALPGGEDMTTAEALATEMTRRCSWLPAPIAKRWSITYGSRSWRLLEGAQSLEDLGQHLGAGLYTREVDYLCDQEWATSIEDILWRRTKLGLFTTPEEQAAVSSYLETVVRNKASFEAA

SEQ ID NO: 60509 - protein, 113 aa, Glycine max
  misc_feature (28)..(28): Xaa can be any naturally occurring amino acid
MASSMIWSAAVTTVNRAGAGMVAPFTGXLKSLLGFPTGRPTIAFTSMVGTVGGVHCLQVWPPIARKKFGTLSYLPDLDDAQLAKEVEYLLRKGWIPRLEFELEHGFVYREHNR

SEQ ID NO: 60510 - protein, 396 aa, Pasteurella multocida subsp. multocida str. Pm70
MFENITAAPADPILGLGESFKAETRDNKINLGIGVYKDAKGNTPIMRAVKEAEKRLFDLEMSKNYLAIDGVAEFNACTKELLFGADSEIVKQGRAKTVQSLGGTGALRIAAEFIKRQTKSQNVWISTPTWPNHNAIFNAVGMTIREYRYYDAENKCLDWDNLIADLSNAGEGDVVLLHGCCHNPTGIDPTPAQWQQLAKMSEEKGWLPLFDFAYQGFANGLEEDAFGLRTFAKNHKELLVASSYSKNFGLYSERVGAFTLVAETEQIAATALTQVKTIIRTLYSNPASHGATTVSMVLKDSQLRAEWENELTEMRERIKQMRSQFVELLKAFASEQDFSFIIDQNGMFSFCGLNPAQMDRLKEEFAIYAVRSGRINVAGITEQNIRYLCESIAKVL

SEQ ID NO: 60511 - protein, 216 aa, Colwellia psychrerythraea 34H
MKPIKPTIIAIAGPSASGKTLFAKTIHDELIDELGDSGISIIYEDAYYRDQSHLSMQEREQTNYDHPSAFEHELLSEHLKKLTENQMINSPVYCYKTHTRLDESKKFLPTKIILVEGILLLSNKELRECFDIKVYMDTPLDICLIRRIKRDLVERNRSIESVTNQYLATVRPMYYQFIEPSKAWADIVITRGGKNRMAIEVIKAKIRQLSQLPPQQ

SEQ ID NO: 60512 - protein, 115 aa, Prochlorococcus marinus str. AS9601
MKSWTCIENCGACCKFDLNERSDLANKLNKEDKALINSMTAKDGWCKNLDRENRKCLIYETRPHFCRVSEFSTSFKGYLKSGDKFLIDCCKQHISSNYGYQSKEMKTFRIAVSGK

SEQ ID NO: 60513 - protein, 432 aa, Colwellia psychrerythraea 34H
MTTVTTPATFTELGLITPLLARLAELEYHQPTPIQARAIPSVFAGRDLIAGANTGSGKTATFALPMLQKLREDISSGSKNSKGNFVTGLVLVPTRELAKQVADSIKSYAVHFNGEIKTLAVFGGVSVNIQMLALRGGVDILVATPGRLLDLISSNAIKLDKVKTLVLDEADRMLSLGFTEELTALLALTPKKKQTLLFSATFPEQVTTLTQELLNNPIEIQLQSADASTLVQRVFTVNKGEKTAVLAHLIQQEQWRQALIFVNAKHHCEHLAEKLAKRGITAAVFHGDKGQSERSRVLDGFKAGDIEVLIATDIAARGLDIEKLPVVINFNLPRSPSDYMHRIGRSGRAGEVGLAISLIDHEDYHHFSVIEKKNKFRLKREQVEGFEAAEITGDSILAVEKPMAAPEGTGKKKRKKKTSVNADIWSGYSKPE

SEQ ID NO: 60514 - protein, 197 aa, Desulfococcus oleovorans Hxd3
MIIRSAEFVISAVQPSQYPDTDLPEIAFAGRSNVGKSSMINLLVNRKNLVKTSSTPGKTRLINFFDINGQLMFVDLPGYGYAKVSRKEQKTWGPMVERYLSSRKTLRGLMLLMDLRREPREDEFLMMQWCAHYDIPWKMVLTKADKFKKTAADRRRHEIARAVGIGADEMILFSTLQKMGRDPALETIARMTGILEE

SEQ ID NO: 60515 - protein, 158 aa, Zea mays
  misc_feature (85)..(85): Xaa can be any naturally occurring amino acid
  misc_feature (139)..(139): Xaa can be any naturally occurring amino acid
MGSSPGSTAADKTRPSNKCQRPLAVAAMESTFIMIKPDGVQRGLIGEIISRFEKKGFYLKALKLVNVHNDAAWRHRTVFIQFSIXEMGIIMKDFDQPGHLLPTVLVLYPTNYMVIQGECDAVMRGKKASCPITVKKTGXSSAVVIYVELMTPVECTLL

SEQ ID NO: 60516 - protein, 470 aa, Chlamydophila pneumoniae CWL029
MNKKKRFLSLLFLTAVLLGIWFSPHPASINSNAWQLFAIFTTTIMGIIFQPVPMGAIAIIGISTLLLTQTLTLEQGLSGFHNPIAWLVFLSFSIAKGIIKTGLGERIAYFFVSALGKSPLGLSYGLVITDFFLAPAIPSVTARAGGILYPVVTSLSDSFGSSAEKGTQDLIGSFLIKVAYQSSVITSAMFLTAMAGNPLVAALAGHVGVSLSWVLWAKAAIIPGLPSLFLMPIILYKLYPPKITSCEEAIRSAKLRLKEMGPLKKEEKTILMIFFLLVVLWTFGDLLGISATTAALIGLSLLILTNILDWQKDVIANTTAWETFIWFGALIMMASFLNQLGFIPLVGDSAAALVSGLSWKIGFPLLFLIYFYSHYLFASNTAHIGAMYPIFLAVSISLGTNPIFAALTLAFASNLFGGLTHYGSGPAPLYFGSHLVTVQEWWRSGFALSIVNIVIWIGIGSLWWKALGLI

SEQ ID NO: 60517 - protein, 254 aa, Shigella boydii
IVAAGIKEILLVTHASKNAVENHFDTSYELESLLELRVKRQLLAEVQSICPPGVTIMNVRQGEPLGLGHSILCARPAIGDNPFVVVLPDVVIDDASADPLRYNLAAMIARFNETGRSQVLAKRMPGDLSEYSVIQTKEPLDREGKVSRIVEFIEKPDQPQTLDSDIMAVGRYVLSADIWPELERTQPGAWGRIQLTDAIAELAKKQSVDAMLMTGDSYDCGKKMGYMQAFVKYGLRNLKEGAKFRKGIEKLLLE

SEQ ID NO: 60518 - protein, 561 aa, Oryza sativa
TPRLNTKPRKNLRLRHRHRRRRRHGRHRRRGPHPPPPRGPEEALRGAPTPARHPTPTGSSSHIDVDVATEADLRENGFRSTRRTKLVCTVGPASCGADELEALAVGGMNVARVNMCHGDREWHRGVIRAVRRLNEEKGFAVAVMMDTEGSEIHMGDLGGAAAAKAEDGEIWTFSVRSFEAPPPERTIHVNYEGFAEDVRVGDELLVDGGMARFEVVEKLGPDVKCRCTDPGLLLPRANLTFWRDGSIVRERNAMLPTISSKDWLDIDFGISEGVDFIAVSFVKSAEVINHLKSYIAARSRGSDIAVIAKIESIDSLKNLEEIIRASDGAMVARGDMGAQIPLEQVPSVQQKIVKLCRQLNKPVIVASQLLESMIEYPTPTRAEVADVSEAVRQRADALMLSGESAMGRYPEKALSVLRSVSLRIEKWWREEKRHEELELKDVSSSFSDKISEEICISAAKMANKLEVDAVFVYTNTGHMASLLSRCRPDCPIFAFTTSTSVRRRLNLQWGLIPFRLSFSDDMESNLNRTFSLLKARGMIQSGDLVIALSDMLQSIQVMNVP

SEQ ID NO: 60519 - protein, 288 aa, Xanthobacter autotrophicus Py2
MTTLAALGFGYCVHHLVAGEPAAFSRVVGTARTAERLAVLPAGVEPVLFDGESLSAVLADALAGTDLIIASAPPDARGDPILRCAGTVLEAGQLRQVVYLTTLGVYGDHGGDWVDEATPPRAGSPRLERRLAAEHEWFAFGQKRGIPVSVLRLAGIYGPGRNALEQLRAGEARRIDKPGQVFNRIHVADIARTIRAVVDRRFDGILNVTDDLPAPPGDPIAYAAGLLGLPVPPAIPFDEAARDMSPMALTFWAANKRVANHRLKSELGVSLAYPTYREGLKALYDSGA

SEQ ID NO: 60520 - protein, 171 aa, Clostridium thermocellum ATCC 27405
MDLKAKLREVPDFPKEGINFIDITTVLQDPEALKECIDSMKKKVESFGEFDIIVGAESRGFIFGAPLAYALGKGFVPIRKKGKLPYKTISVEYELEYGTDILEMHIDAIKKGQRVVIVDDLLATGGTTKSNIKLVEQLGGEILGIVYFVELTFLNGREKLKGYNVESIVQY

SEQ ID NO: 60521 - protein, 186 aa, Xanthobacter autotrophicus Py2
MFIQTETTPNPATLKFLPGRSVLGEGTLDLRSHDDADLSPLAQRLFDVRGVAAVFLGSDFVTVTKAEAEWPQIKPAILGAIMEHFMSGAPVLSDGVKPEVADADEFYEAKDAEIVATIKELLDTRVRPAVANDGGDITFRGFKDGIVFLNMKGSCSGCPSSTATLKNGIENLLKHFVPEVTEVQAV

SEQ ID NO: 60522 - protein, 433 aa, Burkholderia sp. 383
MSLNDDPTFWRNARQHLVRYGGTFEPLIIERAKGSFVYDADGRAILDFTSGQMSAVLGHSHPEIVSVIGEYAGKLDHLFSGMLSRPVVDLATRLADVTPAGLDRALLLSTGAESNEAAIRMAKLVTGKYEIVGFAQSWHGMTGAAASATYSAGRKGVGPAAVGSFAIPAPFTYRPRFERNGAYDYLAELDYAFDLIDRQSSGNLAAFIAEPILSSGGIIELPEGYMAALKRKCEERGMLLILDEAQTGVGRTGTMFACQHDGVTPDILTLSKTLGAGLPLAAIVTSAAIEERAHELGYLFYTTHVSDPLPAAVGLRVLDVVQRDGLVARANVMGDRLRRGLLDLMERFDCIGDVRGRGLLLGVEIVKDRRTKEPADGLGAKITRECMNLGLSMNIVQLPGMGGVFRIAPPLTVSEAEIDLGLSLLEQAIRRAL

SEQ ID NO: 60523 - protein, 443 aa, Clostridium thermocellum ATCC 27405
MNMIPKVAMFGTGYVGLVSGVCIADFGINVICVDVDKEKIDGLNNGKIPIYEPGLDVFLERNIKAGRIQFTTDAKMAIEESNVLFIAVGTPPKENGEADMQYVYAVAETIGQYMNGYKVIVDKSTVPVGTGQVVKKIIADKLKERGVEYSFDVVSNPEFLREGKALYDFTHPDRVVIGVESEEVAEIMKKVYRPLYINETPFVITNIETAEMIKYASNAFLATKITFINEIANLCEKVGANVQQVAMAMGRDGRIGPKFLHAGPGFGGSCFPKDTKALVQIAEKHGVQMSVVNAVIEANERQKKMVAEKLEKFAGDLKGKTIGILGLAFKPETDDVREAPALTIIADLIERGASIRAYDPQAMEEAKKALRKYADNITYCKHAYDTAESVDALVIVTEWHEFRNMDLTLLKKIMRGNIFYDARNIYSRKDIEEKGFVFIGTGV

SEQ ID NO: 60524 - protein, 446 aa, Methanosarcina acetivorans C2A
MEKDYDIIIIGTGTSGRTFADKVASSGLKTAIIDSREYGGVSPPIGCDPKKMFVDIAEITDWNNRLIGKGAGTQNPLKIDWPSLIEFRRTFTEKCSRKTENHFVELGIDTYHGKAYFENKNTVAVGEDKLKGEYIFLATGAKPRKLNIPGEEYIITSGEFMETEKLPERIIFIGGGHISMEFSHITLKAGSEAIILHRSEKLLKSFDSDMVNFLINESEAAGIKIFTNKPVIAVEKEGNSFLVRAGSESEIRSFRADMVVHGAGRVPYIEELHLEKAGVRVEGGAIEVDKHMRTSNPRIYAGGDCASEGMQLTPVAAYQGEVAAVNILTEDSVEADYKGIPSAVHTMPVLASVGISTVKDSDKYKIIFRDRSSEKTGRSEGADFVASKVIIDEANDRIMGAHILGPNAGEAINIFAAVMRLGLKASDMKKMIFSYPTVCSDIPYML

SEQ ID NO: 60525 - protein, 653 aa, Chlorobium tepidum TLS
MKSVNLIIDGRSVQAAPGQTILEAARENGIRIPTLCFHKEIEATGSCWICIVEIKGKNRFIPSCSTKVSEGMVVETSNAELDAMRRQSLERLLARHCGDCLAPCELACPAGCDIPGFVSAIAKGNDREALEIIRRTIPLPGILGRVCPAPCEEACRRHGVDEPVSICALKRFAADQDMVEGSGLPERKPASGKRVAIVGAGPAGLTAAWYLLLDGHAVTVLDANEKAGGMMRYGIPKFRLPEAVIDADVKPLVKMGAEFRFSTLFGKDANLEELQQEHDAVLLTIGASQASKLGIPGEELDGVQSGIGFLANVADGKAAAPGKSVIVIGGGNTAIDAARTALRLGAESVTILYRRGREEMPANRLEIEEAVAEGVELRLLAAPVAIEKGANSLVVTAVEMQLGEPDASGRRRPVPVAGSEFTLHADTVISATGQQVDLPAEAAAGIGVERNGTVKINGESMLTGAAGVFAAGDCVSGPDLAIKAVRQGRLAAEAIDRYLNGGDPAATGMSMFNSSYGARDKAPHQFYDRARPAARVAVPELEAESRRQSFEEAVTGYDPEKAREEAKRCLRCRCQAVDDCRLRNLATAFGVATPATEEAHEYFSIDRSGDMRFEREKCIDCGICIRTLESASADAVTIREELIDHCPTGAISR

SEQ ID NO: 60526 - protein, 571 aa, Streptococcus sp.
  misc_feature (1)..(1): Xaa can be any naturally occurring amino acid
  misc_feature (15)..(15): Xaa can be any naturally occurring amino acid
  misc_feature (28)..(28): Xaa can be any naturally occurring amino acid
  misc_feature (63)..(63): Xaa can be any naturally occurring amino acid
  misc_feature (116)..(116): Xaa can be any naturally occurring amino acid
  misc_feature (131)..(131): Xaa can be any naturally occurring amino acid
  misc_feature (138)..(138): Xaa can be any naturally occurring amino acid
  misc_feature (209)..(209): Xaa can be any naturally occurring amino acid
  misc_feature (266)..(266): Xaa can be any naturally occurring amino acid
  misc_feature (298)..(298): Xaa can be any naturally occurring amino acid
  misc_feature (400)..(400): Xaa can be any naturally occurring amino acid
  misc_feature (482)..(482): Xaa can be any naturally occurring amino acid
  misc_feature (504)..(504): Xaa can be any naturally occurring amino acid
XRGSHHHHHHGSACXFSNKTRQDSIQKXQQEELDLLIIGGGITGAGVAVQAAASGIKTGLIEXQDFAEGTSSRSTKLVHGGIRYLKTFDVEVVADTVGERAVVQGIAPHIPKPDPXLLPIYEDEGATTFNXFSVKVAXDLYDKLANVTGTKYENYTLTPEEVLEREPFLKKEGLKGAGVYLDFRNNDARLVIDNIKKAAEDGAYLVSKXKAVGFLYEGDQIVGVKARDLLTDEVIEIKAKLVINTSGPWVDKVRNLNFTRPVSPKXRPTKGIHLVVDAKKLPVPQPTYFDTGKQDGRXVFAIPRENKTYFGTTDTDYQGDFTDPKVTQEDVDYLLDVINHRYPEANITLADIEASWAGLRPLLIGNSGSPSTISRGSSLEREPDGLLTLSGGKITDYRKXAEGALRLIRQLLKEEYGIETKEIDSKKYQISGGNFDPTKLEETVTELAKEGVAAGLEEEDATYIADFYGTNARRIFELAKEXAPYPGLSLAESARLRYGLEEEXVLAPGDYLIRRTNHLLFERDQLDEIKQPVIDAIAEYFGWTEEEKAQQTKRLEALIAESDLRELKGEK

SEQ ID NO: 60527 - protein, 464 aa, Thermoanaerobacter tengcongensis MB4
MAVKDRVPMREQDPKVRIKNFDEVALGYTEEEAILEASRCLQCPNPTCVAGCPVHVRIPEFIKAITERKFEEAYKIITSTNSLPAVCGRVCPQEEQCEKNCILNRIGKPIAIGRLERFVADYALQNNIEEEVKPEKKNKKVAIIGSGPAGLTCAGDLLKMGYDVTIFEALHALGGVLTYGIPEFRLPKRIVEAEIERLKKLGAKVETNVVVGKTVTIDELMEEEGFEAVFIGTGAGLPRFMGIPGENLNGVYSANEFLTRINLMKAYKFPEYDTPIAVGKRVAVIGGGNVAMDAARSALRLEGVEEVIVVYRRSKEEMPARAEEIEHAIEEGIKFEFLANPIRINGTEDGWVKSMDVIRMKLGEPDSSGRRRPIEIPGSEFTMEVDTVIMALGTSPNRLIPSTTKDIQVQKWGGIITDEDGRTSRPGVFAGGDAVTGAATVILAMGAGKKAAKAIDEYLRSKGE

SEQ ID NO: 60528 - protein, 755 aa, Hyphomonas neptunium ATCC 15444
MTTQRPSFTDQEALDFHSHPTAGKISMVPTKPMGTQRDLSLAYSPGVAIPVLAIAENPDKAYDYTSKGNLVAVISNGTAILGLGNLGPMASKPVMEGKSVLFKRFADIDSFDVEVDTTDVEDFIRTVRNIGATWGGINLEDISSPACFIIESRLRDELDIPVFHDDQHGTAIIAAAGLINACHITGRQLKDTKVAISGAGAAGLSVAGLIRHLGVKAENILICDTAGVVYEGRTEKMDQFKSAFAVKTAKRTLTEAMDGADVFLGLSVKGAVTKEMVKSMAKNPIIFAMANPDPEITPEEIKSVRSDAIIATGRSDYPNQVNNVLGFPYIFRGALDVRARGINEEMKVACARALAELAREDVPDEVAAAYHGARPSFGREYIIPSPFDPRLISFVPPFVAQAAMDTGVARKPIADMDNYRRSLIRRADPSAAFLQGLQARARETQRRIVFAEGEEPAVVRAAYSFKNQGLGHPILIGREAQVERAMEQMGIPLGSLDIINARLSDKNPVYVDFLYERLQRRGYLKRDVQRLVNQDRNIFGSCMLKNGDADGMVTGVTRNYDAALKDAMLVLDPIAGQALIGMSMVINLGKTIFIADTSVHELPDGPTLANIALEAARAVRALGFTPRVAFLSYSTFGNPMGERGDRVREAVAILDQRTDIDFEYEGDINADVAMNPNHRMVYPFSRLSGPANVLVMPAIHSASIATNLLEAMSRATVIGPMLFGLEKPVQISSLGATVGDIVDLATIAAYDTDNV

SEQ ID NO: 60529 - protein, 366 aa, Triticum aestivum
MSTPTGNFVRPFHPDVIGNAFAQQYYRVLGSSPEHVHKFYHDESILGRPDSDGPLTSITTTYAINQHFLSTDMKGCLIQLDNVDTQPSHGGGVLILVTGSLTMLDTVKHRFVQSFFLAPQENGGYFVLNDVLRAVPEMPLAETNEALVDHVDGNTQIAPFPAEPETSVNESMDPELPSAGNISTNGEVINPSAETIPVDAEVINPSAENISISDEVVEPSVESISSKEKVINSFGNENSQIKNDAIKIPEVAPTPASAQKDVIKKTYASIVKATNESIPPAPITKPKPKPKPRPNPTVKRAENVEKSSSVPAKTMHASLTVPPNDQNISDDQGYSIFVKNLPWNATIEMVDAEFIKFGSIKPRGIQ

SEQ ID NO: 60530 - protein, 572 aa, Yarrowia lipolytica CLIB122
MSPRFSRRSVVHSTKGMVASTQPLASAIGARVLDQGGNAAMAGIAVAAALNLLEPHQTGVGGDMFALFYDAKTKKVEGLNGSGRSPKALTVDYLRKHGVEGPRIPLTSPHTITVPGAVGGWCDIYERWGNKKLTMAEILEPVAQLAEEGAPISEVSAKLWKDHGPKLLKTDSAGADLLVKDDSAETGYRAPYAGEVFKNPGLAAVLREIGAKGRDGFYKGWVADSILEILQKRGSLMTREDLENHTSSFVEPIAIEIKDNIKLWELPPNGSGLVAIIAVGVIKALDRQGKISLEGLKLNSAEYLHVAVEALKFAFREADEYVSDPDHHDVSLEELLSETKYDELANRFDTSKIHPNYDDNVINPIHKSDTVYFAITDRWGNACSFIISIFDGFGSSTVPAGTGFCLQNRGLNFNLTEGTRNCLAGGKRPYHTIIPAMVTKGDDLWACYGVMGGFMQPQGHVQVLLNMINFGLDPQQALDAPRFCLSAGKGIDFGKGTHGPCSKHETVVNLEETIDPEVVETLKNLGHTVNVVSGEDAWALFGRGQVIRQDENGVYHAGSDPRGDGQAVPILL

SEQ ID NO: 60531 - protein, 239 aa, Desulfitobacterium hafniense DCB-2
MDFSGKDKAAYVQDTFNSIAKRYDVMNTLMSFGLDKGWRKKAVQTVEAKPGMTMVDICCGTAQLSLELAMTVGEQGHITGLDFSENMLKKAQENLAGSPYRSIIELRQGDAMNLPFADNSFDGATVGWGLRNLPDLEKGVQEMIRVVKPGGMVVSLDMAKPTMPGFKQGYWLYFNKLVPLMGKIWAGKAKAYQYLHDSAVEFPSQQELANIFARCGLTETRYQNLAGGVVAIVSGRKPR

SEQ ID NO: 60532 - protein, 170 aa, Triticum aestivum
  misc_feature (10)..(10): Xaa can be any naturally occurring amino acid
  misc_feature (60)..(60): Xaa can be any naturally occurring amino acid
MAGARSKVNXPHKTRFASKASRQSRKIDKVRSGKPAGRHRAAVKGARAARLQNRKAMRYXKRAALLKDKRSSNGSSPAPRVIVLCGLYSSANVGSLAQDLLIFASRGDEILILNTVASPAYRLRTMVMPAPDGDLHSCMELGKVADLLPFLGTANSVYHIDSGDPNDELG

SEQ ID NO: 60533 - protein, 387 aa, Pseudomonas syringae pv. phaseolicola 1448A
MTVLKMTDLDLQGKRVLIREDLNVPVKDGVVSSDARILASLPTIRLALEKGAAVMVCSHLGRPTEGEFSAENSLKPVADYLSKALGRDVPLVADYLDGVDVKAGDVVLFENVRFNKGEKKNADELAQKYAALCDVFVMDAFGTAHRAEGSTHGVAKFAKVAAAGPLLAAELEALGKALGAPAQPMTAIVAGSKVSTKLDVLNSLSGICNQLIVGGGIANTFLAAAGHKVGKSLYEPDLLDTARAIAAKVSVPLPTDVVVAKEFAESATATVKLIADVADDDMILDIGPQTAAHFAELLKSSGTILWNGPVGVFEFDQFGEGTKTLAKAIGESQAFSIAGGGDTLAAIDKYGVAEQISYISTGGGAFLEFVEGKVLPAVEVLEQRAKA

SEQ ID NO: 60534 - protein, 327 aa, Desulfitobacterium hafniense DCB-2
MQKIKLIATGGTIAMRKDSFGKTVPAVTGHDLLESIPELQESAFWNVEEFSNVASCNFNPERMLQLARRVEEAFADPDCMGIIITHGTDTLEETAYFLELTVKDSRPVILTASQRDASERDSDGPRNLHNSMRIAMDPHAKERGVLIALNEEIHAARDVRKLHTSHVDAFSSGEVGSLGSIDHDEVLWHRKPEPSIKFDLPEKLAKVMICKGYTGMDGRMLECMVDAQVEGIVIEAFGRGNLPPEVVPSIGKITAENIPVVITSRCLFGRTAPIYGYPGGGAELQRRGALFAGDLSTEKVRLLLSIALGQNVSHTRLKEILSRGGVK

SEQ ID NO: 60535 - protein, 560 aa, Dehalococcoides ethenogenes 195
MSFESFNFAPAVMAGVRACGYQEPTPIQAQAIPPILEGHDVIGLAQTGTGKTAAYALPVIQKMLSTPRGRVRTLVLAPTRELACQIAESFRSLGQRARIRECSIYGGVNMDQQIRRLRSGVDVVVACPGRLLDHIWRGTIDICGVETLIIDEADRMFDMGFQPDIQSILKCLVQPHQTLLFSATMPPEVRKLTLETQTNPVTIQIGTQAPASSVSHSVYPVKNHQKTPLLIEILKTTETKSVLIFARTKYGAENLADEISRAGFTTASLQGNLSQNRRHAVMEGFRRGNFKILVATDIAARGLDIDHISHVINYDMPDTPEDYTHRIGRTGRFDRTGQALSLVTGRDGDMVRDIQKLINSPIQRLRVDGFDYATTRNDGQNHSQRRGFAPRRGYSAEGYNRSEMPAAETSPNSLTAEMPSGNVRPFSQAVRSGRPADSAPRFRREGYSAPRFGGRPSFEDAPMAAKPVARFNARPAFRKEDDAQAAAKAYPSFGRETGVTSAENTRSVSENPEQFSSRRPARFNGKASFANRPARPGNKVGKPPFFRRSKPPVSENNPTY

SEQ ID NO: 60536 - protein, 219 aa, Populus alba x Populus tremula var. glandulosa
MTDVKLHGFWASPFCYRVIWALKLKGVEFEHIEEDLTNKSELLLKYNPVYKKIPVLVHGGKPIAESLVILEYIEETWPENPLLPTDPYERAMARFWIQYGVTKGAALVALYRASGEELEKAVKEVVEVLRVLEEQGLGDKKFFGGDSINLVDISYGLFTCWFAAMEEAMGVKVLEPSTLPRLHAWAQNFIEVPLIKENIPDNDKLLLFMKGFREKLVNE

SEQ ID NO: 60537 - protein, 786 aa, Gibberella zeae PH-1
MASEDAGFDMSDGFGLQRPNFHIGYHNSNSNEPLTDIQYGHLLNHGLAFVTTPITNTHFRDRVFALVSEHLSTLSSNGEKPTTTATGSRAEPILPPLTTKDTGLFPCAAVNTYTAVISPWIDLGSSNPIISSISRQVLNVEINYANFCGVRSIIIPGPRQDASIDGGNQSLAQYSRAVEEALTVGNRLTFLVQMPMYREPGQESKEVNISSLDVKTPTKTEGKEIDLLAAWDSWHHVRSVCNYNTRLFVSLEIPRVMPEKALQDRWFAEPLHYLTFSPSTFQANKAGFPSLSKHHQNLIFSYMRLKNVPWILLCDVGPDVSHLNESPQAPPTSQVEFPSLSEAETQNQLPKGQASQVKTNDYISYLRWLEDQQPPFTYLESPTLTSFQDWLQSPLQPLSDNLESATYEVFEGDPVKYSQYEIAVFEALTEWKELKKPLSKEGKVVVAVAGSGRGPLVTRALKASEDAGVPIDMWAVEKNPNAYVYLLRQNELVWGGKVRVVKTDMRAWKGPVVSEDENGPVYGKVDILISELLGSFGDNELSPECLDGIQHVMSTPHGISIPSSYTAHMSPISTPKIHGDILSRVPGDPHAFETPWVVRLFALDFVAERVPNKPRFQEAWEFSHPIPESSLAALEAKRSGGVVGGGGGSMAGAAGANDHNSRYCHLTFVCRTRGVTHGLAGYFESTLYESQIPDNKGAKIEISTHPERIDDKSKDMISWFPIFFPLKKPLYFPADTELEVSMWRQTDDTKVWYEWLVEAYTWVGASTRVKVASSDLCSSRQVACLM

SEQ ID NO: 60538 - protein, 216 aa, Pasteurella multocida subsp. multocida str. Pm70
MKTLTFYLIRHGKTEWNEKRLLQGNGDSPLTQEGIEGAKRTAKALSNIDFTAAYSSVLPRAISTANMILAHKTTPLICHAGLNELCFGSWEGQAIEELSCLPEYRQMRDQPAQYLGLTNGGETYQQLATRAIGVIEQIIQRYDTGNILIVSHGHTLRMLLALFHGATWQTHREKSTSLANTSISVVHYLQTENETGRFVLEKVNDIQHLTDSFDEE

SEQ ID NO: 60539 - protein, 336 aa, Desulfococcus oleovorans Hxd3
MAEGLSWTVYDADTLTQAEIYGQVLCDLGKMRPDIVGLSADLAKSTKIGKFQDHFPDRFFNVGIAEQNLFGVAAGLAKSGLLPFVSTMAAFTAMRAAEQVRTDICYQNLNVKIIATHGGASFGQAGTTHHCTEDIAIMRSFANMTVIVPADGIETANAVKQCVNWPGPVYIRIGRGFEPRYYDSEEYGFQIGKAVELASGTDITLICCGITVFHAMEAAKILKENDGLSVRVLNMHTIKPLDTEAVLKAVTETRRVIVFEEHNLIGGLGSAVAEVIADNGKGCAFKRVGIPDCYCEVGYPEDLYTHYKLDADGVLETVREVMNMDFEEDEDWEDEV

SEQ ID NO: 60540 - protein, 592 aa, Kluyveromyces lactis NRRL Y-1140
MSDITEKTAEQLENLQINDDQQPAQSASAPSTSASESEASSVSKVENNNASLYVGELDPNITEALLYDVFSPLGPISSIRVCRDAVTKASLGYAYVNYTDYEAGKKAIQELNYAEINGRPCRIMWSERDPAIRKKGSGNIFIKNLHPAIDNKALHETFSTFGEVLSCKVALDENGNSRGFGFVHFKEESDAKDAIEAVNGMLMNGLEVYVAMHVPKKDRISKLEEAKANFTNIYVKNIDVETTDEEFEQLFSQYGEIVSAALEKDAEGKPKGFGFVNFVDHNAAAKAVEELNGKEFKSQALYVGRAQKKYERAEELKKQYEQYRLEKLAKFQGVNLFIKNLDDSIDDEKLKEEFAPYGTITSARVMRDQEGNSKGFGFVCFSSPEEATKAMTEKNQQIVAGKPLYVAIAQRKDVRRSQLAQQIQARNQIRFQQQQQQQAAAAAAGMPGQYMPQMFYGVMAPRGFPGPNPGMNGPMGAGIPKNGMVPPPQQFAGRPNGPMYQGMPPQNQFPRHQQQHYIQQQKQRQALGEQLYKKVSAKIDDENAAGKITGMILDLPPQQVIQLLDNDEQFEQQFQEALAAYENFKKEQEAQA

SEQ ID NO: 60541 - protein, 293 aa, Crocosphaera watsonii WH 8501
MAKIRVGINGFGRIGRLVFRAGINNPDFEFVGINDLVPAKNIAYLLKYDSTHGRFDGTVEATDEGIVVNGKLIPCFAIRNPEELPWGQLEVDYVVESTGLFTTHETASKHLKAGAKRVVISAPTKDPEKVNTFVVGVNDDQYDPTKDYIVSNASCTTNCLAPIAKVINDNFGLAEGLMTTVHAMTATQPTVDGPSKKDLRGGRGAAQNIIPASTGAAKAVTLVIPELKGKLTGMALRVPTPDVSVVDLTFKTEKATSYEAICAAMKAAANGELKGVLGYTDEDVVSMDFNGRS

SEQ ID NO: 60542 - protein, 109 aa, Zea mays
ASEYLYEILTNANVVKKKIPVLLCCNKTDKLTAHTKEFIRKQMEKEIEKLRASRSAVSTADIANDFTIGIEGEVFSFTHCSNKVTVAEASGLTGETIQIEDFIREYIKP

SEQ ID NO: 60543 - protein, 770 aa, Arabidopsis thaliana
MVAPALLPELWTEILVPICAVIGIAFSLFQWYVVSRVKLTSDLGASSSGGANNGKNGYGDYLIEEEEGVNDQSVVAKCAEIQTAISEGATSFLFTEYKYVGVFMIFFAAVIFVFLGSVEGFSTDNKPCTYDTTRTCKPALATAAFSTIAFVLGAVTSVLSGFLGMKIATYANARTTLEARKGVGKAFIVAFRSGAVMGFLLAASGLLVLYITINVFKIYYGDDWEGLFEAITGYGLGGSSMALFGRVGGGIYTKAADVGADLVGKIERNIPEDDPRNPAVIADNVGDNVGDIAGMGSDLFGSYAEASCAALVVASISSFGINHDFTAMCYPLLISSMGILVCLITTLFATDFFEIKLVKEIEPALKNQLIISTVIMTVGIAIVSWVGLPTSFTIFNFGTQKVVKNWQLFLCVCVGLWAGLIIGFVTEYYTSNAYSPVQDVADSCRTGAATNVIFGLALGYKSVIIPIFAIAISIFVSFSFAAMYGVAVAALGMLSTIATGLAIDAYGPISDNAGGIAEMAGMSHRIRERTDALDAAGNTTAAIGKGFAIGSAALVSLALFGAFVSRAGIHTVDVLTPKVIIGLLVGAMLPYWFSAMTMKSVGSAALKMVEEVRRQFNTIPGLMEGTAKPDYATCVKISTDASIKEMIPPGCLVMLTPLIVGFFFGVETLSGVLAGSLVSGVQIAISASNTGGAWDNAKKYIEAGVSEHAKSLGPKGSEPHKAAVIGDTIGDPLKDTSGPSLNILIKLMAVESLVFAPFFATHGGILFKYF

SEQ ID NO: 60544 - protein, 344 aa, Mycobacterium smegmatis str. MC2 155
MRVVQSLRAPYATVLKPYGSALVNLARQKSNIVCLGADLTRQTETDLFRDQLGDRFFNGAMSEQNLMGVAAGLARTGHQVFVNTFGVFATRRPYEQVAMQIAYANLDVKIVGLMPGLSTPGGPSHQATDDIALMRALPNMTVIDVADAREIPQAVTAISEIAGPVYMRLKRGEIPVLFDEDHRLDLDNVVVVDGEADEREPVDLTIFATGMMVATSLAAADALRGIGICVNVVNVACLKPLDTAGVLREARRSAAVVTAENHSVIGGLGSAVAEVMAEAGLAVPLRRVGIQDTFARAASARYLFEHYGLSSQYLVDNAAALCGRDAPYPQVVEVPQEVGAYSPV

SEQ ID NO: 60545 - protein, 479 aa, Phyllanthus calycinus
SALEKKNLGRIAQIIGPVLDVAFPPGQMPNIYNALVVKGQDTAGQQINVTCEVQQLLGNNRVRAVAMSATEGLMRGMEVIDTGAPLSVPVGGATLGRIFNVLGEPVDELGPVDTRTTFPIHRSAPAFIQLDTKLSIFETGIKVVDLLAPYRRGGKIGLFGGAGVGKTVLIMELINNIAKAHGGVSVFGGVGERTREGNDLYMEMKESGVINEDNIAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPQIVGEEHYETAQRVKQTLQRYKELQDIIAILGLDELSEEDRLTVARARKIERFLSQPFFVAEVFTGSPGKYVGLAETIRGFKLILSGELDSLPEQAFYLVGNIDEATAKATNLE

SEQ ID NO: 60546 - protein, 522 aa, Glycine max
MGQSPSTSAAPPSDLNRLQIAQLHPNTDSDSTDYTLRLSDDCLAAIFHFLNTADRKRCSLVCLRWRLVDGQRRHRLSLNAQPELLDFVPSLFNRFDSVTKLALRCDRKCASINDEALVLISLRCRNLTRLKLRGCRDITELGMAGVGDNCKALKKLSCASCMFGAKGIAAVLDRCFTLEDLTLKRLRGVHHIGDMAVGAAASLKSICLKELVNGQSFAPLLIGSKKLQTLKVIGCTGDWDETLVRVGCSNNGLVEVHLEKLQVTDVGLVAVSKCLGLDTLHVVKTAECSDVGLCAVAERCKLLRKVHIDGWRTNRIGDDGLVAIAKHCLNLQELVLIGVYPTFSSLAAIASNCGNLERLTLCGIGTVGDAEIECIADKCVALRKLCIKGCPVSNAGIGALASGCPNLVKLKVKKCKRITGKGVEWVREQRVSLAFNYDDSEFEALDGGASDGVGGAQHNTVEFLPNIINQTTVAEAEASSSNNNNRMTMLRSRFGFSAGRNLVPGAFRRWSNSDNVSSSSFG

SEQ ID NO: 60547 - protein, 479 aa, Phyllanthus cf. decipiens Hoffmann et al. 162
SALEKKNLGRIAQIIGPVLDVAFPPGQMPNIYNALVVKGQDTAGQQINVTCEVQQLLGNNRVRAVAMSATDGLMRGMEVIDTGAPLSVPVGGATLGRIFNVLGEPVDELGPVDTRTTFPIHRSAPAFIQLDTKLSIFETGIKVVDLLAPYRRGGKIGLFGGAGVGKTVLIMELINNIAKAHGGVSVFGGVGERTREGNDLYMEMKESGVINEENIAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPQIVGEEHYETAQKVKQTLQRYKELQDIIAILGLDELSEEDRLTVARARKIERFLSQPFFVAEVFTGSPGKYVGLAETIRGFKLILSGELDSLPEQAFYLVGNIDEATAKATNLE

SEQ ID NO: 60548 - protein, 429 aa, Arabidopsis thaliana
MIGAVNSVEAVITSIQGLSGSPEDLSALHDLLRGAQDSLRAEPGVNFSTLDQLDASKHSLGYLYFLEVLTCGPVSKEKAAYEIPIIARFINSCDAGQIRLASYKFVSLCKILKDHVIALGDPLRGVGPLLNAVQKLQVSSKRLTALHPDVLQLCLQAKSYKSGFSILSDDIVEIDQPRDFFLYSYYGGMICIGLKRFQKALELLYNVVTAPMHQVNAIALEAYKKYILVSLIHNGQFTNTLPKCASTAAQRSFKNYTGPYIELGNCYNDGKIGELEALVVARNAEFEEDKNLGLVKQAVSSLYKRNILRLTQKYLTLSLQDIANMVQLGNAKEAEMHVLQMIQDGQIHALINQKDGMVRFLEDPEQYKSSEMIEIMDSVIQRTIGLSKNLLAMDESLSCDPLYLGKVGRERQRYDFGDDFDTVPQKFSM

SEQ ID NO: 60549 - protein, 1870 aa, Oryza sativa
MAKATTGICLVDVILFSFFLVAPRAFAAAAAVTDTLRGGRNITDGETLVSADGTFTLGFFSPGVSAKRYLGIWFTVSPDAVCWVANRDSPLNVTSGVLAISGAGILVLLDGSGGGHVAWSSNSPYAASVEARLSNSGNLVVRDASGSTTTLWQSFDHPSNTLLPGMKMGKNLWTGAEWDLTSWRSPDDPSPGAYRRVLDTSGIPDVVLWQDGVERYRSGPWNGRWFSGNPEAATYTTNLITFQVTVSPGEISYGYVSKPGAPLTRSVVLDTGVVKRLVWEATSRTWQTYFQGPRDVCDAYAKCGAFGLCDANAPSTSFCGCLRGFSPTSPAAWAMKDASGGCRRNVPLRCGNTTTTDGFALVQGVKLPDTHNASVDTGITVEECRARCVANCSCLAYAAADIRGGGGGSGCVIWTGGIVDPRYVDQGQGLFLRLAESELEGIPHNPATTVPSVDLQKVKAATGNFSQSHVIGQGGFGIVYKGQLPDGRMIAVKRLHQSTLTKKGKKDFTREVEVMARLRHGNLLRLLAYCSEGSERVLIYDYMSNRSLDLYIFGDSGLRLMLNWRKRLGIIHGIANGVAYLHEGSGECVIHRDLKPPNVLLDDSFRPKIADFGTAKLFTADQPEPSNLTVVVSPFGVVLLETLSGQRNGPMYSLLPHAWELWEQGRVMSLLDATIGLPLSVSGPDHTEMEDELARCVQIGLLCVQDAPEERPAMSAVVAMLTSKSSRVDRPKRPGVHGGRSRPPLRESELLGATDIDDDLTTTTGAELGDTLGKGRNITDGERLVSAGGSFTLGFFSPASSSSSSTSRRYLGIWFSVSDDVVCWVANRDRPLTDTSGVLVITDAGSLLLLDGSGHVVWSSNTTTGGGASMAAQLLESGNLVVSDRGNGGAGAVVVWQSFDHPCDTLLPGMKIGKNLWTGAEWYLSSWRSSGDPSPGNYRYRTDTKGVPENVLWDGDGEVYRTGPWNGLWFSGIPEMGTYSDMFSYQLTVSPGEITFGYSANAGAPFSRLVVTGVGEVQRLVWEPSSRAWKNFFQGPRDLCDDYGKCGAFGLCDAGAASTSFCSCVEGFTPASPSPWKKMRDTSAGCRRDAALGCATDGFLAVRGVKLPDAHNATVDKRVTVEECRARCLANCSCVAYAPADIEGGGGGGAGSGCIIWADDLVDLRYVDGGQDLYVRLAKSELAATAAVHARPNPALAAPSINLSSVKEATGNFYESNIIGRGGFGIVYQGKLPSGRKVAVKRLTQSLVTDKRKEDFIREVEMMSNTRHAYLVELLCYCQEGGEMILVYEYMENMSLDLYIFDIIRGIAIGVEYLHNVKVIHRDLKPSNILLDDNWRPKVADFGTAKLFINDQTDPTLVLSAGYIAPEYAAQGNLTLKCDVYSFGVVLLEIISGKRNRTLPTFLRDTWESWKQHEIEDILDLGLIKPEPDLLLGLDRCIQIGLLCVQQSPDDRPTMNQLTQAKQLHPGDVLGSKSGVFALGFFSPGTSNKSLYLGIWYHNIPQRTYVWVANRDNPISTPSSSVMLAISNSSNLVLSDSEGRTLWTTNITITGGDGAYAALLDTGNLVLQLPNETIIWQSFDHPTDTILPNMKFLLRYKAQVSRRLVAWKGPNDPSTGEFSLSGDPSLDIQAFIWHGTKPYYRFVVIGSVSVSGEAYGSNTTSFIYQTLVNTQDEFYVRYTTSDGSANARIMLDYMGTFRFLSWDDSSSSWTVRLQRPASTIDCYTYASCGPFGYCDAMLAIPRCQCLDGFEPDTTNSSRGCRRKQQLRCGDGNHFVTMSGMKVPDKFIPVPNRSFDECTAECNRNCSCTAYAYANLTIAGTTADQSRCLLWTGELVDTGRTGFGDGQNLYLRLAYSPGMPTFFPLQLQYNS

SEQ ID NO: 60550 - protein, 320 aa, Crocosphaera watsonii WH 8501
MKIAHNITELIGHTPLVQLNRIPQAEGCKAQIVVKLEGMNPAASVKDRIGVNMINAAEKEGFIIPGKTLLVEPTSGNTGIALAMAAAAKGYKLILTMPETMSQERRAMLKAYGAQLELTPGSEGMGGCIRRGQELAETLPNAYMLQQFNNPANPEIHRLTTGEEIWEDTDGRVDFLIAGVGTGGTLTGVAEVIKQKKPSFQAIAVEPTSSPVLSGGSPGGHKIQGIGAGFVPGVLKVELIDEVVTVTDEEAMSYGRRLAKEEGLLSGISTGAALCAAIKVGQRPENIGKLIVMVQPSFGERYLSTPLFQDVEPPQLAMVH

SEQ ID NO: 60551 - protein, 449 aa, Saccharomyces cerevisiae YJM789
MGLCASSEKNGSTPDTQTASAGSDNVGKAKVPPKQEPQKTVRTVNTANQQEKQQQRQQQPSPHNVKERKEQNGSINNAISPTATANTSGSQQINIDSALRDRSSNVAAQPSLSDASSGSNGKELKVLLLGAGESGKSTVLQQLKILHQNGFSEQEIKEYIPLIYQNLLEIGRNLIQARTRFNVNLEPECELTQQDLSRTVSYEMPNNYTGQFPEDIAGVISTLWALPSTQDLVNGPNASKFYLMDSTPYFMENFTRITSPNYRPTQQDILRSRQMTSGIFDTVIDMGSDIKMHIYDVGGQRSERKKWIHCFDNVTLVIFCVSLSEYDQTLMEDKNQNRFQESLVLFDNIVNSRWFARTSVVLFLNKIDLFAEKLSKVPMENYFPDYTGGSDINKAAKYILWRFVQLNRANLSIYPHVTQATDTSNIRLVFAAIKETILENTLKDSGVLQ

SEQ ID NO: 60552 - protein, 347 aa, Clostridium thermocellum ATCC 27405
MSKIDLRNKIIFITGVAGFIGAYFAKQLLDTVDGITIIGIDNMNDYYDVKLKESRLESLCNNSKFIFVKGNIADKELINNIFNTYHPQIVVNLAAQAGVRYSITNPDAYIESNIIGFYNILEACRHSYDEGKVPVEHLVYASSSSVYGSNKKVPYSTEDKVDYPVSLYAATKKSNELMAYTYSKLYNIPSTGLRFFTVYGPAGRPDMAYFSFTNKLAQGKKIQIFNYGDMYRDFTYIDDIVKGIVLVLQKVPEPMEDGVRYKIYNIGNNKPENLMHFVEVLEKCLMEEGIITKPGEKELLPMQPGDVYQTYADVDDLVRDFGFKPSTSLEEGLSKFAKWYREFYMQK

SEQ ID NO: 60553 - protein, 286 aa, Saccharomyces cerevisiae YJM789
MTYTLAILGCGVMGQALLSAIYNAPKAADETAAAFYPSKIITCNHDEPSAHQVTDLVETFDESPNGIKVESTYGHNVSAVEEASVVLLGTKPFLAEEVLNGVKSVIGGKLLISLAAGWTIDQLSQYTSTVCRVMTNTPAKYGYGCAVVSYSADVSKEQKPLVNELISQVGKYVELPEKNMDAATALVGSGPAFVLLMLESLMESGLKLGIPLQESKECAMKVLEGTVKMVEKSGAHPSVLKHQVCTPGGTTIAGLCVMEEKGVKSGIINGVEEAARVASQLGQKKK

SEQ ID NO: 60554 - protein, 607 aa, Streptococcus sp.
MFSNKTRQDSIQKMQQEELDLLIIGGGITGAGVAVQAAASGIKTGLIEMQDFAEGTSSRSTKLVHGGIRYLKTFDVEVVADTVGERAVVQGIAPHIPKPDPMLLPIYEDEGATTFNMFSVKVAMDLYDKLANVTGTKYENYTLTPEEVLEREPFLKKEGLKGAGVYLDFRNNDARLVIDNIKKAAEDGAYLVSKMKAVGFLYEGDQIVGVKARDLLTDEVIEIKAKLVINTSGPWVDKVRNLNFTRPVSPKMRPTKGIHLVVDAKKLPVPQPTYFDTGKQDGRMVFAIPRENKTYFGTTDTDYQGDFTDPKVTQEDVDYLLDVINHRYPEANITLADIEASWAGLRPLLIGNSGSDYNGGDNGSISDKSFNKVVDTVSEYKENKVSRAEVEDVLNHLENSRDEKAPSTISRGSSLEREPDGLLTLSGGKITDYRKMAEGALRLIRQLLKEEYGIETKEIDSKKYQISGGNFDPTKLEETVTELAKEGVAAGLEEEDATYIADFYGTNARRIFELAKEMAPYPGLSLAESARLRYGLEEEMVLAPGDYLIRRTNHLLFERDQLDEIKQPVIDAIAEYFGWTEEEKAQQTKRLEALIAESDLRELKGEK

SEQ ID NO: 60555 - protein, 275 aa, Rhizobium leguminosarum bv. viciae 3841
MPTKAFSSTHPVVLIGAGNMGGAMLSGWLKSGVPGSAVIVVDPGPSPAMLSTINEAGATHLTALPKDLKASVLFLAVKPQVMETVLPAVKSAVGPDTVVVSVAAGKTLGFLEKHLGKAAMVRAMPNTPAMVGRGVTGAFANSGVSDPQRERVHSLLRVSGPVEWVPAEADIDAVTALSGSGPAYVFYLVECMAEAGRKLGLQADLAMRLARETVAGAGELMHQSPDDASRLRENVTSPGGTTAAALAVLMAEDGMQPLFDAALAAARKRAEELAG

SEQ ID NO: 60556 - protein, 512 aa, Thermoanaerobacter tengcongensis MB4
MGIKRETILILDFGGQYTQLIARRIREANVYCEIVPYDISPEEIKKIDPKGIVLSGGPASVYVKNAPKCDKEIFELGYPVLGICYGVQLMTELLGGKVAPAPVREYGKTEVVINNTIPLFKGIERDTIVWMSHTDQIELPPPDFKVVASTENCPIAAIANVEKKLYGVQFHPEVSHTHRGTEIIRNFLFEVCDCSADWTMDSLIEQTVKEVRAKVGNHKAVCALSGGVDSAVAAVLVDRAIHDQLVCIFVDTGLLRTNEGDMVIETFRKNYDMNIIRVDAKDRFLSRLKGVTDPEEKRKIIGNVFIEVFKEEAMKIGDVKFLVQGTLYPDVIESGHGISSTIKSHHNVGGLPEDIGFELIEPLRMLFKDEVRQVGKELGIPDEILYRQPFPGPGLAVRIVGEVTEEKLEILRLADSIVQREMKRFGWYNKVWQSFAILPGIKSVGVMGDERTYGYAIILRVVDSMDGMTADWTKLPYEILESISTSITNEVPGVNRVLYDITSKPPATIEWE

SEQ ID NO: 60557 - protein, 298 aa, Mesorhizobium loti MAFF303099
MKKIRKAVIPVAGLGTRFLPATKSMPKEMLPVVDRPVVQYAVDEAFEAGIEHIVFVTGRNKAVIEDYFDLHPELIGTLEQTGKKTQLEALESMLPVAGATSFIRQQSPQGLGHAVWCAREVIGNEPFALLLPDMVSFGGRGCLAETVDLYERTGGNVIAVERCDPSETNKYGIVGRGADIGGGFEVTAMVEKPAPANAPSNFYINGRYILQPEIFALLGNQQRGAGNEIQLTDAMVRLSKDQPFFAQPFLGRMFDCGSKEGFIQANIAFALARNDMKGPVFEMLQEFVRSHERQEEAA

SEQ ID NO: 60558 - protein, 446 aa, Shigella boydii
MSKQQIGVVGMAVMGRNLALNIESRGYTVSIFNRSCEKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLSNEELAQTFTEWNNGELSSYLIDITKDIFTKKDEDGNYLVDVILDEAANKGTGKWTSQSALDLGEPLSLITESVFARYISSLKEQRVAASKVLSGPQAQPAGDKAEFIEKVHRALYLGKIVSYAQGFSQLRAASEEYNWDLNYGEIAKIFRAGCIIRAQFLQKITDAYAENPKIANLLLAPYFKKIADDYQQALRDVVAYAVQNGIPVPTFSAAVAYYDSYRAAVLPANLIQAQRD

SEQ ID NO: 60559 - protein, 540 aa, Bordetella parapertussis 12822
MSNIVEIKVPDIGDFKEVEVIEVLVSAGDTIKAEQSLITVESDKASMEIPASAAGVVKSVKVKVGDKIAEGTVILEVEAAGEAAAAPKAEQAPEAAEAPKADAAKAEAPAAAGPIEVKVPDIGDFKEVEVIEVLVAEGDTIKAEQSLITVESDKASMEIPASAGGVVQSLKVKVGDKVAMGTVIAVVQGQGAAAPAAKAEAPAAAEPAASASASAPAPAQRPAPAAALQDEDLKPGQLPHASPSVRKFARELGVNLSRVTGSAAKGRITADDVRAYVKQALSAGAPAGASGGGDGAALGLLPWPKIDFTKFGPIEAKPLSRIKKISGANLHRNWVMIPHVTNNDEADITDLEALRVALNKENEKSGVKVTMLAFLIKAVVAALKKFPEFNASLDGDNLVLKQYYHIGFAADTPNGLVVPVVRDADKKGILELARETSELARKAREGKVSPAEMQGGCFSISSLGGIGGTHFTPIINAPEVAILGVSRSAHKPVWDGKQFVPRLTLPLSLSYDHRVIDGASAARFNAYLGQLLADFRRIAL

SEQ ID NO: 60560 - protein, 591 aa, Bordetella parapertussis 12822
MSNIVEIKVPDIGDFKEVEVIEVLVAAGDTIKAEQSLITVESDKASMEIPASSAGVVKSVKVKVGDKVAEGTVILDVEAAGEAAAAPKAEAPKAEAPKADAPKAPAAKASAPAAAAYSGSADLECDMLVLGAGPGGYSAAFRAADLGMDTVMVERYATLGGVCLNVGCIPSKALLHNAAVIDEARALAAHGISFGEPKVDLDKLRGYKDGVVAKLTGGLAGMARACKVRVATGTGEFADPHHLTVTDGEGKKQTIRFKQAIIAAGSQSVKLPFLPDDERIVDSTGALQLRAIPKKMLIIGGGIIGLEMGTVYSTLGARLDVVEMLDGLMQGADRDLVKVWQKMNAPRFDNIMLKTKTVGAEARKDGIYVSFEGEGAPKEPQRYDLVLQAVGRSPNGKKIGAERAGVAVTERGFIEVDRQMRTNVPHIYAIGDVVGQPMLAHKAVHEGHVAAEAAHGEKSFFDARVIPSVAYTDPEVAWVGLTEDEAKKQGVKVEKGLFPWAASGRAIANGRDEGFTKLLFDAETHRIVGGGIVGTHAGDLISEIALAIEMGADMVDIGKTIHPHPTLGESVGMAAEVAEGVCTDLPPMRKK

SEQ ID NO: 60561 - protein, 499 aa, Oryza sativa
MPPHEDALDAGAVDVLTFRLHPLAVLKLSHRIREFVHLHDDQYQQARMSGCVIGVRRGGTVDISDTFDILHDPDPGTFDRALLEKDQEIYKKAFPDLSVLGWYSIGTNVHATDTGIHHGDYTDMQIHQTLMDANGTAFYLLLNPAINFSHKDIPVTIYERVLCNSDGSPPVSFVQGNYTVEIVGAERISLDHADFLYPSPCVVFDVLAPPLGEKKNAFRTMLFETPSGFAMFRVSDVLFRYPEDIWSSFTDPHTAHQVVRTIGFIEVGDKSVVWDNDIGPGEDIEHFILKFPIKSLVVPDAQLKFIIEKNLNISCWFNGRIVPGLIWGLNYALDEFVPREKGNLSNERHFPLSKQLHEQLKAYGFSISPQLINREFITSFGYLNYLERTSNCISGDLHQKFDRFFCGLEMSEGEFVRGVAHRLHSMEEVASTPGRREALSNAEFLLAVPKKKCNTISRLKRMEAEDRGTGLGHPWVCAAAVAVGFGVMAGLCIAMKRAN

SEQ ID NO: 60562 - protein, 268 aa, Neptuniibacter caesariensis
MSQNPECPTWLWDEISAEAEREVIEEPVLAGFYHANILGHQSLCSALAYLLSRKLYDDAVPAVTFRLVIEEVFREAPEILQAVCADIAAVRNRDPAIDKYSTVLLYLKGFHAIQAYRVAHHMWNQGRKSMALYIQSRVSCVLQVDIHPAAKIGQGVMFDHATGIVVGETSVIENDVSILQSVTLGGTGKECGDRHPKIREGVMIAAGAKIFGNIEIGSGAKVGGGSVVLDGVPAHTTVVGVPARAVGHPQCDKPALDMDQNILHDKEK

SEQ ID NO: 60563 - protein, 493 aa, Ustilago maydis 521
MMNTKLKDLSLLEASDFLKAPDSLDTSDNESFDVMDPGSGRPICRLTASNLKDVDYAIQAASQAFPSYSAIPARERAMLLLNFDKLIRDNLDDLAWILVYETGKPLEEARAEVQYALTFSWWYVGETERVQGQVVKSATNPSLRYLTVWQPVGPVAILTPWNFPVALFVRKAVSALAAGCTIVAKPSPETPLSTLAVANLLHRAGFPSGSVNIVLASYRNTPAIGQALCTDLRIKKLSFTGSTRVGRLLMQQCAPTLKKLTLELGGLGAYLIFDDADIEAAATALVANKLRHAGQTCISAQRTFVHESIVDRVLKCIIELLDRVTLGHGAQPSTTLGPLQTERSQQKVREHIEDARAKGATVYTSKAAVPSSGYFVAPTLIVGCTAEMLVFQEESFGPLISLTSFATEQEAVALANKTDMGLTSYVFTKDSARLWRMFEQLKAGNVGLNVGGSTTAAEIPFGGVDQSGFGKEAGIGAGLKEYMVEKSATMSIA

SEQ ID NO: 60564 - protein, 241 aa, Prochlorococcus marinus str. AS9601
MRKSVIAGNWKMHMTCAEAKSYLKEFIPLIKDINEDRKVVIAPPFTAISTFSNHSDFDYLDISSQNIHWEDQGAFTAEISPKMLLEHGVSYAIVGHSEPRKYFSESDEQINKRAVFAQSSGLTPIVCVGETLEQRERGEAVRVITRQVEQGLENTDPSNLIVAYEPIWAIGTGKTCQAEDANKICSLIRKLIGFDDVIIQYGGSVKPNNIDEIMSMSDIDGVLVGGASLDPNSFARIANYQ

SEQ ID NO: 60565 - protein, 210 aa, Glycine max
  misc_feature (139)..(139): Xaa can be any naturally occurring amino acid
  misc_feature (188)..(188): Xaa can be any naturally occurring amino acid
MAEHLASIFGTEKDRVNCPFYFKIGACRHGDRCSRLHTKPTISPTLVLSNMYQMFYMNMNIITNPDQPQPQSLDPDKVQDHFDDFYEDLFEELSKYGPIQSLNICDNLADHMVGNVYVQFREEDHAANALMNLTGRFYXRQYEENVCNRGGYCNFMHLKKISRDLRRKLFGRNRRWNGRSGSRKQSPXQGNRTMGEHLHSGRGSGRRDFD

SEQ ID NO: 60566 - protein, 537 aa, Ustilago maydis 521
MGSKYHYTPRRISNDHFGIDIGLRGNALLSVITATCAVAFCTVGIENGLLGGVINTTQFKETFNDPDANTIGNIVSLYEIGCVIGALSTFVVGDVLGRRRTILLSSILMLIGAAIQAASSTVGVMIAGRIISGLGMGAINSTVPILQAETSPAVSRGQLVALDLTVLNIGIVFAYWMDYGFAYSGLTGSKVWRIPVALQSVFIIVLVLTTLIIPDSPRWLAKKGRHEEAIAVLERLHNASIDSPEVQNSYAGIQQALEHERAAANTGWASLVAKDSIQTRKRLFLACFIQAAQQLSGINALIYYSGTLFSKSIGLDDKKSALMAGGLNMCLILGSIISIFFIDRVGRKKLLIPCIAGMSAVMCVQTGLVKVIQDGTQNANYGRAASAMLFVFEFFFSLGFQATVWLIPSEVLPLLIRTKGSALSTASNWIFNFAIVKFTPSALQNIGWRTYIIFAVLNACWVPVIYFFLPETKGRSLEEIDELFATDDWHIDNSHAATDTKAAAHRSGDVEYADIDAGSNKSSFKGDNIVTSTGDSK

SEQ ID NO: 60567 - protein, 304 aa, delta proteobacterium MLMS-1
MAKHLLALADFSGEELRALIDRALQMKRESKAGGRHRALEGRSVALIFEKPSTRTRVSFEAAMYGLGGQVIYLSSRDTQLARNEPLKDMARVMARYVDGLVVRTFGQEIVEELARYSAVPVINALTDLHHPCQVLSDLMTVIEHQGELERLKIAWVGDGNNMANSWLQAAARLGFALTLACPEGYEPDAGILAAARAAAARPINLVADPREAVADADVVNTDVWASMGQEDEQLHRLQIFRPFQINEELLAEAAAGAIVLHCLPAHRDEEISEAVLEGPRSVVWEQAENKMHIHKAILATFLDR

SEQ ID NO: 60568 - protein, 318 aa, Cryptococcus neoformans var. neoformans B-3501A
MTQPQQPLSLLESFLCGGLAGCGAVTITNIPETMKTRLQLQGELQRNDPSAPRVYRNVLDVFRKTWQHEGIRGLQRGLVPAYGYQTLLNGSRLGLYEPCRRLFNRAIGKDPNEGVFITAITAGAVTGCIGASLGSPLFLIKARMQAYSPHIPVGAQHYYKNSYDALRTILKSDGFFGLWRGVSTAILRTAMGSSVQLPSYNLSKYYLVSSAGMASDSFWTFLAASSVSGVCVCIAMQPPDTALTRMYNQNTIKDPITGKVRGALYTNPFDCLWKTFKAEGIAGWYKGTTAHFLRITPHTIFTLVFNELIMAEYTKWRG

SEQ ID NO: 60569 - protein, 288 aa, Brassica napus
  misc_feature (116)..(116): Xaa can be any naturally occurring amino acid
MENGDIPENANEHCPGPQSESAGKSDSCAGCPNQEACATAPKGPDPDLVAIAERMSTVKHKILVLSGKGGVGKSTFSAQLSFALAGMDHQVGLMDIDICGPSMPKMLGLEGHEIHXQSNLGWSPVYVEENLGVMSIGFMLPNSDEAVVWRGPRKNALIKQFLKDVYWRDIDYLVVDAPPGTSDEHISIVQYLQATGIDGAIIVTTPQEVSLIDVRKEVSFCKKVGVPVLGVVENMSGLSQPLADVTFMKVQSELGLSVDVTHEVISCLRKNAPELCHVLAYSEVFDRS

SEQ ID NO: 60570 - protein, 214 aa, Triticum aestivum
MAGEADGKTYQVSRMPPAALNERILSSMSQKHVAAHPWHDLEIGPGAPAVFNCVVEIPRGSKVKYELDKATGLIKVDRVLYSSVVYPHNYGFIPRTLCEDNDPMDVLVLMQEQVVPGCFLRARAIGLMPMIDQGEKDDKIIAVCADDPEYRHFRDISELPPHRLQEIRRFFEDYKKNENKEVAVNDFLPAEDAINAIKYSMDLYGSYIMEGLRK

SEQ ID NO: 60571 - protein, 351 aa, Triticum aestivum
MTEACCKTAIVHTLRFRSSETRPRATAAMDPDTEVDFDFSPFLIRYKSGRVHRLMGASRVDTGTDAATGVTCKDVVIDAGAGLAARLYLPKDVPRSEKLPVLVYFHGGAFAVHSAFSGTHHRFLNALVAAAGVVAVSVDYRLAPEHPLPAAYDDAWAALGWALASCAPSAGREPWLAEHGDAARVFVAGDSAGANIAHHMATRAGGGENGLPAGARIEGLVLLHPYFRGKDLVPSEGTDPRFLQRVERSWGFVCAGRYGTDHPFIDPLAMPAEDWAALGCRRALVTVGELDTMRDRGRMYVEALRGSAWTGKEAVLYQTDGEGHVYFLEKSGWGDKAEREMDAVVSFIKRS

SEQ ID NO: 60572 - protein, 377 aa, Zea mays
MAPRGSREEASSGSEDEEEEAGFSRSYFLAKEKEPSSVKKRARAAAGKLSDLNLVDEQVLRASLAQIPPKHKEEVESLTRSYKDQYRNWLFELRCGFGLLMYGFGSKKQLLEDFASTTLTNFTVVVINGYLPAVNLKQVIATIAEMFWDQTKAKRRKRAGTRSQLSQQFPSQSTEGIISFLMRQTSDDVDDHVCLLIHNIDGPALRDTESQQCLAQISCCPQIRVVASIDHVNAPLLWDKKMVHKQFKWSWYHVPTFAPYKVEGVFYPLILASGGHAQTTKTALVVLQSLTPNAQSVFRVLAEYQLANEKEEGMPVSSLYTKCRERFLVSSQVTLNAHLTEFKDHDLVKVRKHSDGQDCLRIPLVSDALEKLLQELA

SEQ ID NO: 60573 - protein, 489 aa, Bacillus cereus ATCC 10987
MNKELLADKLKVKDAKLFIDGKYVDSVCGETFDTFNPATNRKLASIAKANEEDTKRAIDVAERTFKSGIWSKMPVEERSNILCKMSDLIMERVDELAYIETLDVGKPIKESKGFDIPRSAHNFRFFAEMAKYIVHEHYDKHNFMSYAKYAPAGVTSLIIPWNLPFMQMTWKASAALASGNTVVVKPASYTPLSAVMLGEIANDAGLPPGVLNIITGPGSTVGTKMTTHPAVRRISFVGESNTGKTIMRNASENLIPVSLELGGKSANIVFEDADLDEAVQGSIEAIYRNQGEICLAGSRLLVQESVYEQFLEKFVAAVKRIKVGDPLSEDTDMGALVSKSHLETVDRYVELGISEGAKLAYGGKRVESLVEGNFYEPTILYDVDNSMRVAQEEIFGPVLVVIPFKTEEDAIRIANDSIYGLAGVVWTNDLRRAQRVVSQIDSGLLWINCWYVRDLRTPFGGSKASGIGREGGRHSFEFYTEAKTVTMKL

SEQ ID NO: 60574 - protein, 310 aa, Rhizobium leguminosarum bv. viciae 3841
MKVFAGNSNRQLAEAICNYLNVPLGKASVRRFADQEIFVEIQENVRGEDVFLVQPTAFPANDHLMELLIMIDAMRRSSARRITAVLPYFGYARQDRRASGRTPISAKLVANLITEAGADRVMTLDLHAGQIQGFFDIPTDNLFAMPVLTRDIKSHYDLSNVVVVSPDVGGVVRARALAKRLDCLLAIVDKRRERPGESEVMNIIGDITGKDCLLIDDIVDSGGTLCNAADAMLAKGASSVTAYITHGVLSGGAVTRVTSSKLRELVITDSIQPTTAVLSAHNIRIVTTAPLIGEAISRTAQEESVSSLFD

SEQ ID NO: 60575 - protein, 233 aa, Zea mays
MMEGGSRADGRNPNQLRPFTCTGNPLHRAHGSARWAQGDTVVLAAVYGPKSGTRKGENPEKASIEVVWKPKTGQIGRQEREYEMTLKRTLQSICLLTVHPNTTTSVVLQLMSCAINASCAALAFAGIPMKHLAVAISCGVMDNGVVILDTSRAEEQQARSFAHLVFPNSRKSVESKDTTQRDEESERGLITCITHGAMSEDDYFNCIERGVMASSRISDFMRKTLQKEASRDA

SEQ ID NO: 60576 - protein, 323 aa, Zea mays
MAAGRELVVSFGEMLIDFVPTVAGVSLAEAPAFLKAAGGAPANVAIAVSRLGGGAAFVGKLGDDEFGRMLAAILRDNGVDGGGVVFDAGARTALAFVTLRADGEREFMFYRNPSADMLLTADELNVGLIRRAAVFHYGSISLIAEPCRTAHLRAMEIAKEAGALLSYDPNLREALWPSREEARTQILSIWDQADIVKVSEVELEFLTGINSVEDDVVMKLWRPTMKLLLVTLGDQGCKYYTRDFHGAVPSFKVQQVDTTGAGDAFVGALLRRIVKDPSSLQDEKKLVESIKFANACGAITATKKGAIPSLPTETEVLLLIEKA

SEQ ID NO: 60577 - protein, 105 aa, Magnetospirillum magnetotacticum MS-1
MRLLDATPELLAAHYAEHEGKPFFQPLVDFMLSGKILAVVAEGQGVVPGFRSLAGATNPTEALPGTIRGDLGRDWGLKVQQNLVHGSDSPESAAREIALWFPELG

SEQ ID NO: 60578 - protein, 207 aa, Zea mays
RLRKLHVDGWRTNRIGDFGLMAVARGCPNLQELVLIGVNPTVLSLRMLGEHCRTLERLALCGCETVGDAEIICLAERWAALKKLCIKGCPVSDRGMEALNGGCPSLVKVKLKRCRGVSYECIENLKVTRGGSFSISLDIVLEHDARSASENGAQENGQAQITALTDQMAGMDLPVNAAGAQSSTHTITRMRSVVSALRRRFGNPPPP

SEQ ID NO: 60579 - protein, 433 aa, Haemophilus somnus 2336
MTILVLGINHKTASVALREKVAFSDEKRLLALKQIKQTQLAECAVILSTCNRTEVYLHNKNVGPQNDEVWLDSCVQWFADIHQVDLEELKSCLYSQQNLQASRHLMRVASGLDSLILGEPQILGQVKQAYQMSEEYYSLHSDIGMMSTELSRLFQKTFATAKRVRTETHIGESAVSVAYAACSLARQIFDSLRNLNILLVGAGETIELVSRHLLRHGVNGLAIANRTLSRAEKLVEKLETTQKIDIFSLDRLSEGLKRADIVITSTGSPHVLISRNLIEQAQQMRHYKPMLIVDIAVPRDVEESAGEIESVYHYTVDDLHNIIQHNINQREQASQQAEHIIQQESADFFEWLKVHQFSNLIRNYRESAEIIRQDLLEKALQALQNGENTEQVLQELSHKLTKKLIHQPTQAMQTMVKAGNTEGLQAFSHAVKS

SEQ ID NO: 60580 - protein, 322 aa, Physcomitrella patens subsp. patens
MDKLKKLLQQPDNRLCADCRAPYPKWASTSIGVFICTKCYEVHRDLGAHISTVVSVNLEEWSDEQVEVMEAVGGNAAANSVYEKCIPSDVRKPSPNASIDERTDFIRRKYEDQEFLKPNLRMKATSRTRSSSSTEPTSLNPSALSNRDSVNNNRDSARKEESLGMLKVTIIRGRSLVVRDLLSSDPYVSVSYGTQTFKTGVVNRNLNPVWKEEFYFSVGNPPQPVKLEVFDHDVFSADDSMGTAEVDLNPLILAAQMHQGMFEAFGSEKIGRWLATSDNSLIEDSNIEVIDGVIKQDIIFKLKNVERGELELSLEWVPIHAP

SEQ ID NO: 60581 - protein, 527 aa, Mesorhizobium loti MAFF303099
MRAMRIEGVPASAGYAEGPLFDLDRPPAVYAGKATLAEEKTSLQAAIGTAVSRLSAMAEAADSDAAGILEFHIAMLEDDALRGPAFASITSGQTADVAWREALDAEIAGYEASDQDYFRARATDLRDIRDQVLRALTEDVDSAAPTGAILCGEDIAPTRFLETDWSHGGGIALKAGSTASHVAMLARSRGVPMVVGLREMSASPAGMALLDAEHGSIVLAPSPAEIGAFRQSSASFAARQGKAQRFLARPAVTKAGTAVRVQVNIADPSDVDGIDVATCDGVGLMRTEFLFGKNLPDEETQYRAYRKVLEWAGEKPVTIRTVDAGGDKPVPGFTVEEGNPFLGLRGIRLSLARLDIFRIQIRALLRAAPHGNLRVMFPMIAMADEYERAAALFAEEQAALAAGGVAQKMPPLGIMVEVPSVAIAPEAFAGVAFFSIGSNDLTQYVMAAARDNAAVAHFNSVRHPAVLRLIGSVAAFGRENGIPVSLCGDAGGDPAAIPSLLEAGLRDLSVAPAQLAMAKAAIADVSV

SEQ ID NO: 60582 - protein, 261 aa, Platismatia glauca
VEHGDVKVVAVNDPFIEPHYAAYMLKYDSQHGQFKGTIEVKGSDLVVNGQTVKFYTEKDPANIPWKDTGAYYIVESTGVFTTTEKAKAHLKGGAKKVVISAPSADAAMFVMGVNEKEYKSDIEIISNASCTTNCLAPLAKVMHDNYTIIEGLMTTIHSYTATQKTVDGPSSKDWRGGRTAAQNIIPSSTGAAKAVGKVIPSLNGKLTGMSMRVPTSNVSVVDLTCRLEKSVTYDQIKATMKKASEGELKGIMSYSEDALVS

SEQ ID NO: 60583 - protein, 1143 aa, Physcomitrella patens subsp. patens
MTADLSEVESESRPLRPFSGGGTAWVESNVGIPEGPEWRIKDGFKTQKEVDRGREQVGVNRVVVREKNGARLENGRRITDRSGTAVLKAREGPKDIAEQRMRKLDHQFPANDLLGTSESDEDGRREDSAEDHYEEGDAVAAVACEKQRLLGIAQTREQQHGTDVAAGIQGGDSWESFLLKRKLRVLLVEDDDATRHVVGALLRNCNYEVTSVANGSLAWGLLEEANSNFDLVLTDVVMPCLSGVGILSKMLKREACKRVPIVIMSSYDSLNIVFRCLSKGACDYLVKPVRKNELKNLWQHVWRKCHSGSVGSDYLHLPDKCGCAPSVGHDGMRYELLWTGDGVWRSIGSRSGSGNQTGEVARPQSRGVEAADNPIGSNDGNGSSDGSDNGSSRLNAQGGSDNGSGNQACVQPVQVPRNNAVPEAADGDEEGQATSQDKGAELGYSWIRNKLDACVILLTTSALASTFVELKHVELSFDRELFLLRSGSFLTNSSRGSCEDSKMGHDLEMATRPSACNTTGKDQQPEVARQLDEDAACVFQDAGQSPDGINGESPSSSLRNDAAEESSPKAIDLINVVACQPQTQDAEQPQESENDFDELDPQGSSPKVNSGSDSGPMLELSLKRPRSAVDNDGELEERQPLRYSGGSAFSRCSPYTTTAVSKVLTRLLLTFWKVLTCIMLDIKVGVLRGLLFLLVSLNLPSLLSFFGPILSRYDSGGTIIQQHYQGGSSLPLNGYPMCGAYGVYGMPGGGSGGSLRLGMGMDRIGSSKESVKGLTSPLSHPQNVEKAGGQDGCSSATQTTEDALIVPGMPMAIPIPPPGMLAYDGVGGSYGPAMHPMYYAHPSARIAAPPPHMGERGEVYNQSPAFKEQDSGSGHHSQAGQSHQHMHHHQGNHHHHHHHYHHGNGAQHSGNAGVQDEQQQSVVTLGSGAPRCGSTGMDGQSGSSNGYGSTGNGNGSMNGSASGSNTGVNNGQSGLGAMLMANDNSGSNGAGGTDPSVDGVSGGNGLCTDQMRFARREAALNKFRQKRKERCFEKKVRTFVVRYQSRKRLAEQRPRVRGQFVRQAVYDPSAGMASEHFLYCQCFEMHELAVGKLETDPETSLSSVKQRFLLPHEHGDGRLPPRLVESYIATYNFTNYPPWERPF

SEQ ID NO: 60584 - protein, 278 aa, Cetraria islandica subsp. islandica
VEHGAVKVVAVNDPFIEPHYAAYMLKYDSQHGQFKGTIEVKGSDLVVNGQTVKFYTEKDPANIPWKDTGAYYIVESTGVFTTTEKAKAHLKGGAKKVVISAPSADAAMFVMGVNEKEYKSDIEIISNASCTTNCLAPLAKVMHDNFTIIEGLMTTIHSYTATQKTVDGPSSKDWRGGRTAAQNIIPSSTGAAKAVGKVIPSLNGKLTGMSMRVPTSNVSVVDLTCRLEKSVTYDQIKATMKKASEGELKGIMSYSEDALVSTDLNGDNHSCIFDATAG

SEQ ID NO: 60585 - protein, 192 aa, Physcomitrella patens subsp. patens
MSVAQAGFVASLAVSPASFRKEVTSACTTSGDGLFSRGASCSALLRRKTQHSSTMKSFNVPTRLYITAKQNETSTIKSVPVQVAHELLNAGHRCLDVRTTEEFTAGHVKGAVNIPYLIKTGHGMSKNPKFLAEVEKGFSKDDEILIGCQSGRRSLMAAAELRDAKFTGVIDMGGGYLAWKENGLPVNIPNQA

SEQ ID NO: 60586 - protein, 1056 aa, Physcomitrella patens subsp. patens
MDGLNENINTTQQAFHEEQIASVYGGGAGAQRPVIIGDQNMGSAPKDQKRTSVGTRGGNKGKGKSCEFSLLTGGPLFPNLSEVARAAFVGENLGLAARFNVSSRKRGCAEGRCGRRGVRFMTADLCEFESESDPLQPLSAVGRAWVEPIVGTPVGAEWRIKGGFKAHKEVDRSREQVGSKRVDDREKNSGRLENGCRFADRTGGAVLKAREDPKDIAEQIRRELDHQFPVNDVLRTSESDEDGRREDSAEDHYEEGDAVAAVVFEKQRPREIAQTREQQQGGNAAAAAAGTQGGGGWESFLLKRNLKVLLVEDDDATRHVVGALLRNCNYEVTPVANGSLAWGLLEEANSNFDLVLTDVVMPYLSGVGLLSKMMKREACKRVPIVIMSSYDSLGIVFRCLSKGACDYLVKPVRKNELKNLWQHVWRKCHSSSGSRSGSGSQTGEVAKPRSRGVAAADNPSGSNDGNGSSDGSDNGSSRVNAQGGSDNGSGNQACMQPVQVLRNSAIPEAVDGDEEGQATSQDKGADLDGEMGHDLEMATRRSACVTTGKDQQPEDAQKQDEDAVCILQDAGPSPDGANAESPSSSGRNDAAEESSPKIIDLINVIACQPQTQDAEPQESENDDEELDPRGRSSPKNNSASDSGTSLELSLKRPRSAVGNGGELEERQPLRHSGGSAFSRYGSGGTIIQQYHQTGGSLPLSGYPVSGGYGVYGMSGGSPGGSLRLGMGMDRSGSSKGSVEGTTPPPSHPQSMEKVGGQDGYGNARQTTEDAMIVPGMPMAIPLPPPGMLAYDGVIGTYGPAMHPMYYAHPSAWMAAPSRHMGERGDVYNQSPAFQEQDSGSGNHSQAGQTHQHMHHHQGNQHHHHHHHHHHGSGAQPSGNAGVQDEQQQSVVPPGSSAPRCGSTGVDGRSGSSNGYGSTGNGNGSMNGSASGSNTGVNNGQSGFGATPMLTDNSGSNGVGGTDAAMDGVSGGNGLCTEQMRFARREAALNKFRQKRKERCFEKKTAVGVIGYRCNLQNGRISSVIGHDAGTGAIPKQETACRTKTTSPRSVCAASGT

SEQ ID NO: 60587 - protein, 402 aa, delta proteobacterium MLMS-1
MDNNEWMARGERVLMATYGRLPVTMVRGEGCRLFAADGREFLDFVAGIAVCNLGHCHPAITDAVREQVERLVHVSNLYHSQPQIELAETLVAHSFADRVFFCNSGAEANEAAIKLARRAGGEGRYEIISLTGSFHGRTLATVAATGQPRFHEGFEPLPAGFVHAPFGDLDGLRRLIGPQTCAVLCEPLQGEGGVRPLAPEYLAAIRELCDERGLLLIFDEVQVGMGRAGSLLAHQQLGVVPDIATLAKGLGNGLPIGAMLATEQVAAAFTPGSHASTFGGNPVVCAAANAVLEIMLAPGFFEGVRQRGEYLRGRLEELVARYPRQLVEVRGMGLIQGLVLQDDFRARGPEIIKELFAAGLLLNFAGDTALRFLPPLVVSHQEIDRAVELVAAALQKALYKGG

SEQ ID NO: 60588 - protein, 547 aa, Vitis vinifera
  misc_feature (160)..(160): Xaa can be any naturally occurring amino acid
  misc_feature (274)..(274): Xaa can be any naturally occurring amino acid
  misc_feature (475)..(475): Xaa can be any naturally occurring amino acid
MSKKDMPMDEQFMKECLNKAVTLAPNIGDFWALYYKFELQHGSCTILLKGPNRNELKKVKHVIQYVVFTAYRLTYETSFLANEGAFLTKPTVDPHLGLIFCSLILPSVTISRSHVSMHGWLLGHQSGVFDGQPEVDTCPKNLQKAADAGLEKEDGKVRRXILEPSSCWSRKRGFQSADVSTSGSSFDARQIWRVIEENKDLDSPAHKAMTTTVRYEEINGVKLEKIVRFEAAPAPVEAGTEAESALLHDKENGKFDQEPGVTEPIKFGSHGDEXVKGKGPVLGAFGNAKTVRNNNSSRFGKFVEIQFDQRGMISRADIRTYLLETKLCLLEGGRSAFSLESFAHVPTPIHKWNLHNLPKNTQLWIKRDDLSEMQMSDNEVRKLEFLWQHLWKEIQTYLGKLQSATLIYKIYVACWMGEEVLSPAAAASVLRFMGCSCSGDLIGMSVKHAASGIHGPINGKKTLAEANALRPAESXVRHALTIRYSHTPCTPNWRKMREMPIVVITVGFPEFFWVVALRHFITKKKTPKHGYSSYPAATCFMQNVWSK

SEQ ID NO: 60589 - protein, 333 aa, Azoarcus sp. BH72
MRRVTLTQFLIEQQRAGRVSADLRLLIEVVARAVKAISVNVSKGALAGVLGEAGTDNVQGEAQKKLDVIANEILLQANEWGGHLAAMASEEVETVHQIPFDYPKGGYLLLFDPLDGSSNIDVNISVGTIFSVLRFPEGEAEPTEQSFMQPGREQVAAGYAVYGPSTQLVLTVGHGVHAFTLDREMGSFIYTHPFMTIPDDTHEFAINASNARFWEEPVQRYVGELQAGKTGPRGKDFNMRWVASMVADVHRILTRGGIFMYPLDEKCRAQGGKLRLMYEANPMAMLVEQAGGAATTGRERILDLMPTKLHQRVPVILGSRNEVERVTAYHRES

SEQ ID NO: 60590 - protein, 444 aa, Brassica napus
MRGVIPNYHHSYTFIFFVILVLFPHVFSTNTLSPNENLTISSNKTLVSPGDVFELGFFKTTTRNSPDGTDRWYLGIWYKTTSGHRTYVWVANRDNALHNSMGTLKISHASLVLLDHSNTPVWSTNFTGVAHLPVTAELLANGNFVLRDSKTNDLDRFIWQSFDYPVDTLLPEMKLGRNLIGSENEKILTSWKSPTDPSSGDYSFILETEGFLHEFYLLKNEFKVYRTGPWNGVRFNGIPKMQNWSYIDNSFIDNNEEVAYSFQVNNNHNIHTRFRMSSTGYLQVITWTKTVPQRNMFWSFPEDTCDLYKVCGPYAYCDMHTSPTCNCIKGFVPKNAGRWDLRDMSGGCVRSSKLSCGEGDRFLRMSQMKLPETSEAVVDKRIGLKECREKCVRDCNCTGYANMDIMNGGSGCVMWTGELDDMRKYNAGGQDLYVKVAAASLVPS

SEQ ID NO: 60591 - protein, 512 aa, Chlamydophila pneumoniae CWL029
MTNVVQETIGGLNSPRTCPPCILVIFGATGDLTARKLLPALYHLTKEGRLSDQFVCVGFARREKSNELFRQEMKQAVIQFSPSELDIKVWEDFQQRLFYHRSEFDNNMGYTSLKDSLEDLDKTYGTRGNRLFYLSTPPQYFSRIIENLNKHKLFYKNQDQGKPWSRVIIEKPFGRDLDSAKQLQQCINENLNENSVYHIDHYLGKETVQNILTTRFANTIFESCWNSQYIDHVQISLSETIGIGSRGNFFEKSGMLRDMVQNHMMQLLCLLTMEPPTTFDADEIRKEKIKILQRISPFSEGSSIVRGQYGPGTVQGVSVLGYREEENVDKDSRVETYVALKTVINNPRWLGVPFYLRAGKRLAKKSTDISIIFKKSPYNLFAAEECSRCPIENDLLIIRIQPDEGVALKFNCKVPGTNNIVRPVKMDFRYDSYFQTTTPEAYERLLCDCIIGDRTLFTGGDEVMASWKLFTPVLEEWDQDSSPSFPNYPAGSSGPKEADALIERDGRSWRPL

SEQ ID NO: 60592 - protein, 549 aa, Mycobacterium smegmatis str. MC2 155
MSADITETPAWQALSDHHAEIGDRHLTELFADDPARGTELALTVGDLYIDYSKHRVTRRTLDLLVDLARAAGLEERRDAMFAGEHINTSEDRAVLHTALRLPRDAKLVVDGQDVVADVHDVLDRMGDFTDRLRSGEWTGATGERITTVVNIGIGGSDLGPVMVYDALRHYADAGISARFVSNVDPADLVAKLDGLEPAKTLFIVASKTFSTLETLTNATAARRWLTDALGDAAVAKHFVAVSTNKKLVDEFGINTDNMFGFWDWVGGRYSVDSAIGLSVMAVIGKERFAEFLAGFHIVDEHFRTAPLHQNAPALLGLIGLWYSNFFGAQSRAVLPYSNDLSRFAAYLQQLTMESNGKSVRADGTPVSTDTGEIFWGEPGTNGQHAFYQLLHQGTRLVPADFIGFSQPTDDLPTADGTGSMHDLLMSNFFAQTQVLAFGKTADAIASEGTPADVVPHKVMPGNRPTTSILATKLTPSVVGQLIALYEHQVFTEGVIWGIDSFDQWGVELGKTQAKALLPVLTGDKSPAAQSDTSTDALVRRYRTERGRPA

SEQ ID NO: 60593 - protein, 268 aa, Haemophilus influenzae Rd KW20
MAIPIRTEKEIVKLREACKLASDVLVMIEPYVKAGVTTGELDRICHEYMVNEQKVIPACLNYHGFPKATCISINEVVCHGIPSDDKVLKNGDIVNIDVTVIKDGYFGDNSKMYIVGGETNIRSKKLVEAAQEALYVGIRTVKPDIRLNEIGKAVQKYTESQTFSVVREYCGHGVGTEFHCEPQVLHYYADDGGVILKPGMVFTIEPMINAGKKEVRVMGDGWTVKTKDRSHSAQYEHQLIVTETGCEVMTIRDEEIAEGRISRIMVNV

SEQ ID NO: 60594 - protein, 449 aa, Clostridium thermocellum ATCC 27405
MKVAKFGGSSLADANQIRKVCDIILSDKDRKLIVVSAPGKRCKEDTKVTDLLIALGEKYYKEGKADAELQAVIDRFDDIVKGLELSPDITQMVADDLKKRLECNNGNKDKFMDTIKAAGEDNNAKVVAAYLVSRGIDAEYVNPKDAGLLLSEEYGNARVLPESYENLKRLRERDKIMIFPGFFGYSKKGDVVTFPRGGSDITGAILAAAVKADVYENFTDVDSVFAANPNIIENPKPIATFTYREMRELSYSGFSVLHEETLEPVYRMEIPVCIKNTNNPSAPGTTIVPKRKLDNGPVIGIASGTGFCCIYISKYMMNREIGFGRKVLSILEDEGLSYEHIPSGIDNMSIIIEQKQLDKAKEERVVRRIKDELNVDDIKIEYDRALVMIVGEGMMSTVGIAARACTALAKANVNIEMINQGSSEVSMMFGVKAEDNVKAVKALYDEFFS

SEQ ID NO: 60595 - protein, 328 aa, Coccidioides immitis RS
MAEDAGGWSTIESDEGVFTSLIEDLGVKNVQFEELISLDANTIQSLSPVYGVIFLFKWISGQTRSSDSPQDGTYDPSATENGLFFAAQTIQNACGTQAILSVILNQDNPSLSDPTAPGIDIGPSLRDFKEFTTGFPPDLRGEALSNSAEIRNAHNTFARASPFVDETSRPPVPEEESELYHFIAYTPFNGVLYELDGLQPFPISHGPCDSSDFPEKVIEVLQRRIARYPEGEIRFNLMAVVKDLRIRAAEIGDVEALEGEERKRRAWAWENALRRWNFVGFIGEVLKGVVGKKVEQGDGEYEKWVGDATEATVRKLNMRRGRGNGNGE

SEQ ID NO: 60596 - protein, 399 aa, Streptococcus thermophilus LMG 18311
MAKLTVKDVELKGKKVLVRVDFNVPVKDGVITNDNRITAALPTIKYILEQGGRAILFSHLGRVKEEADKEGKSLAPVAADLAAKLGQDVKFIPGVTRGAELEAAVNSLEDGQVLLVENTRFEDVDGKKESKNDPELGKYWASLGDGIFVNDAFGTAHRAHASNVGISANVEKAVAGFLLENEIAYIQEAVENPERPFVAILGGSKVSDKIGVIENLLEKADKVLIGGGMTYTFFKAQGIEIGNSLVEEDKLDVAKALLEKSNGKLILPVDSKEANAFADYTEVKYTEGEAVDPGFLGLDIGPKSIAKFDEALTGAKTVVWNGPMGVFENPDFQAGTIGVMDAIVKQPGVKSIIGGGDSAAAAINLGYADKFSWISTGGGASMELLEGKELPGLAALTEK

SEQ ID NO: 60597 - protein, 603 aa, Vitis vinifera
MAVKVSAEKAAEIAIGSIGRGYDISDDLRLKYCKGDLVDSRLIEIDEESVREIVLPGGISIPNASKSIKCDKGERTRFRSDVLSFQQMSEQFNQEISLTGKIPSGLFNAMFEFSGCWQKDAAKTKTLAFDGVFITLYTVALEKSQMVLREHVKNAVPSSWDPAALARFIETFGTHIIVGVKMGGKDVIYVRQQHASPLQPADVQKRVKEMADKRFVDASGQYGMNSGHVYQDDKFEIREQRLRFADTSPSSSYSHKDDIVSICKRRGGSDNKNLSHNEWLQTVQSAPDVISMSFIPITSLLNGVQGSGFLSHAINLYLRYKPPIEELRQFLEFQLPRQWAPVFSELPLGPQRRQQNSAFLQFSFMGPKLYVNTNPVDVGKRPVTGLRLYLEGKRSNRLAIHLQHLSSLPKIFQLEDDPSANFRHETYDHKYYEKVQWKNFSHVCTAPVQADDDFSIVTGAQLQVGGYGFKKVLFLRLRFSTVSGAMLVKAPEWDGSPGLAQKSGLISTLISHPFTTVQKPPPRPADVNINSAVYPGGPPVPVQAPRLLKFVDATEMTRGPQETPGYWVVSGARLMLEKGRISLKVKFSLLTVLLSDEEAPEEP

SEQ ID NO: 60598 - protein, 179 aa, Fusobacterium nucleatum subsp. vincentii ATCC 49256
MDNDKKLGRFISLILRHKPETIDLKLDKNGWANTKELIEKISKSGREIDFEILERIVNENNKKRYSFNEDKTKIRAVQGHSIDVNLELKEIVPPAILYHGTAFKNLESIKKEGIIKMSRQYVHLSADVETAKNVATRHSGKYIILEIDTEAMLKENYKFYLSENKVWLTDFVPSRFIKF

SEQ ID NO: 60599 - protein, 519 aa, Vitis vinifera
MKGPLDRTKVVVRHLPPTISEAAFLEQIDTVFKGRYTLVKFRPGKNSQKRQSYSRAYLDFKRPEDVIEFAEFFDGHVFVNEKGTQFKTIVEYAPSQRIPKHWPKKDGREGTIFKDPEYMEFVELLAKPVENLPSAEIQLERREAERAGAVKDTPIVTPLMDFVRQKRAAKGVSRRSLSNGKLSRRASGSSSGNPSLGSSKRGSEKRRLSTTMYVLRDTAKSTSAKDKSTFILVPKRDDQLLSDKSVNLAAGGGAEALEEESGVSGAVDAGKKKVLLLKGKEREISHHLLQQNVTSPVKNILGANAPKQNQRREGSGRIIRSILLNKDARQSQSSMFQTEQQSQASNLEKEKRPPRPPHIQLASKETNGAQDDKVVGNDVHSFVSEKQDKRTRNKDRPDRGVWTPLRRSDGSHASDESLSSSASQPTSSDFPEGSHGEMRSDMSNARSGEVKALGSGRGGHSALDNGSHKHSGRRGPTHSVKDADGSSIVSEGKHSKRGSAPGYGSHEKQVWVQKSSSGP

SEQ ID NO: 60600 - protein, 512 aa, Thlaspi caerulescens
MSRLENDRPLLIDRIDEEEEETAYDETEKVHIVRDEDDNERDLEYGVGCGGAPPFSWRKLWLFTGPGFLMSIAFLDPGNLEGDLQSGAVAGYSLLWLLMWATAMGLLVQLLSARLGVATGRHLAELCREEYPSWAGMVLWVMAELALIGSDIQEVIGSAIAIKILTNGILPLWAGVIITALDCFFFLFFENYGIRKLEAVFAVLIATMGVSFAWMFGQAKPSGSELLVGILVPKLSSRTIQKAVGVVGCIIMPHNVFLHSALVQSREVDKRQKYRVQEAINYYTIESTLALFVSFLINLFVTTVFAKGFYNTDLADSIGLVNAGQYLQDKYGGGLFPILYIWGIGLLAAGQSSTITGTYAGQFIMGGFLNFRMKKWMRALITRSCAIIPTIIVALVFDSSEATLDVLNEWLNVLQSIQIPFALIPLLCLVSKERIMGSFKIGPLCQTIAWLVAALVIMINGYLLIEFFSSEVSGIVYTGFVTVFTALYGAFIVYLIARGINFTPWRPKAESS

SEQ ID NO: 60601 - protein, 371 aa, Rhizobium leguminosarum bv. viciae 3841
MDQAMGFKCGIVGLPNVGKSTLFNALTKTAAAQAANYPFCTIEPNTGEVAVPDPRMRKLADIAKSKELIPTRISFVDIAGLVRGASKGEGLGNQFLANIREVDAIVHVLRCFEDSDITHVEGRINPVADAETIETELMLADLESLERRTEQTRKRATSKDKDSVAMLPIMEGSLKLLNEGKPVRTLLSTLDAEEIVILKSLNLLTSHPVLYVCNVAEGDASTGNEFTDAVAIMAKEQGAETVVISAAIESEVAQLPDEEAKEFLSALDLDEAGLDRLIRAGYKLLHLITYFTVGPKETRAWTIERGTKAPQAAGVIHSDFERGFIRANTIAYDDYIKYNGEVGAKDAGKARDEGKEYVVQDGDVIHFRFNT

SEQ ID NO: 60602 - protein, 278 aa, Cetrariella delisei
  misc_feature (26)..(26): Xaa can be any naturally occurring amino acid
VEHGEVKVVAVNDPFIEPHYAAYMLXYDSQHGQFKGTIEVKGSDLVVNGQTVKFYTEKDPANIPWKDTGAYYIVESTGVFTTTEKAKAHLKGGAKKVVISAPSADAAMFVMGVNEKEYKSDLEIISNASCTTNCLAPLAKVMHDNFTIIEGLMTTIHSYTATQKTVDGPSSKDWRGGRTAAQNIIPSSTGAAKAVGKVIPSLNGKLTGMSMRVPTSNVSVVDLTCRLEKSVSYDQIKATMKKASEGELKGIMSYSEDALVSTDLNGDNHSCIFDATAG

SEQ ID NO: 60603 - protein, 897 aa, Saccharomyces cerevisiae YJM789
MESQRSHHILTRLTKIRRRPQQPLTDFTELYSRIANETIYYLNLEEKKRYKEALQGWKALTTDVLFKQTLIEHNYPNTQSYTKDEVSLQNGIRELYHKSVMHLERVKKLVREEPAPRNDMSSSKTYTNHSSSFTRSTEPPPVFQMVPGRMMKTLRNRNACGYKTAYSNPSLSSYGNSTSIKRGEHAENIRVNFVPSKPLSNNASRQHKNPIEHNDPALKKETELYSDKYISEPILIDLTNDEDDHDVGILKGHNVFDEEESDGFEFDVSDYYDNFSEVDVEEEEEEKEERRRIKTLEAIQQQMCDLSVTSSTSSNKSVSSSENVPGSCIQSLPTTAPALPSLPPPPLLNVDRASSTGALKPHSLETSTTMDSSKIRNPQISKLMKNNHVPYLKGTKSTPTLITKSTPTFITRSKSNTKPIIKSNASSPTSSLTVPNSVIQKPKTAAMAAKRVLNSKKVASNPALNTTKKSHPILKSKTAKVPNSSSKKTSSHPSRPVSNSKPYSHGASQNKKPSKNQTTSMSKTNRKIPAQKKIGSPKIEDVGTEDATEHATSLNEQREEPEIDKKVLREILEDEIIDSLQGVDRQAAKQIFAEIVVHGDEVHWDDIAGLESAKYSLKEAVVYPFLRPDLFRGLREPVRGMLLFGPPGTGKTMLARAVATESHSTFFSISASSLTSKYLGESEKLVRALFAIAKKLSPSIIFVDEIDSIMGSRNNENENESSRRIKNEFLVQWSSLSSAAAGSNKSNTNNSDTNGDEDDTRVLVLAATNLPWSIDEAARRRFVRRQYIPLPEDQTRHVQFKKLLSHQKHTLTESDFDELVKITEGYSGSDITSLAKDAAMGPLRDLGDKLLETEREMIRPIGLVDFKNSLEYIKPSVSQDGLVKYEKWASQFGSSGS

SEQ ID NO: 60604 - protein, 595 aa, Solanum lycopersicum
MEFLCLAPTRSFSTNPKLTKSIPSDHTSTTSRIFTYQNMRGSTMRPLALPLKMSPIVSVPDITAPVENVPAILPKVVPGELIVNKPTGGDSDELFQYLVDILASPVYDVAIESPLELAEKLSDRLGVNFYIKREDKQRVFSFKLRGAYNMMSNLSREELDKGVITASAGNHAQGVALAGQRLNCVAKIVMPTTTPQIKIDAVRALGGDVVLYGKTFDEAQTHALELSEKDGLKYIPPFDDPGVIKGQGTIGTEINRQLKDIHAVFIPVGGGGLIAGVATFFKQIAPNTKIIGVEPYGAASMTLSLHEGHRVKLSNVDTFADGVAVALVGEYTFAKCQELIDGMVLVANDGISAAIKDVYDEGRNILETSGAVAIAGAAAYCEFYKIKNENIVAIASGANMDFSKLHKVTELAGLGSGKEALLATFMVEQQGSFKTFVGLVGSLNFTELTYRFTSERKNALILYRVNVDKESDLEKMIEDMKSSNMTTLNLSHNELVVDHLKHLVGGSANISDEIFGEFIVPEKAETLKTFLDAFSPRWNITLCRYRNQGDINASLLMGFQVPQAEMDEFKNQADKLGYPYELDNYNEAFNLVVSE

SEQ ID NO: 60605 - protein, 180 aa, Rhizobium leguminosarum bv. viciae 3841
MNNTISELAASIRSIPDYPKPGIIFRDITTLLGNPRAFRRAVDELVQPYAGTKIDKIAGMEARGFILGGAVAHQLSSGFVPIRKKGKLPHETVRIAYSLEYGVDEMEMHRDAVQPGEKVILVDDLIATGGTAVGATRLLRQIGAEVVGACFVIDLPDLGGRRKLEELGVVVHTLVEFSGH

SEQ ID NO: 60606 - protein, 278 aa, Cetraria commixta
VEHGDVKVVAVNDPFIEPHYAAYMLKYDSQHGQFKGTIEVKGSDLVVNGQTVKFYTEKDPANIPWKDTGAYYIVESTGVFTTTEKAKAHLKGGAKKVVISAPSADAAMFVMGVNEKEYKSDIEIISNASCTTNCLAPLAKVMHDNFTIIEGLMTTIHSYTATQKTVDGPSSKDWRGGRTAAQNIIPSSTGAAKAVGKVIPSLNGKLTGMSMRVPTSNVSVVDLTCRLEKSVSYDQIKATMKKASEGELKGIMSYSEDALVSTDLNGDNHSCIFDATAG

SEQ ID NO: 60607 - protein, 278 aa, Cetraria sepincola
VEHGEVKVVAVNDPFIEPHYAAYMLKYDSQHGQFKGTIEVKGSDLVVNGQTVKFYTEKDPANIPWKDTGAYYIVESTGVFTTTEKAKAHLKGGAKKVVISAPSADAAMFVMGVNEKEYKSDIEIISNASCTTNCLAPLAKVMHDNFTIIEGLMTTIHSYTATQKTVDGPSSKDWRGGRTAAQNIIPSNTGAAKAVGKVIPSLNGKLTGMSMRVPTSNVSVVDLTCRLEKSVTYDQIKATMKKASEGELKGIMSYSEDALVSTDLNGDNHSCIFDATAG

SEQ ID NO: 60608 - protein, 327 aa, Physcomitrella patens subsp. patens
MGGHGDSSLHSSTMDAVAGAVAGGIARTVVSPLDVIKIRFQIQLEPTSSRNIFSKGGASASVMSKYTGVMQAAHVIVREEGVRGLWRGNIPALLLQMPYTAIQFVVKSNADSLVAGSPQAARHKGLMSFLGGSLAGTAATIGSYPFDLLRTVLASQGEPKVYPNMRSVMVDIYKRKGVTGFYAGLTPTLMEIVPYAGLQFGFYDSLRRWALTLNPLKEDGEHTPLSSTQNFWCGFGAGLFAKLCCHPLDVIKKRYQVEGLMRDIRYGARIEEKAYKGVGDAIRRILAEEGLKGLYKGTLPSIVKAAPNSALTFYVYESTKHWLTSRS

SEQ ID NO: 60609 - protein, 638 aa, Thermosynechococcus elongatus BP-1
MHLSELTHPNQLHGLSIAQLTQIAAQIRDKHLETVAATGGHLGPGLGVVELTLALYQTLDLEKDRVVWDVGHQAYPHKMLTGRYNNFHTLRQKGGIAGYLNRRESPFDHFGAGHASTSISAALGMAIARDLKGENFKVVAIIGDGALTGGMALEAINHAGHLPHTNLMVVLNDNEMSISPNVGAIPRYLNKIRLSPQVQFITDNLEEQFKHIPFFGENLTPEMQRLKEGMKRLAVPKVGAVFEELGFTYVGPVDGHNLEELIATFQHAHTIPGPVLVHVATVKGKGYAIAEKDQVGYHAQNPFDLVTGKAKPSSKPKPPSYSKVFGETLTKLAENDPRIVGITAAMATGTGLDILQKRVPKQYIDVGIAEQHAVTMAAGMATQGMRPVAAIYSTFLQRAYDQIVHDVCIQKLPVFFCMDRAGIVGADGPTHQGMYDIAYLRCLPNMVLMAPKDEAELQRMIVTGINYTDGPIALRYPRGNGYGVALMEEGWEPLEIGKGELLRSGEDLLLVAYGSMVYPAMQVAEILKEHGMSAAVINARFAKPLDTELILPLAKQIGRVVTLEEGCLMGGFGSAVLEALQEADILVPVLRLGVPDILVEHASPDESKADLGLTPPQMAETIMQKFGVPQRATVVTAS

SEQ ID NO: 60610 - protein, 393 aa, Desulfitobacterium hafniense DCB-2
MGGKVLKARRLSSLGASVFTEMDDLRKELEKAGKQLINLSIGSPDRSPSAEIRKVLAEGVLDGGSYGYTLTRGTESFRSGCARWYKERFGVNLDPEKEVLPLMGSQDGLAHIFLALCDPGDVALIPDPGYPIYTAGLVLAGGEKVALPLREENGFLPDLSAIEDEVAQQAKIMFLNYPNNPTAAVAPLSFFEEVVDFARRNRIVVCHDAAYSELAFDGYRPVSFLQVPGAKEVGIEFHSVSKTYNLAGVRLGFAVGNGEIIGALAELKSNIDYGVFEPALQAGAYALSASQENVEQNRRAYQERRDIWVKGCAQAGWSMPSPRGSMFIWAPVPTAQDSRSFAFALAREAGVIVVPGVAFGEYGEGYVRIGMVQDQEVLQEAVRRVQEFLAAQG

SEQ ID NO: 60611 - protein, 409 aa, Physcomitrella patens subsp. patens
MDDQPQSKRRRRPSVRLGEIGYAAPYDASSLWVEAPRQRRKQVGAGKSPSAEVLSIGKGNSGKKAPRTRPLEQVAGDKVVMEEEWEVIEPIAASEDEQRFVTAVQKLVNAAGPGGSSTPVKEQQAKRHTGVLRKVNNKVRGKGPGGPRLGWRSSGKHEGIRSKPPLGADSPESRGDEEDDDEVDKEILPLQADDEAPFLAETSSDSDEPLGSGLKVEEDMPADDSENGASAGSEDGDAGANPNNHGDEIQGAIEDGPGQANGKGFSKMKQREGERRSGRQAASRDVEIRDSENRDMASADIVGRDKGVSSREIAGEPSGRFQAAAAVADGTTTITPSSSQRGLLSAGVSGWLQDLGLGKYSELFELNEVDTEVLPLLTMDDLREMGVDAVGARRKMFTAIQELGQIRGI

SEQ ID NO: 60612 - protein, 584 aa, Triticum aestivum
  misc_feature (125)..(125): Xaa can be any naturally occurring amino acid
  misc_feature (215)..(215): Xaa can be any naturally occurring amino acid
  misc_feature (258)..(258): Xaa can be any naturally occurring amino acid
  misc_feature (484)..(484): Xaa can be any naturally occurring amino acid
  misc_feature (506)..(506): Xaa can be any naturally occurring amino acid
  misc_feature (511)..(512): Xaa can be any naturally occurring amino acid
  misc_feature (514)..(514): Xaa can be any naturally occurring amino acid
  misc_feature (525)..(525): Xaa can be any naturally occurring amino acid
  misc_feature (529)..(529): Xaa can be any naturally occurring amino acid
  misc_feature (532)..(532): Xaa can be any naturally occurring amino acid
  misc_feature (538)..(538): Xaa can be any naturally occurring amino acid
MDDEDYSWVRRTRFSHSVVRSNSGREQFGAFVEQFNRGAALRQNKGSDSGFKLHGMNFEPRTKASATTNPVPIPRTRPPRAEARADLNHAFSNAMPVHHHEKPGDHGRPPQSAPANNSANGTRGXTTSSSTICSEPEVQEPGKGDSPGPLEFSFHPEEQSMRLRMVCSSPSPCPVNKTPVLDAPRTPVRNSSLRVLPEGRTTRMLRARSPLPSRXVPEVFKEAKSASKRFSTPPASRRKSSSPPRAPPCGRATQGAGXVKHHRKEHWDNQRAKAAAEKVLETWTVDRKQLLIGQKFAYGAHSRLFHGIYKEVPVAVKFIRQPDVEEDAELASQLEKQFNTEVVTLSRLQHRNVIKLVGACTSPPVFCVITEFLSGGSLRSFLHKQEHRSLPLDKIISVGLDIAHGMGYVHSQGIVHRDVKPENIIFDGECCAKIVDFGIACEEAYCDPLANDPGTFRWMAPEMMKHKPYGRKVDVYSFGLILWXEMLTGSLPYEDLTPFPTTFAVXFDKNXXPXIPATCPAALRXLIRXCWXFQADKXPEFREIFIDNSRWSKNGHTYPTKRQENMIQEWQPRLKAKHPITHDP

SEQ ID NO: 60613 - protein, 174 aa, Neptuniibacter caesariensis
MYSLEDKKVTCIGNEHFVAENATVIGNVELHDRSSIWFNVVIRGDNDPIIIGEGTNIQDGSVLHTDPGYTLKLGADVTVGHMAMLHGCEVGDGSLIGIGAVVLNGAKIGKGCLIGANALVPEGMEIPDYSLVVGSPAKIKRPLNDEQVAGLKQNAQHYVDNMRRFNSSFKKQEN

SEQ ID NO: 60614 - protein, 135 aa, Zea mays
MAARLAQLRAQAVQAAEFASKHGGSYYKELMEKNKQYVVQPPTIEKCQELSKQLFYTRLARALVLTNTPYVSKFLPGRYESFWKELDGVKQVWKNRKDLKVEDLGIATLFGVELYAWFCVGEIVGRGFTLTGYKV

SEQ ID NO: 60615 - protein, 736 aa, Archaeoglobus fulgidus DSM 4304
MQVQVSLSRDLSFFDITMIGIAGMIGAGVFALTGIAAGIAGPAIILAFFLNGIIATLTGLAYAELGSAMPQAGGGYLWIKEAMGDYAGFMAGWIDWAAHTIACALYAVTFGAFFAEMLVGFVGLPLPHVLTAKISSLAMVSFLAYVNYRGAKESGFLGSLVTVLKVLILLVFAGFGIIKMLSYPDWQSSFTPFFPTGFAGVLAAMGLTFIAFEGFEIIVQSGEEVKDPEKNIPKAIVVSLWVAVAIYILIAFSLLGAVRADVPSWMYLGQLAELSLVKVADSIMPLGGWMILAGGLISTISAMNATIYSSSRVIFALSRSGYLHRSLSAINERTKTPHYAIFFSYIIIAAASLAPIEAVASAASLMFIILFLAVNVTLIILRLRRPDIQSAFRLPLVPVLPAIAAALLAVVSYFLITQVEHGEGVFLITIAWMFLGSFFYFAYSEKELEKREEEEVMTVFTEKPVEKMEYTILVPVANPVIAKKLVRFAELIARKKKGAVVILNTVRLPQQTPISAPAKDVKKAKELVEGLMNLSVPSGGVVKVSHSVSEAILSTAEEWKANMIVMGWRGRTFRRDVVLGSTIDPVLLKAKCDVVVIRFEPGEKIPEFRDVLISTIGGPHAKLGYEIARALVEDKSGRIKLLYVGSSEKEREKAEKVFEEAMEILNGLNVEREFAISSSPSDVVAREAESFDLVIVGASERTFLKNFLTGLFPEKVVMKTSKTVAMTRKWVGLLNR

SEQ ID NO: 60616 - protein, 487 aa, Brassica napus
MGETAAANHHHHHHGHQVFDAYVPPQPAFKCFDDDGRLKRTGTVWTASAHIITAVIGSGVLSLAWAIAQLGWVAGPAVMLVFSLVTLYSSTLLSDCYRTGDAVSGKRNYTYMDAVRSILGGFKFKICGLIQYLNLFGIAIGYTIAASISMMAIKRSNCFHKSGGKDPCHMSSNPYMIIFGVTEILLSQVPDFDQIWWISIVAAVMSFTYSAIGLALGIVQVAANGVFKGSLTGISIGTVTQTQKIWRTFQALGDIAFAYSYSVVLIEIQDTVRSPPSESKTMKKATKLSIAITTIFYMLCGSMGYAAFGDAAPGNLLTGFGFYNPFWLLDIANAAIVVHLIGAYQVFSQPIFAFAEKSASERFPDNDLLTKELEFKIPGFRSPYKTNVFRVVFRCSFVVLTTVISMLMPFFNDVVGILGALGFWPLTVYFPVEMYIKQRKVEKWSTRWVCLQMLSVACLVISVVAGVGSIAGVMLDLKVYKPFQSTY

SEQ ID NO: 60617 - protein, 501 aa, Ustilago maydis 521
MPHMPQGIVKGGKEDVKLNNQSLWQTKAYINGVWTDADNKSTLKVFNKATGAEIGQVPDMGANETAAAISAADEAFKSWSKTTAKHRHDLLMKLYYAHQENAEDLAKIIVAENGKALPEAKGEISYSNGFLEWFAEEATRTYGHTVPSPLPGVRNVVQMQPVGVAGLITPWNFPAAMITRKAAPALAAGCTVVVKAPAETPFSALAFAHLAEKVGFPKGTINVVTCAKGDNEIAVGKQLCENPAVRKISFTGSTRVGKILMSQSASTLKKLSMELGGNAPFIVFEDADLDKAVEGAIACKFRGSGQTCICANRIYVHASIKDEFLQKLAAKVNDFKVGYGMDKGTTHGPLVSEAGLSKVEEHVNDSVKKGAKVIVGGKRGEGLFFEPTIITDLPEDVPTDREETFGPLAAVYTFTSEQEVVRKANNVDVGLAGYFFSKDTARCWRVAEELQVGMVGINTGLISQHAVPFGGVHESGFGREGGRTGIDEYLVQKLMVFGGVN

SEQ ID NO: 60618 - protein, 399 aa, Alkaliphilus metalliredigens QYMF
MMNLSKRITSMQESPIRKLVPYAQAAKANGKKVYHLNIGQPDIETPSSFMEAIRNFDEKVLAYSLSQGMPELIDSMIDYYKKYDMHFENDEILITNGGSEALLFAMIAVADAGDEVLVPEPFYTNYNGFTSAVDVKVVPITCKAEEGFHLPNRKSIEDIINPKTKAIMLSNPGNPTGVVYTKEEIHMLADLAKEYNLFILADEVYREFVYDGLEYTSFGNIKEIQDRVVIIDSVSKRYSACGARIGSVACKNKELIKEVLKLCQGRLCVPTLEQVGAIELYKTPESYFKTVNKEYEKRRDIVYTELNKMPGVLCKKPTGAFYVAAKLPVDDAEKFVIWMLKDFDIDGETLMMAPAEGFYATPGLGKDEVRIAYVLNEDDLMKSMNLLKVALELYPNKTI

SEQ ID NO: 60619 - protein, 666 aa, Coccidioides immitis RS
MEGRDRDSDLTDGQEDESPFSSPAESPLEHNETDAMFPSTTQPPSLRTVSPQTMTPSSTPLGQINAARRPPPVPTAGQSSGLSQDIQAKMKAFSLSRQGGRSGQNTPSSLSSGGSSSVGTPSKGALVGGINTNVLGGGPALAGRFPGGLSNAGLSPTGRPQPGGWTSMPSPVGRTATMTPKLGGLAAKRGLKQTMKLSDAGGTRPAFRAPTSLPEGVTGPHSKAHFAQTQSGFNKYSEIIDTKAGTIRFKDKAVIHGGGIDFTGGHSFSISLDEVETLDELGKGNYGTVYKVRHCRPRLRRPGLGLRGSMAPHSVHQAENAPNSEDGETDQLSNVVMAMKEIRLELDKSKFTAIIMELDILHRCVSPFIIDFYGAFFQEGAVYICVEYMDGGSMEKLYGDGVPENILRKIALSTIMGLKSLKDEHNIIHRDVKPTNILINTRGQIKICDFGVSGNLVASIAKTNIGCQSYMAPERIAGGVPSAGPDGGTYSVQSDIWSLGLSIIECAIGRYPYPPESYNNIFSQLNAIVQGDPPTLPDEGFSANARDFVRCCLNKTPSLRPTYATLLRHPWLADLLAPPASLLGGTEGGAAAEINATDRKGKGPLSAAEFDTADEEVAAWVKEALDKRKRGVMGRHAQPALHKVALDAVPGSPLLDDPANLMAAQQ

SEQ ID NO: 60620 - protein, 396 aa, Escherichia coli
  misc_feature (246)..(246): Xaa can be any naturally occurring amino acid
MFENITAAPADPILGLADLFRADERPGKINLGIGVYKDETGKTPVLTSVKKAEQYLLENETTKNYLGIDGIPEFGRCTQELLFGKGSALINDKRARTAQTPGGTGALRVAADFLAKNTSVKRVWVSNPSWPNHKSVFNSAGLEVREYAYYDAENHTLDFDALINSLNEAQAGDVVLFHGCCHNATGIDPTLEQWQTLAQLSVEKGWLPLFDFAYQGFARGLEEDAEGLRAFAAMHKELIVASSYSXNFGLYNERVGACTLVAADSETVDRAFSQMKAAIRANYSNPPAHGASVVATILSNDALRAIWEQELTDMRQRIQRMRQLFVNTLQEKGANRDFSFIIKQNGMFSFSGLTKEQVLRLREEFGVYAVASGRVNVAGMTPDNMAPLCEAIVAVL

SEQ ID NO: 60621 - protein, 191 aa, Glycine max
MADYETSTSHNHHSKETAFQALNTIIQLHFEKTLEKKRAIDLQKKELHKLFQIFFIFLGLVFLAQAQSPRLQCRHCWIPITLLSMAHLIFYVSVAQTLRCINAFKYQRRCHKLTLGLATEKLREIKTRLAGAATNGADYDSVVADEEFEIHYQEPPESYFGKFKRNWALHFSFLILIYAFMISSSVVLLCF

SEQ ID NO: 60622 - protein, 387 aa, Coccidioides immitis RS
MAPIDSVEVKKYDYIVIGGGSGGSGAARRAAGWYKAKTLIIENGRSGGCCVNVGCVPKKMTWNFSSIAESLRDGVHYGYDIPKNISVDYNLFKRKRDAVIERLNGIYERNWNREGIDLVHGTATFVGQKELEVTLQDGSGKVRFTAPHILIATGGYPKVPNTPGAEHGITSDGFFEIEDLPPKVAVVGSGYIGVELAGVMHTAGVETHLFCRHETFLRKFDPMIQHTMTKRYEDVGMKIHKNFTGVKEVKLLREGKGADKLLRLIMHDGSEIEVNELLWAIGRSPAVDNLGLKEIGVKQLPGGYIAVDDFQNTSVEGIYALGDVTGRAELTPVAIAAGRQLGNRLFGPPELKSSRLSYDNIPTVVFAHPEVGSIGLTEPEAVENYVL

SEQ ID NO: 60623 - protein, 396 aa, Escherichia coli
  misc_feature (246)..(246): Xaa can be any naturally occurring amino acid
MFENITAAPADPILGLADLFRADERPGKINLGIGVYKDETGKTPVLTSVKKAEQYLLENETTKNYLGIDGIPEFGRCTQELLFGKGSALINDKRARTAQTPGGTGALRVAADFLAKNTSVKRVWVSNASWPNHKSVFNSAGLEVREYAYYDAENHTLDFDALINSLNEAQAGDVVLFHGCCHNATGIDPTLEQWQTLAQLSVEKGWLPLFDFAYQGFARGLEEDAEGLRAFAAMHKELIVASSYSXNFGLYNERVGACTLVAADSETVDRAFSQMKAAIRANYSNPPAHGASVVATILSNDALRAIWEQELTDMRQRIQRMRQLFVNTLQEKGANRDFSFIIKQNGMFSFSGLTKEQVLRLREEFGVYAVASGRVNVAGMTPDNMAPLCEAIVAVL

SEQ ID NO: 60624 - protein, 138 aa, Crocosphaera watsonii WH 8501
MVQTKENKKSEVAAIPFSVAHTGVAATEMRPWGSFTTLEEGPGYKIKRIEVNPGHRLSLQMHHHRSEHWIVVSGTAKVTCGDKEEILAANQSTYVPQCTSHRLENPGVIKLILIEVQNGEYLGEDDIIRFQDDYSRHK

SEQ ID NO: 60625 - protein, 771 aa, Desulfococcus oleovorans Hxd3
MDHTLLNKIGNTPLVEIRRLSPNPRVKIFAKLEYMNPGGSIKDRAAVAMIEDGEASGRLTKEKIVLEATSGNTGIGLAMVCAIKGYRLLLAMSERASEERKKILRARGAEILLTPGHLGTDGAIEEVYRLARENPETYFCTDQFNNEANWKAHYTGTAQEIWDQTEGKVDVVVATLGTSGTAMGLSRRLKELKPDIRIVGVEPFLGHKIQGLKNMKESYRPEIFEQKRLDAKPNIEDEAAYEMTRRLAREEGLLVGMSSGAAMHVAAEEARAMEAGIIVVILPDSGERYLSTTLFVEPEKSGVVLFNTLTREKEAFAPLAQGKASIYSCGPTVHARMDLGQCRRMVFADLLCRYLVYRGFEVRHIVNITDFDDRTIEGAQKAGMDLAAFTGTYIDLFKADLKTLRVHPADAYPLASQEAPEMVALVEKLVDRGVAYEKLRSVYFDIASAEGYGGLSNIDTNKIRLGATVDLDEYEKENPRDFTLLKRAKMSELKQGWYLKTRWGNVRPSLHIQCAAISRKYLGDRFDIHTGSRDLVFPHHENEIAIARAATGREPARYWVHCDSVLESDDSVHWKTARTTLEQALDMGFTGRQLRYWLISGHYRKALSFSADRIAAAASALARLDGCVRSLADLAANPSAESARQMEGAEQDVDQLLYDIRQGFVDAMDDDLNVSAALANIFKNVKTVNVMLDQSRLDGPAAEKIQDAFAGIDSVLQVFDFDQTPADDLLPEVKQLMEQREAARKAKDWELADRLRETLRDMGVSVTDEKL

SEQ ID NO: 60626 - protein, 1384 aa, Oryza sativa
  misc_feature (1086)..(1086): Xaa can be any naturally occurring amino acid
MELSNQGQTPMSTNMGSQPLPSSNIQPNQAEYPSMFYPSLPADWGAQPMFSMGASVPISSYFIVPMSQQSVQIGASRPETPRSSGAHSLSRVSLRPPQQVLSIRTSLPTMVGSQHSPAGKKLQPTIASPKVQILKSTQSQSSNKRSAQKETPSKVQTQQLESVRSKFRESLSAALRTDSDQSKNQSSDVQPDGSADQKKEMDVDADQVATTSQGMSAAKSEVLTSVGAERRAEDEKLNSDLVSNIATPLNADIQQQPENASLQDEMLGQYTVVADELLQGHGLCWVSDFDAGVPEPATQPNLKRSRASDIDPVVADTLSESESKRMKSANDEEAIDKDSIIQKADDLAVRVEEELFKLFGGVNKKYKEKGRSLLFNLKDKSNPELRERVLSGDITPDRLCSMTAEELASKELSECRLANAEELAQMVVLPSTEVDVRRLVRKTHKGEFQVEVEETDGISVEVELGGNLLTQVPSKAPEDQTKSDDKESTDDKTGIQDNDKAPDGTSQDEDNGAGKNDPQDDLEYVDNEKSDLMQELMVDDLKDTENLPPIPSLDEFMQGLDSEPPFENLSAGTPEEDSDDRDEADTTAESAELPEEEVKVSAAEKIVSEADLPSSQDKSESKLESPKDEVGSNLGPVEQREGKLIKSSPDSVEVKQTTTENVLNRDSTVHNMATTLPMIRESIWEGAIQLTMSSLTNVVAIFKSGEKPPVKEWRSFVEIKGRVKLSAFQEFVEQLPKSRSRAIMVTELCWKEGSHESGRQHLLQTIDSYISDERVGLAEPADGIELYLCPSQGKTVEILSRHLPKEHLESLAVSASSIIGVIVWRRPNVPRMPAHPRHDGSRRPSILKKPQVTGSTPGPRPSLPMSSHGAPPGFPVQRHRHEEDVTDDVPPGFGPGVARDEDDLPEFNFVNSSNPAANVTTTQAYKGRQHVPLTSARPVEQMRELVQKYGKRSSVQARPWDDDDDDDIPEWNPNQLVTQQQPTRQLPVPPTPQQPLPPPPPPPSLQQLHHPYQHQQQQQQQLYHHQNALQPQIPSNSIPQAYLRTQQPLQQLPLMQQQLQPAQAWQQTNAWWPAQGGAAAAAAPAXMVQQSQYGVIPNSNNSAQSYGSGSESGSEDDDLDVGIGDVPSELEVKNSGLIPAQSKETERQLSKKEWKKKELAELDTVLAELGISGHAERKPDKQNGGDKNGAPQGPWRGGGYKSEEEITAVYMKEKMKKIASAKKKSGRGGWGCKACCKMEDAARSAKLAGAKKKEKTNSLSIDRLLPSPSSEFRMSTGLICSTCYYEVEVPGVGFAPRIDLKLCFASWLFLKSALRIGSTVTLKLMNKEYAAKESLKKFLRFFVGVPKRHFCLSLESKPAALSSHPLWQYPFTRNRRFAYSYYKL

SEQ ID NO: 60627 - protein, 462 aa, Erwinia carotovora subsp. atroseptica SCRI1043
MAEDVKQEKLHRGLEARHIELIALGGTIGVGLFMGAASALKWAGPSVLLAYIVAGIFVFFIMRSMGEMLYLEPVAGSFAVYAHKYMHPFFGYLTAWGYWFMWMAVGISEITAIGVYVQYWFPELPQWIPAIVAVALVAGANLAAVRLYGEIEFWFAMIKITTIVVMILVGVGIIFFGFGNHGQATGFSNLTEHGGFLAGGWKGLLFALCLVVASYQGVELVGITAGEAKNPQVTLKRAINNILWRILIFYVGAIFVIVTIFPWNEIGTSGSPFVLTFAKIGIVAAAGIINFVVLTAALSGCNSGMYSCGRMLYSLANNRQLPAWLGKVTASGVPAAGVMISILCLVAGSLLNYVIPNPEKVFVYVYSASVLPGMVPWFVVLISQLRFREQHRVALASHPFKSILFPWVNYLTMAFLLCVLVGMYINIDTRMSLLVGVAFLAVVSLCYFALGLGKKTSLAGGK

SEQ ID NO: 60628 - protein, 403 aa, Vitis vinifera
MPLTRLAADAFGVVTICLVSLLTLLGFLCIIYSCYFRTRIHSRGFVQLGYFSGPWIIRIIFILFAIWWGFGEIIRLSLLRSEGRVLNALNLKWQETVCKYYIVSNLGFAEPCLFLTLVFLLRAPLQKMDSGILSQKWNGKTAGYVFLCCLPVFALQLIVILIGPDFNKGKNNTFELPHYFTSTAVPSRMKDGDDDIALCTYPLLSTILLGFFATVLTTYLFWLGRRILNLVINKGLQRRVYTLIFSVSGFLPLRVLLLGLSVLYKPEQVVFEALAFLAFLSLLCCAGVSIWMLVYCPVADSLALRSLLDLEARRRISDDHNETISLIANQSLLGESMGVSPERNSDASTKRGSISFRTVEKDGTSVDTYVELSLFSPSRHATPPGSPRPLGWPMVPRAQVHGP

SEQ ID NO: 60629 - protein, 239 aa, Streptococcus thermophilus LMG 18311
MKLKTVAKYIKKLSKESRSLMSYKIAPSILAADYANFASELARIDASGAEYVHIDIMDGQFVPNISWGADVVASMRKHSKLVFDCHLMVVDPERYVTAYAQAGADIMTIHVEATKHIHGAIQKIKAAGMKAGVVINPGTPVEALIPVLALVDQVLIMTVNPGFGGQTFIPEMMSKVEQVVELRQKGGYSFDIEVDGGVDNKTIAACAKAGANVFVAGSYLFKNHDLTAQVQTLRDAIDA

SEQ ID NO: 60630 - protein, 199 aa, Physcomitrella patens subsp. patens
MAWPTVSPKPSLKRDLSHSIHLFTVPDFLSQNECEAFIRCADARGLEHQGSGGPAKGEAFRDNERLADYNPDLANMLWQAGLRESFHDIVLPGGRVAVGLNPNIRLYRYGLGQRFGPHYDESVDMDGGGATEFTLLIYLTGGLSGGETVFYERRKVVAEVAPVAGLALFHIHGARCLLHEAKPVLKGVKYVLRSDVVFA

SEQ ID NO: 60631 - protein, 527 aa, Saccharomyces cerevisiae YJM789
MPMDFQPTSSPSNWVVQKFGGTSVGKFPVQIVDDIVKHYSKPDGPNNNVAVVCSARSSYTKAEGTTSRLLKCCDLASQESEFQDIIEVIRQDHIDNADRFILNPALQAKLVDDTNKELELVKKYLNASKVLGEVSSRTVDLVMSCGEKLSCLFMTALCNDRGCKAKYVDLSHIVPSDFSASALDNSFYTFLVQALKEKLAPFVSAKERIVPVFTGFFGLVPTGLLNGVGRGYTDLCAALIAVAVNADELQVWKEVDGIFTADPRKVPEARLLDSVTPEEASELTYYGSEVIHPFTMEQVIRAKIPIRIKNVQNPLGNGTIIYPDNVAKKGESTPPHPPENLSSSFYEKRKRGATAITTKNDIFVINIHSNKKTLSHGFLAQIFTILDKYKLVVDLISTSEVHVSMALPIPDADSLKSLRQAEEKLRILGSVDITKKLSIVSLVGKHMKQYIGIAGTMFTTLAEEGINIEMISQGANEINISCVINESDSIKALQCIHAKLLSERTNTSNQFEHAIDERLEQLKRLGI

SEQ ID NO: 60632 - protein, 274 aa, Thermosynechococcus elongatus BP-1
MNILGSLLTPSPTPVQTRPRRGIEIKSKREIEIMRQASRIVATVLKEISQIIEPGMTTADLDAYAEKRIREMGATPSFKGYQGFPASICACINNEVVHGIPSPRKVIRNGDIVKIDTGAYYNGFHGDSCITIPVGEISEEAAKLVKVAEEALYRGIEQVKEGNYLMDLAGAIQDYVEANGFVVVEDFTGHGVGRNLHEEPSVFNFRTHDLKNVRLRAGMTLAIEPIVNAGSKQVRILRDRWTAVTVDNSLSAQFEHTVLVTKTGYEILTDRTLV

SEQ ID NO: 60633 - protein, 260 aa, Tuckermannopsis chlorophylla
NDPFIEPHYAAYMLKYDSQHGQFKGTIEVKGSNLVVNGQTVKFYTEKDPANIPWKDTGAYYIVESTGVFTTTEKAKAHLKGGAKKVVISAPSADAAMFVMGVNEKEYKSDIEVISNASCTTNCLAPLAKVMHDNFTIIEGLMTTIHSYTATQKTVDGPSSKDWRGGRTAAQNIIPSSTGAAKAVGKVIPSLNGKLTGMSMRVPTSNVSVVDLTCRLEKSVTYDEIKATMKKASEGDLKGIMSYSEDALVSTDLNGDNHSC

SEQ ID NO: 60634 - protein, 230 aa, Candida albicans SC5314
MVKPIIAPSILAADFANLGCNCKRVVDTGDVEWLHLDVMDGHFVPNISLGPPIISSLRKQFPREGDKPIVFDCHMMVSEPDEWIEEIAKAGGDSYTFHFEATKDPARVIKKIKEHGLKAAMAIKPKTPVEEVFPYAEDLDMVLVMTVEPGFGGQKFMPDMMPKVETLREKYPNLDVQVDGGLGKDTIQPAADAGANVIVAGTSVFKPEDPKPVVQYLKQTVADAIQARNK

SEQ ID NO: 60635 - protein, 278 aa, Flavocetraria cucullata
VEHGEVKVVAVNDPFIEPHYAAYMLKYDSQHGQFKGTIEVKGSDLVVNGQTVKFYTEKDPANIPWKDTGAYYIVESTGVFTTTEKAKAHLKGGAKKVVISAPSADAAMFVMGVNEKEYKSDIEVISNASCTTNCLAPLAKVMHDNFTIIEGLMTTIHSYTATQKTVDGPSSKDWRGGRTAAQNIIPSSTGAAKAVGKVIPSLNGKLTGMSMRVPTSNVSVVDLTCRLEKSVTYDEIKATMKKASEGELKGIMSYSEDALVSTDLNGDNHSCIFDATAG

SEQ ID NO: 60636 - protein, 208 aa, Zea mays
MDLHYGARVGEAMAVGEAAYIATAGAGVGAGPSTVVDVVTRESAAQALGTVVQLHFDKTVEKKRAADAQNQELWRLFLAFFFLLALVLSGVAASPPARLQCRHLWAPAGLLSLAHLAFYAAVAHHLRCLNGFRYQRRCHKLTLALAADRLRMLKSAADVVPAADVEVPYQEPPEAYLAKFRRSWAIHFAFLITTFAFCVAASVAILCF

SEQ ID NO: 60637 - protein, 78 aa, Glycine max
  misc_feature (12)..(12): Xaa can be any naturally occurring amino acid
  misc_feature (24)..(24): Xaa can be any naturally occurring amino acid
MAFLLNQTSIAXHFRANSQKNEDXASFTSRRFHVKPLAREKSLLADEATLKPFKSYKKSVKKLRKTGNALTIAVAARC

SEQ ID NO: 60638 - protein, 2218 aa, Physcomitrella patens subsp. patens
MTTCVPALVQFNSRFTLVHANRSRVPQTCSHKLQLLEVTRFTGLRREVPPRLKPEERTRQWKGDWWEFTERFCDKGSGLKPVLVALSGFPDGNLGLYDPALDMDSCGVGFVAELSAQPNRKIVTDAIGMLLRMAHRGACGCEVNTGDGAGILVATPHDYFSQVLMEELDLSLPPLGQYAVGMVFLPQNDQRREESKNVFKKVVAESLGHRILGWRVVKTDNTGLGKGAIETEPIVAQVFLSPSSHSTVDIERQMYVLRKTSMIAIRAALNLQYGAAKDFYICSLSSRTIVYKGQLKADQLEKYFHNDLGDKRFTSYMGLVHSRFSTNTFPSWDRAQPMRLLGHNGEINTLRGNVNWMHAREGLLQCDALKLSKDELQKLLPIVDAGSSDSGAFDGVLEILMRSGRDLPEAVMMMIPEAWQNDNNMDPERRALYEYFSCILEPWDGPALISFTDGRFLGATLDRNGLRPSRYYITHDQRVIMASEVGVVDVDPRNVFKKGRLHPGMMLLVDFDKHKVVDDTELKKKYASRYPYAEWLRRQKIPLQEIVDSVSKGERTPPPIIGAAEVGTSDETMDHMGVKGLIAPLRAFGYTTESLELLLLPMAGDGIEALGSMGNDTPLAVMSDRPKLSFEYFKQMFAQVTNPPIDPIREAVITSTECMVGPEGDLTEVAESQCNRLSLKSPLLTLEEMEAVKKTQHRGWRTKIIDITFPRSGGSEGLEKALDRICAEARLAISDGCTVLVLSDRATSAQRVPVSSLVATGAVHHDLVASLERTRVALMLETGEPREVHHFCTLIGFGADAICPYLAIESIYRLQVDGKIAPKKEGTLYNREEIIAKYFKGSNAGMLKVLAKMGISTLASYKGAQIFEAIGLSTAVVQRCFKGTSSRIEGATFEMLAHDMLRMHKLAFPARLLPDGSAEALALPNPGDYHWRLKGISREVHLNDPDAIAKLQEAARENSPAAYKEYSKITQNMNRKCNLRGLLRFKDLPESEQIPLEEVEPASDIVKRFVTGAMSYGSISLETHTTLAVAMNRLGGKSNTGEGGEQPERLEPLEDGSTNPQRSAIKQVASGRFGVTSYYLTNADEIQIKMAQGAKPGEGGELPGHKVIGDIAITRNSTEGVGLISPPPHHDIYSIEDLAQLIYDLKNANPSARISVKLVSEAGVGVVASGVVKGHADHILISGHDGGTGASRWTSIKHAGLPWELGLAETQQTLVANGLRGRTILQTDGQLKNGHDVIIAALLGAEEFGFSTAPLITLGCIMMRKCHKNTCPVGIATQDPVLRTKFSGLPDHVTNFFFMVAEEAREIMASLGVRRMDDLIGRADLLEMDKTAMTENEKVSNIDLSLLLHPASKIKPDAAQRCVESQDHGLENALDRKLIALSQPALNRNMPVYVETSVFNVNRAVGTMLSHEVTKRYHRTGLPTDTIHVKLNGSAGQSLGAFLCSGITLELEGDSNDYVGKGLCGGKIIVYPHKNSSFDPKENIVIGNVALYGATGGEAYFNGMAAERFAVRNSGANAVVEGVGDHGCEYMTGGTVVVLGETGRNFAAGMSGGVAYVLDRERLFLRKCNTALVDLDSVEEEDDIILLRSLIQQHQRATHSRLARYVLNHFEALLPKFIKVYPRDFKRVVMEKKTKEAAERSARTGEDLSNKDTFAALKDLSTRSEATSPSANGASKVERPTIVYEPTKHGGFVRYGRESLPLRPIGERVQDWDEVIDHEINEPLLKTQSARCMDCGTPFCHQDHSGCPLGNKIPEWNELVYQGRWREALDRLLETNNFPEFTGRVCPAPCEGACVLGIIENPVTIKTMECTIIDKGWEMGWMVPRSPMKRTGKKIAIVGSGPAGLAAADQLNKAGHTVTVYERSDRVGGIMMYGVPNMKTDKVDIVQRRVDLMAAEGVQFAVNAHVGVDPMYSVESLRQDNNALLLACGATKSRDLPIPGRDLKGIHFAMEFLHANTKSLLDSGLQDGKYISAKGKKVVVIGGGDTGTDCIGTSVRHGCSNLVNLELLPQPTSTRAPGNPWPQACELFSEPSINARDWPRVFRIDYGHEEAHAKFGKDPRTYEVLTKKFIGSKKGELIGLEVVHVKWEKDSDKFQMQEIPGSEEVIETDLAFLALGFQGPEQNIAEKLGLERDARSNFKADYGRFATNLQGVFAAGDCRRGQSLVVWAIAEGRQVAEQMDNYLMKDEAVEKGREQLHAANGNRESKKGQRYPEGLCKA

SEQ ID NO: 60639 - protein, 417 aa, Azoarcus sp. BH72
MQLYALGLNHHTAPLAIRERVAFQPDRLDQALQALTDSRTVSEAAILSTCNRTELYFAAEQPQRAADWLAGFHQLPLAQVSPYLYSYPQRDAVRHVFRVASGLDSMVLGEPQILGQVKEAARRAEEAGTLGTLLHKLFQNTFAVAKEVRSTTAIGANIVSMAAAAVHLTGRIFERVSDQHVLFIGAGEMIELCAAHFAGAGPRSMTVANRTEARAEALAARLGAQTMRLDAIADALPRFDVVVSCTASPLPIVGLGMVERAVKVRRHRPIVMVDLAVPRDVEPEVGQLDDVFLYTVDDLAQVVDAGIESRQQAVVEAEGIIDQRVDGFLHWLHARDAVPTIRALREHAETLRRGEIERALRQLAKGEDPQAVLDALSHGLTNKLMHGPTRFLTQAEGEGQAEASRVVQQLFNLSRHD

SEQ ID NO: 60640 - protein, 278 aa, Ahtiana pallidula
VEHGEVKVVAVNDPFIEPHYAAYMLKYDSQHGQFKGTIEVKGSDLVVNGQTVKFYTEKDPANIPWKDTGAYYIVESTGVFTTTEKAKAHLKGGAKKVVISAPSADAAMFVMGVNEKEYKSDIEVISNASCTTNCLAPLAKVMHDNFTIVEGLMTTIHSYTATQKTVDGPSSKDWRGGRTAAQNIIPSSTGAAKAVGKVIPSLNGKLTGMSMRVPTSNVSVVDLTCRLEKSVTYDEIKATMKKASEGELKGIMSYSEDALVSTDLNGDNHSCIFDATAG

SEQ ID NO: 60641 - protein, 418 aa, Escherichia coli
MTLLALGINHKTAPVSLRERVSFSPDKLDQALDSLLAQPMVQGGVVLSTCNRTELYLSVEEQDNLQEALIRWLCDYHNLNEEDLRKSLYWHQDNDAVSHLMRVASGLDSLVLGEPQILGQVKKAFADSQKGHMKASELERMFQKSFSVAKPFALKQISVPALCLSLLPACTVARQIFESLSTVTVLLVGAGETIELVARHLREHKVQKMIIANRTRERAQILADEVGAEVIALSDIDERMREADIIISSTASPLPIIGKGMVERALKSRRNQPMLLVDIAVPRDVEPEVGKLANAYLYSVDDLQSIISHNLAQRKAAAVEAETIVAQETSEFMAWLRAQSASETIREYRSQAEQVRDELTAKALRALEQGGDAQAIMQDLAWKLTNRLIHAPTKSLQQAARDGDNERLNILRDSLGLE

SEQ ID NO: 60642 - protein, 189 aa, Mesorhizobium loti MAFF303099
MFIQTESTPNPATLKFLPGKEVLLEGTADFRDADSAATASPLAGRLFEIPGVTGVFFGYDFITVTKDGPDWQHLKPAILGAIMEHFMSGAPVMAKSGPAAETSQTGEFYDKADEELVITIKELLDTRVRPAVAQDGGDITFRGFENGTVFLHMKGACAGCPSSTATLKHGIQNLLRHFVPEVQQVEQVA

SEQ ID NO: 60643 - protein, 1320 aa, Emericella nidulans
MGKTSAKDVAELKDYQLGDCLGRGAFGSVYRALNWNTGETVAVKQIKLADLPKSELRVIMLEIDLLKNLDHPNIVKYQGFVKSAETLNIILEYCENGSLHSIAKNFGRFPETLVGVYMSQVLHGLLYLHDQGVIHRDIKGANILTTKEGLVKLADFGVASRTTGLSESSVVGTPYWMAPEVIELSGATTASDIWSLGCTVIELLEGKPPYYNLQPMPALFRIVNDDHPPLPQGASPAVKDFLMQCFQKDPNLRVSARKLLKHPWIVNARRSDSVVPKKSTEYEEAVKSVQEWNEALRSPESNALRRGTRNENQNPPSLRLDTRHTPTKVTLPSPVSRIVADKFSSPSSGEEDNWDDDFATAISPSALQLPHLRPHDNFGGMLSSEKLKAFASLDGTVLKSDESFEESDDPFKGSLLAGEHDPLKTIRPPPSQQANSGTSQSQNGPYGAHMRRGPPLNTAITPVYGGQMLQNSSSPIRQQRPPLFYKENSVEDYSDLISANEDVLDRKISAFQVGPTLRTPEGSDHAADVHQESDEHKDLADTGRSREVIRYQSSYEQEDTPRIGRQISVKRYRGTVEIQQFAENEHDEDFSDILGVDGVTLDKAESDDGSNKSTLMLNTKLSNNSWLGDLDDEDDPFALLEEGLDETDLEANIARDKHARLRSQVEGLVGSLKTSQDEEVLGDISEQLLAVFCDFPETKNIIISAHGMLPILEILDLCRRRDITLCLLKIVNAIIYDDYEIQENLCFVGGIPIINEFAAKKYPREIRLEAAAFVQQMYQTSTLTLQMFVSAGGLNVLVEFLEDDYEDERDLVLVGVNGIWSVFELQGSTPKNDFCRILSRSSVLDPLSLVLSRVLDEEGELAEVVEGRIANIFFIFSQAENHVKEMVSERTVLHRVLKELKRMTPAHQITMLKFIKNLSMLSTTLDSLQNSNAIDVLTDLLRSTIKRPHFREVSNQILNTIYNMCRLNKSRQEDAALNGIVPLLQKIVKTERPLKEFALPILCDMAHSGKVGRRELWRNKGLAFYISLLSDPYWQVTALDAIFIWLQEETAKVEEHLLENRYDQPSFTDAIVRCLTLSKANAFENILEPLQKLLRLSPPIASTLARPDLFSRLGQKLHHSKAAVRLNLLRIISSICDSSEQQGGLLASYGLLDSIRELEHDPAILVRDMAGKLIQSSERNDSYGLCKLKPNVRRGSTSATSPGLLANQSAPVTPQLSRQNQSKGYYDSRETQRRPRSAISGSALALRPGSRDGPTPGIVGGANGSAGASRNRIARGVSNRLSHIELLPNDDDRIPSSITRRSSVLPRRRRLTQFEAERGS

SEQ ID NO: 60644 - protein, 451 aa, Bacillus sp. SG-1
MSNSLSLFNLEKNFQEAHEGLSSREAVEEANRCLYCYDAPCIQACPTGIDIPSFIKKIASGNLKGSAKTIMLSNPVGASCSRVCPTDELCEGACVLNHSTKPIMIGDLQRYATDWARHNEEVLFEAGEPNGKTVGIIGGGPAGLSAARELARFGYEVTIYEAEKEAGGLNTYGIVSFRLPQSVSFWEVDQVKKLNVEIKTNTRVGRDVSAEELVNKHDFIILAAGMAHVPNLRIDGEDLEGVHDAIEFVKATKSGEISKDYIGKKVVVIGAGNTAIDGATCSVRLGAENVKILYRRTQEEMTAYDFEYEFAKQDGVEFRWLTAPKRIIGNDEGKVTGIECIKMELGEPGEDGRRRPVPVKGSEFILPVDAVIKAIGQTRHQSLIDQFDLDHRDGVVQVNRETFQTSNPKVFACGDIVFGKGVGEAMVVTAAEQGKQTAHHLHKQLTKVQLN

SEQ ID NO: 60645 - protein, 390 aa, Archaeoglobus fulgidus DSM 4304
MRKTGGLPLSRRLARRVEELKPSGIRRFFDLVVGRDDVISLGVGEPDFPVPWRIREEMIYSLEKGYTSYTSNLGLPELREGIAEYYTRFGVKALPEQVMVTSGVSEGVDIAIRALIEPGDAALIPEPCYVSYKPLVEICGGEAVTIPTAPEFRLTYEMLMQYRDAKAKILVLNYPANPTGVSYSKKELEEIADAVNELDLIVLSDEIYAELTYTGRHVSMAALNGMEDRVVIFNGFSKAFAMTGMRVGYVIAPPDIFAGMLKIHQYCMLCAPITGQIGAIEALRSLDEVERMRAEYMRRRNFVVKRLSEIFEIKKPEGAFYAFPKISSTGMSSEEFAEKLLLEKSVAVVPGNAFGECGEGYVRLAYAVKFEKLKEAMDRIKEFVEEHGEG

SEQ ID NO: 60646 - protein, 756 aa, Brucella suis 1330
MRELTTGPRVLLKRLRELMAEPLEPQARLDRIVREIAQNMVAEVCSFYILRADGVLELYATEGLNPQAVHLAQLRLGQGLVGTIAASARPLNLTDAQSHPAFAYLPETGEEAYNSFLGVPVLRAGRTLGVLVVQNRTKRAYREDEVEALETTAMVLAEIIATGDGLRLARPGIELDLGRPMSVSGHGFNDGIGLGHVVLHEPRIVVTNLFNEDSQAELNRLDEALGSLRISIDDMLSRRDVAVEGEHREVLEAYRMFAHDRGWVRRLEEAVHNGLTAEAAVEKVQSDTRARMVHLTDPYMRERLSDFDDLANRLLRQLMGRDVKTIAESLAKDAIIVARSMGAAELLDYPRERLRGVVLEDGAATSHVVIVARAMGIPVVGQAKGVVSMAENNDAIIVDGDEGIVHLRPQADVESAYAEKVRFRARRQAHYRELRDKPAITKDGVDIALLMNAGLLVDLPQLSASGAAGIGLFRTELQFMVASTFPRSEQQERLYRSVIDAAGDKPVTFRTLDIGGDKVLPYFRATAHEENPALGWRAIRLTLDRPGLLRTQLRALLKAAGGRELKLMLPMVTEVSEVKAAREIIEREVRHLSRFAHSLPLCLKLGAMVEVPALLWQLDELMTAVDFVSVGSNDLFQFLMAADRGNSLISDRFDQLSPSFLRALRHIVKAGARHEKPVTLCGEMAGRPLTAMTLIGLGFRSISMSAAAIGPVKAMLGALDAGKLNALLLEELNKPNNAHSLRELLLRFAEDNEIPL

SEQ ID NO: 60647 - protein, 375 aa, Xanthomonas campestris pv. vesicatoria str. 85-10
MSKRDYYEVLGVARGASDEELKKAYRRCAMKHHPDRNPGDAAAEAAFKECKEAYEVLSDGNKRRAYDAHGHAAFEHGMGGGGGPGGPDMGDIFGDIFGNIFGGGAAGPRAARRGADVGYVLELDLEEAVAGIERRIEIPTLVECAPCHGSGSEDGKVETCGTCHGRGQVRIQRGIFAMQQSCPHCDGRGTLIQNPCKTCHGAGRVEEDKVLSIKVPAGVDTGDRIRLAGEGEAGPAGTPPGDLYVEVRVREHAIFQRDGDDLHCEVPIRISQAALGDTVRVATLGGEAEIRIPAETQTGKLFRLRGKGVRSVRSRSEGDLYCRVVVETPVNLTADQRELLQQFEATFTGEDARKHSPKSATFIDGVKGFWDRMTS

SEQ ID NO: 60648 - protein, 517 aa, delta proteobacterium MLMS-1
MSCPPAEPDPPPFIFDNSYARLPAAFYRFCNPTPVAAPRLLKLNAALAGELGLQLEGLDEQALAEIFAGNRLSAGAQPLAMAYAGHQFGSLVPQLGDGRAILLGEVLDGRGRRWDIQLKGAGKTPFSRGGDGRAPLGPVIREYLVSEAMHALGIPTTRALAAVSSGEQVMRERLLPGAVITRVAASHIRVGTFEFFARRGDFASLRTLADYVIPRHYPEINGPEINGPETNGPEIGGAGGHSRYLALLAAVIARQAELVARWMSIGFIHGVMNTDNTTISGETIDYGPCAFLDHYHPETVFSAIDTGGRYAYHMQPRIAQWNLARFAESLLPLLHDDQEQAIALATALLQDFMPRYEKAWLTRMGNKIGLTDPQPDDRKLIEELLAAMADNEVDFTLFFRRLANAVENPTEADGIRPLFNRPEAWEHWAEGWHKRLAADPLPPAERAKRMRSVNPAIIPRNHRIEQAISKATEAADFSDFTKLNQALNHPWEDNPERDRWLAPPAPEERVRQTFCGT

SEQ ID NO: 60649 - protein, 501 aa, Zea mays
  misc_feature (437)..(437): Xaa can be any naturally occurring amino acid
MFTPSNYSYAERETQKPVLLDYSVRQFRPERRRYVYAPQPLLLIRISCFPQKIHVLIFSAAAPNFPLISCCLFRRRRTSSFPSLSTGAGLPWGGDRLGPTHILGSVGGAKMSDNLMDKVSAFGERLKITGTEVSKKMTAGMSSMSFKMKELFQGQTPADKIVEGATSEELDGPDWNSNLEICDLINTEKVDSMELIRGIKKRIMLKDARVQYLSLVLLETIVKNCDKAFSEVAAERVLDEMVRLIDDPQTVVNNRNKALMLIEAWGESGDELRYLPVYEETYKSLKSRGVRFPGRDNESLAPIFTPARSVAEADVDASLPQQVFEDVHVHTYTAEETKEAFDVARNSVELLSTVLSSSPEQDALQDDLTTTLVQQCYQSQHTIQMIIETVGDNEAVLFEALSVNDEIQKLLSKYEEMKQPRASEHAEHVPVVIPIAXHEDLNAVGNEDALVRKPAAARATSGGDDDILDDLDEMIFGKKGGSSSQEGPKKPDPKKDDLISF

SEQ ID NO: 60650 - protein, 546 aa, Oryza sativa
MTKPQQQSPPSTTATTTTSPPPPPPSTPPPASSSSSSLAKLPLRLHSLASSSRSLLSALRRSPVTTLVAAFFLLALFMYGEDVRTLAELSIDDYLYPDADFYNVSALPPLLLPPPTCDLSRGRWVFDNTSLPAYREKECTFLTKQVSCLANGRPDDLWQYWRWQPNNCSLPTFDARRFMEKMRGKRMMFVGDSLNRNQWESLVCLVQPILSKGRKKIVKRGSFNIFYAKEYRATLEFYWAPFLVESNSDNPNFHHIDQRIISPERIESHANNWKDVDYLIFNTYIWWMNNEDIKVRRPNSTSWSDHDEVPRIETYGRVFKTWSTWLEQNVDPARTSVFFMTISPLHNSSKIGIGGRWFNTDAVITFCQFNIDEPCISATGSLELWNILKYRHRVRWFPAQWGNPNGIKCVKETLPVLNYTKPLDLNHDMRMYDLVAKVAKNMKNVPVSLIDITRMSDYRKDAHTSLYSIRQGKLLTPEQKADPQKYADCIHWCLPGKLPISVNRRNHLQRDDKSLSWNQLTPNLSVAISDLSKWSTLKCWYLQIAL

SEQ ID NO: 60651 - protein, 423 aa, Brucella suis 1330
MARIVMKFGGTSVADLERIYNVARHVKREVEAGNQVAVVVSAMSGKTNELVDWVQNMPKVCGASSPFYDAREYDTIVASGEQVTSGLLAIALQSIGVDARSWQGWQIPIQTDNAHGAARIQEIDGSQIIRRMEMGQVAVVAGFQGIGPDNRVATLGRGGSDTSAVAVAAAVKADRCDIYTDVDGVYTTDPRIEPKARRLPKISFEEMLEMASLGAKVFQVRSVELAMVHKVRTFVRSSFTDPDAPGMGDPINPPGTLICDEEEIVEQQVVTGIAFAKDEAQISLRRVADRPGVSAAIFGPLAEEHINVDMIVQNVSEDGSKTDMTFTIPTGDIDKALKVLDKAKSEISFDNIQSETGLAKISVIGIGMRSHAGVAATAFKALAEKGINIRAITTSEIKISILIDGPYAELAVRTLHAVYGLDK

SEQ ID NO: 60652 - protein, 271 aa, Arabidopsis thaliana
MASIASSSSTTLLSSSRVLLPSKSSLLSPTVSFPRIIPSSSASSSSLCSGFSSLGSLTTNRSASRRNFAVKAQADDLPLVGNKAPDFEAEAVFDQEFIKVKLSEYIGKKYVILFFYPLDFTFVCPTEITAFSDRYEEFEKLNTEVLGVSVDSVFSHLAWVQTDRKSGGLGDLNYPLVSDITKSISKSFGVLIPDQGIALRGLFIIDKEGVIQHSTINNLGIGRSVDETMRTLQALQYVQENPDEVCPAGWKPGEKSMKPDPKLSKEYFSAI

SEQ ID NO: 60653 - protein, 254 aa, Cryptococcus neoformans var. neoformans B-3501A
MAKQLVQRLSPLIEELLQASDLSTVSAKAIRKELIARGADKYEIKNFRAEIDDKVTITEIYNSLGSKEAPAPKIEGSVSPSAKAPSSPHSLIEPKTVTCKRKAPTSENEETDEQMARRLQGEYGGSRTRKQRSSRSARPAKKTRPKSHAHIDNETEKNGDKKDDTKTKRGGAFNKELLLSDSLAELVGSHSLSRPQVVKHIWAYVKERNLQDSNDRRYILCDDKLREVFHTDRLHMFTMNKILVNHLRDPDDIA

SEQ ID NO: 60654 - protein, 162 aa, Vitis vinifera
  misc_feature (24)..(24): Xaa can be any naturally occurring amino acid
MVSGLINANPVIYQKKERQVRIAXCDSDEDIKDPEHPYSLEELKVITEDAIEVDDKRSYVRVTFTPTVEHCSMATVIGLCLRVKLLRSLPSRYKVVVGLVLIQKLSRFQLRRSKVDIKVAPGTHATEAAVNKQLNDKERVAAALENPNLLDMVDECLAPSYG

SEQ ID NO: 60655 - protein, 517 aa, Zea mays
MASSASTLEIEARDVVKIVLQFCKENSLQQTFQTLQNECQVSLNTVDSIDTFIADINAGRWDAVLPQVAQLKLPRKKLEDLYEQIVLEMAELRELDTARAILRQTQVMGVMKQEQPERYLRLEHLLVRTYFDPNEAYQESTKEKRRALIAQAVASEVSVVPPSRLMALIGQALKWQQHQGLLPPGTQFDLFRGTAAMKQDEEETYPTSLSHQIKFGKKTHPECARFSPDGQYLVSCSVDGIIEVWDYLSGKLKKDLQYQADESFMMHEEPVLCVDFSRDSEMLASGSQDGKIKVWRIRTGQCLRRLERAHSKGVTSVTFSRDGTQILSTSFDTTARVHGLKSGKMLKEFRGHSSYVNYAIFTTDGSRVITASSDCTVKVWDTKTTDCLHTFKPPPPLRGGDASVNSVHLFPKNTDHIVVCNKTSSIFIMTLQGQVVKSFSSGKREGGDFVAASVSPKGEWIYCVGEDMNMYCFSYQSGKLEHLMKVHEKDVIGITHHPHRNLVATIAEDCMMKIWKP

SEQ ID NO: 60656 - protein, 498 aa, Hordeum vulgare
MRTNPTTSRPGVSTSEEKSTGRIDQIIGPVLDVTFPPGKLPYIYNALVVQSRDTADKQINVTCEVQQLLGNNRVRAVAMSATDGLMRGMEVIDTGAPLSVPVGGATLGRIFNVLGEPVDNLGPVDSSATFPIHRSAPAFIELDTKLSIFETGIKVVDLLAPYRRGGKIGLFGGAGVGKTVLIMELINNIAKAHGGVSVFGGVGERTREGNDLYMEMKESGVINEKNIEESKVALVYGQMNEPPGARMRVGLTALTMAEYFRDVNKQDVLLFIDDIFRFVQAGSEVSALLGRMPSAVGYQPTLSTEMGSLQERIASTKKGSITSIQAVYVPADDLTDPAPATTFAHLDATTVLSRGLASKGIYPAVDPLDSTSTMLQPRIVGNEHYETAQRVKETLQRYKELQDIIAILGLDELSEEDRLTVARARKIERFLSQPFFVAEVFTGSPGKYVALAETIRGFQLILSGELDGLPEQAFYLVGNIDEASTKAITLEEENKSQK

SEQ ID NO: 60657 - protein, 420 aa, Erwinia carotovora subsp. atroseptica SCRI1043
MSFTTISVIGLGYIGLPTAAAFASRQKKVIGVDVNKLAVETINRGEIHIVEPDLDTLVKVAVENGYLQAMTKPVPADAFLIAVPTPFKGDHEPDLAYVQAAAASIAPVLKKGDLVILESTSPVGATEQMAEWLADARADLTFPQQVGETADINIAYCPERVLPGQVVVELIKNDRVIGGMTPVCSARASELYNIFLEGECVVTNSRTAEMCKLTENSFRDVNIAFANELSLICAEQNINVWELIRLANRHPRVNILQPGPGVGGHCIAVDPWFIVAQNPQQARLIHTARLVNDGKPLWVVDRVKAAVADYLAQTDKRASEVTVACFGLAFKPDIDDLRESPAVGITSMIAQWNTGVTLVVEPNVKHLPSVLAGQVKLVDTSSALKEADVLVMLVDHRQFKAINPDDVKQQWVIDTKGVWR

SEQ ID NO: 60658 - protein, 504 aa, Burkholderia sp. 383
MNANSKDVPTVKLLIDGAFVESATNEWRDIVNPATQQVLARVPFATVAEVDAAVQAAHTAYATWKNTPIAARMRIMLKFQDLVRTNQQRIAKTLTAEQGKTIPDAEGDIFRGLEVVEHACSIGSLQLGEFAENVAGGVDTYTLRQPLGVCAGITPFNFPAMIPLWMFPMAIVCGNTFVLKPSEQDPLSTMELVELAVEAGVPKGVLNVVHGGKEVVDAICTHPLVKAISFVGSTAVGTHVYNLGSANGKRVQSMMGAKNHAVVLPDANREQAINALVGAGFGAAGQRCMATSVAVLVGNARDWLPDIVAKAKALKVNAGAEAGTDVGPVVSKAAKERILSLIDAGVKEGAKLELDGRDVKVTGYEHGNFVGPTIFSGVKTGMSVYTHEIFGPVLVVMEADTLDEAIALVNANPFGNGVGLFTQSGAAARKFQSEIDIGQVGINIPIPVPVPFFSFTGSRGSKLGDLGPYGKQVVQFYTQTKTVTARWFDDDTTAGPVNTTIRLH

SEQ ID NO: 60659 - protein, 123 aa, Glycine max
DAIGNMLVKFPPLLTYSLNKKIRPVVIFLMTKAGVSEKDIAKVVALGPELLGCNIAHKLDLNVKYFLSLGIRLRQLGEMIADFPMLLRYNPDVLRPKYIYLRKTMVRPLQDLTEFPRFFSYSP

SEQ ID NO: 60660 - protein, 267 aa, Flavopunctelia flaventior
NDPFIEPHYAAYMLKYDSQHGQFKGTIEVKGSDLVVNGQTVKFYTEKDPANIPWKDTGAYYIVESTGVFTTTEKAKAHLKGGAKKVVISAPSADAAMFVMGVNEKEYKPDIEIISHASCTTNCLAPLAKVMHDNYTIIEGLMTTIHSYTATQKTVDGPSAKDWRGGRTAAQNIIPSSTGAAKAVGKVIPSLNGKLTGMSMRVPTSNVSVVDLTCRLEKSVTYDQIKETMKKASEGDLKGIMSYSEDALVSTDLNGDNHSCIFDATAG

SEQ ID NO: 60661 - protein, 253 aa, Physcomitrella patens subsp. patens
MCLSTWLFVLVAGESALILIRHGESLWNSKNLFTGCVDVPLSQKGVEEAIEAGKCISELPVDMIFTSALIRAQMTAMLAMTQHHRQKVPVILHNESERAEAWSRIYSDTDDVIPVVTAWQLNERMYGELQGLNKAETAEKFGTEKVKEWRRSYDIPPPNGESLEMCAERAVKYFVDNVVPELESGKNIMIAAHGNSLRAIIMYLDKLTSKEVIELELSTGIPMLYTLQDSKFLRRGSPVGPTVQGVYALTQVS

SEQ ID NO: 60662 - protein, 372 aa, Physcomitrella patens subsp. patens
MDGGGPDWKGLLKWSIAHSDGTQAPRQLSEEDKRFFAEAMESQTVDIIKRMKEISMVMNMPSEVLESQGVTVEELEELLEELQEHVESIDMANDLHAIGGLVPLLNYLKNPNAGIRSRAAEVVSTIVQNNPKSQQQVMECNGLEKLLANFNSDDNMKVRTKALGAISSLIRNNKVATDAFRLSNGYAGLREALASEDTRFQRKALQVMQYLLKETPKDHNVATQLGFVRSLTNLVNSPDHDLRQATLQSLVEIIRNQDNQSSGKYDDTTQLKDVISKRVEDIKKMNKEDLAAVKEERILVDLLWQLLYKEPSELRKEGLLVTPEDNAPPPDVASRTFASGLRALAESSPVEPSSGQNESQEGNKKTVLLLGP

SEQ ID NO: 60663 - protein, 273 aa, Melanelia stygia
VEHGDVKVAAVNDPFIEPHYAAYMLKYDSQHGQFKGTIEVKGSNLVVNGQTVKFYTEKDPANIPWKDTGAYYIVESTGVFTTTEKAKAHLKGGAKKVVTPAPSADAAMFVMGVNEKEYKSDIEIISNASCTTNCLAPLAKVMHDNFTIIEGLMTTIHSYTATQKTVDGPSSKDWRGGRTAAQNIIPSSTGAAKAVGKVIPSLNGKLTGMSMRVPTSNVSVVDLTCRLEKSVTYDQIKATMKKASEGELKGIMSYSEDALVSTDLNGDNHSCIF

SEQ ID NO: 60664 - protein, 362 aa, Rhizobium leguminosarum bv. viciae 3841
MRCPNDVTHCSIFAACKALPSAISSQHAIKGMKIMGMLVDGVWHDAWYDTKESKGHFKRQPSQFRNWVTSDGGAGPSGSGGFKAEAGRYHLYVSLACPWAHRTLIFRKLKKLEELISVSVVDPLMLENGWEFKVGDGATGDHLFGASALWQVYVRADPHYSGRVTVPVLWDKKTGTIVNNESAEIIRMFNGAFDGLTGSTADFYPEDLRSEIDALNATVYDTVNNGVYKAGFATTQEAYAENVGTLFETLDLLDERLGKGRYLFGDRQTEADWRLFTTLVRFDAVYVGHFKCNIRRIADYRNLPGYLRDLYQTAGVAETVNLHHIKQHYYRSHKTINPTGIVPVGPALDLDSPHGRARLNAA

SEQ ID NO: 60665 - protein, 263 aa, Menegazzia terebrata
PFIEPHYAAYMLKYDSQHGQFKGTIEVKGSDLVVNGQTVKFYTEKDPANIPWKDTGAYYIVESTGVFTTTEKAKAHLKGGAKKVVISAPSADAAMFVMGVNEKEYKSDIEIISNASCTTNCLAPLAKVMHDNFTIIEGLMTTIHSYSATQKTVDGPSAKDWRGGRTAAQNIIPSSTGAAKAVGKVIPSLNGKLTGMSMRVPTSNVSVVDLTCRLEKSVTYDQIKETMKKASEGELKGIMAYSEDALVSTDLNGDNHSCIFDAT

SEQ ID NO: 60666 - protein, 491 aa, Bordetella parapertussis 12822
MNPPALPLPADTAAVPVADRWQTQLQIGSIRAASTEPWLVSGRITRAAGLVLHATGLRLPVGAACRIELARGHDHWADAEVVGFDGHTLYLMPQSDISGLPPGARVVPAEPAVQRPVPLPRKAELNGNAKPQVGRHLPVGNAMLGRVVDGAGRPLDGLGPLAGAEQAPLTALPINPLSRAPIDSVLDVGVRAINGLLTVGRGQRMGLFAGSGVGKSVLLGMMARYTRADIIVVGLIGERGREVKEFIEHNLGPEGLARSVVVAAPADVSPLLRLQGASYATRLAEHFRDQGLDVLLIMDSLTRFAMAQREIALAIGEPPATKGYPPSVFAKLPALVERTGMGAPSPNGKAGSITAFYTVLAEGDDQQDPIADSARAILDGHVVLSRHLAEAGHYPAIDIEASISRAMTSLITTEQFQQVRRFKQILSRYQRNRDLISVGAYVAGADPQLDDAIARYPRLEAYLQQNIGDSVDYGTAIDQLQRSLETREAYA

SEQ ID NO: 60667 - protein, 759 aa, Mesorhizobium loti MAFF303099
MARKTENNGPSVSAQEALEFHAMGRPGKLEIVATKPMTTQRDLSLAYSPGVAVPVRAIAEDPSRAFDYTTRGNMVAVISNGTAILGLGNLGALASKPVMEGKAVLFKRFADVDSIDLEVDTEDADEFINCVRFLGPSFGGINLEDIKAPECFIIEQRLRELMDIPVFHDDQHGTAIISAAGLINALEITGRDMKTTRLVCNGAGAAGIACIELMKAMGFAPENIILCDTKGVVFQGRTEGMNQWKSAHAVKTEARSLADALDGADVFLGLSAKGALTTAMVQSMAKNPIIFAMANPDPEITPEEVAEIRTDAIMATGRSDYPNQVNNVLGFPYIFRGALDVRATTINEDMKIAAARALAELARQDVPDDVAAAYQGNRPKFGPNYIIPVPFDPRLISAIPLAVAKAAMESGVARKPILDLDRYAQELSARRDPIASTLQRIYDRVRRQPKRIVFAEGEEEQVMRAAVSYVNQRLGTAILLGRDDVIKENAKHAGIDLNKQGIEIINARLSRRNGIYTDYLYERMQRKGFLFRDCQRLINNDRNHFAACMVALGDADGIVTGVTRNYSTALDDIRRVIDAKPGHRVIGVSIVLARGKTVLVADTAVHDMPNAEQIADIAEEAAGFARRMGYEPRLAMLAYSTFGHPQGERSERVQEAVRILDKRRVDFEYDGEMAADVALNARAMAQYPFIRLTGPANVLIMPAFHSASISTKMLQELGGSTVIGPLLVGLNKPVQIVSLNAKDSDIVNMAAIAAYTAGT

SEQ ID NO: 60668 - protein, 718 aa, Saccharomyces cerevisiae
MGSDRSCVLSVFQTILKLVIFVAIFGAAISSRLFAVIKFESIIHEFDPWFNYRATKYLVNNSFYKFLNWFDDRTWYPLGRVTGGTLYPGLMTTSAFIWHALRNWLGLPIDIRNVCVLFAPLFSGVTAWATYEFTKEIKDASAGLLAAGFIAIVPGYISRSVAGSYDNEAIAITLLMVTFMFWIKAQKTGSIMHATCAALFYFYMVSAWGGYVFITNLIPLHVFLLILMGRYSSKLYSAYTTWYAIGTVASMQIPFVGFLPIRSNDHMAALGVFGLIQIVAFGDFVKGQISTAKFKVIMMVSLFLILVLGVVGLSALTYMGLIAPWTGRFYSLWDTNYAKIHIPIIASVSEHQPVSWPAFFFDTHFLIWLFPAGVFLLFLDLKDEHVFVIAYSVLCSYFAGVMVRLMLTLTPVICVSAAVALSKIFDIYLDFKTSDRKYAIKPAALLAKLIVSGSFIFYLYLFVFHSTWVTRTAYSSPSVVLPSQTPDGKLALIDDFREAYYWLRMNSDEDSKVAAWWDYGYQIGGMADRTTLVDNNTWNNTHIAIVGKAMASPEEKSYEILKEHDVDYVLVIFGGLIGFGGDDINKFLWMIRISEGIWPEEIKERYFYTAEGEYRVDARASETMRNSLLYKMSYKDFPQLFNGGQATDRVRQQMITPLDVPPLDYFDEVFTSENWMVRIYQLKKDDAQGRTLRDVGELTRSSTKTRRSIKRPELGLRV

SEQ ID NO: 60669 - protein, 185 aa, Desulfitobacterium hafniense DCB-2
MNLPNQLTMARIILIPIFMALLLIQFPKGQPIFPYQDFVAAMIFILAAATDGLDGYIARKRGQVTVLGKFMDPLADKLLVSAALIALVDLGHVPAWICWIILAREFAVTGLRAIASADGTVIAASKLGKIKTVSQVVAISLILLHDWPLSLFNLYLGQPLLYVALFFTIVSGVDYLVKSKKLLKK

SEQ ID NO: 60670 - protein, 227 aa, Desulfococcus oleovorans Hxd3
MKDKLEQIRERIQAATEACGRDPATVRLVAVSKTQPVSRIAEAIAAGATDLGENYIQEAKEKIESLAGHSVCWHFIGHLQSNKAKIAVSLFDWIHTVDSVKLAAEIDKHAAKLGKVQKILIQVNTGQERSKSGVAPEDMAGLVTEISRFAHVTVQGLMAIPPFYADPEAVRPHFKKLRMLRDAIEKQQIPNVVMEELSMGMSGDFDAAIAEGATMVRIGTAIFGARQ

SEQ ID NO: 60671 - protein, 342 aa, Blastopirellula marina DSM 3645
MDRVPSIRIFAAVLLAALIVGVASAQEPTAMLDRTIQLRPEPGRLHPPVISDISIHPAGAIFAAAGDDHIVRVFEMDSGNELYRLEEHHDWVRAVKFSPDGATLATAGNDRRIILWDVERRAQLRSMGEFPYAVADVAFNKAGTMLAIVGFGPTIAIHDPITGQKLHELEAPINDMRCVSFSPDGAIVAAAGRNGVIRTWDAVSGRPLGDVKAHRQRIHSLVFSSDSSQLISCSDDRTIKVTDLGQNKERTSMSSAPAKVMALTLINDTTLVSAGSDNRLRLWDLTTHAEIAKLEGHSGSVTAIDVYNDVIVSGGFDTTVRIWKIQSGERTAQSPQGSLFTK

SEQ ID NO: 60672 - protein, 480 aa, Xanthomonas campestris pv. vesicatoria str. 85-10
MSEQEQFDVVVIGAGPAGYHAAIRAAQLGMKVACIDAALGKDGKPALGGTCLRVGCIPSKALLDSSRQFWNMGHLFGDHGISFNDAKMDVPTMIGRKDKIVKQFTGGIAMLFKANKITPYYGFGQLLPGNIVKVTQHEGGEIELKGTNVILAAGSESIELPFAKFDGDTIVDNVGGLDFTAVPKRLAVIGAGVIGLELGSVWKRLGAEVTILEALPDFLALADAEVAKTALKEFKKQGLDIKLGAKVSKTEITGSGDAKQVVLSYTDAAGEQTLTVDKLLVAVGRKAATKNLLAEGTGVKVTDRGQIEVDGHCHTGVDGVWAIGDCVRGPMLAHKGFEEGIAVAELIAGLPGHVNFDTIPWVIYTEPEIAWVGKTEQQLKAEGVAYKAGSFPFAAIGRAVAMGEPAGFVKVIADAETDRVLGMHLVGVGVSELVHEGVLTMEFNGSADDLARICHAHPTLSEAIHDAAMAVSKRAIHKAN

SEQ ID NO: 60673 - protein, 353 aa, Penicillium chrysogenum
MGCGMSTEDKEGKARNEEIENQLKRDKLMQRNEIKMLLLGAGESGKSTILKQMKLIHEGGYSRDERESFKEIIYSNTVQSMRVILEAMESLELPLEDARHEYHVQTIFMQPAQIEGDSIPPEVGNAIGQLWRDTGVQECFKRSREYQLNDSAKYYFDSIERIAQPDYLPTDQDVLRSRVKTTGITETTFIIGDLTYRMFDVGGQRSERKKWIHCFENVTTILFLVAISEYDQLLFEDETVNRMQEALTLFDSICNSRWFVKTSIILFLNKIDRFKEKLPVSPMKNYFPDYEGGADYAAACDYILNRFVSLNQAEQKQIYTHFTCATDTTQIRFVMAAVNDIIIQENLRLCGLI

SEQ ID NO: 60674 - protein, 404 aa, Xanthomonas campestris pv. vesicatoria str. 85-10
MATEVKVPVLPESVSDATIASWHKKAGEAVKRDENLVDLETDKVVLEVPSPVDGVLKEIKFDTGSTVTSNQILAIIEEGAVAAAAPAEEKKADAPAPAAAAPAAAPAPAAAAAPAAASKSAADALPPGARFSAITQGVDPSQVEGTGRRGAVTKEDIVNFAKAGGVGKASGARPEERVPMTRVRKTIAKRLMESKNSTAMLTTFNEVNLAKVSAARKELQDEFQKAHGIKLGFMSFFVKAAANALQRFPLVNASIDGDDIIYHGYSDISIAVSTDKGLVTPVLRNVERQSFADVEQGIADYAAKARAGKLGLDDLQGGTFTITNGGTFGSLLSTPIINPPQSAILGMHAIKERPIAENGQVVIAPMMYLALSYDHRIIDGKDSVQFLVDIKNQLENPGRMLFGL

SEQ ID NO: 60675 - protein, 77 aa, Bacillus sp. SG-1
MAEVLDRVTKIIVDRLGVDESQVTLEASFKEDLGADSLDVVELVMELEDEFDMEISDDDAEKIATVGDAVNYINNKG

SEQ ID NO: 60676 - protein, 363 aa, Chromobacterium violaceum ATCC 12472
MSLKCGIVGLPNVGKSTLFNALTKAGIEAANYPFCTIEPNVGIVEVPDHRLGELAKIINPQKIQPAIVEFVDIAGLVAGASKGEGLGNQFLANIRETDAIVNVVRCFDDPNIVHVAGKVDPIADIETILTELALADLSAVEKAIAREGKKAKAGDKDARALIAILEKLVPHLNEGKPARSLGLSDEDKALIKPLCLLTIKPAMYVANVAEDGFSDNPLLAKVEEYAAKEGAPVVALCAAIESEIAELEDADKAEFLETLGLEEPGLDRLIRAGYKLLGLQTYFTAGVKEVRAWTIHVGDTAPQAAGVIHTDFERGFIRAQTISFQDFVTLGGEAKAKEAGKMRAEGKDYVVQDGDVMNFLFNV

SEQ ID NO: 60677 - protein, 514 aa, Bacteroides fragilis YCH46
MKELINRLEELNRQAEKGGGDARIEKQHSVGKLTARERIDLLLEKGSFIELDKLVTHRCTDFGMEKQKISGDGVVTGYGMIGKRLVYVFAQDFTVFGGALSETYAKKICKVMDMAMQMGAPIIGLNDSGGARIQEGVRSLAGYAEIFLRNSLASGVIPQISAIMGPCAGGAVYSPALTDFILMVKNSGYMFITGPDVVKSVTQEEVSKEDLGGADVHTMKSGVAHLSAENDIECINYIRELISYLPGNNMEEPPFVATTDSPTRLTPELSDLVPTNPNQPYDMKEMIRAVADDNSFFELQEEFARNIVIGYIRLNGKTIGVVANQPLALAGTLDINASVKAARFVRFCDAFNIPLLTLVDVPGFLPGVDQEYGGIIRNGAKLLYAYCEATVPKVTVIARKAYGGAYDVMSSKHIRGDVNLAYPTAEIAVMGPDGAVNILFRKEIDKAADTEARRKELQDDYRSKFANPYRAAELGYVDEVIDPAITRMRLIRSFEMLANKRQSNPPKKHSNLPL

SEQ ID NO: 60678 - protein, 327 aa, Chromobacterium violaceum ATCC 12472
MAAYDSLMVFTGTANPELAQNVVKHLDISLGRADVGKFSDGEVAVELLENVRGRDVFILQSTCAPTNDNLMEILTMADALKRASAGRITAAIPYFGYARQDRRPRSARVPISAKLVANMLTSAGIDRVLTVDLHADQIQGFFDIPVDNVYATPVLLKDIRAQRFDDLIVVSPDVGGVVRARAVAKALNTDLAIIDKRRPKANVAEVMNIIGDVSGRTCLIVDDMIDTANTLCKAASALKERGAERVLAYATHAIFSGQAVDRIKNSDIDMVVVTDTIPLTAAAKACPNIRVASIAGLLAETLRRINNEESVSYLFNEELVATGACLP

SEQ ID NO: 60679 - protein, 227 aa, Glycine max
MAENSNGNGVYVDEEEEEEEIKLKQKKQRLKETLPEVLNRIASAILFQEPADAGSLLRRIKVSVADNATLLPEASRNSARDVLIWTRRGTPFRALFVISVGTVTFVALTGLLVFMLFFLAATVNAIVISLLMSLAAAGGFLALFFAFVTAIYIGALSIAIFAISVTTFWAIVAILMITGWIGFIYTVWLVTRKSFGFAKHSLDVTGSAISSYTTARHARYQIHTNSK

SEQ ID NO: 60680 - protein, 328 aa, Bacillus cereus ATCC 10987
MKAIIVTSFGGPEVMKYTDVDMPVISENQVLIRVVATSVNFADIKSRYGKKGNKALPFIPGIDVAGIVERVGSHVKNINPGQRVIAFPQNGSYAEYVVSNENLTFVLPDEVDFQTAAACPIVSFTSYNLLANVARLQQGESVLIHAAAGGIGTTAIQLAKLLGAGTVIGTVGSEAKKEIPLYAGADYIICHQNEDFAEKVNELTNGEGVDVILDSISGTVSERSLKCLAYYGRLVHFGNASGEIGNFQTKDLHASCRSILGFSFGTTRKKRPELLQATANEVFRYLRDGRLQITATKSFPLQDAGKAHEWVESRKSTGKVILTVQSSS

SEQ ID NO: 60681 - protein, 449 aa, Bacteroides fragilis YCH46
MRYDIAIIGGGPAGYTAAERAGANGLRAVLFEKKAMGGVCLNEGCIPTKALLYSAKVLDGIKSAPKYGVSVEGAPAFDMEKIIGRKNKTVQKLTGGVRMTVNSYGVTIVDKEAVIEGEGEEGFHIRCDGEVYEATYLLVCTGSDTVIPPIKGLSDVDYWTSREALDSTVLPSSLAIIGGGVIGMEFASFFNSMGVRVKVIEMMPEILGAMDKETSAMLRADYTKKGVNFYLNTKVTEVSDKGVTVEKDGKSSFIDADRILVSVGRKANITQVGLDKLNIELHRNGVVVDEHMLTSHPRVYACGDITGFSLLAHTAIREAEVAINHILGIDDRMDYDCVPGVVYTNPELAGVGKTEEELIAKGIYYRIQKLPMVYSGRFVAENELGNGLCKLIIDHNDRIVGCHMLGNPASEIIVVAGIAIQRGYTVDEFRKSVFPHPTVGEIYHETLFA

SEQ ID NO: 60682 - protein, 101 aa, Glycine max
MGNCLKHQSSTNKYDGSDHDSDDWDFLAGEEGSFAATTAKTVTEVKIKIPKKQLEELLSKVDVRELRVEQVLSQLMNHSSGGFQSLQRPWRPALQSIPEVN

SEQ ID NO: 60683 - protein, 578 aa, Shigella flexneri 2a str. 301
MDATTIISLFILGSILVTSSILLSSFSSRLGIPILVIFLAIGMLAGVDGVGGIPFDNYPFAYMVSNLALAIILLDGGMRTQASSFRVALGPALSLATLGVLITSGLTGMMAAWLFNLDLIEGLLIGAIVGSTDAAAVFSLLGGKGLNERVGSTLEIESGSNDPMAVFLTITLIAMIQQHESSVSWMFVVDILQQFGLGIVIGLGGGYLLLQMINRIALPAGLYPLLALSGGILIFALTTALEGSGILAVYLCGFLLGNRPIRNRYGILQNFDGLAWLAQIAMFLVLGLLVNPSDLLPIAIPALILSAWMIFFARPLSVFAGLLPFRGFNLRERVFISWVGLRGAVPIILAVFPMMAGLENARLFFNVAFFVVLVSLLLQGTSLSWAAKKAKVVVPPVGRPVSRVGLDIHPENLWEQFVYQLSADKWCVGAALRDLHMPKETRIAALFRDNQLLHPTGSTRLREGDVLCVIGRERDLPALGKLFSQSPPVALDQRFFGDFILEASAKYADVALIYGLEDGREYRDKQQTLGEIVQQLLGAAPVVGDQVEFAGMIWTVAEKEDNEVLKIGVRVAEEEAES

SEQ ID NO: 60684 - protein, 187 aa, Fusobacterium nucleatum subsp. vincentii ATCC 49256
MNLPNRLTMIRFILAIPFIIFLQYSDSSKYGLIFRLISLVIFVIASLTDFFDGYIARKYNLITDFGKIMDPLADKILVISALVIFVQLEYIPGWMSIVVLAREFLISGIRILAAAKGEIIAAGNLGKYKTTSQMIVVIIALAIGPVGFYISDYFFTIAEVLMLIPVILTIWSGWEYTFKAKHYFTEQ

SEQ ID NO: 60685 - protein, 280 aa, Physcomitrella patens subsp. patens
MAERGGERGGFGRGFGRGDRGDRGGRGDTGRGDRRGGRRGAKRDEEEKWVPVTKLGRLVKDGKIKSLEQIYLFSLPIKEHQIVEFFLGSALKDEVMKIMPVQKQTRAGQRTRFKAFVVVGDNNGHVGLGVKCSKEVATAIRGAIILAKLSVIPVRRGYWGNKIGKPHTVPCKVTGKCGSVTVRLVPAPRGSGIVAARVPKKVLQFAGIEDVFTSSRGSTKTLGNFVKATFECLLKTYGFLTPDLWRETRFSKSPFQEFTDFLAKPHKISVVEDVEKTPVY

SEQ ID NO: 60686 - protein, 278 aa, Hypogymnia physodes
VEHGDVKVVAVNDPFIEPHYAAYMLKYDSQHGQFKGTIEVKGSDLVVNGQTVKFYTERDPANIPWKDTGAYYIVESTGVFTTTEKAKAHLKGGAKKVVISAPSADAAMFVMGVNEKEYKSDIEIISNASCTTNCLAPLAKVMHDNFTIIEGLMTTIHSYTATQKTVDGPSSKDWRGGRTAAQNIIPSSTGAAKAVGKVIPSLNGKLTGMSMRVPTSNVSVVDLTCRLEKSVTYDQIKETMKKASEGELKGIMSYSEDALVSTHLNGDNHSCIFDATAG

SEQ ID NO: 60687 - protein, 520 aa, Saccharomyces cerevisiae YJM789
MLSRTRAAAPNSRIFTRSLLRLYSQAPLRVPITLPNGFTYEQPTGLFINGEFVASKQKKTFDVINPSNEEKITTVYKAMEDDVDEAVAAAKKAFETKWSIVEPEVRAKALFNLADLVEKHQETLAAIESMDNGKSLFCARGDVALVSKYLRSCGGWADKIYGNVIDTGKNHFTYSIKEPLGVCGQIIPWNFPLLMWSWKIGPALATGNTVVLKPAETTPLSALFASQLCQEAGIPAGVVNILPGSGRVVGERLSAHPDVKKIAFTGSTATGRHIMKVAADTVKKVTLELGGKSPNIVFADADLDKAVKNIAFGIFYNSGEVCCAGSRIYIQDTVYEEVLQKLKDYTESLKVGDPFDEEVFQGAQTSDKQLHKILDYVDVAKSEGARLVTGGARHGSKGYFVKPTVFADVKEDMRIVKEEVFGPIVTVSKFSTVDEVIAMANDSQYGLAAGIHTNDINKAVDVSKRVKAGTVWINTYNNFHQNVPFGGFGQSGIGREMGEAALSNYTQTKSVRIAIDKPIR

SEQ ID NO: 60688 - protein, 278 aa, Everniastrum sp. Feuerer s.n.
VEHGEVKVVAVNDPFIEPHYAAYMLKYDSQHGQFKGTIEVKGSDLVVNGQTVKFYTEKDPANIPWKDTGAYYIVESTGVFTTTEKAKAHLKGGAKKVVISAPSADAAMFVMGVNEKEYKSDIEVISNASCTTNCLAPLAKVMHDNYTIIEGLMTTIHSYTATQKTVDGPSAKDWRGGRTAAQNIIPSSTGAAKAVGKVIPSLNGKLTGMSMRVPTSNVSVVDLTCRLEKSVTYDQIKETMKKASEGELKGIMSYSEDALVSTDLNGDNHSCIFDATAG

SEQ ID NO: 60689 - protein, 276 aa, Everniastrum americanum
VEHGEVKVVAVNDPFIEPHYAAYMLKYDSQHGQFKGTIEVKGSDLVVNGQTVKFYTEKDPANIPWKDTGAYYIVESTGVFTTTEKAKAHLKGGAKKVVISAPSADAAMFVMGVNEKEYKSDIEVISNASCTTNCLAPLAKVMHDNYTIIEGLMTTIHSYTATQKTVDGPSAKDWRGGRTAAQNIIPSSTGAAKAVGKVIPSLNGKLTGMSMRVPTSNVSVVDLTCRLEKSVTYDQIKETMKKASEGELKGIMSYSEDALVSTDLNGDNHSCILDAT

SEQ ID NO: 60690 - protein, 306 aa, Pseudomonas syringae pv. phaseolicola 1448A
MNARHFLSMMDYTPDELLGLIRRGVELKDLRIRGELFEPLKNRVLGMIFEKSSTRTRLSFEAGMIQLGGQAIFLSHRDTQLGRGEPIADSAKVMSRMLDAVMIRTYAHSNLTEFAANSRVPVINGLSDDLHPCQLLADMQTFLEHRGSIKGKTVAWIGDGNNMCNSYIEAAIQFDFQLRVACPAGYEPNPEFLALAGERVTIVRDPKAAVAGAHLVSTDVWTSMGQEEETARRMALFAPFQVTRASLDLAEKDVLFMHCLPAHRGEEISVDLLDDSRSVAWDQAENRLHAQKALLEFLVAPSHQRA

SEQ ID NO: 60691 - protein, 118 aa, Brassica napus
THKDREKKPKRSGSMTTVAAVTPPAKRRRTDGGKEIAIIEGLPDHVSEICLSLVCSPSLLAAVCTRWRRLVYSPEFPPFSSLYALFVDSNSDPARVNPAIRFMCFDPVSSKWDPLPPP

SEQ ID NO: 60692 - protein, 105 aa, Desulfitobacterium hafniense DCB-2
MLIWSLMLVCLLNIPFGYWRENVRKLSLPWFMAIHLPVPFVALLRHHLELPGATLLAFLAAYFLGQYLGSRLSRTLRPYGNVSSSLVHDLVHRSWIIIIGRQIGR

SEQ ID NO: 60693 - protein, 494 aa, Azoarcus sp. BH72
MSFADLGLIPELQRAVADAGYTEPTPIQRQAIPIVIAGNDVMGGAQTGTGKTAGFTLPLLHRLARHANTSTSPARHQTRALILAPTRELAMQVYESVKTYSKHLPLRATCIYGGVDMNPQIQELRRGIEIVIATPGRLLDHVQQKTINLTQVEMLVLDEADRMLDMGFIPDIKRILALLPASRQSLLFSATFSDEIKKLADQMLKNPQLIEVARRNMVSETITHRVHPVSSGMKRNLLAHLLRHQPDTQALVFVDTKLVCGRLAHFLERHSISADSIHGDKSQQQRTETLEAFKAGKLRVLVATDVAARGIDIDELPYVINYELPHTAEDYVHRIGRTGRAGHQGNAVSLVCTEEKHLLADIQKLIKLEIPQEVVPGFEPDPDFFEAGSRAHRGRRPVEDFDERPRREPRGGREERPPREERAPREDRGARNVVAKRPPRSTIAPDGFDFSKPYVAKPVVLAEGAAPDASPAEAGTPRRGQRPIAFLLGGLGRK

SEQ ID NO: 60694 - protein, 276 aa, Lactobacillus plantarum WCFS1
METYTLRDGLTVPKIGFGTYKLNGAHGVQVIDSAIDRGYRLLDTAFNYENEGAVGKAVRRSSVPRSELLISSKLPGRHHTYTEAINTIQESLYRAGLDYYDLYLIHWPNPKEDHYVEAWQALINAQKLGLIRSIGVSNFLPEHLERLNKETGVLPVINQVELHPYFNQQAQRDYDQAHGILTQDWSPLGRASEMLQNETLKEIAVHYHKNVGQLILRWELQLGTLPIPKSSTPSRQAGNMDVFDFEISAADMATINGLSQVDGRLNNQDPAVYQEF

SEQ ID NO: 60695 - protein, 382 aa, Shigella flexneri 2a str. 2457T
MIKSALLVLEDGTQFHGRAIGATGSAVGEVVFNTSMTGYQEILTDPSYSRQIVTLTYPHIGNVGTNDADEESSQVHAQGLVIRDLPLIASNFRNTEDLSSYLKRHNIVAIADIDTRKLTRLLREKGAQNGCIIAGDNPDAALALEKARAFPGLNGMDLAKEVTTAEAYSWTQGSWTLTGGLPEAKKEDELPFHVVAYDFGAKRNILRMLVDRGCRLTIVPAQTSAEDVLKMNPDGIFLSNGPGDPAPCDYAITAIQKFLETDIPVFGICLGHQLLALASGAKTVKMKFGHHGGNHPVKDVEKNVVMITAQNHGFAVDEATLPANLRVTHKSLFDGTLQGIHRIDKPAFSFQGHPEASPGPHDAAPLFDHFIKLIEQYRKTAK

SEQ ID NO: 60696 - protein, 177 aa, Leptospira interrogans serovar Lai str. 56601
MSIVKSKIRTIPDYPKPGILFRDITSLLLDPEGLALTIGTFVNRYQGKGITKVAGIEARGFLTGAPLAFQLGVGFIPIRKKGKLPSETVSEEYDLEYGKDVIEVHKDSIQPGDKILLMDDLIATGGTMIAAVKLLKKLGAEIYEAGVIIDLPDLGGRKKLQEELKVPVFSICEFEGH

SEQ ID NO: 60697 - protein, 358 aa, Fragaria x ananassa
MTAYRGKYADELIKNAAYIGTPGKGILAADESTGTIGKRFDSIKVENVEENRRALRELLFTAPGVLQYLSGVILFEETLYQKTAEGKPFVDVLNEGGVLPGIKVDKGVVELKGTDGETTTQGLDGLGARCAKYYEAGARFAKWRAVLKIGPNEPSQLSINENANGLARYAIICQENGLVPIVEPEILVDGPHSIDKCADVTERVLAACYKALNDHHVLLEGTLLKPNMVTPGSEAKKASPEVIAEYTVRALQRTTPAAVPAVVFLSGGQSEEEATLNLNAMNQLKGKKPWTLSFSFGRALQASTLKAWSGKKENVKAAQEALLTRAKANSEATLGTYKGDAKLGEGAAESLHVKDYKY

SEQ ID NO: 60698 - protein, 738 aa, Arabidopsis thaliana
MERKTIDLEQGWDYMQTGITKLKRILEGLNEPAFDSEQYMMLYTTIYNMCTQKPPHDYSQQLYDKYREAFEEYINSTVLPALREKHDEFMLRELFKRWSNHKVMVRWLSRFFYYLDRYFIARRSLPPLNEVGLTCFRDLVYNELHSKVKQAVIALVDKEREGEQIDRALLKNVLDIYVEIGMGQMERYEEDFESFMLQDTSSYYSRKASSWIQEDSCPDYMLKSEECLKKERERVAHYLHSSSEPKLVEKVQHELLVVFASQLLEKEHSGCRALLRDDKVDDLSRMYRLYHKILRGLEPVANIFKQHVTAEGNALVQQAEDTATNQVANTASVQEQVLIRKVIELHDKYMVYVTECFQNHTLFHKALKEAFEIFCNKTVAGSSSAELLATFCDNILKKGGSEKLSDEAIEDTLEKVVKLLAYISDKDLFAEFYRKKLARRLLFDRSANDDHERSILTKLKQQCGGQFTSKMEGMVTDLTLARENQNSFEDYLGSNPAANPGIDLTVTVLTTGFWPSYKSFDINLPSEMIKCVEVFKGFYETKTKHRKLTWIYSLGTCHINGKFDQKAIELIVSTYQAAVLLLFNTTDKLSYTEILAQLNLSHEDLVRLLHSLSCAKYKILLKEPNTKTVSQNDAFEFNSKFTDRMRRIKIPLPPVDERKKVVEDVDKDRRYAIDAAIVRIMKSRKVLGHQQLVSECVEQLSRMFKPDIKAIKKRMEDLITRDYLERDKENPNMFRYLA

SEQ ID NO: 60699 - protein, 455 aa, Bacteroides fragilis YCH46
MARFEIKMPKLGESITEGTILSWSVQVGDVVNEDDVLFEVNTAKVSAEIPSPVAGKVVEILFKEGDTVPVGTVVAIVDMDGEGSGEASETAGSVETASAPKAAEVSGTASVPKVQAEVTAPKVERWYSPAVLQLAREAKISQEELDSIPGTGYEGRLSKKDIRTYIEMKKGAPAADVSTTVVSTVSANNSGSSPVPSAEVQKKAAAAAPQAQHGQSASAVSSDASVEVKEMDRVRRIIADHMVMSKKVSPHVTNVVEVDVTRLVRWREKTKDDFFRREGVKLTYMPAIAEATAQALAAYPQVNVSVDGYNILYKKHINVGIAVSQDDGNLIVPVVHDADRLNLNGLAVAIDSLAKKARVNKLMPDDIDGGTFTITNFGTFKMLFGTPIINQPQVAILGVGVIEKKPAVVETPEGDVIAIRHKMYLSLSYDHRVVDGSLGGNFLHFIADYLENWKE

SEQ ID NO: 60700 - protein, 516 aa, Erwinia carotovora subsp. atroseptica SCRI1043
MLMAVSQPLPAAPGGAEYLRAILRSPVYEITQVTPLEKMDKLSSRLGNVILVKREDRHAVHSFKLRGAYAMMAGLSDEQKSHGVVTASAGNHAQGVALSSSKLGIKSLIVMPVATADIKVDAVRGFGGEVLLHGANFDEAKAKAIELSEQQHMTFLPPFDHPAVIAGQGTLAMELLQQDAHLDRVFVPVGGGGLAAGVAVLIKQLMPQIQVIGVEAEDSACLRAALDAGQPVDLPRVGLFAEGVAVKRIGDETFRLCREYLDDVITVDSDAICAAVKDLFEDVRAIAEPSGALALAGMKKYIQQHQIQGERLAHVLSGANVNFHGLRYVSERCELGEQREALLAVTIPEQQGSFLKFCQLLGGRSVTEFNYRYADAKDACIFVGVRLTRGYAERQEIIAELSADGYEVVDLSDDEMAKLHVRYMVGGRPSKPLQERLYSFEFPESPGALLKFLHTLGAHWNISLFHYRSHGTDFGRVLAGFELEAGDREFEQHLLALGYECHDETNNPAFRFFLAG

SEQ ID NO: 60701 - protein, 414 aa, Vibrio cholerae O1 biovar eltor str. N16961
MNQLKKDISLGAGIAQLSTTLMGTGLFMVPAIAAGIAGVFSLWAWLLLFVAICPIALTFAQLGKRYPNAGGTAYFVRQAFNPRLERAVAWLFLSVIPVGVPAAVTLAASFLQALLPAPLANPLLTQTLTILLLVGVNLAGTKSSGRLQTLIALAIFSLVIAFWWRGEVTTQDLVMPALTQEGWVSIGAALAVMFWCFVGIEAFAHMGEEFRNPQRDFPLAILIGSFVAGLTYWACSVVVLKFSAFGTPQFDSGAIPWLSDQLFGTRWAIMISVIGFLACFASLNLYTQSLARMVWAQAREYRPESAIARVSIRGVPAHATLLVGVVLFASCFIGHLTGLDLEFFLKLANGIFVLVYLLAMLAAFKLLTGWSKHLAGLALVLCAGVFLCLGWSMLYALGVFVLLIRPWQVRVQTI

SEQ ID NO: 60702 - protein, 282 aa, Streptococcus pneumoniae R6
MKRLVAIHFTEQFRLPKKKGKERFLLESKFEFAKELVKKAGQYILDHMQEDLRVETKSSSTDLVTRLDKEVQELLVGEILSRYPEDKICAEEGCLRASVQEGKVWVIDPIDGTNNFVAQQEDFAVMMAYFENGQGQFGLIYDVVKGDCYHGGGEFPVCLNDRPLAPFKTKPLGDFLIAGNSGMLETNEWGLADLSRSVLGVRVYGSAAISFAKILSGRLLTYLTYLQPWDYAAASILGESLGYRVVTLFGEAPDFQTRQPVMMVPLEMQEEIQSYIYERKRT

SEQ ID NO: 60703 - protein, 143 aa, Oryza sativa Indica Group
MASSLPSVLRGCACADGGRLLRDACHGAARGLAAWTRRGGAARALLVASVGSVALAALTVLLVAAFVLVAAATSAAAVAAVVSLAALSALLAVAYVGALSVAVFVVAATTAATVVAITIATGWAALFWIIWFAARKCLDLATN

SEQ ID NO: 60704 - protein, 280 aa, Glycine max
MSETATLHAQTRTPISSLDSMAHHHPHYRSPFGDTTFTKLFVGGLAWETPTEEMRKYFEQFGNILEAVIITDKNTGKSKGYGFVTFCDQESARRACADPNPIIDGRRANCNIASLGRTRLSPPRGRNVVQGGGGTAQGVPGVGLPPSLPPPPPVLYPPYGYTTYTPDYGYHQIQQPQYYQQLYGASSSTMSTPYYYSYSVQAPRNAFSSPQANRLSPGPSYLYYPTPMEVSFSGYRPPQQIPMRQTFASPNDSQSQQRTSSETAAGVAITSERSNTQGKN

SEQ ID NO: 60705 - protein, 271 aa, Parmotrema sp. Feuerer s.n.
VEHGEVKVVAVNDPFIEPHYAAYMLKYDSQHGQFKGTIEVKGSDLVVNGQTVKFYTEKDPANIPWKDTGAYYIVESTGVFTTTEKAKAHLKGGAKKVVISAPSADAAMFVMGVNEKEYKSDIEIISNASCTTNCLAPLAKVMHDNFTIIEGLMTTIHSYTATQKTVDGPSAKDWRGGRTAAQNIIPSSTGAVKAVGKVIPSLNGKLTGMSMRVPTSNVSVVDLTCRLEKSVTYDQIKETMKKASEGPLKGIMSYSEDALVSTELNGDNHSC

SEQ ID NO: 60706 - protein, 278 aa, Parmotrema cetratum
VEHGEVKVVAVNDPFIEPHYAAYMLKYDSQHGQFKGTIEVKGSDLVVNGQTVKFYTEKDPANIPWKDTGAYYIVESTGVFTTTEKAKAHLKGGAKKVVISAPSADAAMFVMGVNEKEYKSDIEIISNASCTTNCLAPLAKVMHDNFTIIEGLMTTIHSYTATQKTVDGPSAKDWRGGRTAAQNIIPSSTGAAKAVGKVIPSLNGKLTGMSMRVPTSNVSVVDLTCRLEKSVTYDQIKETMKKASEGPLKGIMSYSEDALVSTDLNGDNHSCIFDATAG

SEQ ID NO: 60707 - protein, 182 aa, Mycobacterium avium subsp. paratuberculosis K-10
MADSDAVTNSPFQTATATLHTNRGDIKVALFGNHAPKTVANFVGLAQGTKEYSTQNASGGSSGPFYDGAVFHRVIRGFMIQGGDPTGTGRGGPGYKFADEFHPELQFDRPYLLAMANAGPGTNGSQFLITVDKTPHLNRRHTIFGEVVDPESQKVVDAISTTSTDGNDRPSEPVVIESITIS

SEQ ID NO: 60708 - protein, 271 aa, Parmotrema perlatum
VEHGDVKVVAVNDPFIEPHYAAYMLKYDSQHGQFKGTIEVKGSDLVVNGQTVKFYTEKDPANIPWKDTGAYYIVESTGVFTTTEKAKAHLKGGAKKVVISAPSADAAMFVMGVNEKEYKSDIEIISNASCTTNCLAPLAKVMHDNFTIIEGLMTTIHSYTATQKTVDGPSAKDWRGGRTAAQNIIPSSTGAAKAVGKVIPSLNGKLTGMSMRVPTSNVSVVDLTCRLEKSVTYDQIKKTMKEASEGPLKGIMSYSEDALVSTDLNGDNHSC

SEQ ID NO: 60709 - protein, 260 aa, Parmotrema tinctorum
HGDVKVVAVNDPFIEPHYAAYMLKYDSQHGQFKGTIEVKGSDLVVNGQTVKFYTEKDPANIPWKDTGAYYIVESTGVFTTTEKAKAHLKGGAKKVVISAPSADAAMFVMGVNEKEYKSDIEIISNASCTTNCLAPLAKVMHDNFTIIEGLMTTIHSYTATQKTVDGPSAKDWRGGRTAAQNIIPSSTGAAKAVGKVIPSLNGKLTGMSMRVPTSNVSVVDLTCRLEKSVTYDQIKKTMKEASEGPLKGIMSYSEDALVST

SEQ ID NO: 60710 - protein, 267 aa, Zea mays
MPPNRTSNGPRSITTAAAELGPNIQILRGAATAVGDMEAAVPSRVALSAASRLPNPHAVTGDRSFIYKGRCQSLAIPMALSAAAPGKGGGVLDRPVEKTTPGRQSEFDVNKLLYIEEQWLACQKEKNKKARAHLESTTNVHGRGARLVEAVVARQEVTSANQQTGIQEYFILDRGIRSSIMFGDSSLVEICNMSSILSAGKTGAAQAFHDDLCGSVTSMTLGGRCYFLFVVDDASRIMWAVLSTKGAVAEAIKQVQMVTEKESSHKL

SEQ ID NO: 60711 - protein, 630 aa, Arabidopsis thaliana
MASSSRSEKRCHYEVLGISKESSPDEIRSSYRRLALQRHPDKLMKAAGLSEAEATAQFQELVHAYEVLSDPKERAWYDSHRSQILFADHSSAGGSKSGGSVPDLFAFFSPTVYSGYSDTGKGFYKVYYDVFNSVYLNEIKFARTLGLRMDSVREAPIMGNLESPYAQVTAFYNYWLGFCTVMDFCWVDEYDVMGGPNRKSRRMMEEENKKSRKKAKREYNDTVRGLAEFVKKRDKRVIDMLVKKNAEMEKKKEEERERKKKMEKERLERAMNYEEPEWAKAHEGEDEGAGLSELEEEDDDAKRKNEQLYCIVCSKKFKSEKQWKNHEQSKKHKEKVAELRESFTDYEEENEEEEIDGPLDSPESVEELHEKLQEELNIDNEERDVKKEVVGEADETDDEYFVAEEDMQGSSESEDEDDEMTLLKKMVSGQKNKQKNVVSKEEDEDETEVEIEGDTAEFSEFDNQKSTGRNKEAKEERNKQNAGNDMADDTSKVQIPGEGGNPDENMNATESASGALADSQKDEANSMEYDNRKSTGRRRRSKKGKDKNNQGELNEKSSEADDTQYVNRDMESQDYKKAPRSKKSTRGMKTKGTTKKNSSNECDRCGEEFESRTKLHKHLADSGHATVKSR

SEQ ID NO: 60712 - protein, 335 aa, Triticum aestivum
NHRRCSESFRKVNVSDVIILEGILVFHDQRVRDLMDMKIFVDTDADIRLARRIRRDTVERGRDVSSVLDQYGRFVKPAFDDFVLPSKKYADVIIPRGGDNHVAIDLIVQHIRTKLGMHDLCKVFRNVFVVQSTFQIRGMHTLIRDRDITTPDFVFYSDRLIRLVVEHGLGHLPFTEKQVVTPTGSVYSGVDFCKKLCGVSIVRSGESMENALRACCKGIKIGKILIHRVGDNGQQLIYHKLPMDIDERHVLLLDPVLGTGNSANQAIDLLRRKGVAEERIIFLTLISAPEGIQCVCTRFPKLKLVTSEIDTGLSEEFRVIPGLGEYGDRYFGTDN

SEQ ID NO: 60713 - protein, 449 aa, Xanthomonas campestris pv. vesicatoria str. 85-10
MRVAIFGTGYVGLVTGACLAEVGHQVVCVDIDQAKLDALNRGLIPIYEPGLEPMVKANHAAGRLRFTSDAAAAIAHGEITFIAVGTPADQDGSADLQYVLAVARTVGRHIDGPAIVVNKSTVPVGTADIVRVAIQEELAARGVAHEVDVVSNPEFLKEGDAVADCMRPDRIVIGAKKPAAIARMRRLYAPFNRNRDRIVEMDVRSAELTKYAANAMLATKISFMNEIATIAERVGADVEHVRNGIGSDPRIGWHFIYPGAGYGGSCFPKDVQALAKTAEQYGMRPTLLEAVESVNNAQKGHLFELVQRHYGAEGTGSVAGKTFAVWGLAFKPNTDDMRAASSRRLMEQLWEAGATVRAYDPEATREARRIFGERDDLAYCDDAFSALEGADALVVVTEWKQFRSPDFGKIKQALKDDVVFDGRNLYDPQEIEAAGLAYYAIGRGRSLYA

SEQ ID NO: 60714 - protein, 592 aa, Triticum aestivum
MVSDASKKKAAQKKAAAAAKRGAKSSAAASSSSASSAADKAANGVAALNLSDRTCTGVLASHPLSRDIHIESLSLTFHGHDLIVDSELELNYGRRYGLLGLNGCGKSTLLTAIGCRELPIPEHMDIHHLTREIEASDMSALQAVICCDEERVKLEKEAEILAAQDDGGGEALDLVYERLEAMDASTAEKRAAEILFGLGFDKQMQAKPTRDFSGGWRMRIALARALFMNPTILLLDEPTNHLDLEACVWLEEKLKNFERILVVISHSQDFLNGVCTNIIHMQNKTLKLYTGNYDQYVQTRSELEENQMKQYKWEQEQIANMKEYIARFGHGSAKLARQAQSKEKTLAKMERGGLAEKVVNDRILVFRFTDVGKLPPPVLQFADVTFGYSPDNLIYKNLDFGVDLDSRVALVGPNGAGKSTLLKLMTGDLSPLDGMVRRHNHLRIAQFHQHLTEKLDLDMPALQYMMREYPGNEEEKMRAAIGKFGLSGKAQVMPMKNLSDGQKARVIFAWLAFRQPQMLLLDEPTNHLDIETIDSLAEALKEWDGGLVLVSHDFRLINQVAQEIWVCENQAVTRWEGDIMDFKQHLKKRAGL

SEQ ID NO: 60715 - protein, 208 aa, Ustilago maydis 521
MLRNSIIPFAKQAVASTSRTASFSTVARPAAVATARASTSSNVFGAAVQRRGYHEKVIDHYENPRNVGSFLKTEKNVGIGLVGAPACGDVMKLSIKVNEEGIIEDVRFKTFGCGSAIASSSYMTERVKGLSLDEAAKIKNTEIAQELCLPPVKLHCSMLAEDAIKSAIKNYRSKREATGNKKQGHIEVVQDVATGNTSATAHVGSGTV

SEQ ID NO: 60716 - protein, 154 aa, Lactobacillus plantarum WCFS1
MANSEKTLVLVKPDGVSEGHIGEVITRLERKGYQIAALKVIKATAEQLQQHYSEKVGKPYFKEIETYMMEGPLVAIIVSGTGVVKAVHRLAGSTRPAEAQPGTIRGDFSHEYPDGILRNVIHTSDSRENAHHEIAIWFPELAVKARKADNKVKA

SEQ ID NO: 60717 - protein, 328 aa, Xanthomonas campestris pv. vesicatoria str. 85-10
MSATKHQVVCFGEALIDMLALPQDGPDQARTFAQYAGGAPANVAVAVARLGGAAHFVGMLGRDMFGDFLLQSLQQSGVATDGIVRTDQAKTALAFVALDDAGERSFSFYRPPAADLLFRPEHFAADGFTQAAVLHVCSNSMTEPEIAQCTLDGMRRARADGAIVSLDLNLRPMLWPQDVDPAALLWEALALADVVKLSREELEYLAGTLDGDASAVTQKLWQGKASCLLVTDGGGPVHWQTRTDAGQVPAFQVQVRDSTAAGDAFVGGLLYQLATRAASLEQLCGDSAAINEVIRFAAAVGALAVTRKGAFAAMPSIDDVHSLIQEQS

SEQ ID NO: 60718 - protein, 124 aa, Zea mays
IFRFCAIPQIMAIGTCALCYNNVHVFRGVVKMRRGLTARIIDETNSMTDVYTAFYEFSSLIESKIDDSDPNAALTQRRVDSIKQTCKSSGLVKQRGYHLEKSPSRPMLIMIVLLLVAILFGVMF

SEQ ID NO: 60719 - protein, 514 aa, Populus trichocarpa
MVHDCILESVKREGTKASPASSSRNNSTEYNSIIADTSSSRLGSSLNGANRTGSILAKVDEKSRSREKGEFSQSSKSSIGDYSSSTSISDDSNLSGSSHSGSRPHMSKDLRWEAIRHTQKQHGSFCLKHFKLIKKLGCGDIGSVYLAELTGTNCLFALKVMDNDYLATRKKMSRALTERKILQMLDHPFLPTLYAHFVSDKLSCLVMEYCPGGDLHVLRQKQSGRSFSEPAARFYVAEVLVALEYLHMLGVVYRDLKPENILVREDGHIMLSDFDLSLRCAVNPVLLKSSSPAEEPTKKMSSPCSEASCIDPFCLHPAWQVSCFTPRLLSVAAKSQKLKSDLAAQVSPLPQVVVEPTSARSNSFVGTHEYLAPEIIKGEGHGSAVDWWTFGIFLFELLYGRTPFKGSGNEETLSNVVSRSLKFPSNPIVSFHARDLIRGLLIKEPGDRLGSAKGAAEIKQHPFFDGLNWALIRCAIPPELPNQCDVGIASNTFSQNKDCAKFKDTAELREFEMF

SEQ ID NO: 60720 - protein, 406 aa, Oryza sativa Japonica Group
MLVKAGAPVDQTIATLAAHLEQGDCIIDGGNEWYENTERREKAMEERGLLYLGMGVSGGEEGARNGPSLMPGGSFEAYKYIEDILLKVAAQVPDSGPCVTYIGKGGSGNFVKMVHNGIEYGDMQLISEAYDVLKSVGKLTNSELQQVFSEWNKGELLSFLIEITADIFSIKDDQGSGHLVDKVLDKTGMKGTGKWTVQQAAELSVAAPTIEASLDSRFLSGLKDERVEAAKVFQGDFSSNLPVDKAQLIEDVRQALYASKICSYAQGMNIIKAKSMEKGWSLNLGELARIWKGGCIIRAIFLDRIKKAYDRNSDLANLLVDPEFAQEIMDRQAAWRRVVCLAINNGVSTPGMSASLAYFDSYRRDRLPANLVQAQRDYFGAHTYERVDMPGSFHTEWFKIARAAKM

SEQ ID NO: 60721 - protein, 188 aa, Shigella flexneri
KINLGIGVYKDETGKTPVLTSVKKAEQYLLENETTKNYLGIDGILEFGRCTQELLFGKGSALINDKRARTAQTPGGTGALRVAADFLAKNTSVKRVWVSNPSWPNHKSVFNSAGLEVREYAYYDAENHTLDFDALINSLNEAQAGDVVLFHGCCHNPTGIDPTLEQWQTLAQLSVEKGWLPLFDFAYQ

SEQ ID NO: 60722 - protein, 177 aa, Brassica napus
MGSLGTLLRYPDDIYPLLKMKRAIERAEKQIPPEPHWGFCYSMLHKVSRSFSLVIQQLRPELRNAVCVFYLVLRALDTVEDDTSIPTDEKLPILIAFHRHIYDTDWHYSCGTNEYKVLMDQFHHVSAAFLELDKGYQEAIEEITKRMGAGMAKFICQEVETVDDYDEYCPYVAGLVG

SEQ ID NO: 60723 - protein, 231 aa, Triticum aestivum
TDELSWIPSSDAIYSSDVALQAGFDTSYSDYGMLDDLSAFPCAQDKSLPTADEQFNDNYPFNEQKNVNVYGEQSYHGGAMELLSTDQICNGDGNIDMIGERYSSENALQQLEGRKFSVSSGSQLSSSQNLLKQKHHSDKTSPIQKQVANLQPGQLINDEGQLGQQTLTRRASYPCENYEVEKKGFGKQSKDTLGTSVVVDGSFVSSLSSDNSVEESSFQQLQDAVSQLDVK

SEQ ID NO: 60724 - protein, 227 aa, Zea mays
MYRAAGSHLRSLKHHGASRLASTSVAKQSSDFVEPSKTKVTTLPNGVKIASETSSSPAASVGLYIDCGSIYETPASSGVSHLLERMAFKSTVNRTHLRLVREVEAIGGNVSASASREQMSYTYDALKSYTPEMVEVLIDSVRNPAFLDWEVKEQLQNIKSEIADASANPQGLLLEALHSVGYSGALAKPLMASESAVNRLDVSSLEEFVAEHYTAPRMVLAASGVDH

SEQ ID NO: 60725 - protein, 297 aa, Mycobacterium leprae
MNRTGDDETLSTQVKAEVLAEALPWLKQLHGKVVVVKYSGNAMTDDMLRRAFAADMAFLRNCGIHPVVVHGGGPQITAMLRRLGIADDFKGGFRVTTPEVLDVARMVLFGQVGRELVNLINAHGPYAVGITGEDAQLFTAGRRSATVDGMATDIGLVGDVDQVNIAAVLDLISAHRIPVVSTLAPDRDGVVHNINADTAAAALAETLGAEKLLMLTNVEGLYTRWPERDSLVNEIDSAALAQLLPTLEAGMIPKVEACLRAVTGGVPSAHVIDGRVKHCVLVELLTNEGTGTKVVSA

SEQ ID NO: 60726 - protein, 156 aa, Helicobacter hepaticus ATCC 51449
MNIIEGKLQLIGDERIAIISSRFNHLITDRLVEGAKDCFVRHGGRDDLLDLVLVPGAYEIPFALQKILSQGEYDGICCLGAVIRGSTPHFDYVSAEATKGIANVTLKYGAPVTFGVLTTDSIEQAIERAGTKVGNKGFEAMASLIELINLYRKIGA

SEQ ID NO: 60727 - protein, 373 aa, Drechslerella dactyloides
MASPTPPNSTASPKPQAPPSQVQACRYKTGKTLGSGSYSVVRECVHIHTGRYYAAKIINQKLMAGREHMVRNEIAVLKKVSMGHQNILTLVDYFETMNNLYLVTDLALGGELFDRICRKGSYFESDAADLIRATLSAVAYLHDHGIVHRDLKPENLLFRTPEDNADLLIADFGLSRIMDEERFHVLTTTCGTPGYMAPEIFKKTGHGKPVDIWAIGVITYFLLCGYTPFDRDSNLEEMQAILKADYKFEPAQYWSDISENAKDFIRRCLTIDPKARPTAHAALEHPFICEDQPEREADLLPTVRKNFNARRTLHAAIDTIRAINKLREGGMMDGALSSAPENQKEKQPQNQPATGLWQGTAQAATAKGLWSKS

SEQ ID NO: 60728 - protein, 188 aa, Physcomitrella patens subsp. patens
MACNGWMSSQRNRVISRRCASSAHPKNYVFAKFCHSKHEKAQEAAISTERMETAGCRARLRHTVWKSPSSNEEHEKEEREVTGKCGSVTVRLVPAPRGSGIVAARVPKKVLQFAGTEDVFTSSRGSTKTLGNFVKATFECLLKTYGFLTPDLWRETRFSKSPFQEFTDFLAKPHKISVVEDVEKTPVY

SEQ ID NO: 60729 - protein, 195 aa, Shigella dysenteriae
ADERPGKINLGIGVYKDETGKTPVLTSVKKAEQYLLENETTKNYLGIDGIPEFGRCTQELLFGKGSALINDKRARTAQTPGGTGALRVAADFLAKNTSVKRVWVSNPSWPNHKSVFNSAGLEVREYAYYDAENHTLDFDALINSLNEAQAGDVVLFHGCCHNPTGIDPTLEQWQTLAQLSVEKGWLPLFDFAYQG

SEQ ID NO: 60730 - protein, 257 aa, Parmotrema fistulatum
AYMLKYDSQHGQFKGTIEAKGSDLVVNGQTVKFYTEKDPANIPWKDTGAYYIVESTGVFTTTEKAKAHLKGGAKKVVISAPSADAAMFVMGVNEKEYKSDIEIISNASCTTNCLAPLAKVMHDNFTIIEGLMTTIHSYTATQKTVDGPSAKDWRGGRTAAQNIIPSSTGAAKAVGKVIPSLNGKLTGMSMRVPTSNVSVVDLTCRLEKSVTYDQIKETMKKASEGPLKGIMSYSEDALVSTDLNGDNHSCIFDATAG

SEQ ID NO: 60731 - protein, 191 aa, Escherichia coli
ERPGKINLGIGVYKDETGKTPVLTSVKKAEQYLLENETTKNYLGIDGIPEFGRCTQELLFGKGSALINDKRARTAQTPGGTGALRVAADFLAKNTSVKRVWVSNPSWPNHKSVFNSAGLEVREYAYYDAENHTLDFDALINSLNEAQAGDVVLFHGCCHNPTGIDPTLEQWQTLAQLSVEKGWLPLFDFAY

SEQ ID NO: 60732 - protein, 273 aa, Cornicularia normoerica
VEHGDVKVVAVNDPFIEPHYAAYMLKYDSQHGQFKGTIEVKGSDLVVNGQTVKFYTEKDPANIPWKDTGAYYIVESTGVFTTTEKAKAHLKGGAKKVVISAPSADAAMFVMGVNEKEYKSDIEIISNASCTTNCLAPLAKVMHDNFTIIEGLMTTIHSYTATQKTVDGPSSKDWRGGRTAAQNIIPSSTGAAKAVGKVIPSLNGKLTGMSMRVPTSNVSVVDLTCRLEKSVTYDQIKETMKKASEGELKGIMSYSEDALVSTELNGDNHSCIF

SEQ ID NO: 60733 - protein, 514 aa, Oryza sativa Japonica Group
MQPYLQLASLRLATTIPLAPRLYDANLLAASGAAMASSMAYIALLCAALAAVVALLRWAYRWSHPRSNGRLPPGSLGLPVIGETLQFFAPNPTCDLSPFVKERIKRYGSIFKTSVVGRPVVVSADPEMNYYVFQQEGKLFESWYPDTFTEIFGRDNVGSLHGFMYKYLKTLVLRLYGQENLKSVLLAETDAACRGSLASWASQPSVELKEGISTMIFDLTAKKLIGYDPSKPSQVNLRKNFGAFICGLISFPLNIPGTAYHECMEGRKNAMKVLRGMMKERMAEPERPCEDFFDHVIQELRREKPLLTETIALDLMFVLLFASFETTALALTIGVKLLTENPKVVDALREEHEAIIRNRKDPNSGVTWAEYKSMTFTSQVIMEIVRLANIVPGIFRKALQDVEIKGYTIPAGWGIMVCPPAVHLNPEIYEDPLAFNPWRWQGKPEITGGTKHFMAFGGGLRFCVGTDLSKVLMATFIHSLVTKYSWRTVKGGNIVRTPGLSFPDGFHIQLFPKN

SEQ ID NO: 60734 - protein, 504 aa, Bacillus anthracis str. A2012
MERGLNVKVVIYMFQKIAKECLAGFTVAIVALPLAIAFGIAATGTSEGALVGLYGAIFAGLFAALFGGTPGQVTGPTGPITVIATGVIATHGLEASFIAFMMAGLFQILFGVCKLGSYVRYIPYPVVSGFMNGIALIIILGEMKHVQNSFLLVVLTIIVMIVSGKWIKAIPSSLVALVGVTALLPLFSSALEGLTVKLPVIGNLTLNKVIEKIGTIPEAMPTLHIPSLGGTGIAELVLPALSIALLGSIDSLLTSVVMDNVTGTRHKSNKELVGQGIGNMVSGLFGGLAGAGATVRSIVNIRSGGKTALSACMHSVILFIFIMGLGSVVQYIPLAVLSGILILTGIGMFDWESMKKMHVAPKGDVIVMLVTMIVTVKFDLMIAVAFGILLSFLIYMVKCKERKVSIVKEKEATYKIKGPLSFLTVDRVFYALQDVKSPVVLRMKDARYMDVSGAMALLNFIEQSDKSGLSVTLEQVPVHIKKTLVTMASNEQKDKLLFAEVDVM

SEQ ID NO: 60735 - protein, 131 aa, Glycine max
FPFTYSLLSFHLAAHSKQRIKLSPQKFLIPSDDTAHRPHFISLCLAGDRHEEKQFTGRLYNMVNATKGVFISCDIPMAQYIINMNASLPASDKFIIHILDNTHMFVQPHVEQMIRSRIAKFREDNTYVKPN

SEQ ID NO: 60736 - protein, 254 aa, Pseudomonas syringae pv. phaseolicola 1448A
MSPLWQRLRDQARQLTERNPVLGDYATSHLLVYSTFEDALAANLARQMQAQASNVALEDWFKAIIKASPSVAQSAAADINHLETVNPACPDHLTAFLTFRGIQAVQAYRIAHALWAEGDEQSAVLVQNWAANTWSIDIHPAARLGKSLFVDHGIGLVIGETAVVEDQVSLWHGVTLGSTLNEAGDRHPKIRRGALICAGATVLGNIEVGANAIVAANSVVLKAVGAGTVVAGTPAKVVGNAPAFLATFTTKSKG

SEQ ID NO: 60737 - protein, 383 aa, Candida glabrata CBS 138
MEVYVRLNDDCEHDYAFQVDKEDTIKTRVEKIFTSNLNEIMVLRPTIFHEKKPYAFKKSVHPGFLTEGGCLLFDYDAADQKYVKDLDYDKPLFEQLWPGQLIVPQWRYSKKYVTIFALLMAGWLYTDLPDVISPTPGICLTNQLSRMLLPFVRRMELYELAAKLEAEIQVNFSSVDAQWLFFVLHILKIILIITFFYSGMANPISFNPYRLWNLRNELDVHNPKFKNMLKSIGWIGARRATFDAYQGNYYNHMLEKYGGQVRAYRAGVIKRIASPGVQLHDGEGFQTPLKERFTGSTFKEMKENERFVLSEEYFVELENNLKENLDKCNGDIGKMNMEIRRFRRFGIYEPNEKLLELVTIRRARADKEKAEAEAAEAEKKKEK

SEQ ID NO: 60738 - protein, 454 aa, Wolbachia endosymbiont of Drosophila simulans
MPIEILMPALSPTMSKTGGKIVKWHKKEQDKVEVGDVIAEIETDKAIMEFESIDEGVLAKILVTEGTSGVPVNQPIALMLEEGEDESALNNYTSTSINSAVKKEVTKSAVDNQKSEHQDLNGKPISHSSVSFQRVTLESNPSMSSQCLTLGSRKEEWIPVSATQMTEGYAEGRTKISPLAKKIAQNEGVNVQQLKGTGPYGRIIKADVLEFLGSGIHTESPEKDTIVEVSNMRQVIAQRLTESKQNVPHFYLTVDCQVDKLISLKNEINSADENNKVTINDLIIKAAAFSMKKFPDINSSWIDNKILRYSNIDISIAVALEDGLITPIVKNADKKGILSISKEVKDLVSRARSGKLKPEEFQGGGFTISNLGMFGIKAFSAIINPPQSCIMAVGASKKQPIVMNEKIEIAEIMTVTLSVDHRAVDGALGAKFLNAFKHYIENPLVMLIETAVIY

SEQ ID NO: 60739 - protein, 322 aa, Bacillus cereus E33L
MNILVTGGAGFIGSNFVHYMLQSYETYKIINFDALTYSGNLKNVKSIQDHPNYYFVKGEIQNGELLEHVIKERDVQVIVNFAAESHVDRSIENPIPFYDTNVIGTVTLLELVKKYPHIKLVQVSTDEVYGSLGKTGRFTEETPLAPNSPYSSSKASADMIALAYYKTYQLPVIVTRCSNNYGPYQYPEKLIPLMVTNALEGKKLPLYGDGLNVRDWLHVTDHCSAIDVVLHKGRIGEVYNIGGNNEKTNIDVVEQIITLLGKTEKDIEYVTDRLGHDRRYAIDAEKMKNEFDWEPKYTFEQGLQETVQWYEKNEEWWKPLKK

SEQ ID NO: 60740 - protein, 312 aa, Eucalyptus globulus
ANLFAMQLASASVLPMVLKAAIELDLLEIMAKAGPGAFLSPGEVAAQLPTQNPEAPVMLDRISRLLASYSVLTCTLRNLPDGKVERLYGLAPVCKFLVKNEDGVSIAALNLMNQDKILMESWYYLKDAVLEGGIPFNKAYGMTAFEYHGTDPRFNKIFNRGMSDHSTITMKKILETYKGFEGLETVVDVGGGTGAVLSMIVAKYPSMKGINFDLPHVIEDAPPLPGVKHVGGDMFVSVPKGDAIFMKWICHDWSDDHCAKFLKNCYDALPNNGKVIVAECVLPVYPDTSLATKNVIHIDCIMLAHNPGGKER

SEQ ID NO: 60741 - protein, 437 aa, Ralstonia eutropha JMP134
MSPTITIEQGIRAAGVGRFQYRLFVIFGLVWLADAMQVLSIGFTAPSIAKTFGIPVPTALQSGTMFFVGMLIGAFVFGRLADRIGRRPVLMMAVVIDAICGVASSFAPDFQWLLVLRFLTGIGVGGTLPVDYTMMAEFLPSDRRGRWLVLLESFWAIGTILLAVLALIAVSRGDAAWRLIFLVTGIPALVGVVCRFFVPESPLYLNKSGRSAEARAVLQRVATANRVSVEIGALEPQQMERKSVLALFASGFRRRSISLLVAWALISIAYYGVFVYLPVKLAGQGFGFMRGQVFLILLALVQLPGFALAAHGVERWGRKPTLIGFLLLSAAGCMLYSLGQSPALVVGSTLLMSFSLLGTWGALYAFTPEVYPTDLRASGMGTAGAMARFGGLFAPAIVAPVMATQFTLALVLLSTCLAVAALAIYMVDIESKDRALD

SEQ ID NO: 60742 - protein, 375 aa, Brassica napus
METRLSTPFSVPKLPSLKRKRPPQIEIPNILQEIQSDDLRFRDSAHQNDAVCSGGNGFGVVSRKGKKKFMEDSRRVAPCSVGSSDTSFFGVYDGHGGCKAADFVAENLHKNVLEMLKGCKEKEEAFKAAYLRTDRDFLGEEMIVSNLGDCRAVLCRGGVAEALTTDHRAGRDDERKRIENQGGYVEFHRGAWRVHGILAISRSIGDAHLKKWVVADPETRILDLEQDMEFLVLASDGLWDVVSNQEAVDTVLSVLAQRKTPRETEDEGLFKGLVNVSPSSKLRRVSLVKQRKELLPAQSPKCAKPYHSENESPSYHEMGSPPSKARKITALKRIKMKAESSWAKAASKELVNLAVSRGSMDDITVVIVDLNHYKC

SEQ ID NO: 60743 - protein, 321 aa, Methanothermobacter thermautotrophicus str. Delta H
MMVTVIGAGSFGTAIAQVLSWNAEMVRLMARRSEVVENINRTRENSAYHPGVKLRDNIEATLMDGSVLEESEYVFMAVPSGNLRSIVRSMNSSLEDKKIVSCIKGIEHPGLKTMSSVIREETGSRTVFSISGPNFADELIRGMTSGITVGASTRYAREIAGLLKSPRIILDHSENVEGVEFCGILKNVYAVAMGILDGQITGENHRHSLLTLCFREMNLILNEMGYGELHDRFCGFGDFLLTSTTDKSRNRTLGLMLGKKMRLSEDSTITIESLRSIRAIRELTEGLELPVLEMVYQTMQEPENVNLYIREFQERISRPEF

SEQ ID NO: 60744 - protein, 467 aa, Brucella suis 1330
MSYDVVVIGTGPGGYVAAIKAAQLGLKVAVVEKRKTFGGTCLNIGCIPSKALLHASEVFAEAGHSFDTLGVEVTPKLNLTKMLAHKDTTVKANVSGVEFLFKKNKITPYIGTGKIVGKGKVSVTSEDGKVEEIEAKNIIIATGSDVAGIPGVKVDIDEKVIVSSTGALSFDKVPGSLIVVGGGVIGLELGSVWARLGAKVTVVEYLDKVLGPMDGEVSKQFQRLLEKQGIAFKLGAKVTGVEKVGKGAKVTFEPVKGGDAETLEADAVLIATGRRPYTDGLGLQEAGVAVDERGRVAIDDHWRTNVEGIYAIGDVVQGPMLAHKAEDEGIAVAEIIAGQAGHVNFDVIPSVVYTQPEVASVGKTEEELKAAGIDYKVGKFPFTANGRARAMLHTDGFVKILADKATDRVLGAHILGYNAGEMIHELAVLMEFGGSSEDLARTCHAHPTMSETVRESALATFAKPIHM

SEQ ID NO: 60745 - protein, 444 aa, Lupinus luteus
MATIATIKARQIFDSRGNPTVEVDLTLSDGTFARAAVPSGASTGIYEALELRDGGSDYLGKGVSKAVDNVNTIIAPALIGKDPTEQTAIDNFIVQELDGTVNEWGWGKQKLGANAILAVSLAVCKAGASALKIPLYKHIANLAGNKNLVLPVPAFNVINGGSHAGNKLAMQEFMILPVGASTFKEALKIGVEVYHNLKSVIKKKYGQDAVNVGDEGGFAPNIQENKEGLELLKSAIAKAGYTDKVVIGMDVAASEFYTSDKKYVLNFKEDNNDGSQKISGEELKELYKSFVAEYPIASIEDPFDQDDWEHYGKITTEIGTEVQIVGDDLLVTNPKRVQKAIDSKSCNALLLKVNQIGSVTESIEAVKMSKKAGWGVMTSHRSGETEDTFIADLAVGLSTGQIKTGAPCRSERLAKYNQLLRIEEELGDEAVYAGVNYRNPVEPY

SEQ ID NO: 60746 - protein, 468 aa, Erwinia carotovora subsp. atroseptica SCRI1043
MTLEHQFDYDAIIIGSGPGGEGAAMGLAKHGAKIAVIERHYNVGGGCTHWGTIPSKALRHAVSRIIEFNQNPLYSDNSRIIRSSFSDILRHADSVIGQQTRMRQGFYERNQCELFSGEASFIDAHTIAVHYPDNTHETLTAANIIIATGSRPYHPAEVDFNHPRIYDSDSILQLDHEPQHVIIYGAGVIGCEYASIFRGLSVKVDLINTRDRLLAFLDQEMSDALSYHFWNNGVVIRHNEEFDSIEGLSDGVIVNLKSGKKMKADCLLYANGRTGNTETLGLENIGLSTDSRGQLKVNSMYQTALAHIYAIGDVIGYPSLASAAYDQGRLAAQAIIKGDASAHLIEDIPTGIYTIPEISSVGKTEQELTAMKVPYEVGRAQFKHLARAQIVGMNVGSLKILFHRETKQILGIHCFGERAAEIIHIGQAIMEQKGEGNTIEYFVNTTFNYPTMAEAYRVAALNGLNRLF

SEQ ID NO: 60747 - protein, 261 aa, Oryza sativa Japonica Group
MDVKPVRTVKVTNVSLSATVQDIKEFFSFSGDIEHVEMQSGDEWSQVAYVTFKDPQGAETALLLSGATIVDLSVIIAPAPEYQPPPTSSAPPMYSATSVPVSEDNNVVHKAEDVVSTMLAKGFTLGKDAVGKAKAFDEKHGFTSTAGAKVASIDRKIGLSEKFTIGTSIVNEKVKEMDQKFQVSDKTKSAFAAAEQKVSTAGSAIMKNRYVFTGASWVTNAFNKVAKAATDVGTMTKEKMAAEDQHKGSGPSGGHSYTPIQ

SEQ ID NO: 60748 - protein, 138 aa, Prunus armeniaca
KEVILTPTHLAIVMEYASGGEMFERICNAGRFSEDEARFFFQQLISGVSYCHAMQVCHRDLKLENTLLDGSPAPRLKICDFGYSKSSVLHSQPKSTVGTPAYIAPEVLLRQEYDEKIADVWSCGVTLYVMLWDLSFRI

SEQ ID NO: 60749 - protein, 208 aa, Fusobacterium nucleatum subsp. vincentii ATCC 49256
MDKVSHISNMANIYYVRQNMPLGLGHAILKAKSFIGDEPFVIALGDDIIYNPEKPVTKQMIEKYELYGKSMIGCQEVAKEDVSKYGIAKLGDKLDEATFQMLDFLEKPSVDNAPSRIACLGRYLLSGKVFKYLEETKPGKNGEIQLTDGILAMMKDEEEVLAYNFIGKRYDIGSKFGLLKANIEFGLRNDETKEDIKEYLKNLDIEKV

SEQ ID NO: 60750 - protein, 631 aa, Bacillus cereus ATCC 10987
MKMLTVENLSKSYGEKPLFDGLSFSIAEGQRAGIIGVNGTGKSTLLKIIAGAEIPDTGDMTHSRGYTISYLSQQPEFDEQLTVLEQVFHGDTPLIRLLRDYEKALLHIEKDPSNEKVQEQLFAVQQRMDAMSAWEANANAKSLLTKLGITDFTAIVGNLSGGQKKRIAMAQCFIETPDLLILDEPTNHLDHETVEWLEEYLARYTGAVLLVTHDRYFLDRVTNRIFELDNGKLYSYEGNYSTFLEAKALREEQELAQESKRQNLYRRELAWIRRGAKARSTKQKARIQRFEELKGQEGPAAKQSVDIALSGSRLGKKVLELKDVTKKFGDKTVLNNFNHIVKPGDRIGIIGANGSGKSSLLNMLAGKISPDSGEIEVGQTVKIAYYTQENEEMNLNQRMIEYIKEIAEVIHTTDGKLIGASQMLERFLFPPHSHGTPLGKLSGGERRRLYLLRILMGEPNVLLLDEPTNDLDTQTLTVLEDYLEDFPGVVLTVSHDRYFLDKVVDELFIFTGEGEVREFLGSYTDYLEMEKTRELIEKAEVQKEKKVVEEAPKQQRKRKLSYNEQREWETIEDTIAELEEKLELIGEELANVGSDFTKAQELSEAQQKTEEELEKTMERWSELSDIVEGLK

SEQ ID NO: 60751 - protein, 194 aa, Helicobacter hepaticus ATCC 51449
MKYEISEQAKLPTRFGNFFTKSFREYGKNNTLFEHLVVFTHTLGETPLVRIHSECLTGDVFGSKKCDCGNELALAMEQIAHNTEGGMLIYLRQEGRGIGLFNKINAYALQDKGYDTVEANQQLGFAGDMRSYEIVGEIFKHFHITHINLLTNNPRKIDALAPYAKVVRHSIITPSNPHNQAYLEVKKQKLGHLL

SEQ ID NO: 60752 - protein, 503 aa, Avicennia marina
MSTMAIRMPTRQLFIDGEWREPVQRKRILIINPANEQTIGDIPAATAEDVDIAVEAARKAFFRNSGKDWSSTTGAHRAKYLRAIAAKIKDRKAELVKLEAIDSGKPLVEASLDMDDVIGCFEYFAGIAERLDSEQRTPVSLPMETFKCHLLKEPIGVVGLISPWNYPLLMAIWKVAPALASGCTAILKPSELASVTCLELAEVCMEVGLPPGVLNILTGLGPEAGAPLVTHPHVAKISFTGSDTTGVKIMTAAAQLVKPVTLELGGKSPIVVFEDVDLDTAAEWTLFGCFWTNGQICSATSRLLVHESIAATFLEKLVKWCEKIKISDPLEEGCRLGPIVSRRQYEKVMKYISTAKEEGATILCGGARPEHLEKGYFVQPTIITDVKTSMQIWIEEVFGPVLCVKTFATEDEAIDLANDTHYGLAAAVISKDLDRCERMAKAFQVGAVWVNCSQPCFYQAPWGGKKRSGFGRELGERGLDIYLNVKQVTQYVSSEPWDWYKSP

SEQ ID NO: 60753 - protein, 457 aa, Rhizobium leguminosarum bv. viciae 3841
MGVKPRERAVGGQENSMSNRLNAPNDLRAFWMPFTANRQFKKEPRLFVGAKDMYYTTHDGRQVLDGTAGLWCVNAGHCRPKITEAIREQAGELDYAPAFQLGHPKAFELANRLVDIAPEGLNHVLYTNSGSESVETALKVALAYHRVKGNGSRFRLIGRERGYHGVNFGGISVGGIVTNRKMFGTLLTGVDHMPHTHQPGKNNFTRGEPEHGGDIATELERIVTLHDASTVAAVIVEPVAGSTGVLIPPKGYLQKLREICTKHGILLIFDEVITGFGRLGAPFAAQYYDVKPDMITAAKGLTNGVIPMGAVFVTSEIHDAFMNGPEHMIEFFHGYTYSGNPIASAAALATLDTYKEEGLLTRAAELSDYWADALHSLKDCPNVIDIRNTGLIGAIELDPIAGEPTKRAFTAFLKAYESGLLIRTTGDIIALSPPLIIEKHHIDELFGKLRTILQNNI

SEQ ID NO: 60754 - protein, 337 aa, Clostridium difficile 630
MAVLVAGGAGYIGSHTAIELLESGYEVVIVDNLSNSNSIVVDRIKELSKKPVKFYNIDIRNKDEMHIVFKENNIESIIHFAALKAVGESVEKPIEYYSNNLISTLNLFELMREYGVKKFVFSSSATVYGDPHTCPILEDFPLSVTNPYGRTKLMIEQMLVDISKADKSLDIALLRYFNPVGAHKSGRIGEEPNGVPSNLMPYITKIAVGKLKELSVYGNDYPTHDGTGVRDYIHVLDLAAGHVKALQKLEENPGLVVYNLGTGKGYSVLDLVKAFSKASGKEIPYKIVGRRAGDVAMCYADSSKAEKELGWKAKYELEEMCEDSWRWQSMNPNGYEE

SEQ ID NO: 60755 - protein, 291 aa, Clostridium difficile 630
MQMTVKKAIIPAAGLGTRFLPATKSQPKEMLPIVDKPTLQYIIEEAIESGIEEILIITGRNKKSIEDHFDKSVELELELEQKGKTEMLEMVRDISNMVNIHYIRQKEPKGLGHAIYCAKSFIGDEPFAVLLGDDIVDSDVPCLKQLIDTYNEYKTTVLGVQKIAKEDTNKYGILDVKHIEDRVYKVKDMVEKPAIEEAPSDIAILGRYIITPAIFSILEKQTPGKGGEIQLTDALQTLGKQEAIYAYNFEGRRYDVGDKIGFLEATIDFALKRENLKDDLMDYMRKKVSEK

SEQ ID NO: 60756 - protein, 79 aa, Populus trichocarpa
MARLRQAKEEADKEIAEFRAHMEAEFQRKLTESSGDSGANVKRLEHETEAKIGHLKTEASRISHDVVQMLLKHVTAVKN

SEQ ID NO: 60757 - protein, 445 aa, Fusobacterium nucleatum subsp. vincentii ATCC 49256
MKIAVIGTGYVGLVQGIIMSEFGSEVICVDKSQEKIEILNKGELPIYEPGLAELLHKNQKAKRISFTTDIEKAIKKSEVIFIAVGTPAMEDGSADLSAVLNVAEEIGEYINSYKVVVDKSTVPVGTGRKVINIIKEKINSRNENLEFDVVSNPEFLREGKAVNDCLRPNRIVIGTESEKAKEIMSKVYNVLYINATPFLFTNLETAEMIKYASNAFLAVKISFINEIALLAEKVGANTQEIARAMGMDGRISPKFLHCGAGYGGSCFPKDTKAIVEIGKEYGEDMYVISAAIAANEKQKKKMVEKIKNTIGNLSGKVIGVLGLSFKPDTDDMRDAPSIDIIEGLIKEGAKIQAYCPEGIKEAIWRLQDYEENIIYCADEYSIANSADAIVLMTEWNQFRGMDLKRLRKRMKDNYYFDLRNINIKNEKIRECFKYYPTGEKYVARA

SEQ ID NO: 60758 - protein, 193 aa, Escherichia coli
RADERPGKINLGIGVYKDETGKTPVLTSVKKAEQYLLENETTKNYLGIDGIPEFGRCTQELLFGKGSALINDKRARTAQTPGGTGALRVAADFLAKNTSVKRVWVSNPSWPNHKSVFNSAGLEVREYAYYDAENHTLDFDALINSLNEAQAGDVVLFHGCCHNPTGIDPTLEQWQTLAQLSVEKGWLPLFDFA

SEQ ID NO: 60759 - protein, 345 aa, Fusobacterium nucleatum subsp. vincentii ATCC 49256
MSVLITGGAGFIGSHLVEKFLKEKHKVIVVDNFDPFYSMDIKILNVLESANKKELREKILDLGDDEKLNFLVKYTESDNYKLYVEDICNLENLKEIFIKENIDFVINLAALAGVRPSVLRPFDYERVNIKGFLNILEICKEFKINKLIQASSSSIYGNSKADIFTEDIRVDFPISPYAATKKAGEEFGSVYSHLYNIDMIQLRFFTVYGERQRPDLAIHKFVKKIENDEEITIYGDGNTSRDYTYIKDIIDGIFKSFEYLNNHQNVYEIINLGSSRKINLLDMVKIIENKLNKKAKLKFIDKQAGDVDKTFACIDKAEKILNYKVSTKFEDGIENFVNWYRQRGV

SEQ ID NO: 60760 - protein, 278 aa, Parmeliopsis ambigua
VEHGDVKVVAVNDPFIEPHYAAYMLKYDSQHGQFKGTIEVKGSDLVVNGQTVKFYTEKDPANIPWKDTGAYYIVESTGVFTTTEKAKAHLKGGAKKVVISAPSADAAMFVMGVNEKEYKSDIEIISNASCTTNCLAPLAKVMHDNYTIIEGLMTTIHSYTATQKTVDGPSSKDWRGGRTAAQNIIPSSTGAAKAVGKVIPSLNGKLTGMSMRVPTSNVSVVDLTCRLEKSVTYDQIKATMKKASEGELKGIMSYSEDALVSTDLNGDNHSCIFDATAG

SEQ ID NO: 60761 - protein, 225 aa, Picea sitchensis
MDDELWAARYSAAKRHAGRSSMDRHMGIDDMKVDYDMRAEFTCSFCDLDFDIATLCRHLEDHHPFESSNAVCPVCAAKVGRDMVGHITLQHGHLFKVQRRRRFRKGVMPSNSTLSFLGKELREVQLHSLLGGAFSRSGGTSSNAASDPLLASLVYMLPKPETEEHPQPSLSTETCSTKDSPHLDNMTSAESSITAEEREQMFEEEVRRTEFAQQLVLSTFFGNDV

SEQ ID NO: 60762 - protein, 273 aa, Allantoparmelia alpicola
VEHGDVKVVAVNDPFIEPHYAAYMLKYDSQHGQFKGTIEVKGSDLVVNGQTVKFYTEKDPANIPWKDTGAYYIVESTGVFTTTEKAKAHLKGGAKKVVISAPSADAAMFVMGVNEKEYKSDIEIISNASCTTNCLAPLAKVMHDNFTIIEGLMTTIHSYTATQKTVDGPSSKDWRGGRTAAQNIIPSSTGAAKAVGKVIPSLNGKLTGMSMRVPTSNVSVVDLTCRVEKSVTYDQIKETMKKASEGELKGIMAYSEDALVSTDLNGDNHSCIF

SEQ ID NO: 60763 - protein, 144 aa, Zea mays
MMASTASATAAAAAVAFGAAAKPRGPAAVALRARVPAGGRRRSGVVVRCDAGVEAQAQAVAKASSIAALEQFKISADRYMKERSSVAVIGLSVHTAPVEMRAKLAVAEELWPRAIQELTSLNHIEEAAVLSTCNRMEIYCVALS

SEQ ID NO: 60764 - protein, 313 aa, Candida glabrata CBS 138
MVIGNRVLLPLTKRYYNARYRKVLHPELREEIIAHNCYCEEVNSKLHFDDEKIDPGISLKTAVPSYDKHVMLISDINRGMAKKPGVWKNIWESRIENNTTHPYDIISKLNFGPGVLFNAISITSSLESFAPTSLEFYDFLVMPDMRYYRVKKPDIEKFSQYINSGHAVAPKLSFSDYLSGKAAATTVSNNNQITLSLDDSIYYRELKNDAWLFVCGHEKRDMRCGIMGPEILHSVNTANSKPLVNNTGIISHIGGHKFAGNILIYKPIENQNGRKKVDSLWFGKVTPFNVSEIVQSVNEGVIIENNFRGGLSL

SEQ ID NO: 60765 - protein, 245 aa, Bacillus cereus E33L
MKGIILAGGTGSRLYPITKVTNKHLLPVGRYPMIYHAVYKLKQCEITDIMIITGKEHMGDVVSFLGSGQEFGVSFTYRVQDKAGGIAQALGLCESFVGNDRMVVILGDNIFSDDIRPYVEEFANQKEGAKVLLQSVDDPERFGVANIQNRKIIEIEEKPKEPKSSYAVTGIYLYDSKVFSYIKELKPSARGELEITDINNWYLKRGVLTYNEMSGWWTDAGTHISLQRANALARDINFGKQFNGE

SEQ ID NO: 60766 - protein, 252 aa, Xanthoparmelia semiviridis
VEHGDVKVVAVNDPFIEPHYAAYMLKYDSQHGQFKGTIEVKGSDLVVNGQTVKFYTEKDPANIPWKDTGAYYIVESTGVFTTTEKAKAHLKGGAKKVVISAPSADAAMFVMGVNEKEYKSDIEIISNASCTTNCLAPLAKVMHDNFTIIEGLMTTIHSYTATQKTVDGPSAKDWRGGRTAAQNIIPSSTGAAKAVGKVIPSLNGKLTGMSMRVPTSNVSVVDLTCRLEKSVTYDQIKDRMKKASEGNMKGIM

SEQ ID NO: 60767 - protein, 295 aa, Wolbachia endosymbiont of Drosophila simulans
MCNVGIPVPPGFTISTSACKVYYQDNRSSVIQVSDYSDPEKNVVTHWNDICSGIKNYMTMLENDIGCKFGDLNNPLLVSIRSGSVSSMPGMLDTILNVGLNDETVVGLAKKSGERFAYDSYCRFIMMYSNVVLQLDHHLFQDVIDNEQQKSGAKSLADLDVDVLKRIVNDFKKIVYEKTEKHFPQNVEEQLLNSVNAVFASWKNDRAVSYRRIHNIPENLGTAVNVQAMVFGNLNDNSATGVIFTRNPSTGEKKLFGEFLVNAQGEDVVSGVYTPMPIDGEQKNTMEKVAAQCLP

SEQ ID NO: 60768 - protein, 262 aa, Karoowia sp. Feuerer and Thell 63322a
VEHGDVKVVALNDPFIEPHYAAYMLKYDSQHGQFKGTIEVKGSDLIVNGQTVKFYTEKDPGNIPWKDTGAYYIVESTGVFTTTEKAKAHLKGGAKKVVISAPSADAAMFVMGVNEKEYKSDIEIISNASCTTNCLAPLAKVMHDNFTIIEGLMTTIHSYTATQKTVDGPSAKDWRGGRTAAQNIIPSSTGAAKAVGKVIPSLNGKLTGMAMRVPTSNVSVVDLTCRLEKSVTYDQIKETMKKASEGDLKGIMSYSEDALVST

SEQ ID NO: 60769 - protein, 348 aa, Zea mays
MTMCDQTRPRKLATGATQTANCHLLPQPLCPSPCHQGPRSPERDLAATQAMESPFRADLLRGKAALVTGGGSGIGFEIAAQLARHGAHVALMGRRREVLDKAVAALRSEGLRAVGFDGDVRKQEDAARVIAATVEHFGKLDILVNGAAGNFLASPEDLKPKGFRTVLDIDTVGTYTMCYEALKYLKKGGPGRGPSSGGLIINISATLQYTAAWYQIHVSAAKAGVDGITRSLALEWGTDYDIRVNGIAPGPIQDTPGMRKLAPEEMGNKGKRETMPLFKLGEKWDIAMAALYLASDAGKYVNGAIIIVDGGLWLSRPRHIPKEEVKALSKVVEKKVRASGVGVPSSKL

SEQ ID NO: 60770 - protein, 180 aa, Lactobacillus plantarum WCFS1
MFQTARAILNRDPAAINLRTVMLTYPGIHALAWYRVAHYFETHRLPLLAALLSQHAARHTGILIHPAAQIGHRVFFDHGIGTVIGATAVIEDDVTILHGVTLGARKTEQAGRRHPYVCRGAFIGAHAQLLGPITIGANSKIGAGAIVLDSVPAHVTAVGNPAHLVATQLHAYHEATSNQA

SEQ ID NO: 60771 - protein, 526 aa, Pseudomonas stutzeri
MASVHSITYELLRRQGIDTVFGNPGSNELPFLKDFPEDFRYILALQEACVVGIADGYAQASRKPAFINLHSAAGTGNAMGAMSNAWNCHSPLIVTAGQQNRAMIGVEALLTNVDAASLPRPLVKWSYEPASAAEVPHAMSRAIHMASMAPRGPVYLSVPYDDWDKEADPQSHHLYDRSVNSAVRLNDQDLEVLVEALNSASNPAIVLGPDVDSANANADCVTLAERLKAPVWVAPSAPRCPFPTRHPCFRGLMPAGIAAISQLLEGHDVVLVIGAPVFRYHQYDPGQYLKPGTRLISITCDPLEAARAPMGDAIVADIGTMTAALASRIGESERQLPAVLPSPERVNQDAGRLRPETVFDTLNEMAPEDAIYLNESTSTTAQMWQRLNMRNPGSYYFCAAGGLGFALPAAIGVQLAEPDRQVIAVIGDGSANYSISALWTAAHYNIPAIFLIMNNGTYGALRWFAGVLEAENVPGLDVPGIDFCAIAKGYGIPALKADNLEQLKGSIHEALSAKGPVLIEVSTVSL

SEQ ID NO: 60772 - protein, 303 aa, Lactobacillus plantarum WCFS1
MLIQHVQELIGHTPLMALPIEVPNHSHIYAKLEMFNPGGSIKDRLGAYLIEDGLQRGRVNAKTTIIEPTAGNTGIGLALATQAHHLRTILVVPEKFSMEKQVLMQALGAEIVHTPSEEGIKGAIRKAEALAATISNSYVPMQFKNPANPAAYYHTLAPEILADMPAPITAFVAGAGSGGTFAGVAAYLQAQDSATKAVVVEPEGSILNGGPAHAHRTEGIGVEFIPPFFDQVRIDQTLTIADNDAFAQVRHLARDHGLLIGSSSGAALAASLQLATNLPANSHIVTIFPDSSERYLSQKIYTK

SEQ ID NO: 60773 - protein, 263 aa, Lactobacillus plantarum WCFS1
MITLKSDREIKGMQAAGDIMVGLFHALEDYIKPGITTWDVDHFAYEYIVAHDATPGELNFEGYKYSTCVSVNDMICHGCPSKDILVKDGDLLKVDTVINYHGYLSDSCHAFVAGTPSPEVKKLMEVTHKALYLGIDQAVVGNRIGDIGWAIQNYAENEMGYGVVREYIGHGIGPTMHEKPDVPHYGEAGHGTRLKAGMTITIEPMVNIGDWRSGETADDGWTVRTLDGSLSCQYEHTLVVTDDGPKILSSFDNDFDAKYLWNK

SEQ ID NO: 60774 - protein, 436 aa, Pseudomonas stutzeri
MNYLSPAMIDSLFSAQKAFFATRATADVGFRKQALKRLRDAVINNKEFFYSALAEDLGKTREVVDLAEIGEVLHEIDFALANLDEWIVPESVPTPEIIAPSECYIVQEPYGVTYIIGPFNYPVNLTLTPLIGAIIGGNTCIIKPSETTPETSRVIEKIIAEAFSPEYVTVIQGGLAENSHLLSLPFDFIFFTGSPNVGKVVMKAAAEHLTPVVLELGGKCPLIVLPDADLDQTVDQLMFGKFINSGQTCIAPDYLYAHRSVKDALLQRVVERVKNDLPKVNSTGKIVTSRQVVRLVSLLEETRGKVLVGAQADVDNRAFSATVVDSVQWDDPLMAEELFGPILPVLEFDDVPTAVNLINKHHPKPLAVYVFGKDVDLAKGIINQIQSGDAQVNGVMLHAFSPYLPFGGIGASGMGDYHGHYSYLTFTHKKSVRIVP

SEQ ID NO: 60775 - protein, 408 aa, Brucella suis 1330
MATEIRVPTLGESVTEATIGKWFKKAGEAIAVDEPLVELETDKVTVEVPAPAAGVLAEITAKEGDTVEVGALLGQISSDGAAVAAAPAQKKEEAKPAAAAPAAAPVASASSGPAMQPAPAAAKLLAESGLSADQVEGSGKRGQVLKGDVLDAITKGVSAAPAAPVAARPASSADDASREERVKMTRLRQTIARRLKDAQNTAAMLTTFNEVDMSAVMELRNKYKDVFEKKHGVKLGFMGFFTKAVTHALKEIPAVNAEIDGTDIVYKNFCHVGMAVGTDKGLVVPVIRDADQMSIAEVEKELARLARAARDGSLSMADMQGGTFTITNGGVYGSLMSTPILNAPQSGILGMHKIQERPMVVGGQIVVRPMMYLALSYDHRIVDGKEAVTFLVRVKESLEDPERLVLDL

SEQ ID NO: 60776 - protein, 413 aa, Dechloromonas aromatica RCB
MTSHIKVPQGGSKIVPGQAIPDNPIIPFIEGDGIGIDITPVMIKVIDAAVEKAYGGKKKIHWMEVYAGEKSTRLYGSDEWLPKETFDALKEYSVSIKGPMTTPVGGGIRSLNVALRQELDLYQCVRPVRYFKGVPSPLKHPELTNMVIFRENTEDIYAGIEWACGSEGVKKVVKFLQEEMGVKKIRFPETSGIGIKPISIEGTSRLVRAAIKYAIDNDRKSVTIVHKGNIMKFTEGLFRDACYKLAQDEFGAELIDGGPWCRIKNPKNGREIIIKDSIADAFLQQILLRPAEYDVIATTNLNGDYISDALAAQVGGIGIAPGANISDRYACFEATHGTAPKYAGLDKVNPGSLILSAEMMLRHLGWGDAANLVLKAMEAAIGDKQVTYDFARQMEGANELSCSEFGDAMIARM

SEQ ID NO: 60777 - protein, 132 aa, Oryza sativa
GVPSPSPLPSGELRALPGERRRFGRRGSPESPPPCPRWPPTSGRRRTDIWRLAQQVKVRQRVIATAVTYFRRVYTRKSMTEYDPRLVAPTCLYLASKVEESTVQARLLVFYIKKMCASDEKYRFEIKDILEM

SEQ ID NO: 60778 - protein, 517 aa, Arabidopsis thaliana
MATGVTHVFHKTCANNTYNIAHPSQTCDNILNHTYNFNIGGGRCAGCGEKIYDSLIYICNKCVLVPLRKGRFGSSYFHFNCAKYPPSEVIDVPQHHDHKLKLEMVKSCFSCATCGKDSDGYSYKCHECDLKFHVNCEKHPAEVTHFSHPLHPLKLVKVEPPAYTDKKCRLCGEKLANSEVFYHCSACNFSLDLQCIFYPPKQNPHDPNIHGHQLTLMPKSISFSCTSCGLKGDRSPYVCLPCDFTSHNDCSGFPWVININRHDHRVSRTSLIGVVNSVCGICRKNMDWSCGGYSCKRCPTSVFHTKCVTREDVWDGKEMKDEPEEEEDILPFKVIDENTIQHVSHKEHNLRLDKSGIFIEERICEACVYPIYHHSFYSCMSCSFILHESCAYLPLWKRHVVSNDRHKYKYWDYFIRCTACGLFSNGFRYEAMRASLDLRCASITEPFVHKSHPHPLFYTSPRGICIVCKKEAQHVLRCVEDDCEYIMDYKCALLPYEVKHSVDQHSLFTLWRRRCRW

SEQ ID NO: 60779 - protein, 446 aa, Glycine max
SVIGYCEKTTEGERYKILRELGDGSCGHVYKARDMRTYEIVAVKRLKRKFCFWEEYTNLREVMVLRKMNHSNIIKLKEVVRENNELFFIFEYMDCNLYQLIKEREKPFSEEEIRCFMRQVLQGLSHMHKKGFFHRDLKPENMLVTNDVLKIADFGLAREVSSMPPYTQYVSTRWYRAPEVLLRAPCYTPAVDMWAVGAILAELFTLTPIFPGESEIDQLYKIYGILGMPDSTAFTIGASNSQLLDIVAHEVVPPVKLSNIIPNASLEAIDLITQLLHWDPSRRPDADQSLQHPFFHVDAWVPCPPSDPLELKLSSKRAKPNLELKLQDFGPDPDDCFLGLTLGVKPSVSNSDVVQNVSQGVRENVLFCSDFNDHSDQSVFWTLLSPDQNGIHNSAETSLSLSFSPVQHPPIGVPQSVGFSFQPLQPNILTSPFLALSSPFQRGHCL

SEQ ID NO: 60780 - protein, 502 aa, Avicennia marina
  misc_feature (158)..(158): Xaa can be any naturally occurring amino acid
MAIRIPSRQLFIDGKWREPVNRKRLPIVNPATEETIGDIPAATAEDVNIAVEAARKAFFHNGGKDWATASGAHRAKYLRAIAAKVTEKKEELAKLEVLDCGKPLEEAAWDMDDVAGCFEYFADLAERLDSNQIPVSLPMDTFKCHVLKEPIGVVGLVXPWNYPLLMATWKVAPALAAGCTAILKPSEIASVTCLELAQVCKEVGLPAGVLNILTGLGPEAGAPLASHPHVDKITFTGSGATGSKIMTAAAQLVKPVTLELGGKSPIVVFEDVDLDTAAEWTLFGCFWTNGQICSATSRLLVHESIATTFLEKLVKWCEKIKISDPLEEGCRLGPIISRGQYEKVMKFISTAKEEGATILCGGARPEHLEKGYFVQPTIITDVKTSMQIWIEEVFGPVLGVKTFSKEDEPFELANDPHYGWAAAVLSQDLERCERMTKAFQAGIVWVNCSQPCFCQAPWGGKKRSGFGRDLGEWGLDNYLNVKQVTRYVSSEPWDWYKSPSKL

SEQ ID NO: 60781 - protein, 384 aa, Bacteroides fragilis YCH46
MDIEHVRSRFIKHFDGTTGFVYASPGRINLIGEHTDYNGGFVFPGAIDKGMIAEIKPNGTDKVNAYSIDLKDYVTFGLNEEDAPRASWARYIFGVCREMIKRGVDVKGFNTAFSGDVPLGAGMSSSAALESTYAFALNDLFGENKIDKFELAKIGQATEHNYCGVNCGIMDQFASVFGKEGSLIRLDCRSLEYQYFPFKPEGYRLVLLDSVVKHELASSAYNKRRQSCEAAVAAIQKKHPHVEFLRDCTMDMLAEAKADISEEDYMRAEYVIEEIQRVLDVCDALERGDYETVGQKMYETHHGMSKLYEVSCEELDFLNDCAKECGVTGSRVMGGGFGGCTINLVKDELYDNFIEKAKESFKAKFGRSPKVYDVVISDGSRRLV

SEQ ID NO: 60782 - protein, 126 aa, Brassica napus
  misc_feature (103)..(103): Xaa can be any naturally occurring amino acid
MKSYEHDGVDLEDGKTRKAGGDKPTLRKIPNQALLSGLAYCVSSCSMILVNKFVLSSYNFNAGIFLMLYQNFVSVIIVMALSVMGLITTEPLTLRLIKVWFPXNVIFVGMLITSMFSLKYITVAWS

SEQ ID NO: 60783 - protein, 504 aa, Glycine max
MEQPPSSSLQVETAQQPGPSPLRKMFAVSSIAAGIQFGWALQLSLLTPYVQTLGVPHAWASFIWLCGPISGLLVQPIVGYSSDRCRSRFGRRRPFIFVGAIAVAIAVFLIGYAADIGHAAGDDLTKKTRPRAVVVFVVGFWILDVANNMLQGPCRAFLGDLAAGDHRKTRTANAFFSFFMAIGNVLGYAAGSYDKLHRAFKFTQTEACDVFCANLKSCFFFSIVLLLVLCFVVLICVDDPQFTPRGDDNNGENDGVSGSCFGELWAAFKGLKRPMWLLMVVTAINWVAWFPYMLFDTDWMGREVYGGKVGEKAYDSGVHKGALGLMLNSVVLALMSLTVEPLGRFVGGVKWLWGIVNVILAVCMAMTVVITRAAEHERKNGVSAVGHPSVGVQVAALTFFSALGVPLAITFSVPFALASIYSSTSGAGQGLSLGVLNVAIVVPQMIVSAISGQWDKWFGGGNLPAFVLGAVAAAVSAVLAVVLLPTPKPADVAKVTSVTAGSFH

SEQ ID NO: 60784 - protein, 137 aa, Picea sitchensis
MAERGGGFGRGFGRGRGDRGRGDRRGGRRGPRRDEEEKWVPVTKLGRLVKEGKIRSLEQIYLFSLAVKEHQIVEAMLGPQLKDEVMKIMPVQKQTRAGQRTRFKAFVVVGDGNGHVGLGVKCSKEVATAIRGAIILA

SEQ ID NO: 60785 - protein, 306 aa, Rhizobium leguminosarum bv. viciae 3841
MSRRFLSIGECMVELSQAGDGLLRKGFAGDTFNTAWYVRACLGPDWSVDYFTALGDDAMSDEMVAFIDKAGIGTSLIRRIRGRTPGLYMINLKDGERSFSYWRDSAAARSLAADPDRLREAVESAEVVYFSGITLAILPHEDAETLLAEVRRAKAAGKLVVFDPNIRPRLWSSYDIMHTTISEGARSSMLVMPSFDDEAAHFGDDSIEATIHRYRALGAVHIVVKNGAEGVTLNFAGEQTFVPAEKVEKVVDTTSAGDSFNGAFLARYLEAGDAPAAARFAAKVAARVVSEHGALVVREKLGLDGG

SEQ ID NO: 60786 - protein, 189 aa, Escherichia coli
RPGKINLGIGVYKDETGKTPVLTSVKKAEQYLLENETTKNYLGIDGIPEFGRCTQELLFGKGSALINDKRARTAQTPGGTGALRVAADFLAKNTSVKRVWVSNPSWPNHKSVFNSAGLEVREYAYYDAENHTLDFDALINSLNEAQAGDVVLFHGCCHNPTGIDPTLEQWQTLAQLSVEKGWLPLFDFA

SEQ ID NO: 60787 - protein, 491 aa, Burkholderia xenovorans LB400
MSDTPVTPSTSTFDQFGLAPDILKAVKESGYTIPTPIQEQAIPVVLAGRDMMGAAQTGTGKTASFSLPIIQRLLPQASTSASPARHPVRALILTPTRELADQVAANVQAYAKHTALRSAVVFGGVDMNPQSEQLRRGVEILIATPGRLLDHVQQKTANLGQVQILVLDEADRMLDMGFLPDLQRILNLLPKERQTLLFSATFSGEIKKLAATYLRDPQTIEVARSNSTATNVRQIVYEVAEGDKTGAVVQLIRERGLKQVIVFCNSKIGASRLSRSLERDGVIATAIHGDRSQNERMQALDAFKRGEIEALVATDVAARGLDIAELPAVINFDLPFNAEDYVHRIGRTGRAGASGDALSLCSPNERKQLADIEKLIKRPLEVQRLTVEAPVRHHHEERAPRRERSSEGREDRGGRRRSGASSSGSFDRPHHHRAQPVDDFFLKPYEPSPASVRKVEEADAASAAPQKPASKQPLAALLGGFGMPRKSPSSS

SEQ ID NO: 60788 - protein, 256 aa, Pseudomonas putida
MNDQRKGDHAEPTTHFGYQDVPESQKAKKVAEVFHSVAAKYDLMNDVLSGGMHRLWKRFTIELSGVRAGNRVLDIAGGTGDLAAKFSRLVGPTGQVVLADINESMLKVGRDRLLDRGVAGNIEFVQADAEKLPFPDNHFDCVTIAFGLRNVTHKDEAIRSMLRVLKPGGRLLVLEFSKPTNKLMSKAYDAYSFAFMPLAGKLITNDSESYRYLAESIRMHPDQETLKAMMVEAGFDRVTYHNMTSGIVAVHRGIKP

SEQ ID NO: 60789 - protein, 301 aa, Myxococcus xanthus DK 1622
MRPMDPVLLVGTASPHLGRALGQALGVAPADCHFERFPDGEMHVEVPEQVRGRTVILVQSTTPPAGEHLLELLLMADACWRMGAARLEAVVPYLGYARQDRRARPGEPLGGRLVADLLSQGRFARVLVVDLHSPALEGCFGAPLEHLTSLPLLAEALREHVTDTSVVVAPDLGAVKRAEALARLLNRPWAVIHKVRLSGDEVHASGLMGEVRGRRPILVDDMVSTGGTLAAAAGTLRDAGCTEDFTVATTHALLVGPAVERLRTLPLTRLVSTDSVEPVLGLPFQHQVVTLAPLVARALRP

SEQ ID NO: 60790 - protein, 193 aa, Escherichia coli
ERPGKINLGIGVYKDETGKTPVLTSVKKAEQYLLENETTKNYLGIDGIPEFGRCTQELLFGKGSALINDKRARTAQTPGGTGALRVAADFLAKNTSVKRVWVSNPSWPNHKSVFNSAGLEVREYAYYDAENHTLDFDALINSLNEAQAGDVVLFHGCCHNPTGIDPTLEQWQTLAQLSVEKGWLPLFDFAYQG

SEQ ID NO: 60791 - protein, 91 aa, Oryza sativa
GTGIGAARTPKKVLQYAGIEDVFTQSTGSTKTLGNFVKATFDALAKTYGYLTPDLWRETRLQKAPYQEFTDFLYQTGKEKVEKKKAAERNY

SEQ ID NO: 60792 - protein, 450 aa, Myxococcus xanthus DK 1622
MAAGPDGVSLGRPMSPIDTDALAGDLLEYIDASPTPYHAVRESARRLTQAGYRQLDEREPWAPEPGARVFITRGDTSIAAFHLGTQPVDRAGFRLVGSHTDSPNLRVKPNAAVTKNGYQQLGVEIYGGVLLHTWTDRDLSLAGRVMVMVEGRPQRHLVDFRRPLLRVPNLAIHLNRGVNSDGLKLNAQEHMVPVLGLERAGVAELHGLLLEELAKGGVKAQAGDILGYDLCLYDLQPSIRSGAHGEFLHAPRLDNLASCHASLSALLSSSEPREATSGVILFDHEEVGSRSAQGAASPFLRTLLERLTLAHSDGKPDAFHRAIAHSFLVSADMAHAIHPNYPSLHEPKHQPHMGAGPVIKSNVNQSYATDGESWAFFTALCREAGVTPQHFVTRTDLGCGSTIGPISAGQLGIRTVDVGNPMLSMHSIREMACATDVAQMVAVLSRLFAS

SEQ ID NO: 60793 - protein, 475 aa, Mesorhizobium loti MAFF303099
MDTQMLIGSKFENGAETEESILNPKTGATILNLPEASQAQIEAAVAAAEKAFVSWSRTTPAQRSGYLLKIADRIEAEAKEFAALEALNCGKPINSVLNDEIPAIVDCYRFFAGAVRSMPGVVAGEYLPGHTSMVRRDPIGIVASIAPWNYPLMMMAWKLAPAIGGGNTVVFKPSEQTPLTALRLARILAEILPEGVVNVVLGRGDSVGNALINHPKVNMISITGDVATGKKVLQAAAKSVKRTHLELGGKAPVIVFDDADLGAVVNGLRAFGYYNAGQDCTAACRIYAGKKIYDKLVADLSSAVSTIKYNQPDDTENEIGPLISRRQRDRVSSFVERASELKHIEITTGGRPGEGTGFYYQPTVVAGALQEDEIVRREVFGPVVSITRFTEVDEAVNWANDSDYGLASSVWTKDVSRAMATAARLQYGCTWINTHFMLTNEMPHGGLKQSGYGKDMSLYALEDYTAVRHVMVAHA

SEQ ID NO: 60794 - protein, 182 aa, Oryza sativa Indica Group
MAQMAFEPDKVGTVTVNGKVYSFRRVHWHAPSEHTINGEKHPLELQMVHAAADGSLAVIAILYKYGAPDSFYFQLKRKLAELAADGCSFGEENAQVALGLVHLRSLQKRTGSYFRYAGSLTAPPCTEDVVWSVLGKIRQISQEQVALITALLPAGGARPTQPLNGRTVQFYNPPNSTISFKV

SEQ ID NO: 60795 - protein, 227 aa, Rhodobacter sphaeroides
MAKTCGMNWSIPNILTVLRLLAAPGVAVMFLYFHRPWADWFALTLFILAAVTDFFDGYLARLWKQESKFGAMLDPIADKAMVVIALVIITGYSGMNPWLILPVTLILFREVFVSGLREFLGAKASLLKVTKLAKWKTTAQMVAIAILFLGTGLEHLEGIARQGMTWEQYARAVSAGEADPIRSCGMHGCSSYATWLGLALIWIAAALTFITGWDYFRKALPYLKDEK

SEQ ID NO: 60796 - protein, 390 aa, Myxococcus xanthus DK 1622
MRALCWNGINDLGVETVGDPRIVNPHDVILQVRMSTTCGSDLHFIDGYIPTMRKGDVIGHEFMGTVVEKGPAVKKVQVGDRVVVPSFIGCGSCWYCQHDLWSLCDNTNPKGELQEPLFGYQTAGIYGYTHTFGGYAGAHAQFVRVPHADNDCFRVPEGVTDEQALFLSDAVPTGYMGADFCDIQPGQTVAVWGCGGVGLMAQKAAFLLGAERVIGIDRFPERLKLAREKVGAETISYEEVDSVLDVLKELTGGRGPDACIDAVGMEAHGTGVGAAYDRAKQAMRLQTDRGQALRQAILACRKGGILSVVGVYGFMDAFPLGAIMNKGLTVRSAQQHGQKYLPRLLEHVVKGELDPSFLATHRFSLEDAPKGYELFKKKQDGCVRAVFLPN

SEQ ID NO: 60797 - protein, 653 aa, Wolbachia endosymbiont of Drosophila simulans
MLFESIPDNPQIAINSNKILNLSLVPIARPDGYFVLKATQINKEQIYEELIEKHSIGTYIANAKGVILSVNKRFLDIFELKKLEKGSSISDFISQSKYNNTTTDNEILFFTISGIPFKAYMSTAIFCDKYNHSYIYGFITPTESNIVDYQLHPCFANSSIAIAQCDINGNFVKKNTALIKLAGSDNNSIFTLILDSYHVKIREYFSSNRINNASFDVQLNGGNNIKIYFNKFLHNKMIFILCYFIDNTEHKNLEIKLEHYQKMQAIGQLAGGIAHDFNNILTGIIGFCDLLLLQHSAGDPSFGDIIQIQQNAKRGSNLVRQLLAFSRRQTLQPKIIDVNNTIANLYEMIKRLIGENIKFNIYYGRDLGAVRADQGQLEQVILNLAVNASAAMEKGGELTIRTFNQKIDSLNSTPQDMFSPDKEAIEHGNYVVIEVIDTGCGMTSDTTEKIFDPFFSTKDITSGTGLGLSTVYGIIKQTEGYIYVASKVNHGTKFSIFLPMVYISDENDREEDSEETERPVVSEIKGNGIILLIEDEDSVREFISKELKRKGFDVIEASIGSEALEIISKKSQHIDLIITDVIMPEVSGPEIVKEALIHRPNINVIFISGYAEDAFLKSDDINIEDFHFLPKPFTLNELGNKVQSVLHKAKKTV

SEQ ID NO: 60798 - protein, 96 aa, Glycine max
  misc_feature (90)..(90): Xaa can be any naturally occurring amino acid
MDSSTTQSEGSQPPVPPKSPTMSSCRKKKTDDDATFLKDVKEHIDEFIHASMDEHKTCFKKTIQKMFGMSKAVAERFAAAKEAEVESACXLRQCVR

SEQ ID NO: 60799 - protein, 249 aa, Leptospira interrogans serovar Lai str. 56601
MSGFQMPQANFKAGFVRENFNKIAKKYDRFNDWNSFLLHRVWKNHLVREIENNFSGHLHVLDLCCGTGDISLRLENSSFVDHVTCVDFSENMLEIAKTRLKKQAQKGRVHFELGDATKLIQFQNSQFDVVSIGFGLRNVDNLSKAIGEIFRVLKPGGMFLNLDVGKVKNPWIRWIADFYFFKIVPILGYILWGGKNEMFDYLPVSSLSYPDQETLQLILEKEGFQRVQYKNFVFGNVVLHVAKKPSEKT

SEQ ID NO: 60800 - protein, 163 aa, Shigella flexneri 2a str. 2457T
MRRILSVLLENESGALSRVIGLFSQRGYNIESLTVAPTDDPTLSRMTIQTVGDEKVLEQIEKQLHKLVDVLRVSELGQGAHVEREIMLVKIQASGYGRDEVKRNTEIFRGQIIDVTPSLYTVQLAGTSDKLDAFLASIRDVAKIVEVARSGVVGLSRGDKIMR

SEQ ID NO: 60801 - protein, 474 aa, Vitis vinifera
MEPRVGNKFRLGRKIGSGSFGEIYLGTNIQTNEEVAIKLENVKTKHPQLLYESKLYRILQGGTGIPNVRWFGVEGEYNVLVMDLLGPSLEDLFNFCSRKLSLKSVLMLADQMINRVEFVHSKSFLHRDIKPDNFLMGLGRRANQVYIIDFGLAKKYRDTATHQHIPYRENKNLTGTARYASMNTHLGIEQSRRDDLESLGYVLMYFLRGSLPWQGLKAGTKKQKYEKISERKVSTSIEVLCRGYPTEFASYFHYCRSLRFDDKPDYAYLKRIFRDLFIREGFQFDYVFDWTILKYQQSQLATPPSRVLGPGAGTSSGLPPPAVANADRQSGEEGRPAGLSSMDPSRRRISGDGGGLSKQKSPVASDLAVSKDAMLSSSHFLGRSSGSSRRAAVSSSRDAAIMGSESDPSRAHTTEASPGAAVRRISSGQRSSPVGSSDPKRTSSGRNITNIKNYESTIRGIENLNFDNDERVHY

SEQ ID NO: 60802 - protein, 336 aa, Pseudomonas putida GB-1
MAFNIHNRNLLSLEHHTTRELRYLLDLSRDLKRAKYTGTEQQHLKGNNIALIFEKTSTRTRCAFEVAAYDQGANVTYIDPNSSQIGHKESMKDTARVLGRMYDAIEYRGFKQEIVEELAKFAGVPVFNGLTDEYHPTQMIADVLTMREHSDKPLHDISYAYLGDARNNMGNSLLLIGAKLGMDVRIAAPKALWPHDDLVERCKKYAEESGARITLTEDPKAAVKGVDFVHTDVWVSMGEPIEAWGERIKQLKPYQVNAELMKSTGNPRTKFMHCLPAFHNSETKVGKQIAEQYPDLANGIEVTDDVFESPACIAFEQAENRMHTIKAILVSTLADL

SEQ ID NO: 60803 - protein, 427 aa, Bacteroides fragilis YCH46
MTFENLNLIEPILKALRQEGYTSPTPIQEQSIPILLQGKDLLGCAQTGTGKTAAFSIPILQKLYKTDHRKGIKALVLTPTRELAIQIGESFEAYGRYTGLKHAVIFGGVGQKPQTDALRSGIQILVATPGRLLDLISQGFISLSSLDFFVLDEADRMLDMGFIHDIKRILKLLPARRQTLFFSATMPPEIETLANSMLTKPEKVEVTPASSTVDIISQQVYFVEKKEKKDLLIHLLKDTSIESVLIFTRTKYGADKLARVLTKAGIGAEAIHGNKTQNARQRALTNFKNHTLRALIATDIAARGIDVDQLSHVINYELPNVPETYVHRIGRTGRAGHEGVAISFCESEELPYLKDIQKLIGKNIPVVKDHPFVTTEGIKAQEEKQEEIKVKAKANKTYRGSRANGDFWRRKKQKTNQPSSTKQEKRK

SEQ ID NO: 60804 - protein, 170 aa, Pseudomonas oleovorans
MNDQRKGDHAEPTTHFGYQDVPESQKAKKVAEVFHSVAAKYDLMNDVLSGGMHRLWKRFTIELSGVRAGNRVLDIAGGTGDLAAKFSRLVGPTGQVVLADINESMLKVGRDRLLDRGVAGNIEFVQADAEKLPFPDNHFDCVTIAFGLRNVTHKDEAIRSMLRVLKPGGR

SEQ ID NO: 60805 - protein, 59 aa, Zea mays
APKVLQAIQLMTKNRVKHIRVFDGPGILGMVSLGDFVGPGVAQPKEEFNRLNDSIQGGF

SEQ ID NO: 60806 - protein, 272 aa, Bacteroides fragilis YCH46
MEHKYLFVAVDAALKAGEEILSIYTDPASDFEIERKADHSPLTIADRKAHVTIATILNETPFPVLSEEGKHLEYDTRRNWDVMWIVDPLDGTKEFIKRNGEFTVNIALVKAGVPIIGVIYLPVKKELYFAGQEIGAYKLSGITTLEDDATLDKLVAASVRLPQDLQRDRFVVVASRSHLTPETEAYIDAVKQEHKHVELISSGSSIKICLVAEGKADVYPRFAPTMEWDTAAGHAIARAAGMEIYQADKKDVPLQYNKEDLLNPWFIVEKRR

SEQ ID NO: 60807 - protein, 310 aa, Nostoc punctiforme PCC 73102
MVATDNVQKTPPEEATFNLVAYLKERQKLCDNALDRAIPIIYPEKIYEAMRYSLLAGGKRVRPILCLATCEMMGGTIEMAMPTACAVEMIHTMSLIHDDLPAMDNDDYRRGKLTNHKVYGEDVAILAGDGLLALAFELVALKTPANVNRELTLQVIVRLGRALGAAGLVGGQVVDLECEGKSDISLETLNFIHRHKTSALLEACVVSGGIIAGASTEDVQRLTRYAENIGLAFQIIDDILDITSTKEQLGKTAGKDQKAKKVTYPSLWGLEESRLKAQELVKVACAELEPFGDRAKPLQAIAHFITSRNN

SEQ ID NO: 60808 - protein, 72 aa, Escherichia coli
MGFKCGIVGLPNVGKSTLFNALTKAGIEAANFPFCTIEPNTGVVPMPDPRLDQLAEIVKPQRTLPTTMEFVD

SEQ ID NO: 60809 - protein, 313 aa, Helicobacter hepaticus ATCC 51449
MLYRSSLELIGHTPLLELTHLNIANNNRIFAKLEFYNPAGGIKDRVALYICQKLKEKGLLHKDSVIIEATAGNTGLGIAFVAQHFGCKAILIVPDKFSIEKQILMRALGAQVINTPKEKGMQGAMDRAQEMLSCTPYALSLNQFENLDNPQAHYLTTAKEIYDDMAKVQANSENGSDALIDYLVCGAGSGGSFSGIVGYLKKQDSRIKGVLCDPVGSIIGGGEEGCANIEGIGNNFIPHTMDISLIDSVQKITDEEAYEGVRMLAKNEGILAGISSGACLIACLKLANEVQNSLIVTLFADDLSRYFSRNLID

SEQ ID NO: 60810 - protein, 591 aa, Brassica napus
MPTWWVRKSSKNKDDSHLLQTQTRSVSDKSIRRISADNSKSSPDPVTPSRCTPRCSREFAGASGFSDEKKCHPLPLPSLSNDQVNGSVSGSGSVSSVSSSGSGEDQSQPTAPRKSNAAAASPKAGARPTSPLHNRFSGMTLESSSTGRNDDGRSSEYHPLPLPPGSPTSPSVVLPCSPTSPSSGVQGSWVVGGSEKEISKWKKGRFIGSGTFGKVYQGFNSEEGRICAIKEVKVISDDKNSKECLKQLNQEINVLSQLCHPNIVQYYGSELSEETLSVYLEFVSGGSIYKLLTEYGAFTEPVIQNYTRQILYGLAYLHGRNTVHRDIKGANILVDPNGEIKLADFGMAKHVTAYSTMLSFTGSPYWMAPEVVMHKNGYTLAVDVWSVGCTILEMATAKPPWSQFEGVAAIFKIGNSKDMPEIPDHLSNDAKNFIRLCLQRNPTVRPTAAQLLEHPFLRVHSPRVANTSMHKDVPPRPYDGSSSMPTREPPYSGRHPVFHPIKSPSRENVRAITSLPVSPCSSPLRQLGPAYKSCFLSPPHPSYAFPVQESGYNHQAEFAASPFRFKKDTSLIEPSSYRAQAPSSPFRSRLV

SEQ ID NO: 60811 - protein, 196 aa, Escherichia coli
FRADERPGKINLGIGVYKDETGKTPVLTSVKKAEQYLLENETTKNYLGIDGIPEFGRCTQELLFGKGSALINDKRARTAQTPGGTGALRVAADFLAKNTSVKRVWVSNPSWPNHKSVFNSAGLEVREYAYYDAENHTLDFDALINSLNEAQAGDVVLFHGCCHNPTGIDPTLEQWQTLAQLSVEKGWLPLFDFAYQ

SEQ ID NO: 60812 - protein, 242 aa, Picea sitchensis
MDRYQRVEKPRPETPISENEIRITTQGRMRNYITYATTLLQDKGSSEIVLKAMGRAINKTVTIAELIKRRIPDLHQNTIIGSTDITDTWEPLEEGLLPLETTRHVSMITITLSTKELDTSSTGYQPPLPADQVKPWTDLEYDGEGSPGGGRGRGRGARGRGRARGNGNLGGEYYGDGNWERGRGSGRGRGRGRGRGRGRGYRGRGRGYGVFEAQQDAGRGRGRGRGRDFGSDEQQGEMPVVA

SEQ ID NO: 60813 - protein, 391 aa, Zea mays
MRSSEASSRLVQELVLYAASAALSCLVLFAGLRHLDPNRAASQKAQQQKKEIAKRLGRPLVSTTPYEDVIACDVINPDSIDVEFDSIGGLDQIKQALYELVILPLRRPELFTFGKLLSPQKGVLLYGPPGTGKTMLAKAIARESGAVFINVRISNLMSKWFGDAQKLVAAVFSLAHKLQPAIIFIDEVDSFLGQRRTTDHEAMTNMKTEFMSLWDGFTTDQNARVMVLAATNRPSELDEAILRRFTQIFEIGIPVQSERNKILQVVLKGENVEPNVDYDHIARLCEGFTGSDILEVCKQAAFYPIRELLDNERNGRKLDKPRPLRQSDLERALSTSRKCKKAASSGLQSPLWVRPTDSEDDQVQNAILEISKLMSRIVESSQSEPQEPSSP

SEQ ID NO: 60814 - protein, 191 aa, Shigella flexneri 2a
RPGKINLGIGVYKDETGKTPVLTSVKKAEQYLLENETTKNYLGIDGILEFGRCTQELLFGKGSALINDKRARTAQTPGGTGALRVAADFLAKNTSVKRVWVSNPSWPNHKSVFNSAGLEVREYAYYDAENHTLDFDALINSLNEAQAGDVVLFHGCCHNPTGIDPTLEQWQTLAQLSVEKGWLPLFDFAYQ

SEQ ID NO: 60815 - protein, 194 aa, Shigella flexneri
ADERPGKINLGIGVYKDETGKTPVLTSVKKAEQYLLENETTKNYLGIDGIPEFGRCTQELLFGKGSALINDKRARMAQTPGGTGALRVAADFLAKNTSVKRVWVSNPSWPNHKSVFNSAGLEVREYAYYDAENHTLDFDALINSLNEAQAGDVVLFHGCCHNPTGIDPTLEQWQTLAQLSVEKGWLPLFDFAYQ

SEQ ID NO: 60816 - protein, 263 aa, Candida glabrata CBS 138
MITNRLMNKCVSSPLRSVTWRRLITIQTLTTPNENALKFLNKDNELLQTRGSKSIVIKNTDQNLISHSDLASKIFAQCPGVESLMIGDDFLTVNKDSQVPWAQIQSDVIDLLTQQLASGKNVISDEFHAIKEDNEAGYQINEMKFDLTEEDEEIKELIEELIETRIRPAILEDGGDIDFRGWDPESGTVYLKLQGACTSCSSSEVTLKYGIESMLKHYVDEVKEVIQMMDPEQEIALKEFDKLEKKLQSKDENDGTTAPASAS

SEQ ID NO: 60817 - protein, 200 aa, Zea mays
KLHVDGWRTTRIGDFGLMAVARGCPNLQELVLIGVNPTVLSLRMLGEHCRTLERLALCGCETVGDAEIICLAERWAALKKLCIKGCPVSDRGMEALNGGCPSLVKVKLKRCRGVSYECIENLKVTRGGSFSISLDIVLEHDARSASENGAQENGQAQITALTDQMAGMDLPVNAAGAQSSTHTITRMRSVVSALRRSVAS

SEQ ID NO: 60818 - protein, 264 aa, Streptomyces spectabilis
MSLAHAEGGAALLRLAVRAAHRAGELLLEGAAAGPPEVRTKSSAKDLVTAFDRGSEACVVEILTAARPDDGILGEEGGERPGGSGVRWVIDPLDGTANFVSGYPAFVVSIAAERAGRTEVGVVYDPSRRETFTAIRGRGAARDGLPLTVSGAERLEQALVSTGFSSDPATRDRQAALAARVVARVRDIRSSGSAALDLCWVAAGRLDAYYESGTRLWDRAAGALIAEEAGAWVGGADGRPPCDAMTIACAPKTADALRALVGHA

SEQ ID NO: 60819 - protein, 334 aa, Oryza sativa Indica Group
MDAEGTRLLNLTVLQRLDPAVEDILITAAHVTLYDFNIDLNQWSRKDVEGSLFVVKRNTQPRFQFIVMNRRNTDNLVEDLLSDFEYELQPPYLLYRNAAQEVNGIWFYNQHDCEAVASLFGRSSEFEELEAVPTSAAIDGPLEPSPATTTIVSDAPDESLVNYFSSAASIGSVSNAPMAGRAHPSSESVATPHVPLIIPSATPTHQIPPPLVGSSAPPLPLHDTNVHTARSANLVTPAFFTPPSSSSTSMVPPASSMMPTAPPLHPTSASAQRATYGTPLLQPFPPPTPPPSLTPSYNEGPIISRDKVKEALLRLVQNDQFIDLVYRELQNAHM

SEQ ID NO: 60820 - protein, 353 aa, Triticum aestivum
  misc_feature (167)..(167): Xaa can be any naturally occurring amino acid
MAANVALLSASSPSTSASSILRRHPPPRRSACPRRAASRLSVVAAMSDDPIKEWILTEGKATQITGTSSIGGGCINAAQRYDTDAGSFFVKTNRRIGPAMFEGEALGLKAMYDTKSIRVPLPYKVGSLPTGGSFIIMEYIQFGRSRGDQVTLSRNPFRSKKKSALGXRKLVEMHKAAKSDKGYGFYVENTIGSTPQINTWTADWIEFYSKHRLGYQLKLISQRFGDSAIYEKGQQLIEKMHPLFDGAVIEPCLLHGDLWSGNISADTNGDPVILDPACYYGHNEAEFGMSWCAGFGGEFYRSYFEVMPKQPGFEKRRDLYLLYHYLNHYNLFGSGYRSSAMSIIEDYLRMLKA

SEQ ID NO: 60821 - protein, 471 aa, Pseudomonas fluorescens PfO-1
MTPDKKVKILATLGPAVDGIEDIRELVEAGVNIFRLNFSHGDHADHAKRYQWIREVERQLNYPLGILMDLQGPKLRVGKFADGKVQLHRGQAFRLDLDATPGDERRVNLPHPEIIAALEAGMDLLLDDGKLRLRVVTKYSDAIDTTVLNGGELSDRKGVNVPQAVLDLSPLTTKDRRDLSFGLELGVDWVALSFVQRPQDILEARELIGDKAFLMAKIEKPSAVEQLREIAELSDAIMVARGDLGVEVPAESVPQIQKNIITTCRHLGKPVVVATQMLESMRFSPAPTRAEVTDVANAVAEGADAVMLSAETASGEYPLEAVQMMSKIIRQVENGPDYQTQLDVSRPKAEATVSDAISCAIRRISNVLPVAVLVNYSESGASSLRAARERPKAPILNLTPNLQTARRLSVAWGIHSVVNDRLRQVDEVCSTALEIAQAQGMAERGDTLLITAGVPFGQPGSTNSLRIETLI

SEQ ID NO: 60822 - protein, 475 aa, Blastopirellula marina DSM 3645
MCRYAYDFIYFTSDAELVGGTRVVVHRKAIDVEVALASAVRRKHEAELGLASHDLRQIVPGEKPKKKFLRKVRDELRRAKRKLKGYWSSFRIFRAPLRRANLEAGNDINRTGEPTPVQLSSMDQRLTALQETAAVISSEMTSVTQPLKYMTNDFKRESGELLSAAQQLSSMAKQLESLEDRMCSEIMSRLQRIEESLHNISIYSLISARRVAIPGDEGEVMIRSEAGYVIVPSCEHAVMAHLIETGDLEVGTRLLLQRVLKPGDTFVDVGCHIGMHTLAAAQILRGNGRIFSFEPSAKNHLFLQKSLILNGCQGIVTTFNCAVSNQAGEQPLYLGKISTHQSLFPLSPDEAKGDEFEVVKTIRLDEAVPPDEKVRLIKIDAEGAELQVLEGAKSIVQKNPGIALIVEFGACHLRRLGVEPSDWLRPFADLGLVYRVVDEKSGKLEEWDFDRLTAVDSVNLFFAYPESDVWAVANA

SEQ ID NO: 60823 - protein, 300 aa, Oryza sativa Japonica Group
MGGGVMRTAAAKVGIAGGAAAAAAAAGGGRFRHVAPAFATAASAEAAAPTLVSAAGGGGGGEVPAVAASGAQWASSWEVDDWEFADWRDVAAAEPEVTAAGKPRLVFAPPSREEAEEATTELRDAIDRVYFSEAPIEVVKEQDKDLSKLGADAIIPAMPGHVMQAFTLLKSSPEAQGVVASLASDKNVWDAVLKNEKVMEFYKTHQQSLVYTFPEGTASVVSPEKLADASSENSSSGEKPESSPFADFMDNARKTVIDIVNNITNFFQDMFRKPNEAEILGGSFMALAIAVILLIMFKKA

SEQ ID NO: 60824 - protein, 563 aa, Vitis vinifera
MKLRVRSLESKETLKIQVPDPCSLQHFIHLLSLAISSSSSSSSSIIYLSLNRKDELQVSSSLDTLQSLGVTSGDLIFYSFNPTAFSRQTHAPPIPETLVNEGTPIPSQTLVPSQALGPNSGETLIQSQTLDPNSGEAQTLPMTKRVMEETPIPSETLVSNSERKETLLESQTLAPLAQANPHEPKEYGSLVSDSKKNETQEFSGATSMDVEGGVAAADEDDEPIVVKKSFSEPCFLRKVLREEVGDDGNEHKLLVIAVHAVMLESGFVGFDSVSGMRVDRFHLSEEYPFAAISMSLWYTLPELLDHGCDDSPAIQSVALKFQHLGQFINIYGSLSGNRSTVHWVSLDEYRFAPTLDLMWTHSDSAEEKDRGSSNSYPENEVFEFWKIVKDGLALPLLTDLCEKGGLLPPPCLMRLPTELKLKILELLPGVDLGKVGCVCSELMYLSSNNDLWKQKFTEEFGNVRVGQGFSLWKDKFATWWENRKKRKRVSGMCTWFPSLEAPSYFPIRRDPNPFAIPPTIGGDYDHFPALGIPSPFGQPGRRYHRFLAPRNTIPRCNLGGFIG

SEQ ID NO: 60825 - protein, 404 aa, Mycobacterium sp. JLS
MRELPHVLGIVLAGGEGKRLYPLTADRAKPAVPFGGAYRLIDFVLSNLVNARYLRICVLTQYKSHSLDRHISQNWRLSGLAGEYITPVPAQQRLGPRWYTGSADAIYQSMNLIYDEDPDYIVVFGADHVYRMDPEQMVQFHIESGAGATVAGIRVPRAEASAFGVIDADESGRIRSFVEKPADPPGTPDNPDEAFVSMGNYIFTTKVLIDAIRADADDDDSDHDMGGDIIPRLVGDGMAAVYDFSNNEVPGATERDHGYWRDVGTLDAFYDAHMDLVSVHPIFNLYNKRWPIRGESENLAPAKFVNGGSAQESVVGAGSIISAASVRNSVLSSNVYIDDGAIVEGSVIMPGTRIGRGAVVRHAILDKNVVVGPGEMVGVDLEKDRERFSVSAGGVVAVGKGIWI

SEQ ID NO: 60826 - protein, 255 aa, Erwinia carotovora subsp. atroseptica SCRI1043
MRHPLVMGNWKLNGSTNLVNELIAGLRKELSTVDGCGVAIAPPAIYLDQANHQLAGSRIALGAQNVDVNLSGAFTGETSAEMLKDIGAKYIIIGHSERRTYHKESDEFIAKKFGVLKDAGLIPVLCIGETEAENEAGQTEAVCARQLDAVLNTLGAKAFENTVVAYEPVWAIGTGKSATPAQAQAVHKFIRDHIAKQDAAVAEQVIIQYGGSVNAANAAELFTQPDIDGALVGGASLKADAFAVIVKAAADAKRG

SEQ ID NO: 60827 - protein, 345 aa, Vitis vinifera
MAITASVSFLSPSPSRLFCLQNHNPLSQPLFSLPFHSHAFLTFASPQKRLKPTAIPKNITPSAQASNDSAPMLPPYNVLITGSTKGIGFALAREFLKAGDNVIISSRSAERVESSVESLRREFGKHHVWGTTCDVRKGEDVKDLVAFAQENLKYIDIWINNAGSNAYSYKPLAEASDEDLIEVVTTNTLGLMICCREAIKMMLNQPQGGHIFNIDGAGSDGRPTPRFAAYGATKRSVVHLTKSLQAELQMQDVKNVVVHNLSPGMVTTDLLMSGATTKQAKFFINVLAEPAEVVAEYLVPNIRSIPVNGSTKPTYIRFLTGLKAYSQIFSRFAFGARRNRYLLED

SEQ ID NO: 60828 - protein, 368 aa, Erwinia carotovora subsp. atroseptica SCRI1043
MMSQLAAPHVTTPHQDGFAMPAEWAPHDAVWMIWPYRTDNWREQGVPAQKTFARVAEAIAQNTPVIMGVPARYMADAQKVMPVNVTLVEMESDDAWMRDTGPTIVLNQAGERRGIDWQFNAWGGELGGLYEDWRQDEKVAAQVLDYHQAAGYAAPLILEGGSIHVDGEGTLLTTAECLLNPNRNPHLSKAEIEQLMRDYLSISTIIWLEEGVYNDETDGHIDNMCCFVRPGEVALHWTDDENDPQYARSVAAYEVLSAARDAQGRELKIWKLPAPGPLHATKEEAQGVDSGDAVERLAGSRLAGSYVNFLISNQQIIFPLLDEKTDDVARDLLQQMFPDYLISGVPAREILLGGGNIHCITQQIPTAK

SEQ ID NO: 60829 - protein, 899 aa, Schizosaccharomyces pombe
MNCEMVTSPESVNLGDSNRAVSPFCLPDCSENAVAQTRSKTLDNAALDLPYVGNRKKSEQDFFKMLSSRDRDAHSTLRKRSNSLSSFLSTKSTSASENKFHGGLNWLSLKLNLLLRLQGRMNSARTNTSMNPYSCDSNENLSTLSSVNQNFNSRQLLATIVPESIQNGCSLLRITKKKVRQRKVSLDPISGYLMLDKNTGKAYKKLCVDDIKEIRQGRDARNYREQYKISSENEKRWFTIIYCADNKLKAMHMISPTLDAHNQWIMALEGLKTYRLNEFIIGLNLVCHQGEKMIDYSENLNPWEKLEKEQSAQLDLGDVHRMCQMLHLNASMEFLEETFQKADADHSGKLSFEEFQHFVSLLKTRSEIVDIFKEYTSGSDKMSLEQFRHFLSTSQKARLDSDSIRTLYVSFCSNDDSKMGLIEFTSFLLSPHNSPVVPVIQDMSRPLNEYLISSSHNTYLLGKQFGGESSIEGYIRSLQAGCKCIEIDCWDGPNGPVVCHGHTFTSMIKFNDVIDAIRKYAFVVSPYPLFISLEIHCCPDQQRQMVSYMKQAFGDTLVMKPVTANESVLPSPEDLLNKILLKVKCSATPLHQFSTDILKVGITDSSTDTTESSELENSELTGLRKGKRRMKNIIVQELQQLAPYARSLKFRNFSLPESKTYSHIFSFSERTIKKHGKAMVPRLSKHNLRYLCRVYPGPLRVGSTNFNPQVYWRLGVQMVALNWQTYDTGLQINDALFIADPPTGYLLKPPCQRIIGTTVGEEGLPRKIKLTIDVISGQQLRRARELSNSETLSPYVEIQVHSMEESPFRWCSKVVHENGFRPFWGETMVYESIISDDFYSMIRFLVHHRGSNGNDSIFANFTCPIDRLQQGYRHIRLLDMQGENLLFSSLFLKIKKEDI

SEQ ID NO: 60830 - protein, 714 aa, Shigella flexneri 2a str. 301
MEMASAFTLNVRLDNIAIITIDVPDEKMNTLKAEFASQVRAIIKQLRENKELRGVVFISAKPDNFIAGADINMIGNCKTAQEAEALARQGQQLMAEIHALPIPVIAAIHGACLGGGLELALACHGRVCTDDPKTVLGLPEVQLGLLPGSGGTQRLPRLIGVSTALEMILTGKQLRAKQALKLGLVDDVVPHSILLEAAVELAKKDRPSSRPLPVRERILAGPLGRALLFKMVGKKTEHKTQGNYPATERILEVVETGLAQGTSSGYDAEARAFGELAMTPQSQALRSIFFASTDVKKDPGSDAPPAPLNSVGILGGGLMGGGIAYVTACKAGLPVRIKDINPQGINHALKYSWDQLEGKVRRRHLKASERDKQLALISGTTDYRGFAHRDLIIEAVFENLELKQQMVAEVEQNCAAHTIFASNTSSLPIGDIAAHAARPEQVIGLHFFSPVEKMPLVEIIPHAGTSAQTIATTVKLAKKQGKTPIVVRDKAGFYVNRILAPYINEAIRMLTEGERVEHIDAALVKFGFPVGPIQLLDEVGIDTGTKIIPVLEAAYGERFSAPANVVSSILNDDRKGRKNGRGFYLYGQKGRKSKKQVDPAIYPLIGAQGQGRLSAPQVAERCVMLMLNEAVRCVDEQVIRSVRDGDIGAVFGIGFPPFLGGPFRYIDSLGAGEVVAIMQRLATQYGSRFTPCERLVEMGARGESFWKTTATDLQ

SEQ ID NO: 60831 - protein, 432 aa, Treponema pallidum subsp. pallidum str. Nichols [sequence omitted]

SEQ ID NO: 60832 - protein, 186 aa, Arabidopsis thaliana
MTPSPPPITYISIPLPTNDVVSRSIHNLTTAISSHRPWSELIFSGDFSLPESFSSLLLRSKTNFNYFFVNYTIIVSTCAAFALITASPVALIVVGAIIALWLIFHFFREDPLILWSFQVGDRTVLLFLVLASVWAIWFTNSAVNLAVGVSVGLLLCIIHAVFRNSDELFLEEDDAINGGLIGSNLR

SEQ ID NO: 60833 - protein, 490 aa, Bouvardia glaberrima
  misc_feature (490)..(490): Xaa can be any naturally occurring amino acid
SGVSALDKKNLGRIVQIIGPVLDVAFPPGKMPNIYDALVVKGKDTVGQPINVTCEVQQLLGNNRVRAVAMSATDGLTRGMEVIGTGAPLSVPVGGATLGRIFNVLGEPVDNLGPVDTRTTAPIHRSAPAFIQLDTKLSIFETGIKVVDLLAPYRRGGKIGLFGGAGVGKTVLIMELINNIAKAHGGVSVFGGVGERTREGNDLYMEMKESGVINEENIAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQKVKQTLQRYKELQDIIAILGLDELSEEDRLIVARARKIERFLSQPFFVAEVFTGSPGKYVGLAETIRGFQLILSGELDGLPEQAFYLVGNIDEATAKAMKLEMESNLKKX

SEQ ID NO: 60834 - protein, 383 aa, Zea mays
MAEDRSPKPIHCKAAVCRAAGEPLTIEEIVVDPPKAYEIRIRVVCTSLCHTDITFWKAKVAPVFPRILGHEAYGVVESVGEHVEGFAAGDTVVPTFLGQCERCASCASEHSNVCDAVPFVIGPGMRRDGTTRFRDARGSPLHDLLAVSSFSEYTVVDVNQVVKVDPAVPPKLACLLSCGAGTGVGAAWRSAKVEPGSTVAIFGLGSVGLAVVQGAKMCGASKIIGVDLNPDKEEVGRSFGVTDFVNPSQLDKRSVVEVIVEMTGGGVDYSFECIGVPSVMTDAFRCTKMGKGKTIVLGLGRDSDEVCLPSLELLFGRCVMGSLFGGLKPKTHIPVLAKKCMDKELQLDALVTHELGLQDINKAFDLLLQGKSLRCILWMDKDK

SEQ ID NO: 60835 - protein, 195 aa, Shigella flexneri
RADERPGKINLGIGVYKDETGKTPVLTSVKKAEQYLLENETTKNYLGIDGIPEFGRCTQELLFGKGSALINDKRARMAQTPGGTGALRVAADFLAKNTSVKRVWVSNPSWPNHKSVFNSAGLEVREYAYYDAENHTLDFDALINSLNEAQAGDVVLFHGCCHNPTGIDPTLEQWQTLAQLSVEKGWLPLFDFAYQ

SEQ ID NO: 60836 - protein, 336 aa, Myxococcus xanthus DK 1622
MATRIAINGFGRIGRCILRAVLSRKEDLEIVAINDLDKPAALAHLFKYDSVHRTWPGEVKATEKGIVVDGKEITVTAEKDPTALPWKSLNVDVVLECTGRFTARDAAEKHLKAGAKKVIISAPAKGPDITIAYGINHNEYDPAKHHVISNASCTTNCLAPIAKVLVDNFGIEKGLMTTVHSYTNDQRILDLTHEDMRRARAAALSMIPTSTGAAKAIGEVIPQLKGKMHGLAVRVPTPNVSLVDLTVNTEKKVTAEAVIEAFRKAAEGPLKGVLEFSDAQTVSVDYNGNPHSAIFDSTNCFVMGDNLLKVMAWYDNEWGFSNRMVDTAKFLVSKGV

SEQ ID NO: 60837 - protein, 280 aa, Picea sitchensis
MAKESETDMEPPAKDYTDPPPAPFFHFREFSLWSFYRALIAEFIATLLFLYITVATVIGHKRTQANCGSVGVLGIAWAFGGMIFVLVYCTAGISGGHINPAVTFGLFLARKVSLPRAVLYMIAQCLGAICGVGLVKAFQKSYYDKYGGGANVVAYGYTKGVGLAAEIIGTFILVYTVFSATDPKRSARDSHVPVLAPLPIGFAVFIVHLGTIPITGTGINPARSFGAAVIYGHQKAWDDQWIFWVGPFIGAAIASAYHQYILRAGAMKALGSFRSVPSMN

SEQ ID NO: 60838 - protein, 399 aa, Pyrobaculum aerophilum str. IM2
MKTKVQVAIIGKPNAGKSTFFAAATLKDVKISPTPFTTIDPNIGVGYVRIDDCPCKSVACNPKSYVVVEGVCYAPVELIDVAGLVPGAWQGRGLGNQFLDHLRRAPVLIHVVDASGSTDEEGRLVKPGSHDPLKDVEFLEREVDMWIASIIKRDWDKVVRFVEFSKRDIVEVLLEKLAGLGMGRVHVEKALEVAGLAKRPPSKWGEEDFYKFSHSVRSLSKPIVIAANKIDLPEGEEGYKRLREAYPDRIIIPTSAEAELALRRAASKGLIKYKPGDDKFEITGELTAQQRAVLDKIAEVMKKWGGTGVVQAINAAVFKALRYVAVYPVEDERRLSDKNGNVLPDILLVPHTYTARDVAYTIHTELGDRFITAIDVRSGRRLASDEPVTHGLVLKIVAR

SEQ ID NO: 60839 - protein, 953 aa, Oryza sativa Indica Group
MARRLRWHDLVGLGLGGMVGAGVFVTTGRATRLYAGPGVVVSYAIAGLCALLSAFCYTEFAVDMPVAGGAFSYLRVTFGELAAFLTGANLIMEYVFSNAAVARSFTAYLGTAVGVDAPSKWRIAVPGLPKGFNEVDLIAVGVILLISVCICYSTKESSVVNMVLTAVHVAFILFIIVMGFWRGDTRNLTRPADPAHNPGGFFPHGAAGVFNGAAMVYLSYIGYDAVSTMAEEVERPSRDIPVGVSGSVMLVTLLYCLMAASMSMLLPYDAIDTEAPFSGAFKGSSGWGWVSNVIGAGASLGILTSLMVAMLGQARYLCVIGRSGVMPAWLAKVHPCTATPVNASAFLGVFTAALALFTELDVLLNLVSIGTLFVFYMVANAVVYRRYVAADDDDADHRRAWPTLVFLAAFSLVALCFTLLWQFAPAGRARTGLLAACGAAAVATVGAFRALVAEARRPELWGVPAMPWVPAASVFLNVFLLGSLDRPSYVRFGFFTAAAVLVYVLYSVHASYDAEEGGGAGAGAAALDGAKVQDEAADFKISYSICFMPNLNCIFDKIYIIYVLSTKESSVVNMVLTVVHVAFILFIIVMGFWRGDTRNLTRPVDLAHNPGGFFPHGAAGVFNGAAMVYLSYIGYDAVSTMAEEVERPSRDIPIGVSGSVVLVTLLYCLMAASMSMLLPYDAIDTEAPFSGAFKGSSGWGWVSNVIGAGASLGILTSLMVAMLGQARYLCVIGRSGVMPAWLAKVHPCTATPVNASAFLGVFTAALALFTELDVLLNLVSIGTLFVFYMVANAVVYRRYVAADDDDADHRRAWPTLVFLAAFSLVALCFTLLWQFAPAGRARTGLLAACGAAAVATVGAFRALVAEARRPELWGVPAMPWVPAASVFLNVFLLGSLDRPSYVRFGFFTAAAVLVYVLYSVHASYDAEEGGGAGAGAAALDGAKVQDEAADFKV

SEQ ID NO: 60840 - protein, 466 aa, Picea sitchensis
MESVSWPYFDPEYENLERRINPPSVSIDNDTCPDCTLIKVDSANKHGILLEVVQLLTDLDLTISKAYISSDGGWFMDVFHVTDQLGDKLTDESIIEYIQQSLGAKRVISSREVKTCLGRIVGVQSIGEYTAIELTGTDRPGLLSEISAVLTSFSCNVVAAESWTHNMRVACVVYVTDESSNRPIEDEVRLSTIKGQLSNVLKGNDDSTKGVKTDFSMGLTHRERRLHQLMFADRDYECSSDSSNPSLLDENMKPVITVENCNEKGYSVVNIQCRDRPKLLFDTVCTLTDMQYVVFHASITCNLPYALQEYYIRHMDGCTLDTEGEKHRVIKCLEAAIGRRASEGLSLELSASDRIGLLSDVTRMFRENGLSVTRADVTTRGDKAINVFYVRDASSGNLAINIDMKVVEAMRREIGHTMFLQVKNMPGDIAYNSLPIDSRSKFRFSFASLFKAQLDRISYNFRMIKF

SEQ ID NO: 60841 - protein, 223 aa, Mycobacterium tuberculosis H37Rv
MCHGGTWAGDYVLNVIATGLSLKARGKRRRQRWVDDGRVLALGESRRSSAISVADVVASLTRDVADFPVPGVEFKDLTPLFADRRGLAAVTEALADRASGADLVAGVDARGFLVAAAVATRLEVGVLAVRKGGKLPRPVLSEEYYRAYGAATLEILAEGIEVAGRRVVIIDDVLATGGTIGATRRLLERGGANVAGAAVVVELAGLSGRAALAPLPVHSLSRL

SEQ ID NO: 60842 - protein, 528 aa, Vibrio cholerae O1 biovar eltor str. N16961
MDLILLSAAFLAGFIALKCHLPPLVGFLIAGFALNAYGFTSNDTLSLLADLGVTLLLFTIGLKLEVKTLLAKEIWAGSTIHNLLSTALFTLLLLIFKQLGLDSLADLSFDKLILIGFALSFSSTVFAVKSLQEKGEMNATYGTLAIGILVMQDIFAVVFLTASTGKLPEWYAIGLFVLPLLRPLFYELLDWVGHGEMLVLFGIFFALVVGAGSFQLVGMKPDLGALILGMMLASHHKASELSKALFNLKELFLVCFFLNIGLSAHPTTTGIMLALLLLLLLPIKGVLYFWVIHQFHFRVRTSLLASLSLFNFSEFGLIVGGLAFKMGWINSDILVALAVSVPLSFILAAPIERKGHAIYQRSAKWLKEQAAESLHTRDRLIDPGEAQVLILGMGRIGRGAYEELTSRHGEICLGVEIREEAANSHREEGRNVISGDATDPDFWERIFDTGKVKLVLLAMPHHQANQIALEQLQKRHYQGQIAAIAEYPDQIESLLEHGAHAAFNIYSEAGTGFARHVCEQLKPNFTRR

SEQ ID NO: 60843 - protein, 738 aa, Pyrobaculum aerophilum str. IM2
MSTEVILKVAEARSRDVGRSIVRLPVRIMKKLGIEPGDYVEIIGRKSAYAQVWPAYPEDEDKEVIRMDGIIRQNAGVGIGDTVKVRKAVLKPAQRVVLTPTEPVRVDSEYLKKQILLGKPVARGQAIDVPFYGGAIRFVVVQVQPGPAAYVSIDTEVTVREEPVKEAELTIPRVTWEDIGDLEDAKQKIRELVELPLRHPELFKHLGIEPPKGILLIGPPGTGKTLLAKAVANEANAYFVAINGPEIMSKYYGESEARLREIFEEAKKNAPAIIFIDEIDAIAPKREEVTGEVEKRVVAQLLTLMDGLQERGQVIVIGATNRPDAVDPALRRPGRFDREIHIPMPDKRARREILAVHTRNMPLCTKADVETKICNPGDEVDLDRIAEMTHGYTGADLAALAKEAAMTALRKAMNKGMINIEQDIIPQEVLSKLKVGMSDFLEAMKFVHPTVLREVIIEVPEVHWDDIGGYDTIKQELREIVEWPMKYKHYFDELGVEPPKGILLFGPPGVGKTLFAKAVATESGANFIAVRGPELLSKWVGESEKAIREVFKKARMAAPCVIFFDEIDSIAPARGSRLGDSGVTDRMVNQLLAEMDGIGTLKNVVVMAATNRPDILDPALLRPGRFDRVIYVPPPDLKARIEIFKVHTKRVKLADDVNLEELAKRTEGYTGADIAALVREAAMLALRETIREKTVKAKPVSMKHFEEALKRIPPSLTPEDIRRYEEIAKRLRRAIAGL

SEQ ID NO: 60844 - protein, 389 aa, Desulfovibrio vulgaris subsp. vulgaris str. Hildenborough
MLNKPRLLTPGPTPLPERVRLVMAQDMIHHRKPAFKKLMGEVQEKLRILFGTSQPVLPLACSGSGAMTAAVHGLFVPGEKVIVVEGGKFGQRWREIASLRGLEVVSIVVEWGRAVSLAEVEAALDAHPDAKGVLMQLSETSTGVLHPVRGIAAVTRKRDVLLVADGISAVGISPCPMDEWGVDCLLTGSQKGLMLPPGLALIALSERAWRKADTVAPSCFYFNLPGERANCEKGQTLFTTPVSLIVGLGESLDMFLEAGLETVYRKQWALTMLARAGTAALGLAPLAPERFTWGLTSVMLPAGVDGTRLLQVAADNHGVVMAGGQDHLKGRILRIGHMGWVDWADIVAGLHAVASGLRTCGAYVGARDYIETGLAAYEAALQVAPGTPV

SEQ ID NO: 60845 - protein, 154 aa, Caulobacter crescentus CB15
MVEDKIRLLIVEGRSHSGISDELLRGATQAIEARGADYDVITVSNALQIPTVIAMAEDAGHRPVGVRYDGYVALGVVIRGETYHFELVANETARGLQDLGVAKRLPIGFGVLAVDEEAQALSRARVSEGDRGGAAAKACLETIGLKRQLLGQAR

SEQ ID NO: 60846 - protein, 449 aa, Mycobacterium tuberculosis H37Rv
MASLQQSRRLVTEIPGPASQALTHRRAAAVSSGVGVTLPVFVARAGGGIVEDVDGNRLIDLGSGIAVTTIGNSSPRVVDAVRTQVAEFTHTCFMVTPYEGYVAVAEQLNRITPGSGPKRSVLFNSGAEAVENAVKIARSYTGKPAVVAFDHAYHGRTNLTMALTAKSMPYKSGFGPFAPEIYRAPLSYPYRDGLLDKQLATNGELAAARAIGVIDKQVGANNLAALVIEPIQGEGGFIVPAEGFLPALLDWCRKNHVVFIADEVQTGFARTGAMFACEHEGPDGLEPDLICTAKGIADGLPLSAVTGRAEIMNAPHVGGLGGTFGGNPVACAAALATIATIESDGLIERARQIERLVTDRLTTLQAVDDRIGDVRGRGAMIAVELVKSGTTEPDAGLTERLATAAHAAGVIILTCGMFGNIIRLLPPLTIGDELLSEGLDIVCAILADL

SEQ ID NO: 60847 - protein, 406 aa, Nicotiana plumbaginifolia
MMQQQRLKQQQQQALMQQSLYHPGLLAPPQIEPILSGNLPPGFDSSTCRSVYVGNIHPQVTEPLLQEVFASTGPLEGCKLIRKDKSSYGFVDYFDRRSAALAIVTLNGRHLFGQPIKVNWAYASAQREDTSNHYNIFVGDLSPEVTDATLFACFSVYTSCSDARVMWDQKTGRSRGFGFVSFRNQQEAQSAINDLNGKWLGSRQIRCNWAAKGAGAVGEQNSDAKSVVELTSGTSDDGQEKVVNEDAPENNPQYTTVYVGNLAPEVTSVDLHRHFHALGAGVIEDVRIQRDKGFGFVRYSSHAEAARAIQLGNARLLFGKPVKCSWGSKPTPPGSSSNPLPPPAIGQIPGLSAMDLAAYQRQLALAKMAGAQAFMQPQGQRIGAPGQGIYDGGYGGIASTQPPMYF

SEQ ID NO: 60848 - protein, 287 aa, Zea mays
MAKDVEQVTEQGEYSAKDYHDPPPAPLIDPDELTKWSLYRAAIAEFIATLLFLYITVLTIIGYKRQSDTKIPGNTECDGVGILGIAWAFGGMIFILVYCTAGISGGHINPAVTFGLFLGRKVSLVRALLYMIAQCAGAICGAGLAKGFQKSFYNRYGGGVNTVSDGYNKGTALGAEIIGTFVLVYTVFSATDPKRNARDSHVPVLAPLPIGFAVFMVHLATIPVTGTGINPARSFGPAVIFNNDKAWDDQWIYWVGPFVGAAVAAIYHQYILRGSAIKALGSFRSNA

SEQ ID NO: 60849 - protein, 300 aa, Ralstonia eutropha JMP134
MAYKTIEDTIGNTPLVRLQRIPGAANDARGNVILGKLEGNNPAGSVKDRPAVSMIARAEARGRIKPGDTLIEATSGNTGIALAMAAAIRGYKMVLIMPEDLSLERRQSMAAYGAEIILTPVKGGMEYARDLADSMERDGKGVILDQFGNPDNPLAHYETTGPEIWRDTEGRITHFVSAMGTTGTITGVSRYLKEQNPAIEIVGAQPAEGSRIPGIRKWPEAYLPKIYDAKYVDRTEPVSQADAEHMARRMASEEGIFSGISAAGALCVALRVAEEVENATIVFVVCDRGDRYLSTGVFPA

SEQ ID NO: 60850 - protein, 630 aa, Treponema pallidum subsp. pallidum str. Nichols
MDLSLLRSLTGPHDLKSLSPEQVRALAQEVRQEILRVVSANGGHLASNLGVVELTIALHRVFSCPHDVVVWDVGHQCYAHKLLTGRAGRFHTLRQKDGISGFPRRDESPYDAFGTGHSSTALSAASGILSALRYRGKSGKVVAVVGDGALTAGLAFEALLNVGRSCSDLIVILNDNKMSISPNTGSFSRYLSTLTVKGPYQKLKTRLRRALQTVPLVGRPACRALSRLKRSARTLLYQSNIFADFGFEYVGPLNGHHIEDLERVLNDAKKLTRPTLLHVQTVKGKGYPFAEQNPTDFHGVGPFNLAEGIVEKKDALTFTEAFSHTLLNAARTDDRVVAITAAMTGGTGLGLFSHIYPERFFDVGIAEQHAVTFAAGLACAGVKPVVAVYSTFLQRAVDQVIHDVAVQNLPVIFALDRAGAVPHDGETHQGLFDLSILRAVPNINILCPASAHELSLLFGWALAQDTPVAIRYPKALCPPEEDGFSTPVHTGRGVLITRENECNVLLVCTGGVFPEVTAAANTLARKGIFADIYNVRFVKPVDEDYFLDLVGRYRSVLFVEDGVKIGGIAEALQALLNTRHPAPCSDVLAFQDMFYPHGSRAQVLAAAGLSAPHIAARAEWLLAHSVGQIR

SEQ ID NO: 60851 - protein, 170 aa, Clostridium difficile 630
MDLKNFIRNIDDFPKPGIDFKDVTTLFKDGDAFKYAVDSIVEELKDKDVDLVIGPEARGFLMGTPVAYALGVGFVPIRKPGKLPGEVESYEYGLEYGTDTLEIHKDAIKKGQKVAIVDDLLATGGTMEAAAKLVEKLGGEVVSMQFLIELKFLNGREKLSNYDVNSLIKY

SEQ ID NO: 60852 - protein, 430 aa, Chromobacterium violaceum ATCC 12472
MLNRIADKSAVIGIVGLGYVGLPLMLRFAEVGYKVLGFDIDQSKVDALMAGNSYIEHISADSIATALTRGFEATTDFSRAGEADTLILCVPTPLNKYREPDLSFVLNTIDSLVPYLRKGHLVSLESTTYPGTTDEELLPRMESRGLKVGDDAFLVFSPEREDPGNPDFTTRTIPKVCGGVTEACQEIGVALYGAVIDKVVPVSSTRAAEMTKLLENIHRAVNIGLVNEMKIVADKMGIDIHEVIRAAATKPFGFVPYYPGPGLGGHCIPIDPFYLTWKAREYGVNTRFIELAGEVNSNMPDYVVSKVASALNLRKKSINGSRVLVLGIAYKKNVDDMRESPSVFLMEKLRDLGAEVAYSDPHVPVFPKMREHKFDLKSVPLTAESIAGYDCVLLATDHDKFDYELIKAKAQLVVDSRGKYLEPAEHIVKA

SEQ ID NO: 60853 - protein, 165 aa, Clostridium difficile 630
MIRDYLEDKPLIDESVFVAKSADVIGNVKIGKDSSIWYNAVVRGDEGPITIGENTNIQDCSIVHGDTETIIGNNVTVGHRSIVHGCKISDNVLIGMGSIILDNAEIGEYTLIGAGTLITSNKKFPPGVLIMGSPGKVVRELTEEDKKYIDESYEWYLEAAQNQKY

SEQ ID NO: 60854 - protein, 163 aa, Zea mays
  misc_feature (43)..(43): Xaa can be any naturally occurring amino acid
PTTPGGDGGYTPTPQVPLPPISTSPPFSPLTPTPTTPTPYDPXTPPFTGPCTYWMMHPGVIWGLFGFWCPLVRLFGPSAAVPFGHDLTVPEALANTREDGMGALFREGTASLLNSMVNNRFPFTTQEVKDAFGAALNSGDDGAAAAQAHLFKKANEGHVIRQN

SEQ ID NO: 60855 - protein, 516 aa, Coprinopsis cinerea okayama7#130
MQLLAFVLAALPLARAAIGPVGNLVIANANVSPDGFVRSAVLAGATGTSLEHPGPVIVGQKGDTFHINVIDDLTDPTMLRTTSIHWHGFLQEGTAWADGPAGVTQCPIAPGHSFLYKFQAKNQAGTFWYHSHHMSQYCDGLRGVMVVYDPLDPHRHLYDVDNENTIITLADWYHDPAPSAGLVPTPWSTLINGKGRYPGGPVVPLAVIHVSRGKRYRFRLVSLSCDPNYVFSIDGHTMTVIEVDGVNHEPLVVDHIQIFAGQRYSFVLNANRPVNNYWVRANPNLCSVGFGGGINSAILRYVGAPAVDPTTSQLPFSNPLLETNLHPLVNPAAPGGPSPGDVDVAINLDILFDVSILKFTVNGATFDEPPVPVLLQILSGAHTASSLLPSGSVYTLPPNKVIELTIPGGGIGAPHPIHLHGHTFKVVRSAGSSTYNFVNPVERDVVNVGQAGDNVTIRFVTDNAGPWILHCHIDWHLVLGLSVVFAEDVPTIDSSVQPPAWHDLCPIYDALPPGTR

SEQ ID NO: 60856 - protein, 184 aa, Brassica napus
MMKMRIGVLAFMVALSAVEFGLASPNTVPAFLWSPHLQAANGELDEAVNYQVMSAKDLVGSVFTHGGWSNFLCSEKKVEQPVDVALVFIGRELQSSDVSSKRNSDPSLVNTLNNLFTASNFSLAFPYIAAPEEERMESLLLSGLKQACPHNVGVSNIVFSDSCLVEDGTIQKLSDLQSFKDHLL

SEQ ID NO: 60857 - protein, 183 aa, Escherichia coli
LGIGVYKDETGKTPVLTSVKKAEQYLLENETTKNYLGIDGIPEFGRCTQELLFGKGSALINDKRARTAQTPGGTGALRVAADFLAKNTSVKRVWVSNPSWPNHKSVFNSAGLEVREYAYYDAENHTLDFDALINSLNEAQAGDVVLFHGCCHNPTGIDPTLEQWQTLAQLSVEKGWLPLFDFA

SEQ ID NO: 60858 - protein, 659 aa, Arabidopsis thaliana
MDSEGVLLRLIHEHSMIPCNHLRKGDCCGRFEAISDGYYCKTCDFFVHKKCVDEASESIEHPSHPGHTLQLLSKQKYRYCNLCGRDIKDLCYHFGNFDVDLYCAKYPPPEVIESSETPCHKRTLLKEKIEFHCDAKCEEIGYGFPYKCLECGLTFHIDCVLHPSGVKHLPEVIHPLDVKNHSCHPLHPLKLVLTGQLPDYSDGKCRLCEKKIDSPLFYHCSPCNFTLDMRCALNPPSISFEDSKTHDHQLTLLPRLDSFTCNACGLKGDRSPYICVQCNFIIHQECLTLPRLININRHDHRVARTNLLGLVYSVCGVCRQKVDWTWGGYSCQRCSNYVVHSKCATRKDVWNGKELEGVIEETEDIEPYVVIDDNTIQHFSHEEHYLKLDDNGVLCDENKRCSACTHSVCLESFYGCMDCDFILHQNCAKFPKRKRHVLHNERLTLFTREAGHFWCNVCGRISNGFSYQYGDMKLDVICCSVLEPFVHPSHPDHPLYYISPEMEEVCNGCNMSGTRMLRCIEDGCGFVLCFKCATLPRVLKHRVDDYPLLLCYGEKANGIYWCEICEKKMNPEKWFYTCKDQWASLHTECVVGDFSGLMPGSVVKAETGSYEVVLNKNVSRPFCRQCKSHCMYPIIYKIPETSVSYLCSDICIKRFTKRD

SEQ ID NO: 60859 - protein, 398 aa, Desulfovibrio vulgaris subsp. vulgaris str. Hildenborough
MTPELKKLQLRRGEDRRLRVGHLWVFSNEVDVARTPLKDFAPGEAACVVDAGGRPLGTAYVNPASLICARMVSRKPDAPLGPDLLRRRLTDALALRERLIGVPFYRLCFGEGDFLPGLVVDRYGDVAAAQITTAGMEMHRDDIASVLQDMLSLSALLWRNDTASRELEGLPRVVETAFGAVPETVTVEESGARFTAPLASGQKTGWFYDQRCNRIEAARFAQGARVLDAFCYLGSFGVMAARAGAVAVTFLDASRPALDAALANAAANATCETDAVHGDALDTLATLRDEGRRFEVVCIDPPAFIKRRKDVKQGLAAYQRVNELAIDLVADGGVLVTCSCSQHLDRDALRRVLLHAAGRRRTQAQIVFQGHQGPDHPVHPAMPETDYLKCFIARVSRA

SEQ ID NO: 60860 - protein, 740 aa, Ustilago maydis 521
MAQPAVRQPTVTRSRISRPGGIPASRSGDRIHLTEAASTSHLAKAKSTKLVGPSTAGKLRADSRSMPQRAALSDVSNRAGVARANALADGAVKLAPGHNGLRSQHTKSMTRLRDARSRSTSEQRLSGPTRSVSEQRDCAPAAAESMHVEASQLLPPFQSSASVKVGISDEAGSSRLHEDADIRDLAGSQHSDHVEEDEMSDVASTSSSDDDTAEDIGVDKANWLDSERLDAEGLVSLHPELEEAARRKVALIKSRYQEEVIQPRAARAQAQHAEAVAAGQLSAELAAHEDELIVMGLDPEEVRDTSMVAEYSNEIFSYMARCERETMANPNYMEFQSEIHWHMRATLVDWLLQVHMRYHMLPETLWIAINVVDRFLSVRVVSLAKLQLVGVTAMFIAAKYEEILAPSVKEFVYMTEGGYSQEEILKGERIILSTLDFNISSYCSPYSWVRKISKADDYDIRTRTLSKFLMELALLDHRFLRARPSLVAAVGMFLAKKMLGGEWDDAFVYYSDFTEEQLVPGANLLLERLLDQGFEEQFVYRKYSNKKFLRASVFARDWAFQNHSALLAAAAAAAGSTQAVHSCLVTTTVQHRFREQRTYVQRRRAGASVWRDERKDPRGSTFGSGCGEWKDKDRIEADVKREASRMKLVHAVSDMAKLYLHTHPHHCSHKRVHAWYESVSVMCIHDFRSAQLAWLRLEPVIARCEAQAIHDRACSQSLWPTQRSCLTRNGTHDEKLSCNS

SEQ ID NO: 60861 - protein, 193 aa, Shigella flexneri
ADERPGKINLGIGVYKDETGKTPVLTSVKKAEQYLLENETTKNYLSIDGILEFGRCTQELLFGKGSALINDKRARTAQTPGGTGALRVAADFLAKNTSVKRVWVSNPSWPNHKSVFNSAGLEVREYAYYDAENHTLDFDALINSLNEAQAGDVVLFHGCCHNPTGIDPTLEQWQTLAQLSVEKGWLPLFDFAY

SEQ ID NO: 60862 - protein, 62 aa, Zea mays
MYLDIIWTNGGPTNLGGPERSHTLHTLRAGPGLGHPIEYICLDLEAPNVCKYCGLRYVQIHH

SEQ ID NO: 60863 - protein, 358 aa, Phytolacca americana
MVGEISPSRVETLATSGIQSIPKEYVRPKEELTSIGNVFEEEMKDGGPQVPTIDIRDIASDDREVRDRAILELNRAAMEWGVMHLINHGIPNELIDRVKAVGGAFFELPIEEKEKYANDQATGNVQGYGSKLAENASGQLEWEDYFFHLIFPEDKRDLSIWPTTPSDYICAVSEYAKELRALATKILSALSLALGLEEPRLEKEVGGLEELLLQLKINYYPKCPQPELALGVEAHTDVSALTFILHNMVPGLQLFYEGKWVTAKCVPNSIIMHIGDTIEILSNGKYKSILHRGLVNKEKVRISWAVFCEPPKEKIILKPLTELLTEEEPARFPPRTFAQHIQYKLFRKTQDVQAPVSN

SEQ ID NO: 60864 - protein, 190 aa, Shigella flexneri
ADERPGKINLGIGVYKDETGKTPVLTSVKKAEQYLLENETTKNYLGIDGILEFGRCTQELLFGKGSALINDKRARTAQTPGGTGALRVAADFLAKNTSVKRVWVSNPSWPNHKSVFNSAGLEVREYAYYDAENHTLDFDALINSLNEAQAGDVVLFHGCCHNPTGIDPTLEQWQTLAQLSVEKGWLPLFD

SEQ ID NO: 60865 - protein, 712 aa, Caulobacter crescentus CB15
MSLWLYLAIGAGLLAVLYGAVQTASLMRASAGNARMQEIAAAIQEGAQAYLKRQYTTISIVGVVVIAALAFFFKSWEQPVGFALGAILSGAAGFAGMLISVRANVRTAQASSESLAKGLSMAFTSGAVTGMLVAGFALLGVAGYYYVLLATGHEATGRVVIDSLVALGFGASLISIFARLGGGIFTKGADVGGDLVGKVEAGIPEDDPRNAATIADNVGDNVGDCAGMAADLFETYAVTTVATMVLAAIFFRGTEAVSAMMLLPLAICAVCIVTSIIGAFFVRLGKSQNIMGALYQGLIVTGVLSIPAVWYVIHQLVPTAVEVDGRSYGADALFYCGLAGLVVTAAIVMITEYYTGTGFRPVKSVAQASVSGHGTNVIQGLAMSLESTALPALTIIVGIVVTYNLAGLFGIAIATTTMLSLAGFIVALDAFGPVTDNAGGIAEMAGLPPEVRVTTDALDAVGNTTKAVTKGYAIGSAGLGALVLFAAYTEDLKFFSENAAPGSFFHGMGAVTFDLSNPYVVVGLLFGGLLPFLFGGLSMTAVGRAAESVVAEVRRQFRDNPGIMTGEVKPEYGKAVDILTKAAIREMIVPSLLPVVSPVALFFVIQAIAGKVDAFAALGAMLMGVIVTGLFVAISMTSGGGAWDNAKKVIEEGFTDKNGVLHKKGGETHKAAVTGDTVGDPYKDTSGPAVNPMIKITNIVALLLLAVLAHGV

SEQ ID NO: 60866 - protein, 658 aa, Candida glabrata CBS 138
MFLFRKPSIRSCQRINSLCSLLELQRGYATTTRENTLYPPHADTSSPHKTPVGEAAKEYLKQKKRKLQEKGTPKSTRLTVEGVIECPLESFQLLNSPLFNKGSAFTQEEREAFNLEALLPPQVNTLDEQLERAYKQLCYLKTPLAKNDFMTSLRVQNKVLYFALVRKHIRELVPIIYTPTEGDAIASYSHRFRKPEGVFLDITEPNSVEKRLAVYGEAKDVDYIVVSDSEGILGIGDQGVGGVRIAISKLALMTLCGGIHPGRVLPVCLDVGTNNKKLARDELYMGNKFSRIRGKQYDDFIDSFIQAVKKLYPSAVLHFEDFGVKNARRILDKYRYDLPCFNDDIQGTGAVVTASLLAALKHTDRELKDTKVLVFGAGSAGLGIADQITNHMVTHGLTPEEARSNIYLMDRRGLILESMEENSTVAQHRYAKPDEDWDDIDTTKLFNVVSKMKPTCLVGCSTQAGAFTKEIVQEMYKYNPRPIIFPLSNPTRLHEAVPSDLMEWTNNDALVATGSPFAPVNGYRISENNNCFSFPGIGLGAVLSRATAITDTMISAAVDQLAALSPLKPGDSRPGLLPPLEDITNTSAKLATAVILQSLKEGTARIEDEEVPGSPGEKVTVPRDFDQCLEWVKSQMWEPVYRPMVKVNYDPEVHTNQM

SEQ ID NO: 60867 - protein, 193 aa, Shigella flexneri
ADERPGKINLGIGVYKDETGKTPVLTSVKKAEQYLLENETTKNYLGIDGILEFGRCTQELLFGKGSALINDKRARTAQTPGGTGALRVAADFLAKNTSVKRVWVSNPSWPNHKSVFNSAGLEVREYAYYDAENHTLDFDALINSLNEAQAGDVVLFHGCCHNPTGIDPTLEQWQTLAQLSVEKGWLPLFDFAY

SEQ ID NO: 60868 - protein, 392 aa, Wolbachia endosymbiont of Drosophila simulans
MDHVVNAYNRLDTPIVRGEGAYLFDKDGKKYLDFAAGISTTSLGHCHPYITDKLKEQSSSLWHCSNIFTIPEQERLAERLTTLTFADKVFFCSSGLEATEAAIKFIRRYFYSKGQAKRNRIITIEGGFHGRSIAAISAGGNEKSREGFAPLLSGFDKVPRNDIKALEEKINNEIAAVFLEPIQSEGGVYPLDVEYLQKVREITKAQGIILCFDEVQCGYGRIGSLFHYQNVGIEPDMLTCAKAMGNGFPVAACLVKDYIAEAITPGTHGSTYGGNPLAMTVGNAVLDIMLKEGFFDHVKRISKYLKEKLLLLAKEFPEMILEVRGEGLLMGIELATLVADKIISRSLDKGLIITRVLNNKVVRVTPPLIIEDEHVNAACNMLYDLFFKIKGI

SEQ ID NO: 60869 - protein, 147 aa, Picea sitchensis
MTIDTFIFLPLGYIFIVGNLFYDLQLSEEYLGCPSVNLIPLGIVLFMVGITGNFYHHYLLSKLRKDGQKQYCVPQGGLFGYVVCPHYFFEVIEFLGVAFICQTPFAFCVVAMMFFGLVGRSISTKSWYMKKFEDFPSHRKALIPFLM

SEQ ID NO: 60870 - protein, 226 aa, Picea sitchensis
MVQCLEEIGHVLDHLLPCLGIKSFMQPRRLRNPEKVANETVFSVSEVEALYELFKRISSTVIDDGLINKEEFQLALFKTNKKESLFADRVFDLFDTKHKNALGFEEFARALSVFHPNAPIDEKIDFSFELYDLKQQGFIERQEVKSMVVATLAESGMNLSDDVIENIIDKTFEEADTKHDGKIDKEEWKTLALRHPQLLKNMSLPYLRDITTSFPSFVFYSQVEDA

SEQ ID NO: 60871 - protein, 656 aa, Oryza sativa
MAHHVAPLLLLLTLAAVAAAASEEAAAADTEAAAAVEAGLLVRREAQLARLEELTESLAKSVQALESALARSVEPDPPPPAAAAAAPGDRRAPQGVAVTKRRPYWSERFHFAAAARLGDGAYAAAATALPYEDADGLTKYFAVGDSRGRVFVFSAAGDALLELEPGVSGEPPVTALLAYLSPRRTDCFLFAGHADGSIAAHRLIESSPHGDDWLTLAAASSRLLVRGLDAAPVLHLEAHHAGRARYVLSCDSGGRIRVFTENGTLYGTAIASSTPLAFVKQRLLFLTEAGAASLDLRSMSVRETPCEGLAEALNGSLPKAYSFDPSERFKAYGFTDAGDLVHVLLLGDIASLKCRVRAIKKAEIDNPVAIQTIKGYLLVASQDKILVYNTSTQYYGRVGAPRLLFATSIKDIKSVFAGSGGVMPASPAGKPLVAADREKLVILGLGDGYIAIYRSNFPVYKPESNAVVWSGPALLFLLFLIGIWQVYVKKKDSLGWTPEETFNTSVTAPTGSILNHSTSDRAFADSSTRTGERGYVDGTTRASDRSYVDATTRATDRAYAEATRGVDLRGGALRGAPRRYVSPTRYTGAAGIPYRPVSTEPVLRTTPELKYRGPDGEITLKFMGYIIAMKEGIVELFSYDFHLQRCRKIGQVYNNF

SEQ ID NO: 60872 - protein, 357 aa, Triticum aestivum
MDSFFQRAFGDPMCSEDSNVVQQGIDKCPFLRNINEPTSFSLTSINFPAPATGAKGPIFEDGPNFDTAFRVFHGRDGVVPLSEGAFAHIEKPLPKPTPEFNPLAAKAATISLSGFGGFFSFGDFSNKRNKQNSNKKNPNNLPQNKGQSNNNHEAMSNDWLENGQCPLAKSYRAIGGVVPLVAKLLTPPAGMKLTCPPAIVAARAAISRTAFAKGLRPQPLPTKVVVIALLGMAANVPLGIWREHTTKFSVQWFAAVHAAVPFIGMLRKSILMPKSAMALTIAASILGQTIGSRAERIRLKRAKLAAEGHGHEHATRIEAPVNLKTGSSGAVQLWDPLGLRVKGAVSPALVPTVGAMY

SEQ ID NO: 60873 - protein, 87 aa, Zea mays
MDSFSSSPSSSGPGANPDVVMEQIKTQLAQAYAQEFLETVGNKCFEKCVTKPGSSLSGSESSCISRCVDRYIEATGIVSRALFTSQR

SEQ ID NO: 60874 - protein, 178 aa, Brassica napus
LDITSTRMLGQYGFLSKVLSTFEKMGISVDVVATSEVSVSLTLDPSKFCSKELIQQEINHVVEELEKIATVNLLQHRSIISLIGNFQRSSSFILEKGFRVLRTNGINIQMISQGASKVNISLIVNDDEAEHCVKALHSAFFETGTSKAVPQIGRLATTPLPCRENLLVQPDLRDLQVV

SEQ ID NO: 60875 - protein, 457 aa, Ralstonia eutropha JMP134
MKVTIIGSGYVGLVTGACLAELGNDVFCLDVDEKKIALLNAGGVPIYEPGLQEIIQRNRAAGRLTFSTDVAASVEHADVQFIAVGTPPDEDGSADLKYVLAAARNIGRHMTGFKVVVDKSTVPVGTGDRVAAVIREELAARGLEDLQYSVVSNPEFLKEGAAVEDFMRPDRIVLGCSADAAGRHAQATMRQLYAPFNRNHERTFYMDVRSAEFTKYAANSMLATRISFMNELANLADEVGADIELVRMGIGSDPRIGYSFLYAGAGYGGSCFPKDVQALMRTASDHGKPMRVLEAVEAVNGAQKQVLGDKVLRRFGDDLSGHTFAIWGLAFKPNTDDMREAPSRVLARELVSRGATLRMHDPVSMEEARRVLETDLADIPGGIDRLSFHAAQMETLDGADALVIVTEWKVFRSPDFEQIKRRLKTPVIFDGRNLYEPEAMAQAGIEYHAIGRSAAKR

SEQ ID NO: 60876 - protein, 407 aa, Pseudomonas fluorescens PfO-1
MAIEIKAPTFPESVADGTVATWHKQPGDAVKRDELIVDIETDKVVLEVLATADGVLGAIVKGEGETVLSDEVLGSIVEGGAASAAPAAAAAPAAAAAAPAAADGEDDPIAAPAARKLAEENGINIASVAGTGKGGRVTKEDVVAAVAAKKAAPAAAPAKAAAPAAAAPVFAAGDRIEKRVPMTRVRATVAKRLVEAQSNMAMLTTFNEVDMTEVMALRSKYKDLFEKSHNGVRLGFMSFFVKAATEALKRFPAVNASIDGNDIVYHGYADIGVAVSSDRGLVVPVLRNAEHMSLAEIEGGIATFGKKARDGKLSMDEMTGGTFTITNGGTFGSMMSTPIVNPPQAAILGMHNIIQRPMAINGQVVIRPMMYLALSYDHRLIDGKEAVTFLVTIKNLLEDPARLLLDI

SEQ ID NO: 60877 - protein, 478 aa, Pseudomonas fluorescens PfO-1
MSQKFDVVVIGAGPGGYVAAIKAAQLGLSTACIEKYTDAEGKQALGGTCLNVGCIPSKALLDSSWKYKEAKESFNVHGISTGEVKMDVAAMVGRKAGIVKNLTGGVATLFKANGVTSIQGHGKLLAGKKVEVTKPDGSVEVIEAENVILAPGSRPIDIPPAPVDQKVIVDSTGALEFQSVPKRLGVIGAGVIGLELGSVWSRLGAEVTVLEALDTFLMAADTAVSKEALKTLTKQGLDIKLGARVTGSKVNGDEVVVNYTDANGEQTITFDKLIVAVGRRPVTTDLLAADSGVTLDERGFVHVDDHCATTVPGVYAIGDVVRGMMLAHKASEEGIMVVERIKGHKAQMNYDLIPSVIYTHPEIAWVGKTEQALKAEGVEVNVGTFPFAASGRAMAANDTGGFVKVIADAKTDRVLGVHVIGPSAAELVQQGAIGMEFGTSAEDLGMMVFSHPTLSEALHEAALAVNGGAIHIANRKKR

SEQ ID NO: 60878 - protein, 929 aa, Gloeobacter violaceus PCC 7421
MIRLCFTDPPAANGEHREIGRHLSSGLRAMATMQTIPWFWCVLLVLWAAAPALAAEVQQTILPNGLRVLTKEIRTSPAVTVQVWYGVGSRDEAPGGTGLAHQLEHLMFKGTKARPVQFGRLFNALGADANAFTSFDQTAYYATAGSDKLEALLQLEADRMRGAVIDAPSLAGEKTVVLSELDGRQNNPRSVLNEMVLAKAFNRHPYRITPIGERKDVEAFTVDQVRDFYRRHYGPNNATLIVVGDFETARLLEKVRRHFGPIEPIAGFKPLVPPVEPPQSAEQRVELRRPGRVPALQVLYRTPAANDPDVPAIDVLDTILTNGRSGRLFKALVETGLATGAGGSQSTQRDPGWYSFSITPRQDPETVLKALDATLAEVRSQGVTAAELARAREQVRVSLLLGKDSIEAQANLLGSFQTTFGDYRKLDTYLQQIDRVTSKDIQRVLQKYFEPTNRTVGVFIPTDGAAAAPQGTPETTQVTSYASGQPVDFDAVSRYLPALGKSGPVREPRPVEATLPNGIRVQVLRNPSAPTVSVLGRFQAGSAFENPERAGIAGMVSALLDEGTRTRSADELAMLLEDQGIRLGFQARRENTLMQAAALAEDLDLLMALGADVVRNPVFPEKEFERVRAQYLTSLANTLDSPAGVAQRTFYSLLYPPAHPFHTQITEASLKAITRADLLDFHRRFYRPQDFILTVVGDVDPQRVIEQVRTHFGDWKVEGPAPELKAAPVTPALRREAVVLPGKREAQVILGGVGIARTDPDYYAVLVMNDILGGNTLSSRLGARVRDQLGLTYGVYSRYAPGELAGPFTIQMQTNPANVERAVAAVNEELASFRKDGPTGAELERARRSLIDRFPLALTDNAGVANLLLEEAIYGLGRDYPTRFVRSLEALKVEDIRRVANRLLQPEAFTTVVVSPNPAPVAKPAARGP

SEQ ID NO: 60879 - protein, 388 aa, Pseudomonas fluorescens PfO-1
MNLHEYQGKQLFAEYGLPVSTGFAVDTPEAAAEACDKIGGNEWVVKAQVHAGGRGKSGGVKLVRSKEDAKAFAQQWLGKRLVTYQTDANGQPVTKILVESCTDIAKELYLGAVVDRSSRRIVFMASTEGGVDIEKIAHDTPEKILKATIDPLVGAQPFQGRELAFQLGLEGKQVAQFAKIFVGLAKLFKDHDLALLEVNPLVIKADGDLHCLDAKINIDANAMYRQPKLKTFHDPSQDDPREAHAAKFELNYVALEGNIGCMVNGAGLAMGTMDIVNLHGGKPANFLDVGGGATKERVTEAFKIILSDSNVAAVLVNIFGGIVRCDMIAEGIIGAVKEVGVKIPVVVRLEGNNAELGAKVLAESGLNIIAATSLTDAAQQVVKAAEGK

SEQ ID NO: 60880 - protein, 244 aa, Glycine max
  misc_feature (82)..(82): Xaa can be any naturally occurring amino acid
NLLHPKLISHIHDPGILFEFIISCRCVVSGSGKIAMHVLEKLIAYGALPISVSDSRGYLVDEDGFDYMKISFLRDIKAQQRXSLRDYSKTYARSKYYDEAKPWSERCDVAFACASQNEIDQSDAINLVNSGCRILVEGSNMPCTPEAVQILRKASVLIAPAMAAGAGGVVAGELELNHECSLMHWSPEDFESKLQEAMKQTYQRAMKAATDFGYQKESPEALVHGAVISAFLTIAQAMTDQGSI

SEQ ID NO: 60881 - protein, 697 aa, Thermobifida fusca YX
MISAIEAAREQFADEVVTRALSRDVELPYGAGKAVLITLDNGHDHTKPNTFGPAGLLSLNEAIDAAAARTDIVAVAITGKPFIFAVGADLNGVPKIQNREQAHAIGKLGHDVFRKLGELHVPTFAFINGAAMGGGVEVALHCTYRTVSSGVPAFALPEVFLGLVPGWGGTYLLPNLIGAEKALKLIIDNPLAQNKTIKGPQVYEMGIADAIFEPADFLEESLRWAAKVVTGEITVERPEVDKGEAWDQAVATARWTVDAKLHGASPAAVRAIDLVAEAKNRTRDEGFAAEDEALADLILSDQLRAGLYAFDLVQKRARRPKGAPDKSLARPVTKVGIIGAGLMASQLALLFARRLEVPVVMTDLDQERVDRGVRYVHDEVDKLLAKGRVNSDKANRIKALVTGSLSYEAFADADFVIEAVFEEMSVKKTVFAKAEEHISPEAVLATNTSSLSISEMAADLKHPERVVGFHFFNPVAVLPLLEIIRGERTDDATLATAFAVAKQLKKTAVLVKDAPAFVVNRLLTLFMGEVLSSVEEGTEPEVADRAVAPLGLPMSPLMLLQLVGPAVALHVAETLHAAFPDRFRVSEQLKAMVEAGKTTIYAPDFTIDPEVRAFFTGGDSPKSEEEILNRALEALAREIKIMLDEGVVAEPADIDLCMITGAGWPFHLGGITPYLDRTGISEKVNGVRFHPDGLKAL

SEQ ID NO: 60882 - protein, 414 aa, Bacillus sp. SG-1
MGLIVQKFGGTSVGDIERIKNVAGRVIDEKKQGNDVVVVVSAMGKTTDGLVDLAYQASAKPSKREMDMILTTGEQITISLLTMALQEMGYDAVSMTGWQAGIETEGIHGNARITNINTERINHNLSENRIVVAAGFQGLADNGEITTLGRGGSDTTAVALAAALKAERCDIYTDVDGVYTSDPRYVKSARKLASVAYDEMLELANLGAGVLHPRAVEFAKNYGVPLVVRSSMEKLEGTIIEEEVSMETGLIVRGVAFEEEIIRMTVLGLQNEITSLSSIFTTLAQNHINVDIIIQSKTETDSINLSFSIKRNDLEEAIEVLQSNREELGFSSIEHESGLAKVSIVGSGMISNPGVAAQMFEVLAKNEIPIKMVSTSEIKVSAVVDETHMLKAAEVLHTEFNLDKTEKPQKVSAK

SEQ ID NO: 60883 - protein, 189 aa, Bacteroides fragilis YCH46
MQLLKKRILQDGKCYEGGILKVDSFINHQMDPVLMKSIGVEFVRLFAGTNVNKIMTIEASGIAPAIMTGYLMDLPVVFAKKKSPRTIQNALSTTVHSFTKDRDYEVVISSDFLTPKDNVLFVDDFLAYGNAALGVIDLIKQSGANLVGMGFIIEKAFQNGRKTLEERGVRVESLAIIEDLSNCRITIKD

SEQ ID NO: 60884 - protein, 533 aa, Coprinopsis cinerea okayama7#130
MSFAWKALATLAVAIASRSAFAQSIIGNQDTMTISNINAGPDGFTRPVIAVNGEFPSPLVRANKGDDFRINVVNNLDDDTMLRQTSVHWHGVFQHQSAWADGPDGVTQCPIPQSGQEFEYAFNAGQEAGTFWYHSHYGTQYCDGLRGPLVIYDPEDPHQDLYDVDDENTIITLADWYHLQAPSIQGPAVSQATLINGKGRRPGNTEGDIAVVNVEKDSRYRFRIVSLSCDPDYTFSIDNHTMTIIEADGQNTKPLEVESIRVFAGQRYSVVVNADQAIGNYWIRAEPNIGDTGLVGTSGGGVNSAILRYATADEVEPDTPRLTNRPALQESNLRALTSGVPGGDGPADITFTFNLGLNFATGTFSMNPGESWVHPDTPVMVQIMNGVPAEDLVPAESLHTITRGQVVEVVIPPFGIAGPHPFHLHGHAFSVIKSAGGSPNFVDPVRRDVVAVGTEAGQGDTIIRFVADNPGPWFFHCHIEFHLVTGLAAVFMEAPDEIASSNPPPPSWDALCPAFSALPPSATSIRIVPTPTP

SEQ ID NO: 60885 - protein, 570 aa, Clostridium difficile 630
MAYKGIGASPGVALGKALVVEHSELVIEKKSIDNVEAEIAKLEDAVAVSKEELVKVKEKASEELGAEEAEIFEAHLLVLEDPELIGSAIDKIKTESVNAEYALNEIKEMFVSMFESMDNEYMKERAADIKDVTNRILRHILGIKVVDLSALSEEVVLIAHDLTPSDTATMNKKMVLGFLTDIGGRTSHTAIMSRTLEIAAIVGLNDITSKVKDGDFVVFNGDTGEVIVNPDEETINKYTELKAKYEDERKALQLLKGKPSVTLDGKHVELAGNIGTPNDIEGLIKNDAEGVGLYRTEFLYMDRDSFPTEEIQYEAYKAVLEGMDGKPIVIRTLDIGGDKELSYLSMEPEMNPFLGYRAIRLCLDRKDIFKTQLRALYRASVHGRLRIMFPMISSLEELLQAKEVVKEVLAELDSEGVAYAKDVEIGMMIEVPSAAVISDVLAKHVDFFSIGTNDLIQYTCAVDRMNQKISYLYNQFNPAVLRLIKTVIDNAHKEGKWAGMCGESAGDQKMIPILLGMGLDEFSMSPISILPARKLITSVKESDMKKLADDVLNMGTAEEIKSYIEKTFNI

SEQ ID NO: 60886 - protein, 466 aa, Zea mays
KTFDTRDPRTGDVLAHVAEADKADVDLAVKSARDAFEHGKWPRMSGYERGRIMSKLADLVEQHTEELAALDGADAGKLLLLGKIIDIPAATQMLRYYAGAADKIHGDVLRVSGRYQGYTLKEPIGVVGVIIPWNFPTMMFFLKVSPALAAGCTVVVKPAEQTPLSALYYAHLAKMAGVPDGVINVVPGFGPTAGAALASHMDVDSVAFTGSTEVGRLIMESAARSNLKTVSLELGGKSPLIIFDDADVDMAVNLSRLAVFFNKGEVCVAGSRVYVQEGIYDEFVKKAVEAARSWKVGDPFDVTSNMGPQVDKDQFERVLKYIEHGKSEGATLLTGGKPAADKGYYIEPTIFVDVTEDMKIAQEEIFGPVMSLMKFKTVDEVIEKANCTRYGLAAGIVTKSLDVANRVSRSVRAGTVWVNCYFAFDPDAPFGGYKMSGFGRDQGLAAMDKYLQVKSVITALPDSPWY

SEQ ID NO: 60887 - protein, 549 aa, Coprinopsis cinerea okayama7#130
MTSRLLGYLQLAIVLYNSVARGQMILSPSDTMVISNANVSPDGVTRSAVVVNGVHPGPVLIGEKDDVFAINVVNELTDPTMLRSTSVHWHGLFQRGTNWADGAEGVNQCPISPERSFLYRFSPAGHAGTFWYHSHFGTQYCDGLRGPMVVYDPDDPYKNEYDVDDVNTIITLADWYHTPAPSIRGPFFPDSTLINGIGRTPGGPKVDLAVVNVEAGKKYRFRIVSLACDVNFQFSIDKHKLTIIEADGQLTDPLEVDRIQIFTGQRYSVILNANQTPDVYRIRAIPNAGVHGLTDTTAGGVNSAILRYANAEATELPQEDELPSNLVDLQEWMLHAYAGGDPAAPGRPEAGGADVRIPLRFTFSGGRFFVNGTAYSSPSVPTLLQIMSGANPGELLPENSIYYLPRNQVIEVEIPSAGISASGPHPFHLHGHAFSVIRSAGNTSYNYVNPVKRDVVNIGGDSDLVTIRFVTDNPGPWFFHCHIEPHLVGGLAIVFAEAMKDTMSANPDVPDEWKDLCDIYDKLEPSLTSLSIIRRAEPTDLSAKFRGLY

SEQ ID NO: 60888 - protein, 166 aa, Arabidopsis thaliana
  misc_feature (28)..(28): Xaa can be any naturally occurring amino acid
  misc_feature (66)..(66): Xaa can be any naturally occurring amino acid
  misc_feature (113)..(113): Xaa can be any naturally occurring amino acid
  misc_feature (132)..(132): Xaa can be any naturally occurring amino acid
  misc_feature (161)..(161): Xaa can be any naturally occurring amino acid
KFGGSVSPEIKLLETLQVLFKNKGRDLXKNLNRPSRFLKRHPLPVPCIPLGVWAESSHETVLEVHXQFDEISSKSLRDAGAYDLIWQECAQFSRVRSVGVQRVKRTHCQLVLXRAVRTQDGMLQLVHFEHKXMDDVSAKICNSVQGVHRVVIDNTSNPPSXTIEWE

SEQ ID NO: 60889 - protein, 460 aa, Nostoc punctiforme PCC 73102
MKLPKGPQSPAVLQMLRWITSPMSFMETCAKRYGDMFTIRLDSKSPPLIFVSKPEVLEQILTNDIKGLEAPGDTNLVFESLLGKHSVITISGAEHQRQRQLLLPPFHGERMRSYSQIISDITEKVISQYQIGQPFNIRSVTQAITLRVIMQAVFGLDEGPRAEKLQHCLAEMLEKGSSVLSAALLYFPALQRDFGPINFWGKQMRRQQAADKLIYEEIRERQEQPDPSRTDILSLLMAARDEAGQPMTDEKLRDELMTLLVAGHETTATALAWAFYWIQKIPTVRQKLLKELDSLGDNPDPSTIFKLPYLNAVCSETLRIYPVAMLTFARVVRTPLSLGGYELEPGIGVIGSIYLTHHREDLYPEPKQFKPERFLERQFSPYEYLPFGGGARRCIGLAFAQLEMKLALAKILSTRELELVDNSEVRPKRRGLVTGQDRPIQMVVTSQRQVKFPILQTATV

SEQ ID NO: 60890 - protein, 447 aa, Azoarcus sp. EbN1
MRYKSLEEFLSHVEQRNPGQPEFIQAVAEVMESLVPFITEYPRYAEHGLLDRLIEPERAIQFRVSWVDDRGEVQVNRGYRIQHSSAIGPFKGGLRFHPSVNLSVLKFLAFEQTFKNALTTLPMGGGKGGSDFDPKGRSPGEVMRFCQSFMTELYRHVGSDTDVPAGDIGVGGREIGFLAGMMKKLSNKASCVFTGKGLSFGGSLIRPEATGYGMVYFAEEMLRHVGKTMAGMTVSVSGSGNVAQYGIEKAMALGAKVITASDSSGTVIDEAGFTPEKLAVLMDVKNVHYGRVSEYAERLGLHFEPGRRPWHVPVDIAFPCATQNELDGDDAAVLVRNGVSCVAEGANMPSNAAAVRVFEKNGVLYAPGKASNAGGVATSGLEMSQNAMRLSWTREEVDGRLLEIMQGIHHMCLQYGTKPDGSVNYSDGANVAGFVKVADAMLSQGVI

SEQ ID NO: 60891 - protein, 255 aa, Treponema pallidum subsp. pallidum str. Nichols
MIRIKTPEQIDGIRASCKALARLFDVLIPLVKPGVQTQELDAFCQRFIRSVGGVPAWFSEGFPAAACISINEEVIHGLPSARVIQDGDLVSLDVGINLNGYISDACRTVPVGGVAHERLELLRVTTECLRAGIKACRAGARVRAVSRAVYAVAARHRFGVVYEYCGHGVGLAVHEEPNIPNVPGLEGPNPRFLPGMVVAIEPMLTLGTDEVRTSADGWTVVTADGSCACHVEHTVAVFADHTEVLTEPTEVERTG

SEQ ID NO: 60892 - protein, 246 aa, Micrococcus luteus
MRKWCLMSKQLNGQEKSELVHNVFQNVSTKYDRLNDIISFNQHKSWRKYTMKQMNVKKGSKALDVCCGTGDWTIQMAQAVGKNGHVIGLDFSENMLSVAQGKTNHIQNIELIHGNAMELPFEDNIFDYTTIGFGLRNLPDYKKGLEEMYRVLKPGGMIVVLETSHPTMPVFKQGYKLYFKYVMPLFGKVFAKSMKEYSWLQQSAFEFPDKYTLALLMAETGFTHIKFKGFTGGVSAMHLAYKPKEK

SEQ ID NO: 60893 - protein, 534 aa, Arabidopsis thaliana
MASRRVSSLLSRSFMSSSRSIFSLRGMNRGAQRYSNLAAAVENTITPPVKVEHTQLLIGGRFVDAVSGKTFPTLDPRNGEVIAQVSEGDAEDVNRAVAAARKAFDEGPWPKMTAYERSKILFRFADLIEKHNDEIAALETWDNGKPYEQSAQIEVPMLARVFRYYAGWADKIHGMTMPGDGPHHVQTLHEPIGVAGQIIPWNFPLLMLSWKLGPALACGNTVVLKTAEQTPLSALLVGKLLHEAGLPDGVVNIVSGFGATAGAAIASHMDVDKVAFTGSTDVGKIILELASKSNLKAVTLELEESHHSFVCEDADVDQAVELAHFALFFNQGQCCCAGSRTFVHERVYDEFVEKAKARALKRNVGDPFKSGIEQGPQVDSEQFNKILKYIKHGVEAGATLQAGGDRLGSKGYYIQPTVFSDVKDDMLIATDEIFGPVQTILKFKDLDEVIARANNSRYGLAAGVFTQNLDTAHRLMRALRVGTVWINCFDVLDASIPFGGYKMSGIGREKGIYSLNNYLQVKAVVTSLKNPAWL

SEQ ID NO: 60894 - protein, 193 aa, Shigella flexneri
ADERPGKINLGIGVYKDETGKTPVLTSVKKAEQYLLENETTKNYLGIDGIPEFGRCTQELLFGKGSALINDKRARMAQTPGGTGALRVAADFLAKNTSVKRVWVSNPSWPNHKSVFNSAGLEVREYAYYDAENHTLDFDALINSLNEAQAGDVVLFHGCCHNPTGIDPTLEQWQTLAQLSVEKGWLPLFDFAY

SEQ ID NO: 60895 - protein, 324 aa, Burkholderia xenovorans LB400
MVKAIRFDKTGGPEVMKWVDVEVGEPGAGEIRVRQTAVGLNYIDVYFRTGLYPLPLPGGLGMEAAGEVTALGSGVSGLKVGDRIAYVARPPGAYAQERVLQAAQVVKVPDALTDEQAASVMLQGLTAQYLLRRTYPVKAGDTILIQAAAGGVGLLVCQWAKALGATVIGTVGSDEKAEIATAHGCDHAIVYTRENFTRRVREITNGAGVPVVYDSIGKDTFTGSLDCLAPLGMFVSFGNASGPLPPIDSSEFAGRGSLFFTRPTLFTYIAKRSDYEAMSTELFDVLVSGKVKTSINQRYALADVGRAHADLEGRRTTGSTVLLP

SEQ ID NO: 60896 - protein, 193 aa, Shigella flexneri
ADERPGKINLGIGVYKDETGKTPVLTSVKKAEQYLLENETTKNYLGIDGIPEFGRCTQELLFGKGSALINDKRARTAQTPGGTGALRVAADFLAKNTSVKRMWVSNPSWPNHKSVFNSAGLEVREYAYYDAENHTLDFDALINSLNEAQAGDVVLFHGCCHNPTGIDPTLEQWQTLAQLSVEKGWLPLFDFAY

SEQ ID NO: 60897 - protein, 273 aa, Triticum aestivum
  misc_feature (92)..(92): Xaa can be any naturally occurring amino acid
MWWPSSLLYPPPPSAFVTAMSVVSFASLASAGLSELRGQHMAYSKFWHVVSGQQQNKGGTGGAQLAGRHGMLVAYAPALVAAAASFVVPGAXVEGLRAELLAAALAVHFLKRVLEVLFIHRYSGNMPLNTALTISSSYLLSAITMIYAQHLAVELPDPSTNLLYPGVLLFAVGIAGNFYHHYLLSQLRKGGDDDKGYKIPKGGLFEFVTCPHYLFEITGFFGFAMISQTVYALAMASGTAAYLVGRSFATRRWYESKFEEFPASIKALVPYIL

SEQ ID NO: 60898 - protein, 158 aa, Oryza sativa Japonica Group
MAGRGKAIGAGAAKKATSRSSKAGLQFPVGRIARFLKAGKYAERVGAGAPVYLAAVLEYLAAEVAIVSVFLDPFDMRYCRESVGIGCWSSPGTRRGDNKKTRIVPRHIQLAVRNDEELTKLLGGATIASGGVMPNIHQHLLPKKAGSSKASHADDDDN

SEQ ID NO: 60899 - protein, 185 aa, Shigella flexneri
ADERPGKINLGIGVYKDETGKTPVLTSVKKAEQYLLENETTKNYLGIDGIPEFGRCTQELLFGKGSALINDKRARTAQTPGGTGALRVAADFLAKNTSVKRVWVSNPSWPNHKSVFNSAGLEVREYAYYDAENHTLDFDALINSLNEAQAGDVVLFHGCCHNPTGIDPTLEQWQTLAQLSVEKGW

SEQ ID NO: 60900 - protein, 194 aa, Shigella flexneri
ADERPGKINLGIGVYKDETGKTPVLTSVKKAEQYLLENETTKNYLGIDGILEFGRCTQELLFGKGSALINDKRARTAQTPGGTGALRVAADFLAKNTSVKRVWVSNPSWPNHKSVFNSAGLEVREYAYYDAENHTLDFDALINSLNEAQAGDVVLFHGCCHNPTGIDPTLEQWQTLAQLSVEKGWLPLFDFAYQ

SEQ ID NO: 60901 - protein, 537 aa, Oryza sativa Japonica Group
MAIVDASTGPAVIVAVAVVVVVVSTLLWTAMAQLVWRPYAVGRALGQQGVRGPAYRLLVGNIGEANEMRAAASGGVLDRRCHDVVPRVLPHYRAWMSRYGKVFVSWTGPFPALCVGDYAMAKEILADRTGLYAKPDPGASILALFGNGLAFVNGDDWARHRRVVHPAFAMDKLKMMAKTMAECARKVIQAWEARAAAAADGERMVQVEVGEQFHELTADVISHTAFGSSYRQGKEVFVAQRELQYIAMSALNSVRIPGSQYIPTKANIRRRQLAKKVRGTLMAIIRERQATAAAAKEDRGYGNDLLGLMLEANAAAGGGEKSMTMDEIVDECKTFFFAGHDTTSHLLTWAMFLLGTHPEWQQRLREEVLRECCGGGGGDTEALPNGDALNKLKLMTMVLYETLRLYGPVSMLVRTATADAELGGVRVPKGTMTMMPVAILHRDADVWGADAGEFDPLRFRGGVNKAAAHAGALLAFSLGQRSCIGQDFAMMEAKTTLAMILRRFAFEVSPEYVHAPLDLLTLQPKCGLPMVLKLLDQ

SEQ ID NO: 60902 - protein, 193 aa, Shigella flexneri
ADERPGKINLGIGVYKDETGKTPVLTSVKKAEQYLLENETTKNYLGIDGILEFGRCTQELLFGKGSALINDKRARTAQTPGGTGALRVAADFLAKNTSVKRVWVSNPSWPNHKSVFNSAGLEVREYAYYDAENHALDFDALINSLNEAQAGDVVLFHGCCHNPTGIDPTLEQWQTLAQLSVEKGWLPLFDFAY

SEQ ID NO: 60903 - protein, 135 aa, Triticum aestivum
  misc_feature (51)..(51): Xaa can be any naturally occurring amino acid
  misc_feature (70)..(70): Xaa can be any naturally occurring amino acid
  misc_feature (103)..(103): Xaa can be any naturally occurring amino acid
  misc_feature (123)..(123): Xaa can be any naturally occurring amino acid
MAPTVMASSATSVAPFQGLKSTAGLPVSRRSNGASLGSVSNGGRIRCMQVXWPSEGIKNSETLSYLPPLXSTGGLPLSKSDYLDSVPSWVLSSEFKKVGFIFXVEHNASPWGTTMARYWACWXLPISGCTDARST

SEQ ID NO: 60904 - protein, 556 aa, Candida glabrata CBS 138
MVFKKRKIEEEEEHETDTKYTPGKHPRTQASLPRVDYESPLDPENELFVEEWNIPKINNYISYMLDTLIETHKNLVKDFIKLPSRKFHPQYYYKIEKPISINEIKSRDYETNDGNLAFLLDVELIAKNCVSYNEEDTLIVKNSEQVVNLIEAEVLKTKNMNRNYLLNDSLKKRATKYLDLLLDCTDKDIEEAFNRPTKGVDSKMKICGPFREMVNKDDLPEYYEIIQNPISLDVIATNITIGKYKQLYDFITDVQLVFLNARVYNDVNTLIYQDATRILHYFNYLINNKLFAELQDATERGELNLELDPVGYEHMINEPSSNTNSLNLLDNDDMGETDNLEGLGNGYNRSIMSEDFLLGPMNDRNESNNNEDEEDDAEAKVPKYNIIKSLQKDVISNQYTMAKKPFEIIKQIEIFSTLRSFKQAVDPLPGSKPSTNPDWFQYIFKGNQMSQNENMYSLSLQPIHTQVTIAADTTKSGIKISLVLNRMLVKSRKMIINERNLMHLQSEVKPDLSGLVGEREEFDIRLSEGLNMLELRCIDTAQSQEEVVKLWINIFA

SEQ ID NO: 60905 - protein, 208 aa, Wolbachia endosymbiont of Drosophila simulans
MTLIPIVVEQTSRGERAYDIYSRLVKERIIFVTGPIEDNMASVIVAQLLFLESENPDKDICMYINSPGGVVTAGLSIYDTMQYINPDVSTLCIGQAASMGSLLLAAGTKGKRYSLPHSRIMIHQPSGGYHGQATDIEIHANEILRVKKKLNQIYEKHTGNSLKKIEGMMERDKFMDPEEARKIGLIDRVIAERTDIEIENIKVKQKVG

SEQ ID NO: 60906 - protein, 76 aa, Picea sitchensis
MSGRSLPKFGDWDVNDPATGEGFTVIFNKARDEKKTGAEAGANPAEIQAAKDEHAKGEFQSKQRKWLCCLSPSAVG

SEQ ID NO: 60907 - protein, 544 aa, Glycine max
MMGIESTGSKWLGLVAAVWIQAISGNNYTFSNYSDALKSLMSLTQIELNNLSVAKDVGKAFGLLAGLASDKFPTWAILLIGSLQGLIGYGVQWLVVSQRIQPLPYWQMCVFLCIGGNSTTWMNTAVLVTCIRNFRRNRGPVSGILKGFVGLSTAIFTDLCSALFADDPASFLLMLALIPFAVCLSGMFFLREIPPAATNDQEESTYFAVFNAVAVVVAVYLLAFGFVPNPSALVSRAFAVVLLLLLVAPMGIPVHSYLKARRQDERFKPNLEERVDEPLIRGKEKGSESEVERGNVLAEEAAAEGMSGPAVGEEHTIWEALKTVDFWILFVSFLCGVGTGLAVMNNMGQIGLALGYSDVSLFVSLTSIWGFFGRIVSGSVSEHFIKKAATPRPLWNAASQILMAVGYILLAMAMPGSLYIGSVVVGICYGVRLAITVPTASELFGLKYYGLIYNILILNLPLGSFLFSGLLAGILYDMEATTTVGGGNTCIGAHCYRLVFIIMAVACVVGFFLDILLSFRTKKVYNKISSSKNSNKNSLNSSRR

SEQ ID NO: 60908 - protein, 285 aa, Glycine max
MAKHDVEGGSFSAKDYHDPPPAPLIDAEELTQWSFYRALIAEFIATLLFLYITVLTVIGYKSQSDVKAGGDVCGGVGILGIAWAFGGMIFILVYCTAGISGGHINPAVTFGLFLARKVSLIRAIMYMVAQCLGAICGVGLVKAFQKAYYNRYGGGANELSEGYSTGVGLGAEIIGTFVLVYTVFSATDPKRNARDSHVPVLAPLPIGFAVFMVHLATIPVTGTGINPARSLGAAVMYNQQKAWDDHWIFWVGPFIGAAIAAFYHQFILRAGAAKALGSFRSNPTI

SEQ ID NO: 60909 - protein, 475 aa, Rhodopirellula baltica SH 1
MHAPVVVLGGGPGGYAAAFLAADEGMEVTIVEAEPRLGGTCLIRGCIPSKALLHVAKVISEVEELKSEWGIEYSGEPKIDVDVVRARKDKVIDNLTGGLGGLAKRRNVTVIQARGSFVSSNELKLEGDHESIPEGGKLTFDKCIVATGSIPAMPPAFDIGSDRVMDSTGALALKDIPETLLVVGGGYIGLEMGTVYAHLGSKVSVVELGEGLLPGADRDLVKPLAKKIDKMCDGRVFLNTKVGSLAEDGDKVVVSFEGPSKFGTESYDRVLISIGRRPVTRGLGLENTKVEVNERGFIVCDEQQRTADPNILAIGDVAGDPMLAHKATHEGRVAAEVLAGKNVAFDKAAIPAVVFTDPEIAWAGLTEGEAKAAGRKVDVEVYPWAASGRAQAIGVTNGLTKWLVDPETHRVLGCGIVGTGAGELIAEAVLAIEMGCEVTDITESVHPHPTLSETLMNAGEVHFGTATEIYKPKRK

SEQ ID NO: 60910 - protein, 837 aa, Xanthomonas campestris
MSSPSIAPVTPDLVRLRATARDKDDAIAQAAQLLVAAGCVAPGYDASMRRREGLANTFLGHGLAIPHGVGEDRHLVRRDGIAVLQLPEGVEWNPGQTTRLVVGIAAQSDTHITLVRRLTRLIQDPAQLEALFTTDDPAVIVAALTGDRAPDTSAAPATDLAERFEWTIAYPSGLHARPATRWAETARGFSARAQVRAGDQAADAKSLVGLLQLGLRAGDSITVSAKGSDAPALLKRLRAVMDSLTAQEKADAERAAQRRAAPVIGWTPPQAQPAIVGIGASPGVAIGIVHRLRAAQTEVADQPIGLGDGGVLLHDALTRTRQQLAAIQDDTQRRLGASDAAIFKAQAELLNDTDLITRTCQLMVEGHGVAWSWHQAVEQIASGLAALGNPVLAGRAADLRDVGRRVLAQLDAAAAGAGLTDLPEQPCILLAGDLSPSDTANLDTDCVLGLATAQGGPTSHTAILSRTLGLPALVAAGGQLLDIEDGVTAIIDGSSGRLYINPSEQDLDAARTHIAEQQAIREREAAQRALPAETTDGHHIDIGANVNLPEQVAMALTQGANVGLMRTEFLFLERGSTPTEDEQYHTYLAMAQALNGRPLIVRALDIGGDKQVAHLESPHEENPFLGVRGARLSSRRPDLLEPQSRALYRAAKDGARLSIMFPMITSVPELISLREICAAIRAELHAPELPIGIMIEVPAAAAQADVLARHADFFSIGTNDLTQYVLAIDRQNPELAAEASSLHPAVLRMIRSTIDGARKHDRWVGVCGGLAGDPFGASLLAGLGVQELSMTPNDIPAVKARLRGRALSALQQLAEQALHCETAEQVRALEAQREGQA

SEQ ID NO: 60911 - protein, 382 aa, Ralstonia eutropha JMP134
MTSEDNNTAREETQQSGASPSAAERALGAELAPLREQIDTVDRELLAMLNRRAQLALDVGEVKKKYGAPVFRPERELQVIRKVQAANPGPLLGESVASIWREVMSACRGLEKPLEIAFLGPAGTFSEQALYAHFGHEVSGVPCPSIDEVFRAVEAGTVEYGVVPVENSTEGAVSRTLDLFLQTSLKISGEIALKVHHNLMAASPDMNGVKVVRAHAQALAQCQHWLTANYPHLERQAVSSNAEAARMASEDPTVAAIAGESAANRYHLHIIRPHIQDDPHNRTRFAVIGRYETEPSGSDQTSMILSVPNKAGAVYQLLAPLAENGVSMCRFESRPARSGAWEYYFYVDVEGHQHEPAVARAIETLRRNAAYLKVLGSYPSSK

SEQ ID NO: 60912 - protein, 370 aa, Vitis vinifera
MYRVSTTNYTLKIFLIRGGKAILQIFSMEFGLYNSSILNLHGFHVYPWSPARIRYQSDQYAGVGEILRWVLSTLVQFIIGWRFYTGSYKALRHGYANMDVLIALGTNAAYFYSFYSMLRAATSEDFKSTNFFETSFMLISFSLLGKYLEVLAKVWNVKKSVHLVQGTLHPDVIKPCPLPGSGRTHSHAIKSHHNVGGLPKDMKLKLIEPLKLLFMDEVRELWRILNVPQAFLQRHPFPRPGLVERVLGDVTEKIPWIFNARLMRFSSNQPKMLENGSFWALRLMELLGLIRILCTSKLSTPTFKTRASSYVGSLEFRRLVLMVVGFSRISWKILHEQLLMCSTGCLRKQPITYSTQILDVTNISSVRFQI

SEQ ID NO: 60913 - protein, 330 aa, Mycobacterium sp. JLS
MDEVAPVIREALAAASGAPGYPTTAGTPELRASAKAALERRYGITGLGDDAVLPVIGSKELIAWLPTLLGAGSDDLVVVPELAYPTYDVGARLAGAQVIRADSLTQLGPQRPALIFLNSPSNPTGRVLGVDHLRKVVGWARDRGVLVASDECYLGLAWDAEPVSVLHPSVCDGDHTGLLAVHSLSKTSSLAGYRAGFVAGDPAVIAELLAVRKHAGMMVPTPVQAAMVAALDDDAHEREQRERYARRREVLLPALKAAGYTVDHSEAGLYLWATRAEPCRQTVDRLARLGILAAPGEFYGPRGAQHVRLALTATDERIAAAAERLSANQG

SEQ ID NO: 60914 - protein, 626 aa, Shigella flexneri 2a str. 2457T
MAIEIKVPDIGADEVEITEILVKVGDKVEAEQSLITVEGDKASMEVPSPQAGIVKEIKVSVGDKTQTGALIMIFDSADGAADAAPAQAEEKKEAAPAAAPAAAAAKDVNVPDIGSDEVEVTEILVKVGDKVEAEQSLITVEGDKASMEVPAPFAGTVKEIKVNVGDKVSTGSLIMVFEVAGEAGAAAPAAKQEATPAATPAPAAGVKEVNVPDIGGDEVEVTEVMVKVGDKVAAEQSLITVEGDKASMEVPAPFAGVVKELKVNVGDKVKTGSLIMIFEVEGAAPAAAPAKQEAAAPAPAAKAEAPAAKAEGKSEFAENDAYVHATPLIRRLAREFGVNLAKVKGTGRKGRILREDVQAYVKEAIKRAEAAPAATGGGIPGMLPWPKVDFSKFGEIEEVELGRIQKISGANLSRNWVMIPHVTHFDKTDITELEAFRKQQNEEAAKRKLDVKITPVVFIMKAVAAALEQMPRFNSSLSEDGQRLTLKKYINIGVAVDTPNGLVVPVFKDVNKKGIIELSRELMTISKKARDGKLTAGEMQGGCFTISSIGGLGTTHFAPIVNAPEVAILGVSKSAMEPVWNGKEFVPRLMLPISLSFDHRVIDGADGARFITIINNTLSDIRRLVM

SEQ ID NO: 60915 - protein, 525 aa, Coprinopsis cinerea okayama7#130
MSRKLFSLAYLAVVLVSVAGQILGPTSTMTVSNIDASPDGFNRPVVAVNGQHPGPLVRANKGDNFRINVVNDLNDPTMLRQTSVHWHGVFQHGTAWADGPDGVTQCPIAQNGESFEYRFNAGNEAGTFWYHSHFGTQYCDGLRGPLVIYDPNDPHRNLYDVDNADTVITLVDWYHLQAPSIEGPALSDATLINGKGRRPGGPETDIAIVNVQRNRRYRFRLVSMSCDPNYKFSIDGHKLTVIEADGQLTEPLMVDEIQIFAGQRYSFVLSANRPVGNYWIRAIPNVGSNNLPNFSSGGINSAILRYAGAPNANPTSTPVTNPVALHESNLHALLNPGAPGGSGPADENIVLQMGLGPAGFEINGVTWANPDSPVMVQIMNGVPPADIVPSGAIHTLPRNRVVEVSIPGFELAGPHPFHLHGHAFSVVRSAGSSTYNYENPVRRDVVDVGGASDNVTIRFTTDNPGPWFFHCHIEFHLVLGLAMVFMEAPSDIPSTSPPPPSWSELCPKFESLPASATSIQIVPTP

SEQ ID NO: 60916 - protein, 178 aa, Brassica napus
  misc_feature (6)..(6): Xaa can be any naturally occurring amino acid
MSIPCXLTEETAKTVLRQVEFYFSDSNLPIDDFLKKTVTQSEDGLVSLALICSFSKMRGYLKLGDSKGDEIPEDTIKAVADTLRTSKALKVSEDGQKVGRSTEMLKLGDLIEQLNARTVAASPFSFDVKRDDVEAFFSQYGKVNSVRLPRHVAETRVFCGVALVEFPTEEDAQNVMKQ

SEQ ID NO: 60917 - protein, 831 aa, Shigella flexneri 2a str. 301
MLTIQFLCPLPNGLHARPAWELKEQCSQWQSEITFINHRQNAKADAKSSLALIGTGTLFNDSCSLNISGSDEEQARRVLEEYILVRFIDSDSVQPTQAELTAHPLPRSLSRLNPDLLYGNVLASGVGVGTLTLLQSDSLDSYRAIPASAQDSTRLEHSLATLAEQLNQQLRERDGESKTILSAHLSLIQDDEFAGNIRRLMTEQHQGLGAAIISNMEQVCAKLSASASDYLRERVSDIRDISEQLLHITWPELKPRNNLVLEKPTILVAEDLTPSQFLSLDLKNLAGMILEKTGRTSHTLILARASAIPVLSGLPLDAIARYAGQPAVLDAQCGVLAINPNDAVSGYYQVAQTLADKRQKQQAQAAAQLAYSRDNKRIDIVANIGTALEAPGAFANGAEGVGLFRTEMLYMDRDSAPDEQEQFEAYQQVLLAAGDKPIIFRTMDIGGDKSIPYLNIPQEENPFLGYRAVRIYPEFAGLFRTQLRAILRAASFGNAQLMIPMVHSLDQILWVKGEIQKAIVELKRDGLRHAETITLGIMVEVPSVCYIIDHFCDEVDFFSIGSNDMTQYLYAVDRNNPRVSPLYNPITPSFLRMLQQIVTTAHQRGKWVGICGELGGESRYLPLLLGLGLDELSMSSPRIPAVKSQLRQLDSEACRELARQACECRSAQEIEALLTAFTPEEDVRPLLALENIFVDQDFSNKEQAIQFLCGNLGVNGRTEHPFELEEDVWQREEIVTTGVGFGVAIPHTKSQWIRHSSISIARLAKPVDWQSEMGEVELVIMLTLGANEGMNHVKVFSQLARKLVNKNFRQSLFAAQDAQSILTLLETELTF

SEQ ID NO: 60918 - protein, 533 aa, Coprinopsis cinerea okayama7#130
MLSNLLPLAILAVSLRPLIVPVTAQAIPPVATMTVSNINASPDGFTRPVVAVNGQHPPPPILANKGDDFQITVVNNLDDPTMLRQTSVHWHGIFVHKAAWADGPDGVTQCPIAQSGDSFTYSFDAGNEAGTFWYHSHYGTQYCDGLRGPLVIYDDNDPYKNLYDVDDESTIITLADWYHLPTPSIAGIALSDATLINGKGRRPGGPLTDIEIVNVQPGTRYRFRLISMACEPTYKFSIDGHNMTIIEADGQLTEPHTVQEITIFTGQRYSFILEANQPVGNYWIRAIPNLGARNLPDFSSGGINSAILRYAGARPRNPTTRAPRNPVVLKEANLRTLLNPGAPGGSGPADENIVFNLALNAEETGFVMNGVAWANPDIPVMVQLMNGVPAEDIIPQGAYRTLPRNSVVEVSIPGFEIAGPHPFHLHGHAFDVVRSAGSDTYNYVNPVRRDVVDIGGAGDNVTIRFRTDNPGPWFFHCHVEFHIITGLAMVFLEAPGDIASNSPPPPSWDALCPKFKSLPANATSIQIVPTPTP

SEQ ID NO: 60919 - protein, 637 aa, Thermobifida fusca YX
MTLLDSVHNPDDLKKLPDSQLPQLAAEIREFLISQVARTGGHLGPNLGVVELTIALHRVFDSPRDPILFDTGHQAYVHKILTGRKDFSKLRKEGGLSGYPSRAESEHDFIENSHASTALSYADGLARAYELQGITDRTVVALVGDGALTGGMAWEALNNIAEGKNRRIVIVVNDNGRSYSPTIGGLAEHFANLRMTRGYEQMLATAKNAINRAPVVGPPLYDALHAFKKGLKDAIQPQMMFEDLGLKYVGPIDGHDVAAVERALRRARDFGAPVIVHVLTQKGKGYAPAENHDEDQFHALGAFDVATGRPQSTPGLKWTSVFSDEMVRIGAEREDVVAITAAMLHPTGLAAFAEAYPDRVFDVGIAEQHAATCAAGLAMGGLHPVVAVYATFLNRCFDQVLMDVALHRQPVTFALDRAGITGDDGASHNGMWDLSILQVVPNLSIAVPRDAVRLRELLREAISIDDGPTVVRYPKGVVPPAIPAVDQIGGMDVLRRPASGTEAPDLLLVAVGPMAQTCCEVADRLADQGIGVTVVDPRWVKPLDPALVSEAARHSVVAVVEDNGRVGAVGDAVARALRDADLDIPVRTFGIEQRFLEHAKRDRILAQMGLDAQGLARKLTEIVAQRAEQSLEDEPAS

SEQ ID NO: 60920 - protein, 484 aa, Camellia japonica
MDSITFSLYLLLSSSLSLLIFVLLRSSIITRRHLRLPPGTLGLPFLGETLHLISAYKSENPDPFIDDRVSRFGPIFTTHVFGEPTVFSADPETNRFILQNEGKLFESSYPGSISNLLGRHSLLLMKGSLHKRMHSLTMSFANSSIIRDHLMLDIDRLVRLNLESWTGRVLLMEEAKKITFELTVKQLMSFDPCEWTESLRKEYMLVIEGFFTIPLPLFSSTYRRAIQARSKVAEALSLVVRERRRESSERGERKNDMLGALMDEEGGGGGFSDEEIVDFLVALLVAGYETTSTIMTLAVKFLTETPLALAQLKEEHDEIRARKDNLEALEWNDYKSMPFTQCVVNETLRVANIISGVFRRAITDVDVKGYTIPKGWKVFASLRAVHMDHDHFKDARSFNPWRWQTNSGTTNSVNLFTPFGGGPRRCPGAELARVELSVFLHHLVTRFSWVPAEEDKLVFFPTTRTQKRYPIILQRRNVPTSCIE

SEQ ID NO: 60921 - protein, 546 aa, Coprinopsis cinerea okayama7#130
MSTRLVAYLQLAISLYQSVARGQAVLNPSDTMVISNANVSPDGVPRSAVVVNGVHPGPVLVGQKDDNFAINVVNELTDPTMLRSTSVHWHGLFQRGTNWADGAEGVNQCPIAPERSFLYRFSPAGHAGTFWYHSHFGTQYCDGLRGPMVVYDPEDPYKDEYDVDDVNTIITLADWYHTPAPSIRGAFRPDATLINGLGRTPGGPPVDLAVVNVQEGQKYRFRIVSLACDVNFQFSIDGHKLTVIEADGQLTDPLEVDRIQIFTGQRYSVILHANQAPNNYRIRAIPNAGVAGLTGTVDGGVNSAILRYAGAPVAEPTTEAPSNMIDLSESQLHAYAGGDPAAPGRPEAGGADVTIPLRFTFSGGRFFVNGTSYTSPSVPTLLQIMNGANPGELLPENSVYYLPRNQVVEVEIPSTGISGSGPHPFHLHGHAFSVVRSAGNSSYNYVNPVKRDVVSMGGDSDLVTIRFVTDNPGPWFFHCHIEPHLVGGLAIVFAEAMEDTAAAHPDIPTEWRDLCDIHHDLDPSLTSVSIVRRAEPTGLSAKFRGL

SEQ ID NO: 60922 - protein, 448 aa, Triticum aestivum
  misc_feature (180)..(180): Xaa can be any naturally occurring amino acid
  misc_feature (193)..(193): Xaa can be any naturally occurring amino acid
  misc_feature (202)..(202): Xaa can be any naturally occurring amino acid
  misc_feature (258)..(258): Xaa can be any naturally occurring amino acid
  misc_feature (319)..(319): Xaa can be any naturally occurring amino acid
  misc_feature (385)..(385): Xaa can be any naturally occurring amino acid
MAAHAALAATRIPTSARLHSKAASRQRVDFADFSGLRPGSCSVSAAAREASFSDVLGAQLVARASGENAVRAPAEAKLKVAINGFGRIGRNFLRCWHGRENSPLEVIVINDSGGVRNASHLLKYDSMLGTFKADVKIVDNETISVDGKNIQVVSNRDPLKLPWAELGIDIVIEGTGVFVXGPGAGKHLQAGAXKKVIITAPXAKGADIPTYVVGVNEGDYDHDVANIISNASCTTNCLAPFAKVLDEEFGIVKGTMTXPTHSYTGDQRLLDASHRDLRRARAAALNIVPTSTGAAKAVSLVLPQLKGKLNGIALRVPTXPNVSVVDLVINTVKTGITADDVNAAFRKAADGPLKGILDVCDEPLVSVDFRCSDVSTSIDASLTMXMGDDMVKVVAWYDNEWGYSQRVVDLAHLVAAKWPGAGTGGSGDPLEDYCKTDPNAVECKVFDE

SEQ ID NO: 60923 - protein, 517 aa, Coprinopsis cinerea okayama7#130
MILLTFSLLILLSLPAALAGFGSSGDLIVGNRFISPDGFSRSAVLAGSSVSGLTFPGPIITGTRGGRFHLNVVNELIDPAMLRTTSIHWHGLFQRGSQWADGPAGVTQCPIVPGSSFLYQFQVPDQAGTFWYHSHHQTQYCDGLRGAFVLYDPHDPHHQLYDIDDESTIITLADWYHTPTLSAGALPIFNSTLINGKGRFAGGPPVDLAVIHVERNRRYRFRLISMSCDPNYIFSIDGHTLTVIEVDGVNVQPHTVDSIQIFAAQRVSFVLNANRPIDNYWIRADPNFGNTGFAGGINSAVLRYHGAEPADPVTERLPFSSPFREFDLRPLFPEPVPGRPEVGGADININLEIGFDSQSTRFSVNNATMIQPTVPVLLQILSGARTPQELMPPGSIYTLPRNRVVELSIPGGSAGSPHPVHFHGHTFHVIRSAGSSEYNYFDPIQRDVVSIGEATDNVTIRFVTDNAGPWILHCHIDFHRALGFAVVFAEDAERVAALEPPPAWHELCPKYEAFGEQ

SEQ ID NO: 60924 - protein, 1811 aa, Mycosphaerella graminicola
MNASNSSLIASDPDGICEKILDVILEYALHKFGDTKQKLALGRPKFLETIAGFVVQGRCIQMCLPAFPFKSSNKIDKVLGTLPDKAEELALGRLNTMCAKVQAIHAPGAALTIISDGLVYNDLLSISDKDTWAYGEALRSMAIAHEFQHIRFARIRDLIKFPGSEVLNEITYVASATNFRRSLLNEFGKDDIDIDHEIATSEDTKMTYLGYRRFLESDLKHIFPLGSDRSANSYKRNVKFLAKEMIIRGYAFAGAVRAAFPEHLRLSIHQSTGEHKISISLLHTKTGFTTPWHCSVARLADGTWVSAQKADFELQDTMRMICENGRPSYFQEEEASEQHFVPTQAFGLGGAKMDGSHSLGSATELSLYANETLSQSTSEFDFATLKEQVVVANTHAVGPTTEQLINTFLRHDYPPLDPKSDSFEARSWLKNFEGLIEANRASNSKQIVGVSYRDLSVEAFWQPSDYQKTFWNQPIAIIDTIAQKLTASRNVKRSILKKCDGLIRHGEMLLVLGQPGSGCSTLLKSIAGELDQLRLGNTTYMNYQGVPGHVMHKEFRGEAVYQAETDVHFHQLTVKETLEFAARARAPCESIPGVNRDTYVTHVRDAYIAMFGLRHIADTKVGNAFLRGVSGGEVKRVSIAEAAVARSAIQCWDNSTRGLDSAAALDFVQTLRTSADIAGTTIAVTLYQAPQSVYNLFDKVSVLYEGRQIFFGPASEAKEYFIDLGFEPKPRQTTADFLTSVTSPAERRIRKDFVGRIPATPDDFFVVWQKSQQFKHLQDDIDKFNESNPIGGPSLEEFRNARRSLQEKSQRSRSPFTLSLPSQIDLCVWRGFQRLKRDMGILISSIIFNSILSIVIGSVFYGLPNDNAALYSRGVLLYFSIMLAAFASALEILVLYAQRPIVEKQARYAFCHPFAEAIASMLCDLPNKITTAIGSSLPLYFMTHLRRTPGHFFVFLVFTFACTLTMSMYFRCIAALSRTLAQAMAPASVFSLALVIYTGFAIPTRYMRPWLRWLNYLNPVGYAFESLMINEFHDRSIPCSEYVPHGEAYNDIQARERICATSGSTAGAEAIDGDVYLAVNFGYHASHLWRNLGIMLALMILGCSIYLLATEYVTEQKPKGETLLFQRGGIPRNRPQDEESVGNGNIETTSVLMAEPTCKGRVDVTFRPEQESVFHWDDVSFDIGTKGSSKRILQGVDGWIRPGTLTALMGVSGAGKTTLLDVLADRVSVGVVSGNMLVDGLPRGPDFRRQTGYAQQQDLHLASSTVREALNFSALLRQPRTVPNDEKIAYVEEVIAILDMEAYSDAVVGVPGEGLNVEQRKRLTIAVELVAKPAVLLFLDEPTSGLDSQTAWSICSLLRKLADNGQAILCTIHQPSAPLLGLFDRLLYLAMGGRTVYFGALGASCSAVIDYFQDKGARPCGGDENPAEWILDVTNTPRNIDGTAWADVWDTSEERQAVKAELARMKPSITSPITAIDADRPYAAAFGTQLGHLLRRGFSHYWRTPSYLWSKVALCVFSALFIGVSFWKMPNSIQGTQNQLFAVFLLLTIFTNFCQQMMPHAITRRELAEARELPSKVYSWQTFILSDIVVEVPWNSLMAVLVFACWYYPIGLQQNAIDAGQTGERAILMFLFILAFFNFAGTFTSMAVALMSTAESAGNITNLLFSLSLIFCGVLATPQALPGFWIFMYRISPLTYLVSGVLSVGLANTRIHCLDEELLHFSAPPSTNCSTYLAPYIQLEGGYLQEVPDSNPAQCVFCTGSQTNIFLKSVSAQYGDRWRNLGIVWAYVAFNLVATVIFYWLARVPKKSRSK

SEQ ID NO: 60925 - protein, 516 aa, Coprinopsis cinerea okayama7#130
MLSIFSLFALQSLPAALAAFGSSGNLIVGNKFISPDGFNRSAVLAGSSRNGLTFPGPVITGIRGSRFNLNVVNELTDPTMLRTTSIHWHGLFQRGSQWADGPAGVTQCPIVPGSSFLYQYRVPDQAGTFWYHSHHQSQYCDGLRGALVVYDPRDPHRRLYDIDNESTIITLADWYHVPAPSAGVVPTFDSTLINGKGRYAGGPAVDLAVINVERNRRYRFRLISISCDPNYIFSIDGHQLTVIEVDGINVQPHTVDSIQIFVGQRVSFVLHANRPVGNYWIRADPNFGTTGFAGGINSAILRYRGAQPVDPVTERLPFSNPFREVDLRPLVPKRPPGRPEIGGADININLDIGFDPSSITFSVNNATMLQPTVPVLLQILSGARTPQELMPQGSIYVLPRNKVVELSIPGGSVGSPHPIHFHGHTFHVIRSAGSSEYNYFNPIERDVVNIGESTDNVTIRFKTDNAGPWILHCHIDWHLVLGLSVVFAEDVSSIARLNAPPAWHELCPKYEAFGEE

SEQ ID NO: 60926 - protein, 412 aa, Shigella flexneri 2a str. 301
MTNYRVESSSGRAARKMRLALMGPAFIAAIGYIDPGNYATNIQAGASFGYQLLWVVVWANLMAMLIQILSAKLGIATGKNLAEQIRDHYPRPVVWFYWVQAEIIAMATDLAEFIGAAIGFKLILGVSLLQGAVLTGIATFLILMLQRRGQKPLEKVIGGLLLFVAAAYIVELIFSQPNLAQLGKGMVIPSLPTSEAVFLAAGVLGATIMPHVIYLHSSLTQHLHGGSRQQRYSATKWDVAIAMTIAGFVNLVMMATAAAAFHFSGHTGVADLDEAYLTLQPLLSHAAATVFGLSLVAAGLSSTVVGTLAGQVVMQGFIRFHIPLWVRRTVTMLPSFIVILMGLDPTRILVMSQVLLSFGIALALVPLLIFTSDSKLMGDLVNSKRVKQTGWVIVVLVVALNIWLLVGTALGL

SEQ ID NO: 60927 - protein, 431 aa, Clostridium difficile 630
MKIAIAGTGYVGLVTGVCLAEVGNENVVCVDVDEQKVKSMKLGIAPIYEEGLEELMVKNYNRGRIDYTTDYKKAYEDVDVILIAVGTPERSDGSANLDYIKAVAKQIAETVTKDTLVVIKSTVPIGTNEEIEDYINRNLKNDVKVELASNPEFLSQGTAVKDTLHASRIVIGVESEWAREILEEIYKPFNQPIIVTNRNSAEMIKYASNNFLALKISFMNDIANLCEIAGANIEDVALGMSYDDRIGSKFLKAGIGYGGSCFPKDTKALHWLSEHNGYELKTVKAAIEVNESQKLKLVRKASKLVESFQDMKVAVLGLTFKPDTDDIREAPSIPNIKYLLERGARVTVYDPIGVNNTKKIFGDSILYADSVDDAIEDAEICFIMTEWKDVLNYDIHKYKEKMKNPLVLDGRNCYKIKDMEELGIEYYSIGR

SEQ ID NO: 60928 - protein, 117 aa, Buchnera aphidicola
VHEENILKIYVPGTYEIPTIASYIAKSGKYDAIIAIGTIIKGQTDHFKYIANDTSSSLSRISAQYFLPITLGILTTKNIEQSIERSGTKMGNKGSDAALAALEMINVMKKLKKVIYY

SEQ ID NO: 60929 - protein, 185 aa, Shigella flexneri 2a
ADERPGKINLGIGVYKDETGKTPVLTSVKKAEQYLLENETTKNYLGIDGILEFGRCTQELLFGKGSALINDKRARTAQTPGGTGALRVAADFLAKNTSVKRVWVSNPSWPNHKSVFNSAGLEVREYAYYDAENHTLDFDALINSLNEAQAGDVVLFHGCCHNPTGIDPTLEQWQTLAQLSVEKGW

SEQ ID NO: 60930 - protein, 233 aa, Listeria monocytogenes str. 1/2a F6854
MTKEKVLWGYDEKTGPEMWGHICSDFEIAHTGKAQSPVNIEQADVVKLKPSTMKFYYKETDYTIRRIEQSVHVFPHDKEQGLRFNGEYYPLVSFHAHIPAEHLLDGYMYPIEWHFVHEKPDGTTLVMSAWMDIDNTNNVEFKNLPTYFPEVFADFETEREITLDVNEFMPEERVFYTYQGSRTTPPTVEGVTWIVLKNAKTLGQEDFTEFEKAIGNTSRPVQDLNGREITFYN

SEQ ID NO: 60931 - protein, 485 aa, Solanum lycopersicum
MGFEIAKTNSILSKLATNEEHGENSPYFDGWKAYDSDPFHPLKNPNGVIQMGLAENQLCLDLIEDWIKRNPKGSICSEGIKSFKAIANFQDYHGLPEFRKAIAKFMEKTRGGRVRFDPERVVMAGGATGANETIIFCLADPGDAFLVPSPYYPAFNRDLRWRTGVQLIPIHCESSNNFKITSKAVKEAYENAQKSNIKVKGLILTNPSNPLGTTLDKDTLKSVLSFTNQHNIHLVCDEIYAATVFDTPQFVSIAEILDEQEMTYCNKDLVHIVYSLSKDMGLPGFRVGIIYSFNDDVVNCARKMSSFGLVSTQTQYFLAAMLSDEKFVDNFLRESAMRLGKRHKHFTNGLEVVGIKCLKNNAGLFCWMDLRPLLRESTFDSEMSLWRVIINDVKLNVSPGSSFECQEPGWFRVCFANMDDGTVDIALARIRRFVGVEKSGDKSSSMEKKQQWKKNNLRLSFSKRMYDESVLSPLSSPIPPSPLVR

SEQ ID NO: 60932 - protein, 406 aa, Caulobacter crescentus CB15
MSTDFHRIRRLPPYVFEEVNKIKARLRAEGTDIIDFGMGNPDMPTPQHIVDKLIETARDPKAGRYSASKGVPGLRKAMANYYGRRFGVKLNPDTEVIATLGSKEGFANLAQALTGPGDVIICPNPAYPIHAFGFIMAGGIIRHVPALSPEEYLSNISRAVKHSVPPPSVLILSYPSNPTAQWVDLDFYKDAVALAKKHDLLVISDVAYGEIYFDNNPPPSILQVDGAKDIAVEVNSLSKTYAMAGWRVGMVVGNARICAALARVKSYLDYGAYTPVQVAAATALNGPQDCVDEIRGIYKSRRDTLIKSMKAAGWDIPNPPASMFAWAKIPEAYREAGSMLFSRLLIEEAGVAVAPGIGFGEYGEGYVRIGLVENEHRIRQAARNVKKFIANADSILAKAHNKMEQA

SEQ ID NO: 60933 - protein, 491 aa, Nicotiana tabacum
MGFENEKNSSILSKLATNEELGENSPYFDGWKAYDNDPFHPLKNPNGVIQMGLAENQLCFDLIEEWIKRNPNASICTTEGIKSFRAIANFQDYHGLPEFRSAIAKFMEKTRGGRVTFDPERVVMAGGATGANETIIFCLADTGDAFLVPSPYYPAFNRDLRWRTGVQLIPIPCDSSNNFQITTKAVREAYENAQKSNIKVKGLILTNPSNPLGTTLDRDTLKNLLTFTNQHNIHLVCDEIYAATVFNTPQFVSIAEILDDETSHCNKDLVHIVYSLSKDMGLPGFRVGIVYSFNDAVVNCARKMSSFGLVSTQTQYLLAEMLSDERFVSNFLTESSKRLAKRHKHFTNGLEEVGIKCLRSNAGLFCWMDLRPLLKESTFDSEMSLWRVIINDVKLNVSPGSSFDCQEPGFFRVCFANMDDETVDIALARIRSFVGVKKSGDESTPILMEKKQQWKKNNLRLSFSKRMYDESVNLSPLSSPIPHSPLVRART

SEQ ID NO: 60934 - protein, 336 aa, Caulobacter crescentus CB15
MGRSAFGSRTRMTAFVDLAARLAAEPADAALKDVVLTIAETCAQISRVVASGALSGSLGAAGSTNVQDEEQKKLDVITNDMLSDALKACGPVAGLASEELEEVEPTGRVGGYLVTFDPLDGSSNIDVNVSVGTIFSVLPAPAGHAPTEGDFLQPGRNQVAAGYAVYGPQTMLVVTLSGGVNGFTLSADGRWLLTHPDLAIKPDTAEFAINMSNQRHWAPAVRRYIDGCLQGKDGARGKNFNMRWVASMVADVHRIMMRGGVFMYPWDAREPDKPGKLRLMYEANPMSLLAERAGGKSIEGLNEILDINPAKLHQRVPVVLGSANEVEVIRAEMRAG

SEQ ID NO: 60935 - protein, 724 aa, Glycine max
MALPKVDFEVGADGVAVITMCNPPVNALAIPIIMGLKNRFDEAARRNDVKAIVLTGKGGRFSGGFDISVMQKVHRTGDSSHLPDVSVELVVNSIEDSKKPVVAAVAGLALGGGLELAMGCHARVAAPRAQLGLPELTLGIIPGFGGTQRLPRLIGLSKAVEMMLTSKPITSEEGRKLGLIDAIVSSEELLNASRLWALEIGERCKPWVRSLHRTDKIGSLSEAREVLRTARQQVKKTVPHLPQQLACVDVIEHGIVHGGYSGVLKEAEVFKQLVVSDTAKGLINVFFSQRAISKVPGVTDIGLKPRNVKKAAVIGGGLMGSGIATALILGNIRVILKEINSEFLLKGIKTIEANVNGLVRRGKLTKQKADAALSLLKGVLDYSEFKDVDLVIEAVIENISLKQTIFGDLEKICPPHCILASNTSTIDLDVVGKTTSSQDRIAGAHFFSPAHIMPLLEIIRTDKTSAQVILDLITVGKIIKKTPVVVGNCTGFAVNKTFFPYSQGAHLLVNLGVDVFRIDTLIRNFGFPIGPFQLQDLAGYGVAVATSKVFADAFSDRIFKSPLLDLLIKSGRNGKNNGKGYYIYEKAGKPKPDPSILPIIEESRRLCNIMPNGKPISVTDQEIVEMILFPVVNEACRVLEDGVVIRASDLDIASVLGMSFPNYRGGIVFWADLVGANHIYTSLKKWAQLYGNFYKPSRYLEERALKGIPLSAPASSTPKSMARL

SEQ ID NO: 60936 - protein, 468 aa, Escherichia coli
MSKQQIGVVGMAVMGRNLALNIESRGYTVSVFNRSREKTEEVIAENPGKKLVPYYTVQEFVESLETPRRILLMVKAGSGTDSAIDSLKPYLDKGDIIIDGGNTFFQDTIRRNRELSAEGFNFIGTGVSGGEEGALKGPSIMPGGQKEAYELVAPILKQIAAVAEDGEPCVTYIGADGAGHYVKMVHNGIEYGDMQLIAEAYALLKGGLTLSNEELAQTFTEWNEGELSSYLYDITKDIFTKKDEEGKYLVDVILDEAANKGTGKWTSQSSLDLGEPLSLITESVFPRYISSLKDQRVAASKVLSGPQAQPAGDKAEFIEKVRRALYLGKIVSYAQGFSQLRAASDEYNWELNYAEIAKIFRAGCIIRAQFLQKITDAYAQNAGIANLLLAPYFKQIADDYQQALRDVVAYAVQNGIRVPTFSAAIAYYDSYRSAVLPANLIQAQRDYFGAHTYKRTDKEGVFHTEWLE

SEQ ID NO: 60937 - protein, 212 aa, Coccidioides immitis RS
MSNPSATTQTNREQSDVSSKVPGHPSTTSASSSELASLKIRLQNALRQFPDFPSPGIIFLDILPIFADPSLHEDLIRSLELHVLETYGDQKPDVIVGLDARGFLFGPSLALRLGASFVPVRKKGKLPGPVETQVYEKEYGSDHFEMQAGAIKPGQKVIVVDDIIATGGSASAAGNLVQKLGGNLLGFVFMLEIDFLKGRAKLHAPVYTLLSS

SEQ ID NO: 60938 - protein, 245 aa, Wolbachia endosymbiont of Drosophila simulans
MIILSNLSCYAVFGIELEFYIEGIEKEYLFLNSIKNKIASLEFSCEKENSTHQYEIKSGCYTNSYNLIKHFELAKQSLTETAQKLGGNVSFKAKPYLDRAGSALNVHVNLVNSNNGNLFYINEQKYSDYLIHSIGGLCAMMKKHMLFFAPNDDSYLRFQYPDIHTPTTISWGVNNRTAAIRIPYFGNDFKRCRLEHRVPGADCDLEKVLTAIIEGMVFGIENKIAPPNRVYGIASDPQYEMERLI

SEQ ID NO: 60939 - protein, 330 aa, Emericella nidulans
MDCPIPQTELDEIYAFATDLARKAGQLLLERVNDRNSEQVYAEKENAVDLVTQTDEDVESLIKTAIQTKYPAHKFLGEESYAKGQSREYLIDEQPTWCVDPLDGTVNFTHAFPMFCVSIGFIVNHYPVIGVIYAPMLNQLFSSCLNRGAWLNEMQQLPLIRKPSIPPLPATAPSKCIFACEWGKDRRDIPDGTLQRKIESFVNMAAERGSRGGKGGMVHGVRSLGSATMDLAYTAMGSVDIWWEGGCWEWDVAAGIAILLEAGGLVTAANPPEDIEGPIEPVKLGSRLYLAIRPAGPSETETGRETQERTVREVWRRVRQLDYERPTRQS

SEQ ID NO: 60940 - protein, 625 aa, Vitis vinifera
METLRREAVLCFVAFLCLWNSASSLLSPKGVNFEVQALMSIKNSLIDPRSVLENWDKDAVDPCSWNMITCSDDKLVISLGTPSQNLSGTLSPSIGNLTNLQTVLLQDNSISGPIPSELGKLSKLHLLDLSNNFFNGEIPTSLSHLKSLQYLRLNNNSLSGAIPSSLANMTHLAFLDMSYNNLSGPVPGFAARTFNIVGNPLICPTGTEKDCFGRPTPLPVSISMNNSQSSQPSARPKSHKVALAFGSSLGCICLLILGFGFLLWWRQRHNQQIFFDVNEQYREEVCLGNLRRFPFKELQIATNNFSSKNILGKGGFGNVYKGYLQDGTVVAVKRLKDGNAIGGVIQFQTEVEMISLAVHRNLLRLYGFCMTTTERLLVYPYMSNGSVAYRLKAKPALDWSTRKRIALGAARGLLYLHEQCDPKIIHRDVKAANILLDDYCEAVVGDFGLAKLLDHRDSHVTTAVRGTVGHIAPEYLSTGQSSEKTDVFGFGILLLELITGQRALEFGKAANQKGAMLDWVKKIHQEKKLDMLVDKDLKANYDRIELEEMVQVALLCTQYLPSHRPKMSEVVRMLEGDGLAEKWEATQRAEATRCKANEFSSSERYSDLTDDSSLLVQAMELSGPR

SEQ ID NO: 60941 - protein, 518 aa, Coprinopsis cinerea okayama7#130
MLLLSSLLIAQFVPRALGAIGPNSNLYVANKDIAPDGFTRSGVLVGTNANNLAFPGPVIRANKNDHYNLNVIDELTDPTMLRTTSIHWHGFFMNGTAWADGPAGVTQCPIAPGHSFRYKFQAKNQAGTFWYHSHHLSQYCDGLRGVMVVYDRHDPHRHLYDVDNEQTIITLADWYHTPAPSAGLVPTPDSTLINGKGRYVGGPMVPLSVIHVRRGRRYRFRLVSLSCDPFYTFSIDGHSMTIIEADGISTEPLIVDSIQIFAGQRYSFVLNANRPVDNYWVRANPNLGDIGYAGGINSAILRYVGAPNAEPTTTESPSLNPLLETNLHPLHSPAAPGNPTPGDVDVAINLDVVFDFASLKFQVNGATFDEPPLPVMLQIMSGAHTPQDLLPAGGVYTLPKNAVVELSMPGGSVGSPHPMHLHGHAFSVVRSAGSSTYNFVNPVQRDVVSIGQAGDNVTIRFRTDNSGPWILHCHIDWHLVLGLSVVFAEDVPTIAASNPPPAWHDLCPIYEELPPGTR

SEQ ID NO: 60942 - protein, 387 aa, Coprinopsis cinerea okayama7#130
MHPHLRPLLVALTSSFALQNFAAAALTTPRAIHSKDTMFISNIRASPDGFERPVIAVNGHHPALLIKAKKGDEFELTVANHLTEETMLRQTSIHGIFQHKSSWADGPEGVTQCPVAQFGNSFTYKFNAGNETGTYWYHSHFETQYCDGLRGPLVIYDDNDPYRNDYDVDNEDTIITLADWYHLQAPSINTTIAPPVNATLINGKGRQPVKPDSPLAIVNVKQGKRYRFRILSLSCDPNYNFSIDGHDLTVIEADGQLTRKLVHPFHLRGHAFSVIQSAGSPNKNYIDPVRRDVVSIGDPDRKENVTIRFVTDNPGPWFFHCHIEFHLSGGLGAVFVEDQKDIKSSDRAPPPSWSELCPTFDALPTNATFVSTVATPTAPTAPTNIPF

SEQ ID NO: 60943 - protein, 305 aa, Zea mays
  misc_feature (42)..(42): Xaa can be any naturally occurring amino acid
GRGTSSPNISGPGVSSPPPPPSPNVPSPSPRRRHRCCRALPXLTAPPCASDPNDERCLTHLHQSLSDSSGRLNWTKAAISAPCDGFFSHLQGVTCNNGRVYKLALPDLSLGGTVPPELSNCTNLQSLDLSANALSGAIPTELSALLNLAVLNLSANALSGAIPRELASCAYLNVIDLHGNQLSGPIPDELGLLVRLSAFDVSHNRLSGPIPVLLANRTGAGTAAVGTARFNASSFVGNKGLYGYPLPPMRTRGLSVLAIAGIGLGSGLLSLVLSFSAVCLWLRATDRTATISGEEGKISQLMPDY

SEQ ID NO: 60944 - protein, 526 aa, Coprinopsis cinerea okayama7#130
MVSLSSSFKFLSQFALFSAVLAADVYYTFDIVNANLAPDGFTRPTVVVNGQFPGTLIQANKDDVLHITVNNLLTNPLMRRSTAIHWHGLFQKKTASEDGPAGVTQCPISPGHSYTYDIPLNGQAGTHWYHSHLSSQYVDGLRGPIVIYDPTDPHLSLYDEDDENTIIQLGDWYHNPAPAIQEDYLNDITDEPVPDSGTINGVGRYRGGPAIPWARVNVVQGKRYRLRVINNSAYGSFEFSIENHELTIIEVDGINHVPKTVGGFEIYAGQRYSVVIDANKPIRNYWIRAPMDVKDDSPTLDDENIYAVLHYEGAPNANPTTRADRSPSNVLKEHELVPLDPGPPGGCGPADKIIDLQYSRDTSGTTKWKFNGVRYHSPTDNTLLNIMGGATIASDFTPSEHTLILNHNDIVEIHLHGSSNGHVHPFHLHGHAFDIIQGRSGGSNCVNPPRRDVVGLTSGTGIIRFKADNPGPWFLHCHIDWHLEAGLAVVFAEAPDEQRTGPQSQIIKQEWLDLCPIYNALSPDLQ

SEQ ID NO: 60945 - protein, 290 aa, Juglans nigra x Juglans regia
MDQYEKVEKIGEGTYGVVYKARNRKTNQTLALKKIRLEQEDEGVPSTAIREISLLKEMQHGNIVKLQDVVHGEKRLYLVFEYLDLDLKKHMDSSPEFANDLRQIKMFLHQILRGIAYCHSHRVLHRDLKPQNLLIDRRSNSLKLADFGLARAFGIPVRTFTHEVVTLWYRAPEILLGSRHYSTPVDVWSVGCIFAEMVNQRPLFPGDSEIDELFKIFRVLGTPNEDTWPGVTSLPDYKGAFPKWPPKDLAAVVSSLDSTGVDLLSKMLSLDPSRRITARTALEHEYFKDI

SEQ ID NO: 60946 - protein, 530 aa, Coprinopsis cinerea okayama7#130
MFSFISSKLALLVQLALASTTFAAHVNYTFNIVNANLAPDGFTRPTVVVNGQFPGTLIQANKDDILHITVNNQLTNPLMRRSTAIHWHGLFQRQTASEDGPAGVTQCPISPGHSYTYDIPLNGQAGTHWYHSHLSSQYVDGLRGAIVIYDPDDPHKSLYDEDDANTIIQLGDWYHKPAPGIQAAYLADRTDEPVPDCGTINGVGRYVRGPRLPWSRINVVRGKRYRLRVINISAYGSFEFSIENHPVTIIEVDGINHVPKTVGGFEIFAGQRYSVVLNANQPVRNYWIRAPMDVKGDSDNDNLDDELIYAVLHYDGAPNADPTTRADRDADNMLREHELVPLDNPGVPGGTGPADRVIDLQYSRSTSGGTKWTFNGIQYHSPNTNTLLKVMAGATIASDFTPSEHTIILNHNETVELRLHGSSNGHVHPFHLHGHAFSVIKGESGPENYVNPPRRDVFGIKSGTGIIRFRTDNPGPWFLHCHIDWHLEAGLAVVFAEAPDQIRDGPQAQVIKQEWLDLCPIYNALPPELQ

SEQ ID NO: 60947 - protein, 402 aa, Aspergillus oryzae
MCSLPEKFTVDSHSLTYGDGFSGSHRLRDTIARFITRYFNPVNPVIKTSFLSPLAWARQLSFPGSVSWTKMTASCLRARTMGKAKIIGVSFGEMDPFGPETVGIYEKALADAQRQGIRVKAVLLCNPQNPLGRCYTREVLEAYMRFCQKQNLHLIADEIYALSTWKNPDFPNAPSFTSVLSVKKDGLIDPSLVHALWGMSKVRASAMLFWWDILTLDFGSNGIRLGCVISQDNVNFLRAAEANSYFSCPSSLSDLATSRILSDDAWVQSFIQTNRQRLAENYTITIRFLESHQIPYKKGGNVGFFVWVDLFDPIRRQVNATLKKQAEANVSSENAARALETKLQEKLLKHRIFLALGADFGGDVPGWYRIVFAHEKEYLRLGLNRMINALGVFREELDTGLA

SEQ ID NO: 60948 - protein, 357 aa, Clostridium difficile 630
MKVYNVIMAGGGGTRFWPLSRQEVPKQLINLSGEDALINETINRIDSLAKKDDLFIVTNEKQLEALKDIVKDKCLDSNILPEPCARNTAAAIGFAAFNIMKKYGDGVMCVYPADHYIKDEKEFKSILEKAIYIAENNDKLVTIGITPTFPSTGYGYINFNRENTIEDVAYEVVEFVEKPNYEIAKEYVNSKKYVWNSGMFVWKVSKILEDFKRYLPKVYEKLEDISKYLGTKEEMEKIKEIYPTIQSISIDYGIMERSNDVIVVPGDFGWNDVGSWDSLGAIYPTDDEGNIKRGENITIDTKNSIIYSDDKLISTIGISDLIVVSTNDAVMVCRKDKAQDVKKIVEQLKEEDRQEYM

SEQ ID NO: 60949 - protein, 323 aa, Shigella flexneri 2a str. 301
MSKIFEDNSLTIGHTPLVRLNRIGNGRILAKVESRNPSFSVKCRIGANMIWDAEKRGVLKPGVELVEPTSGNTGIALAYVAAARGYKLTLTMPETMSIERRKLLKALGANLVLTEGAKGMKGAIQKAEEIVASNPEKYLLLQQFSNPANPEIHEKTTGPEIWEDTDGQVDVFIAGVGTGGTLTGVSRYIKGTKGKTDLISVAVEPTDSPVIAQVLAGEEIKPGPHKIQGIGAGFIPANLDLKLVDKVIGITNEEAISTARRLMEEEGILAGISSGAAVAAALKLQEDESFTNKNIVVILPSSGERYLSTALFADLFTEKELQQ

SEQ ID NO: 60950 - protein, 181 aa, Shigella dysenteriae
INLGIGVYKDETGKTPVLTSVKKAEQYLLENETTKNYLGIDGIPEFGRCTQELLFGKGSALINDKRARTAQTPGGTGALRVAADFLAKNTSVKRVWVSNPSWPNHKSVFNSAGLEVREYAYYDAENHTLDFDALINSLNEAQAGDVVLFHGCCHNPTGIDPTLEQWQTLAQLSVEKGWLPL

SEQ ID NO: 60951 - protein, 176 aa, Shigella dysenteriae
INLGIGVYKDETGKTPVLTSVKKAEQYLLENETTKNYLGIDGIPEFGRCTQELLFGKGSALINDKRARTAQTPGGTGALRVAADFLAKNTSVKRVWVSNPSWPNHKSVFNSAGLEVREYAYYDAENHTLDFDALINSLNEAQAGDVVLFHGCCHNPTGIDPTLEQWQTLAQLSVEK

SEQ ID NO: 60952 - protein, 129 aa, Brassica napus
MEPPKDQPPSSAYPPSGSCNNCGGPTISEPAPQASLPDMSPPPNYRPIRAPAINVPHNPQAIILSPVPHAEKVPVVTPPYQFQRPVKRIHSPDDIRRFQESASFKNFLGFVVSLSESIDGHKIADPCHV

SEQ ID NO: 60953 - protein, 163 aa, Burkholderia xenovorans LB400
MRHIISVLLENEPGALSRVVGLFSARGYNIETLTVAPTEDRSLSRMTIVSIGSDDVIEQITKHLNRLIEVVKVVDLTEGAHIERELMLIKVRAVGKEREEMKRMSDIFRGRIIDVTEKTYTIELTGASDKLDAFIEGIDATAILETVRTGSSGIGRGERILKV

SEQ ID NO: 60954 - protein, 185 aa, Shigella dysenteriae
RPGKINLGIGVYKDETGKTPVLTSVKKAEQYLLENETTKNYLGIDGIPEFGRCTQELLFGKGSALINDKRARTAQTPGGTGALRVAADFLAKNTSVKRVWVSNPSWPNHKSVFNSAGLEVREYAYYDAENHTLDFDALINSLNEAQAGDVVLFHGCCHNPTGIDPTLEQWQTLAQLSVEKGWLPL

SEQ ID NO: 60955 - protein, 184 aa, Shigella dysenteriae
ADERPGKINLGIGVYKDETGKTPVLTSVKKAEQYLLENETTKNYLGIDGIPEFGRCTQELLFGKGSALINDKRARTAQTPGGTGALRVAADFLAKNTSVKRVWVSNPSWPNHKSVFNSAGLEVREYAYYDAENHTLDFDALINSLNEAQAGDVVLFHGCCHNPTGIDPTLEQWQTLAQLSVEKG

SEQ ID NO: 60956 - protein, 227 aa, Gossypium hirsutum
MSTSLSVTELQVENFTFPPTVKPPGSTKTLFLGGAGERGLEIQGKFIKFTAIGVYLEDSAVNCLGVKWKGKSAVELTESVEFFRDVVTGDFEKFIRVTMILPLTGQQYSEKVSENCVAIWKSLGIYTDAEAKAIEKFIEVFKDENFPPGSSILFTISGQGSLTIGFSKDSSVPEGGKVVIENKLLANSVLESVIGKNGVSPAAKESLASRLSPLFNDCGADSEKPQS

SEQ ID NO: 60957 - protein, 171 aa, Triticum aestivum
  misc_feature (96)..(96): Xaa can be any naturally occurring amino acid
  misc_feature (130)..(130): Xaa can be any naturally occurring amino acid
  misc_feature (137)..(137): Xaa can be any naturally occurring amino acid
  misc_feature (157)..(157): Xaa can be any naturally occurring amino acid
AAGLDSEHWISRLAAAKRFYAAQLGHADRAGMDELDMDGDENAGRPDFACPYCYEDHDVASLVAHLEEDHPFEPHAAPCPICSEKVSKDMLNHITXQHGYLFKNRRRLRRFAVPGSQSLSLLSRDLREAXHLQVLLXGGGGHRSSNNNAPNIPADPXLLPSLGLTFPTLDA

SEQ ID NO: 60958 - protein, 110 aa, Ehrlichia canis str. Jake
MVSVMIEQISDSDFHSKVISCNEDILILVDFWAPWCGPCKTLEPQLEKLAQQYAEQVKIYKLSIEDNQDVAIQYGVSAVPTTLMFKNGKKLSQVIGADIAKIINELNNHI

SEQ ID NO: 60959 - protein, 292 aa, Nicotiana tabacum
ASTCSTSSLYLFTQKPKFSVEHLSLSTYNAHFNFKINSTKLKAHFPISSLYRSSIFLSTCASVSDGVEVVQEDDEEEVALSAEEEEEIEEKEESVESESVEGGRLYVGNLPFSMTSSQLSEIFAEAGTVANVEIVYDRVTDRSRGFAFVTMGSVEEAKEAIRLFDGSQVGGRTVKVNFPEVPRGGEREVMSAKIRSTYQGFVDSPHKLYVANLSWALTSQGLRDAFADQPGFMSAKVIYDRSSGRSRGFGFITFSSAEAMKSALDTMNEVVRIHSDEVSWRPFGISLFLTVL

SEQ ID NO: 60960 - protein, 932 aa, Oryza sativa Indica Group
MPRRSASRYAAYWAADALAGDDALDFSLTKALVGVSPDSLTGAPEAVRERVALRCLQEVVSLASDGDYEATPTAGGVLSVDASRSCEDSLLQLIREIGSSGSLEKVMLLPFSQDVQKFICIKRPTLPETSFELLREVYPEITPVVLPSPVEQNGNDQHDNVSHDLENTEKTGFNTDGAQLQQDDLANLVNESNTGNLQKDAMATPDFHQPCTSENRCFDQPQEDSINAVGVNIRSPKDSPTNVDRHIQVAAEPSLATSADLLGSNTGTISEQDMIDDTTMVQSQSQGVKNPNTLHYNNGDEPLVASIQSPKDSIHEGLTIQATVSPAFDRSNDALPASTSEISQLPEFITARDTVMNSEPRINKSHPNSPKHDTVDKANQDVDYGSVGIQKAAAFLSEDRNGATQGEKSEIKDPPENTAEHTKMFEQENSVEAQLEVGCSDKVNQDIQDDGNIMTKNMVCDGLNVQTAPEPHSCRMALHNKNLVANHLSEQNIGRNTTAVEKDCCSIPTSPQVVNDTRVKQPSNKRTMGNTVVETSHVHSSDDSLSGFAATGLLSMADKIPFCTQDQDANGPVEGLSEQDLCIKCGKDGQLLKCSSCLLAAHDTCFGSLATLDDSGQLYCPVCFYTKATEAYQKAKKTYSEARKNLSAFLGRKQLAEQHQQAAVGQRAANNEDHLNGCNDASKRKDNHQSEGNNLSHRDEDPTRKRKKQKTNATSDACAQEVVTEKNNRKQAQVAEHEQPEENEEASGESGNDNSLHKTTHSSQTKCSPAVNQNVDADKENGLASSQQSEDSDEIEATSSNDSTKKSSPPWRKLRHRKAIYQDKDTAMPSNSKKVHGNRDQHMASPSRKRNYACPPKRYSNPIVPAGRRTKLCWTEKEEITLREAMAKFTPRDNGPIPWVQILEHGRDVFHRTRLPSDLRVKWRNMKKKSGS

SEQ ID NO: 60961 - protein, 1832 aa, Podospora anserina
MYNPPGQRDATRPFHVPPPPPPMSPPPPTVGINNPMMTIPPPPPRHPNAPSTTGNVLLPPPPSGPPPNSGFPNSAIAPPSALGSTAPWHGAWGRAYDGRTAFNIPPPPPGGGAGGGGGGGSGGVLRAYDPKYHAQVLAAANNGATYTVPPPPPPQQQQQQQQQQQQQQQQQQQQQQQQQQQQQQQQQQQQQQQQQQQQQQQQQQQQQQQQQQQQSDQMGALTSATYIPQGDTYGEGVGIPGLGLEDSAIGWNMGAHLESATATPLDESSGRDRLYANAMAQRGSSTTSNATVSSVSVPPELAAQWPMEKVLGWLQANSFSSHWQETFKYLGLDGARFLELGSSHGGRGNFGMMHQQVYPRLLALSGPEWNQAREREEGKRMRRLVRSIVTGRPVEVKGGRLGGGQQQPQHARQNSTSAPPAVTGGQTGNRSAESPNVSVDDGFWDTGVTDADDGDKQTPNPIKIPEFGFSRRFSQSRATTMPTLSSTMPTDHRNMMKEIDTSRRHSPTLSESGEAGGTFRGGSTPLGGGGGGGGGGGRDSPSAGSPNPASGLFPSSTAGNLSASPHSSRFGHRSRNSTDSVSSSAAIYGSGVPADAAAMLKSGMNIADVVNAARNANDRRHAQDGGRPSPQESGGGDRSAGEPPGSAKGSGSFLSIFTRKKHGRKDDGFGGDEDSPTSPGLSFKPQSLGDNRPGSSAGTYGHHHAGNVRANRGGPRVFILATADCWNYRMLDVTDIETASDLRQLICINLGLPESEGAHLYPTELGKFEHDGEALDDSKLLAIKTQRADAIGTLKLFVRVGGPPQMRQTGAQIAMDEETYVKLNGRMRSSSSPPTSRQNTLTGKEGEDKMLTAEAIEYRTEQLRKQKEYLAKRKQVAENNHVADRSPSSSIVGRTVDFDQPRHSPFEDRKMDTLLPQRKPPAPPSDPSATLIKANSLKKTGHGLRLSGDSGYHPKRKTSSDLRSSGDVVFEKQKRWGPVADPSAGIGALLVGMSDGMASIARPRPGGGMMQQRQPSPHRVATEPITSQELQRGKKAMSTVNFGPAHQRERSGSGGGSPRPGGMPGSPGSYTWSSKNVPFLVPDYSPNGTPAPPTASRMPDGGGNSGDGCLDQNHNHQAQNGTIAKMRNVARAPSPGNVSPSSRRRPSDSFSSQAAVAKKRKSHGPDTDFTDNDVTFSASSTRASKKVDDSDSDDDSDDGLFAIPIAARNSGPDKGKTTAPAEGNSGDSDGASGTGTGKRPSLRLNTRSGSNSRAKKTLSVAFAVSPQSSSAGGKTPLEDDDSGRSSSQRRGTPGTPQSEGGWDSEEKDSKISRRKSFIEKDVWANRPPTDALVNNLEDFFPDLDVDQPVLEEGVDQEPPSPIAEGDENNQGSASVPPLPPLPPGLSTGKLHTFYNDNDTLGSDESTLKALESRPVSMQSLAHRSIRRSGGGGGLGRMKSIREVARGANEFGKRYTQGPGQIDAQSSAAAAGNRNTNLMRRKSTKMFNANIVQIQPDRGSLNLAMGGLTTIPQDSLPTRSTNSRESIPKRQTTFRWFKGQLIGKGTFGRVYLGMNATTGEFLAVKEVEVNPKAAQGDKKKMQELVAALDQEIDTMQHLDHVNIVQYLGCERKETSISIFLEYISGGSIGSCLRKHGKFEEPVVASLTRQTLSGLAYLHREGILHRDLKADNILLDLDGTCKISDFGISKKTDNIYGNDKTNSMQGSVFWMAPEVIRSQGEGYSAKVDIWSLGCVVLEMFAGRRPWSKEEAVGAIYKIANGETPPIPEDIREVISPVAIAFMLDCFTVVSSERPTADVLLSQHPFCELDPTYSFLDTELYAKIAGRVNDLGRGQ

SEQ ID NO: 60962 - protein, 315 aa, Acidobacteria bacterium Ellin345
MAQTYACTQARFSVSDCYTSCFMLKETLEQGRILADAALERLLPPGTQRPPSIHQAMRHSVFAGGKRLRPILVMEAARMITGSLPDGVDELGAALEMLHTYSLIHDDLPALDNDDLRRGRPTCHVAFGEATAILAGDALQTYAYEVMARLRTTAEARVQIIEEVAHATGTIDGMIGGQVLDLEAEHTHADAATVEYIHRSKTGALITASVVAGGLYAGADKAQVQRIREFGKSAGLAFQIVDDVLDVTQTSEQLGKTAGKDTKSEKSTWPSLYGVDKSLEMADELVYTANKRLDSFGERATTLKELAKFLVERKK

SEQ ID NO: 60963 - protein, 308 aa, Vitis vinifera
MGLLESAASINWEHESFPEYGDFVALPVFAFFFFSVRFFLDRFVFQKLGRILIFGKGGQQLDVGVDEKRKKLRKFKESAWKCVYFLSAELLALSVTYDEPWFTNTKYFWVGPGNQVWPDQQIKLKLKGLYMYCGGFYTYSIFALIFWETRRSDFGVSMGHHVATFILIVLSYIFRFARVGSVVLALHDASDVFLEVGKMSKYKGAETTASISFILFVLSWIVLRLIYYPFWILRSTSYEVILTLDKEKHAVEGPIYYYLFNTLLFCLLVLHIYWWVLMYRMLVKQVQARGQLSDDVRSDSEDEDEHED

SEQ ID NO: 60964 - protein, 280 aa, Vitis vinifera
MVHNGIEYGDMQLIAEAYDVLKSVGKLSNEELRNVFSEWNKGELLSFLIEITADIFSIKDDKGDGFLVDKVLDKTGMKGTGKWTVQQAADLSVAAPTIASSLDARFLTAKVFKSSGFENKKLIDDVRQALYASKICSYAQGMNLIRAKSIEKGWDLKLGELARIWKGGCIIRAIFLDRIKKAYDRNADLANLLVDPEFAKEIVERQSAWRRVVCLAINSGISTPGMSSSLAYFDSYRRDRLPANLVQAQRDYFGAHTYERIDTTGSFHTEWFKIAQQSKI

SEQ ID NO: 60965 - protein, 236 aa, Oryza sativa
MATDGHITHFAHPQHLLLKTRYDSTSRHVCDICRAKLSGLVGYRCNACDFDIHQACADYFKKTISFFAHPWHTLTLSSIPDGSTTWSCDLCRENCPRGNFVYRCIQCAFDVHPLCILLPQTIRSPLHQQHDIHMVPSWGRCSACREDLDLWYYQCGFCLFKLHIRCVSGAPSGVEPCTSNAAIRTTSDAQSIAIVRRSCSSGITKFLVKKSFMVAINLATGGLASPVLDVLEAVLD

SEQ ID NO: 60966 - protein, 252 aa, Azoarcus sp. EbN1
MSATNSTLNGAVALVTGASRGIGRAVALELGRLGATVVGTATSEAGAAEIGKSLREAGTEGCGLALDVTDGAACEAAVREVEKRFGAIGILVNNAGITRDNLALRMKDDEWEVVIDTNLKSVFRMSRLVMRGMMKARGGRIINITSVVGSAGNPGQANYAAAKAGVAGMSRALARELGSRNITVNCVAPGFIDTDMTRALPEAARDALLGNIALGRLGRPEEIAAAVAFLASPAAAYVTGTTLHVNGGMYMS

SEQ ID NO: 60967 - protein, 79 aa, Azoarcus sp. EbN1
MENIEQRVKKIVAEQLGVNESEIKTESSFVDDLGADSLDTVELVMALEEEFECEIPDEEAEKITTVQQAIDYVTAHLKK

SEQ ID NO: 60968 - protein, 309 aa, Oryza sativa Japonica Group
MDRYQRVEKPRPEAAVISENEIRITTQGLIRNYVTYATSLLQEKRVKEIVLKAMGQAISKTVAIAEIIKKRIPGLHQDTSISSVSITDVWEPIEEGLVPLEMTRHVSMISISLSPKELNKSSAGYQAPLHAEPIKPQRYQQTQQYQQQQHQSRPSQVQTDSYGRGRGRGRGRGRGWGGRGGYGGGYGGYDNNQGGYGGYGHQGGYGHQGGYGNQGGYGHNQGGYGGYGYNQGGYGGYENGGWNYNRNRGGGGGGGRGRGNWGYGGPGGYERSGPAYERGGRGGGSPGGRGYARGRGRMGGGRGRGNQNY

SEQ ID NO: 60969 - protein, 532 aa, Bordetella petrii
MNPNPASLPVPGRAALLETLNDNAAWDVIVIGGGATGLGTAVDAASRGYRTLLLEAADFAKGTSSKATKLVHGGVRYLAQGNIALVREALHERGLLNRNAPHLVWPLGFVVPAYGLFDQPFYGIGLKMYDMLAGKLNLSPSRWLSRAETLAQAATVAPSVAGRGLRGGVLYYDGQFDDARLAMALMRTLFDLGGTAVNYVRASGLTRNEKGAIDGVIAQDVLGGGEVTLRARCVVNAAGVWVDSVRRMDDAQAQTMVAPSQGVHLVLPREFLPGDKAILIPKTDDGRVLFVVPWNGHTLVGTTDTPRADLPLDPPATATEVDFILQTAARYLSRKPTRADVTSVWAGLRPLVKATGETKTLSREHTIVVSRAGLVTVTGGKWTTYRKMAQDVVDTAIQHQLLPQAGCRTADLPLHGAGGAPGPDAPAPGTPDSYYGSDLPTLRALPGSEHILVKASGLTEAHVRFAARHELARSAEDVLARRNRALFLDSQAALLAAPEVARILAEELGHDAAWQRATVEDFTRTAAHYRLD

SEQ ID NO: 60970 - protein, 303 aa, Triticum aestivum
  misc_feature (98)..(98): Xaa can be any naturally occurring amino acid
  misc_feature (124)..(124): Xaa can be any naturally occurring amino acid
  misc_feature (131)..(131): Xaa can be any naturally occurring amino acid
  misc_feature (139)..(139): Xaa can be any naturally occurring amino acid
  misc_feature (233)..(233): Xaa can be any naturally occurring amino acid
MLRSTHPLSPSSSSSAPASSSGETMVGGAPSGAKLLQILNVRVVGTGERVVVLSHGFGTDQSAWSRVLPYLIREHRVVLYDLVCAGSVNPDHFDFRPXNNNLDRLTWRTLLPILAPAPGFPRCXLVGHSVXSAMIGILXASIRRPDLFAKLVLIGASPRFLNDSDYHGGFELEEIQQVFQAMSANYEAWPKGYPPLAVGADVPAAVQEFTRTLFKCGRNFSFPVWQTVFKTDXSRGVLGLVQAPCVVVQTTRDVSVPANVAAYLKAHLGGRTTIEPLPTEGHLPHLSAPSLLAQVLRRALARF

SEQ ID NO: 60971 - protein, 274 aa, Listeria monocytogenes str. 1/2a F6854
MNLKDTVKLANGVEMPRLGFGVWKVQDGDEAVNSVKWAIEAGYISIDTAAAYKNEEGVGQAIKESGIKREDLFVTTKLWNAEQGYESTLAAFDESLRKLELDYVDLYLIHWPVKGKFKDTWRAFEKLYKDKRVRAIGVCNFHEHHLKELMEDAEIAPMVNQIELHPQLTQEPLRKFCAENNIVVEAWSPLGNGKLLSNPEIKAIADAHGKSVAQVILRWDLQIGVVTIPKSVHQERIIQNADIFDFELSEEEVAKISGLNKDERTGPDPDNFNF

SEQ ID NO: 60972 - protein, 263 aa, Zea mays
MAPAFSVSCAPGSSRPLAASPGPSVVVVASSQLPASSRSSERRRAPGLALAAAPGVGGRDGGGRWRAGISSFPFLPPFFTGNKGEKDAEKAMRLKEELLDAIAPLDRGAEATPEDKERVEQIVQQLEAVNQVKEPLKSDLLNGKWELLYTTSTSILQPQRPKYLRPFGKIYQSINADNLRAQNMETWPYFNQVTANLVPLNSRRVAVKFDYFKIFGLIPIKAPGSGKGELEITYLDEELRVSRGDKGNLFVLKMVDPAYRVPL

SEQ ID NO: 60973 - protein, 306 aa, Alkalilimnicola ehrlichei MLHE-1
MNKPSKIRHIATLERVSPTWRARVEQALDYWLPEAQTHPARLHQAMRYSALSGGKRLRPILVFATGQALGAAPTLLDGPACAVECIHAYSLIHDDLPAMDDDELRRGQPTCHKAFDEATAILAGDALQTLAFHILAHDPGGVQNSRARLRMVEVLALAAGSRGMAGGQAIDLAATGQQLDVAQLEDMHIHKTGALIRASVQLGALAASPVDEELLQRLDHYGKCIGLAFQIRDDILDVEGETEALGKARGSDQRQAKATYPALLGMREARETADRLVEDALESLEGLDQSADVLRGIAEYCIGRNH

SEQ ID NO: 60974 - protein, 403 aa, Oryza sativa Indica Group
MRVLPLALAAAIFSGVTAILVYLSGLSSYGGARVSDADLAALGALQSGFSKCVDANGLGLKAIPGEDYCRVVIQYPSDTDSKWKDPKTGEPEGLSFEFNLCEAVASWEQVRNSTTILTKEYIDALPNGWEENKCQNRTLCMEKLSLVLPETPPYVPRQFGRCAVVGNSGDLLKTKFGDEIDSYDVVIRENGAPIQNYTEYVGTKSTFRLLNRGSAKALDKVVELDETKKEALIVKTTIHDIMNQMIREIPITNPVYLMLGTSFGSSAKGTGLKALEFALSMCDSVDMYGFTVDPGYKEWLDQLVKIHSPMRGDPGRVVKWAPTKDTIEAARVASEKLLKRPGAGSEGPLSSCTMIKKREKGKTPKRSVVRHAALKHLEYMRGATRYPLERNAGGGYLCMINER

SEQ ID NO: 60975 - protein, 219 aa, Vibrio cholerae O1 biovar eltor str. N16961
MFGCITMSENNQCVIVGIAGASASGKSLIASTIYNELRAKVGDHQIGVITEDCYYKDQSHLSMEERVKTNYDHPSALDHDLLCQHLQMLARGEAVEVPEYSYTEHTRTEQTTTMTPKKVIILEGILLLTDPRLRDLMHATVFMDTPLDICLLRRVKRDVQERGRTMESVLKQYQETVRPMFMQFIEPSKQYADIIVPRGGKNRIAIDVLKAHIAKLLKS

SEQ ID NO: 60976 - protein, 183 aa, Shigella dysenteriae
GIGVYKDETGKTPVLTSVKKAEQYLLENETTKNYLGIDGIPEFGRCTQELLFGKGSALINDKRARTAQTPGGTGALRVAADFLAKNTSVKRVWVSNPSWPNHKSVFNSAGLEVREYAYYDAENHTLDFDALINSLNEAQAGDVVLFHGCCHNPTGIDPTLEQWQTLAQLSVEKGWLPLFDFAY

SEQ ID NO: 60977 - protein, 404 aa, Listeria monocytogenes str. 4b F2365
MGLVVLKFGGTSVSTVDKIGKTADQAIYEKKQGNKVIVVVSAMGKSTDKLVAMAEEISEAPDKREMDMLLSTGEQITIALLAMTLKEKGHDAISYTGWQAGIETEAVHSNARIADIDSARIESALDAGQIVVVAGFQGFTTDGEITTLGRGGSDTTAVAIASALNAVKCAICTDVVGVFTTDPRYVKKAQKLEQITYDEMLELANLGAGVLHPRSVEYAKNFRIPLEVRASHEQVPGTMIEEDLTMENTKVVRGIAFEDQITRVTIHWKQKEAMRVSKVFTKLAENNIDVDIIIQGITGLGHGNLSFTIKTSALLATLAVLEESKELLQIEKLESEQDLAKVSIVGSGMVSNPGVAAQMFEALTENNIPIKMISTSEIKVSTVVPARKMVEAAQVLHDQFELDK

SEQ ID NO: 60978 - protein, 282 aa, Picea sitchensis
MAKEGGKEVEQQGFAAKDYKDPPPAALFDVSEFKLWAFYRAIIAEFIATLLFLYITVATVIGHKRNQAACGSVGLLGIAWAFGGMIFVLVYCTAGISGGHINPAVTFGLFLARKVSLPRAVLYMVAQCLGAICGCGLVKAFQKSYYDQYGGGANSVAHGYTKGVGLSAEIIGTFVLVYTVFSATDPKRNARDSHIPVLAPLPIGFAVFMVHLATIPITGTGINPARSFGAAVIYGHQKIWDEHWIFWVGPFLGAAGAAAYHQYILRAGAIKALGSFRSNPHV

SEQ ID NO: 60979 - protein, 467 aa, Actinidia deliciosa
MKLLSRKAACNSHGQDSSYFLGWQEYEKKPYDEVRNPTGIIQMGLAENQLSFDLLESWLANNPEPAGFMRDGQSIFRELALFQDYHGLPAFKNAMVDFMSEIRGNKVSFDPKKLVLTAGATSANETLMFCLAEPGEAFLLPTPYYPGFDRDLQWRTGVEIVPIHCTSANSFQITDSALEEAYQSAQKRNLRVKGVLVTNPSNPLGTTLTRPELNLLLTFITSKNIHLISDEIYSGTVFSSPDFVSIMEVLKDSSHSTEVWNRVHIVYSLSKDLGLPGFRVGAIYSNDDVVVAAATKMSSFGLVSSQTQYLLASMLSDKNFTKHYISENQKRLKKRQEMLISGLQSAGIGCLKSNAGLFCWVDMRHLLSSKSFDSEMELWKKIVYQVGLNISPGSSCHCSEPGWFRVCFANMSEDTLDIAIQRIKTFVQTTNNNHSQRIHPSVKKSKRKSLTKWVFRLSFDGREPDER

SEQ ID NO: 60980 - protein, 186 aa, Ehrlichia canis str. Jake
MFIQIEETPNPNTLKFMPGVPVNNGKVSEFADNIAAESSPLAAALFKVEHVKGVFFGGDFVSITKSDEIEWDVLKPEVLTVIMEFLTLNPGDSTEDFNEEETDEFFDEKDVEMVDKIKELINDYVKPAVMQDGGDIKFKGYSNGIVFVKLRGACSGCPSASITLKEGIYNMLSYYIPDIQGVESVQ

SEQ ID NO: 60981 - protein, 395 aa, Bradyrhizobium sp. BTAi1
MHTGRHFLQIPGPTNVPDRVLRAMDMPTMDHRGPEFAELGFAVLAASQRIFRTKQPVIIYPSSGTGAWEAAIVNTLAPGDKVLMAETGQFAVLWRGIADKFKLDVDFISGDWRHGADIAAIEQRLVEDKAHKIKAVCIVHNETSTGCLTPPLEVRKALDRAGHPALLMVDTISGLGSMEYEHDAWGIDVSVAGSQKGLMLPPGLGFNAVSEKALAAAKANPGMRSYWDWQEIINFNKLGTFPYTPACNLLMGLNEALKMLEEEGHENVFARHRRHSLATRAAVKAWGLDTQCQDPQAHSPALTGVVMPEGHDADQFRKLVLEHFDMSLGTGLNKIKGKVFRIGHIGHFNDLMLMGTLAGVEMGLALANVPHRAGGVLAAMDVLKAREAAPISKVA

SEQ ID NO: 60982 - protein, 401 aa, Bradyrhizobium sp. BTAi1
MTRHQGRHFLHIPGPSPVPERVLRAMDMPVIDHRSAEFGELGKAVLSGSQKIFKTASPVIIYPSSGTGAWEAAIVNTLSPGDKVLMVETGHFATLWRQMAARWGVEVDFIPGDWRRGVDPAMIEEKLAADTAHQIKAVMVVHNETSTGATSRIGEVRAAMDRAKHPALLMVDTISGLASADFRFDEWKVDVAVSCSQKGFMLPPGLGFNAVSDRARAVAKTNKMPRSFWDWEDMLKLNANGFFPYTPATNLLYGLREAIAMLLEEGLDEVFARHQRLAAATRAAVQHWGLEVLCQEPRDYSPVLTAVLMPPGHDADQFRQVVLDNYNMSLGSGLSKVAGKVFRIGHLGECNELTLMAALSGVEMGLRVAGVPHRAGGVDAAMALLEQPMPGNAPRHLAVVN

SEQ ID NO: 60983 - protein, 231 aa, Ehrlichia canis str. Jake
MEERSKFVNQVFTSVASRYDLMNDIMSFGLHRLWKNKAIQGITSGRLLDVACGTGDIAIKVTKKTQNNVDIIVCDINPKMLRHGRDNAINANALNLKWVCGNAEQLPFSDNSFDYYTISFGIRNVSNRQLALNEAYRVLKQGGKFICLEFSPLKESHPLHKFYNFYSFSIIPNIGQLVAKDKASYQYLVDSISEFPYQEDFAQEIQNSNFVEIKYNNLCFGIVTLYTALKI

SEQ ID NO: 60984 - protein, 452 aa, Pseudomonas putida GB-1
MQDQSTPERLQRGLKNRHIQLIALGGAIGTGLFLGIAQTIQLAGPSVLLGYAIAGLMAFLIMRQLGEMVVEEPVAGSFSHFAHQYWSEFAGFVSGWNYWVVYVLVGMAELTAVGIYVQYWWPEFPTWATAAIFFVAINLINLTQVKVYGEMEFWFALVKVVAIVSMIGFGAWLLSSGHGGPDASVANLWQYGGFFPNGVSGLVMALAVIMFSFGGLELVGITAAEADNPRQSIPKATNQVVYRILIFYIGALAVLLSLYPWQKVVQGGSPFVMIFHELDSDLVATILNIVVLTAALSVYNSCVYANSRMLFGLASQGDAPRQLLKVSRSGVPLTALGVSAFATGLCVLINYLMPGEAFGLLMALAVSALVINWASISITHLKFRKAKLAAGIIPFYKSLGHPLTNYLCLAFIVLILVVMYLTPPIRISVMLIPAWIAVLWVAFKLKKARQAK

SEQ ID NO: 60985 - protein, 242 aa, Oryza sativa Japonica Group
MAAAGSIGVYRAVFAALGALMLGTLVYTCVTDGSPFRLELLTPWLVATLIDFYVNVTAISTWVIYKEVNWISSFFWVVLLYCFGSIATCAYVVVKLFEIKTSGPSQDPLDLLFLRQGDLSERKSSFVIIGRIIFSILGAMMAAVVIYTVITDGLPFRKDLLTPWMAATLIDFYINVFAISVWVAHKESNWISTAIWICLLICFGSITTCGYIVIQLFQVSYRDPIYHVLLNSHNKYGIVPSH

SEQ ID NO: 60986 - protein, 266 aa, Thermobifida fusca YX
MTVPDPRELLDLALEAARKGGALAARGQHGISVLDVKSSPTDVVTEMDRATEEMIRDVLLSARPDDAILGEEGGAAQGRSQVRWVVDPIDGTVNYLYGRAEWAVSVAAEVDGEVVAGVVEVPVLGRTYTAVRGEGAYRNGEPISVADPVDLSMALVATGFGYAAERRRKQAQVLGALLPKIRDIRRGGSAAIDLCTVAEGSVNAYYEQGVHPWDWGAGALIAEEAGARVAGLRGTPPNNAMLVAAPPGLFEPLHDLLVSLEADRDA

SEQ ID NO: 60987 - protein, 174 aa, Burkholderia vietnamiensis G4
MTIYKLGDTAPTIHESVFVADTAAIIGKVVLEQNASVWFGATIRGDNETITVGAGSNVQEGAVLHTDPGFPLTIAENVTIGHQAMLHGCTVGEGSLIGIQAVVLNGAVIGRNCLVGAGAVVTEGKTFPDNSLILGAPAKVVRELSADDIARLRANAKTYVERRAHFKEQLVRIG

SEQ ID NO: 60988 - protein, 175 aa, Ralstonia eutropha JMP134
MSFNLVSPGKDLPNDFNVIIEISAQSDPVKYEADKETGLLFVDRFIGTGMRYPANYGFIPQTLSGDGDPVDVLVITPFPILAGAVVRCRALGMLKMTDESGVDAKLVAVPVDKLSPATAFMKGLSDVPQNTLDQIKHFFENYKALEAGKWVKVEGWAGIEEAHKEITDGVANYKK

SEQ ID NO: 60989 - protein, 478 aa, Ralstonia eutropha JMP134
MHAQHFVANRLIAPDNGLRIKVFDPSNGEPFAEIARGNATDINVAVHAARQAADGAWGAMAPAERVRLLNRVALTLVAHEEELTALETRDTGKPVRQARADARAVARYFEFYAGAVDKLHGQTIPYNPGYTVFTLREPHGVTGHIIPWNYPLQIFGRSVGAALAAGNACVVKPAEDACLSLLRVAELAAEAGLPEGALNIVTGYGHEAGAALARHPGINHISFTGSPQTGKLVSQLAAENHVPVTLELGGKSPQIVFADADVDALVPVIVNGIVQNAGQTCSAGSRVLVERPLYNALLDRIASVFESLRVGPSELDLECGPLISRKQQQRVWDFVSDAQHAGISVMAQGQIVAEAPESGYYQVPMLFRDVPPAHRLAQEEVFGPLLAAMPFDSEAEAVALANGTPYGLVAGLWTRDGGRQLRLARKLRAGQVFINNYGAGGGVELPFGGTGQSGYGREKGFEALYGFTTLKTIAIQHG

SEQ ID NO: 60990 - protein, 427 aa, Burkholderia vietnamiensis G4
MSAIVDIIGREILDSRGNPTVECDVLLESGTMGRAAVPSGASTGSREAIELRDGEAGRYNGKGVLKAVEHINTEISEAIMGLDASEQAFLDKTLLELDGTDNKSRLGANAMLAVSMAVAKAAAEEAGLPLYRYFGGSGAMQLPVPMMNIVNGGAHANNSLDIQEFMIVPVSQPTFREALRCGAEVFHALKKILSDRGMSTAVGDEGGFAPNFGSNDECLSTILQAIEKAGYRAGEDVLLALDCAASEFYHDGKYQLAGEGLQLSSAEFTDYLATLADKFPIVSIEDGMHEGDWDGWKLLTERLGKKVQLVGDDLFVTNTRILKEGIEKGIANSILIKINQIGTLTETFAAIEMAKRAGYTAVISHRSGETEDSTIADIAVGLNAGQIKTGSLSRSDRISKYNQLLRIEEDLGDIASYPGKSAFYNLR

SEQ ID NO: 60991 - protein, 219 aa, Rhizobium sp. NGR234
MSLRINETAPDFTAETTHGTINFHEWIGDGWAVLFSHPKNFTPVCTTELGAMAGIEGEFRKRGVKIVGISVDPVDSHAKWKNDIKVATGFDVEYPLIGDRDLKVAKLYDMLPAGAGDTSEGRTPADNATVRSVYVIGPDKKIKLILTYPMTTGRNFNEILRAIDSIQLTAKHQVATPANWKQGEDVIITAAVSNEDATQRFGSFDTVLPYLRKTKQPTA

SEQ ID NO: 60992 - protein, 606 aa, Neisseria meningitidis
MPCMNHQSNSGEGVLVAKTYLLTALIMSMTISGCQVIHANQGKVNTHSAVITGADAHTPEHATGLIEQKQVIASDFMVASANPLATQAGYDILKQGGSAADAMVAVQTTLSLVEPQSSGLGGGAFVLYWDNTAKTLTTFDGRETAPMRATPELFLDKDGQPLKFMEAVVGGRSVGTPAIPKLMETIHQRYGVLPWGKLFDTPIRLAKQGFEVSPRLAISVEQNQQHLARYPKTAAYFLPNGVPLQAGSLLKNLEFADSVQALAAQGAKALHTGKYAQNIVSVVQNAKDNPGQLSLQDLSDYQVVERPPVCVTYRIYEVCGMGAPSSGGIAVGQILGILNEFSPNQVGYDAEGLRLLGDASRLAFADRDVYLGDPDFVPVPIRQLISKDYLKHRSQLLEQSDKALPSVSAGDFIHEWVSSQAIELPSTSHISIVDKAGNVLSMTTSIENAFGSTLMANGYLLNNELTDFSFEPIKQGKQVANRVEPSKRPRSSMAPTIVFKAGKPYMAIGSPGGSRIIGYVAKTIVAHSDWNMDIQDAISAPNLLNRFGSYELETGTTALQWQQALNDLGYKTDVRELNSGVQAIIIEPSRLVGGADPRREGRVMGD

SEQ ID NO: 60993 - protein, 468 aa, Photobacterium profundum SS9
MELLREREMEKPRLSFWQIWNMSFGFMGIQFGFGLQNANVSRIFETLGASIDQIPILWIAAPLTGLLVQPIIGYFSDRTWTPLGRRRPYFLFGAIASSLALVVMPYSPYLWVAAGMLWILDASINVSMEPFRALVADNLPSDQRTEGFAVQTFFIGVGSVIASAMPYVLSNVFNVANTAPVGEVPPSVKISFICGAVVFLGSILWTVYRTKEYSPKELAVFNGEDISDVKMASEPEEKASMKEILTDLRAMPKTMMQLAMVQFFSWFALFAMWIYTTSAVTSQIFGATDSSSALYNEGADWVGLCFAAYNGISALAAFALPWLARRTSRKFVHSLSLIIGGISLATVSLVESPNMLMLNMVGIGLAWASILCMPYAILAGALPAKKMGFYMGVFNFFIVLPQILAAGILGFFTRWAFNGDTMMAIVLGGVSMVFAGMLVVFVKDEDEPNKIPSATQRSSTLKSQVTTA

SEQ ID NO: 60994 - protein, 301 aa, Rhizobium sp. NGR234
MDRIRTVRKAVIPVAGNGTRFLPATKAVPKEMLTIVDRPVVQYAVDEARQAGIEHIVFVTSRNKQVIEDHFDDTPELISSLSRSGKNAQISELEAMLPKAGSVSFTRQQAPLGLGHAVWCARDLIGDEPFALLLPDMVSYGARGCMAGLMDLYREVGGNVVAVEQCAPEEASKYGIVGKGDTVRHGFSVTEMVEKPPAGQAPSNFYLNGRYILQPEIFSILAHQARGAGNEIQLTDGMLNLSADQPFHAHPYEGRTFDCGSKQGFIEANVAFALARADIGDVVFESVREIVLSHESRIRAA

SEQ ID NO: 60995 - protein, 606 aa, Neisseria meningitidis
MPCMNHQSNSGEGVLVAKTYLLTALIMSMTISGCQVIHANQGKVNTHSAVITGADAHTPEHATGLTEQKQVIASDFMVASANPLATQAGYDILKQGGSAADAMVAVQTTLSLVEPQSSGLGGGAFVLYWDNTAKTLTTFDGRETAPMRATPELFLDKDGQPLKFMEAVVGGRSVGTPAIPKLMETIHQRYGVLPWGKLFDTPIRLAKQGFEVSPRLAISVEQNQQHLARYPKTAAYFLPNGVPLQAGSLLKNLEFADSVQALAAQGAKALHTGKYAQNIVSVVQNAKDNPGQLSLQDLSDYQVVERPPVCVTYRIYEVCGMGAPSSGGIAVGQILGILNEFSPNQVGYDAEGLRLLGDASRLAFADRDVYLGDPDFVPVPIRQLISKDYLKHRSQLLEQSDKALPSVSAGDFIHEWVSSQAIELPSTSHISIVDKAGNVLSMTTSIENAFGSTLMANGYLLNNELTDFSFEPIKQGKQVANRVEPGKRPRSSMAPTIVFKAGKPYMAIGSPGGSRIIGYVAKTIVAHSDWNMDIQDAISAPNLLNRFGSYELETGTTALQWQQALNDLGYKTDVRELNSGVQAIIIEPSRLVGGADPRREGRVMGD

SEQ ID NO: 60996 - protein, 396 aa, Photobacterium profundum SS9
MFEKITAAPADPILGLTDEFKNDTRPEKINLGVGIYKDESGNTPVLATVKKAEAILLEKETTKSYLGIPGTAEYGLAVQQLLFGANATIISDKRAQTAQAPGGTGALRVAAEFIKRQLGDVKVWISNPTWANHIGVFAAAGLETASYSYYNAETKDIDFDAALADLANANEGDIVLLHGCCHNPTGIDPVEAQWHQLAALCVEKKLLPMFDFAYQGFAVGVEEDAQGLRIFAEQCSELLVASSFSKNFGLYNERVGAFTLVGKNAEQAATAFSQVKSIARVIYSNPPAHGAAIVTLILNDEALRNEWEQEVADMRNRIQEMRTLFVQTLKDCGVDADFSFIERQNGMFSFSGLNKDQVNRLKEEFGIYIVGSGRISVAGMTKNNMLPLCKGIAAVL

SEQ ID NO: 60997 - protein, 422 aa, Alkalilimnicola ehrlichei MLHE-1
MSSSPSPRFVSRLTRNTLVLILAGGRGSRLMDLTTWRAKPAVPFGGKFRIIDFTLSNCINSGIRRIGVLTQYKAHSLIRHLRLGWGSLRGDFGEFVEILPAQQRTEGSWYRGTADAVYQSLDIVRMHDPDYVLILAGDHVYKMDYGPMLARHVETGADVTVGCLEVPVEEASAFGVMAVDGDNRVVRFQEKPADPPSIPGQSDRALASMGIYIFNRAFLFNQLIADARKESDHDFGKDIIPSLIDQARVIAFPFRDAATGGQAYWRDVGTIDAFWRTNLELVGVNPQLNLYDKEWPIWTHQEQLPPAKFVFDDDDRRGMAVDSMVSGGCIISGAYLRRSLLFSSVVVEDGSRVEDAVILPEAHIEPGCRIRKAVIDKHCRLAAGTVIGEDPEEDARRFHLSPGGVVLVTPDMLGQEIHNVYT

SEQ ID NO: 60998 - protein, 192 aa, Nicotiana tabacum
MGGCDKQGFPMKQGVLTPGRVRLLLYRGTPCFRGYGRRNGERRRKSVRGCIVSPDLSVLNLVIVKKGENDLPGLTDTEKPRMRGPREPQRSEALYFKEDDVRKYVNTTAEFTTKWKGSKAPKIQRLVTPLTLQRKRARIADKKKRIAKAKSEAAEYQKLLASRLKEQREKRSESLAKKRSRLSAASKPSIAA

SEQ ID NO: 60999 - protein, 138 aa, Glycine max
SNPGNNAYMVAFAGQKYAARSLPIMFADNSHTITSFTLVLEFQEGTLQNLYWKSFGCDGCPSGSICLNQQDCAVPNKECQKNGGTACNMGIQLAFSGTDKNLDALNSWYEVQNLQQYSLYGLFSNLHDSIIGPYENLF

SEQ ID NO: 61000 - protein, 181 aa, Vibrio cholerae O1 biovar eltor str. N16961
MTTETLSLIKSSIKSIPDYPKKGILFRDVTSLLEDAQAYQATIQLLVEKYKDMGFTKVVGTEARGFLFGAPLALELGVGFVPVRKPGKLPRQTVAQSYELEYGTDTLEIHVDAIKPGDKVLVVDDLLATGGTIEATTKLIRQLGGEVEHAAFVINLPEIGGDKRLEGLGLQVYSICEFEGH

SEQ ID NO: 61001 - protein, 692 aa, Vibrio cholerae O1 biovar eltor str. N16961
MSYLALARKWRPTRFSEVVGQSHVLTALENALAQNRLHHAYLFSGTRGVGKTTIGRLFAKGLNCETGITATPCGQCATCQEIDQGRFVDLLEIDAASRTKVEDTRELLDNVQYKPARGRFKVYLIDEVHMLSRHSFNALLKTLEEPPEYVKFLLATTDPQKLPVTILSRCLQFHLKPISVENIQQQLDKVLHAEQISSDSKALNLLAHAADGSMRDALSLTDQAIALGNGVVKSDIVAHMLGTLDTDHSLHLLQAISLQTPQAVMDCIETLAQNGVEWDGLLQQLSTQLHRIAMYQALPATLDKSLPEASRIESLAKTLAPQDVQLYYQIALKGRQDLPLSPTARIGIEMLMLRMMAFRPSHVSLASVIVPPNTAVTAPTIAAPTSQMAAAAPQPQPVAQSNVSQSASQAMPHPVAPPMMAAQPVVESAVPVTQREASHSINAPEASVVTNTDTQSQASMPALAGLRHQLRSKRQEVQNKGADGKKSDATSATPASALERIAQRAQQVQVSPERNDEDELEPEEEIYQWRPMQPIEVAVKSEVTPTQLKKALEHEKTPEMGAKLIEEAVAQDAWSALVQRLETAKMVEQLALNSAFVRQGDQISLTLRPSHAHLHNEKAQQELEQALNHVLGEACSLNITVGQEGETPLELRERLYQQKLTSALHSLQTDPNVQFIERRFNAQLDSDSVRPI

SEQ ID NO: 61002 - protein, 424 aa, Glycine max
MKKKKQVPEWMNSSLWSTPSDPPASVSVREEPPTIPTNQNASPPLSSSSSVSSPTATADDISRHAQAQVQLLAELSRKVIDMRELRRVVASQGISDAGALRPTLWKLLLGYLPPDRSLWSSELAKKRSQYKNFKDDLLTNPSEITRRMYNSNSAALDIDDAKSHTQTRLLLSRSRITHQDHPLSLVKTSIWNQFFQDTEIIDQIDRDVNRTHPDIHFFSGDSLFAKSNQEALKTILIVFAKLNSGIRYFQGMNEVLAPLFYVFKNDPDEENEAFAEADTFFCFVELLSRFQDNFCQQLDNSIVGIRSTITRLSQLLKEHDEELWRHLEVTTKVNPQFYAFRWIILLLTQEFNFSDILHIWDVILSDPEGPQETLLRICCAMLILVRRRLLAGDFTSNLKMLQSYPSTNISHLLQVADKLHVQSV

SEQ ID NO: 61003 - protein, 540 aa, Phytophthora palmivora
QAQELVGMLNTAKIPSNVEVVVAPSQVHAATVKASLRADVRVSGQDVWKQGNGAFTGETSAEMLKDLGAEYTLVGHSERREKGETNEIVAKKAAYALEKGLGVIACIGETKEHREANQTVAYITEQLDAYAAEIKDWTNVVIAYEPIWAIGTGLTASPEQAQEVHASIRAWLKEKVSPDAADKTRVIYGGSVGAKNAPELSQKEDIDGFLVGGASLKPDFLQIINAQNPTDNVGGAVNVAINGFGRIGRLVLRAAATNPLINIVAINDPFISTTYMEYMLEYDTVHGKFAGSLSHDEKHIIVNGKAIRVFNEMNPANIKWGEEQVQYVVESTGAFTTTEKASAHLKNGVEKVVISAPSSDAPMFVMGVNHELYEKNMHVVSNASCTTNCLAPLAKVVNDKFGIKEGLMTTVHAVTATQKTVDGPSKKDWRGGRGACFNIIPSSTGAAKAVGKVIPSLNGKLTGMSFRVPTADVSVVDLTARLVNPASYEEIKAAIKSASENEMKGILGYTEKAVVSSDFIGDSHSSIFDAEAGIALTDDF

SEQ ID NO: 61004 - protein, 385 aa, Populus alba
MAIDCIKTMPSITTPHHHPKDQDQCKDDGKSFVFDAQVLRHQTNIPQQFIWPDHEKPNINAPELQVPLVDLGDFLSGNPVAAVEASRLVGEACKKHGFFLVVNHGVDKTLIAHAHNYVDTFFKLPLSEKQKAQRKIGESCGYASSFTGRFSSKLPWKETLSFRYKAEENSSKHIEEYFHNRMGEDFAEFGTVYQDYCEAMSTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYKSCLHRAVVNSQTPRKSLAFFLCPKNDKMVTPPHELVDTCNPRIYPDFTWPMLLEFTQKHYRADMKTLEVFTNWLHQRSLS

SEQ ID NO: 61005 - protein, 417 aa, Ehrlichia canis str. Jake
MERILVKKFGGTSLQDIKCINKVVEIIKQDINNNYKVVVIVSAMGKFTDNIISQIKQISDVKSPSERSEYDLIISSGEQISCGLLSLALQKVGINAQSWLGWQLPIVTTEDHTKARIIDINVNSLQDSLANNDVAIVAGFQGMHKNNRVTTLGRGGSDTSAVAIAVALGVDLCYIYTDVDGIYTADPNLVPKAHKLDYITYDEMIEMSSLGAKVLQVRSVEIAMKYNIKLCILSTFNPGKGTMLCKKGESHMESQLITGVTCNNKTASITLKQVKTLSGITTVFNAIAEKNINVDMIIQNMNDNNANDITFTISEEDLPTTKKFLTEIQSELMYQDLIINSEVAKVSIIGVGMISHSGIAYKMFDTLTSNNIKILAVTTSEIKISVLIYRKDSQLATVALHSAFELDSTESNLYTIS

SEQ ID NO: 61006 - protein, 475 aa, Phytophthora melonis
VGHSERREKGETNEVVAKKAAYALEKGLAVIACIGETKELREANQTVAFITEQLDAYAAEIKDWTNVVIAYEPIWAIGTGLTASPDQAQEVHASIRAWLKEKVSPEAAEKTRVIYGGSVGAKNAPELSQKADIDGFLVGGASLKPDFLQIINAQNPTDNVGGAVNVAINGFGRIGRLVLRAAAKNPLINIVAINDPFISTTYMEYMLEYDTVHGKFDGTLSHDEQHIFVNGKPIRVFNEMNPANIKWGEEQVQYVVESTGAFTTTEKASAHLQNGVEKVVISAPSSDAPMFVMGVNHELYEKNMHVVSNASCTTNCLAPLAKVVHDKFGIKEGLMTTVHAVTATQKTVDGPSKKDWRGGRGACFNIIPSSTGAAKAVGKVIPDLNGKLTGMSFRVPTADVSVVDLTARLVNPASYDEIKAAIKSASENEMKGILGYTEKAVVSSDFIGDSHSSIFDASAGIALTDDFVKLVSWYD

SEQ ID NO: 61007 - protein, 311 aa, Oryza sativa Japonica Group
MAAAAETSAKVGAPRRWSLQGKTALVTGGTRGIGRAVVEELAALGATVHTCSRKEEELSERLKEWEARGFRVTTSVCDLSVRDQRERLLRQVADLFGGKLDILVNNVGTNIRKPTTEFSAEEYSFMMATNLESAYHLCQLSHPLLKASGSGSIVFISSVCGLVAVFSGSLYAMTKGAINQLTKNLACEWARDNIRSNSIAPWYIRTSLTEGVKLLLINHPDLSCLDTCHFKSEHVVKYSTNCQDTLLANKDFEGAVVSRTPLRRVGEPEEVSSLVAFLCMPGSSYITGQTISVDGGNRYKSSVSMMVLAEQ

SEQ ID NO: 61008 - protein, 546 aa, Pythium vexans
TQLVGMLNTAKIPANVEVVVAPSAIHAAEVKRSLRADVRVSGQDVWSQGNGAFTGETSAEMLKDAGAEYTLVGHSERRQKGESNEVVAKKAAYALDKGLGVIACIGETKEQRESKQTLAVVTEQLDAYAKHVKDWSRVVIAYEPVWAIGTGLTATPEQAQEVHASIRNWLKTKVSQSAADSTRVIYGGSVTAANSAELSQKADIDGFLVGGASLKPDFLKIINAQNPTDKVTGAVNVAINGFGRIGRLVLRSSLNNPLVNVVAINDPFIAPQYMEYMLKYDTVHGILKADVSHDDEHVIVDGKKIRVYNKLNPAEITWNKEDVQYVVESTGAFTTTETASAHLKNGVEKVVISAPSKDAPMFVVGVNHELYEKDMHVVSNASCTTNCLAPLAKVINDTFGIKEGLMTTVHAVTATQKTVDGPSKKDWRGGRGACFNIIPSSTGAAKAVGKVIPSLNGKLTGMSFRVPTADVSVVDLTARLEKKASYDEIKAAVKHASETSMAGILGYTEESVVSSDFIGDSRSSIFDASAGIALTDDFVKLVSWYD

SEQ ID NO: 61009 - protein, 385 aa, Populus alba
MAIDCIKTMPSITTPHHHPKDQDQCKDDGKSFVFDAQVLRHQTNIPQQFIWPDHEKPNTNAPELQVPLVDLGDFLSGNPVAAVEASRLVGEACKKHGFFLVVNHGVDKTLIAHAHNYVDTFFKLPLSEKQKAQRKIGESCGYASSFTGRFSSKLPWKETLSFRYKAEESSSKHIEEYFHNRMGEDFAEFGTVYQDYCEAMSTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYRSCLHRAVVNSQTPRKSLAFFLCPKNDKMVTPPHELVDTCNPRIYPDFTWPMLLEFTQKHYRADMKTLEVFTNWLHQRSLS

SEQ ID NO: 61010 - protein, 546 aa, Phytophthora quercina
GSLGQAQELVGMLNTAKIPANVEVVVAPSQVHAATVKASLRADVRVSGQDVWKQGNGAFTGETSAEMLKDLGAEYTLVGHSERREKGETNEVVAKKAAYALEKGLGVIACIGESKETREANQTVNYITEQLNAYAAEIKDWTNVVIAYEPIWAIGTGLTASPEQAQDVHASIRAWLKEKVSSEAAEKTRVIYGGSVGAKNAPELSQKEDIDGFLVGGASLKPDFLQIINAQNPTDNVGGAVNVAINGFGRIGRLVLRAAATNPLINIVAINDPFISTTYMEYMLEYDTVHGKFAGSLSHDEKHIFVNGKPIRVFNEMNPENIKWGEEQVQYVVESTGAFTKLDNASAHLKNGVEKVVISAPSSDAPMFVMGVNHELYEKNMHVVSNASCTTNCLAPLAKVVNDKFGIKEGLMTTVHAVTATQKTVDGPSKKDWRGGRGACFNIIPSSTGAAKAVGKVIPSLNGKLTGMSFRVPTADVSVVDLTARLVNPASYEEIKAAIKSASENEMKGILGYTEKAVVSSDFIGDSHSSIFDASAGIALTDDFVK

SEQ ID NO: 61011 - protein, 152 aa, Solanum tuberosum
YKSPPPPSPSLPPPYVYKSPPPPSPSPPPPYYYKSPPPPSPSPPPPYYYKSPPPPSPSPPPPYYYKSPPPPPPVYKSPPPPVYKYKSPPPPVYKYKSPPPPPPVYKYKSPPPPVYKYKSPPPPVYKYKSPPPPVHKSPAPYYYTSPPPPSHY

SEQ ID NO: 61012 - protein, 161 aa, Vitis vinifera
MAERKNTRASIRKGIADPNSVAAIILGGGAGTRLFPLTSKRAKPAVPIGGCYKIIDIPMSNCINSGIKKIFILTRFNPASLNRHIDHIYNFGNMMHFWRQICGGETGQKWFQGTTEAVRQFIWVFDDAKNKNVEHILILSGDHLYRMDYMDFVKKHIDIKC

SEQ ID NO: 61013 - protein, 548 aa, Phytophthora richardiae
GNWKCNGSLGQAQELVGMLNTARIPADVEVVVAPSQVHAATVKASLRADVRVSGQDVWKQGNGAFTGETSAEMLKDLGAEYTLVGHSERREKGESNEIVAKKAAYALEKGLAVIACIGESKETREANETVAYITEQLDAYAAEIKDWTNVVIAYEPIWAIGTGLTASPEQAQDVHASIRAWLKEKVSPEAAEKTRVIYGGSVGAKNAPELSQKEDIDGFLVGGASLKPDFLQIINAQNPTENVGGAVNVAINGFGRIGRLVLRAAAKNPLINIVAINDPFISTTYMEYMLEYDTVHGKFDGALSHDEQHIFVNDKPIRVFNEMNPSNIKWGEEQVQYVVESTGAFTTLEKASTHLKNGVEKVVISAPSSDAPMFVMGVNHELYEKNMHVVSNASCTTNCLAPLAKVVNDKFGIKEGLMTTVHAVTATQKTVDGPSKKDWRGGRGACFNIIPSSTGAAKAVGKVIPSLNGKLTGMSFRVPTADVSVVDLTARLVNPASYDEIKAAIKSASENEMKGILGYTEKAVVSSDFIGDSHSSIFDAEAGIALTD

SEQ ID NO: 61014 - protein, 321 aa, Pseudomonas fluorescens PfO-1
MRALAALSRFVGNTFAYWVLIFAVIAFLQPAWFLGLKGAIVPLLGLVMFGMGLTLKLDDFAAVARHPWRVALGVVAHFVIMPGMAWLLCQIFHLPPEIAVGVILVGCCPSGTSSNVMTWLARGDLALSVAIAAVTTLLAPLLTPALIWLLASAWLPVSFMELFWSILQVVLLPIVLGVVAQRVLGDKVRHAVEVLPLVSVISIVIIVAAVVAASQAKIAESGLLIMAVVMLHNSFGYLLGYFTGRLFGLPLPQRKSLALEVGMQNSGLGAALASAHFSPLAAVPSALFSVWHNISGALLSTYFRRMSEKQDSETLAQQAAD

SEQ ID NO: 61015 - protein, 382 aa, Thermobifida fusca YX
MRAGMGRRIVIEADGASRGNPGPAGYGARVRDADTGELLAEVASPIGEATNNVAEYRGLIAGLEAAAAIDPTAAVEVRMDSKLVVEQMSGRWKIKHPALQPLARQARQVAASLASVTYRWVPREQNAQADRLANEALDGAVRNWSTQRTEPVQAAEPVEPPVDQGKTDGTALGWGPADTNPTRLLLLRHGQTPMSVERRFAGIGDIPLTEVGHEQAKAAARRLAQRPVDVVVSSPLRRTLDTAQYVAKECGLDVEVEEDFREADFGAWEGMTFAEARKHSPQEFHRWLSDPHVPPPGGESFAEVSRRVTRARDRVLARHRGRTVVVVTHVTPIKLLVQQAMLAPLPALYRMHLDVACLCEVHCFSDGPMVVRSLNDTGHLAC

SEQ ID NO: 61016 - protein, 538 aa, Vitis vinifera
MPELCDLQIHVNAQQTFFVNEKIISKYSGRLKKVIKQEKRRTQIKNSGIDIDDFPGGADGFELVSRFCYNHGKITVTVSNVSLLHCCAVFLGMTEKVSPCNLLQQTETFLEGMFYWSWNDILVSLKSCESFFSYADSSGLLEKLIGALLAKFAQNSDIILIAPSSSSSSSPETTSGFQFSSSTKNTPQSIRRRSSSKAWWFDDLSILPPKIIEKVIKSLGAYSTENNSLVLTKFLLHYLQKTAVHRKGSLNSRSEYGSLADTVAYGVILLGKTAFSWRGLFWILRVVSGLGLSRDCRIGLERLIGGMLDQATLDDLLVCGHDGGVYDVNLVLRLIRVFVSDDGVSAQKMKKVGRLIDKYLGEVSPDQNLKISKFLGVAESLPDSARDCFDGVYRAIDIYLQSHPTLSFEERSRLCRCLNYEKLTLEACKDLAKSPRIPPKIAVQALASQSQQCTIPTTQEFVYESPIKSHAQMVLYNSFDAESVSEENEDMRLNLQRMQWRVVELERACRKMKGEMSRMARNKIATSPGNNRALPRLC

SEQ ID NO: 61017 - protein, 309 aa, Brassica napus
MPPAGELQHQSPSKDKQPTDTQSAEAAAAIAAAAADAEAAGLWTQIKAEARRDAEAEPALASYLYSTILSHSSLERSISFHLGNKLCSSTLLSTLLYDLFLNTFTSDPSLRNATVADLRAARVRDPACISFSHCLLNYKGFLAIQAHRISHKLWTQTRKPLALALNSRISEVFAVDIHPAAKIGKGILLDHATGVVIGETAVIGNNVSILHHVTLGGTGKACGDRHPKIGDGCLIGAGATILGNVKIGCGAKVGAGSVVLIDIPPRATAVGNPARLVGGKEKPTIHDEECPGESMDHTSFISEWSDYII

SEQ ID NO: 61018 - protein, 638 aa, Cryptococcus neoformans var. neoformans JEC21
MNRNCSSSTPTSSHSPQQSEHKRRWWDDLTFTKCKKMFLRHLHFVGPGLVSSVAYIDPGNWATDLEAGADYGYKLLFVVLLASLAAVVLQLLSVRLGTTTGLSLPAQTRLLFLRLKSRYPRYRIPLTIALWTLYALAEIAIIATDLAELLGSAIALHLLFPKLPLFAGVLITAVDVLVVLVFFRSSSGRQGMMFFEIIIVSLVLAVFISFMILLKLTSPVWRDVFLGLVPSETLVKPGALYLGVGIIGATVMPHALFLGSFLSGVDRLNMIPQPPSMRKPRNVTMPSFNPFRRTRSIRSDSEQGEGVSTGISPVLLQAPRPSSGSEAAVLENDGAKDEVHLQDSVVELTKEEKLFAIEQKEYERNVRMFDRIKWVDVHLFHSTIDTAISLLSFALTINASILTLAGAVYYYNESPPSEGADLFGAFDLIKSYISHAAAIVFALALLCAGQSASITATLAGQVVSEGFINWKTSPFLRRLITRLLGVIPSAVVASAVGTKGLNTMLVASQVLLSIVLPTVVFPLVYLCSKHEIMTVQGPEVESIEMERIANSGASVSDPFALAATTPSLSPTTLGDDLAALGIESTTVRVEPDQSVDRPSRRSKSYVSPKWVTVLGYVLFVVIVLANVYVIVELCLGNG

SEQ ID NO: 61019 - protein, 74 aa, Herbaspirillum seropedicae
LPVKSVGVMGDGRTYEYVVALRAVQTQDFMTAHWAHLPHELLGRVSNRIINEVRGLNRVVYDISGKPPATIEWE

SEQ ID NO: 61020 - protein, 495 aa, Pseudomonas stutzeri
MRVSTLFEWKRPEVRALHLTWIAFYICFFVWFGMAPLASSMLKSVNWLFPEDLKLFAIANVALTIPARILVGMALDHWGPRRVFSVLLVVMAAPALFFAFGDSRTQLLVSRLILSSIGASFVVGIHMTAMWFKPKDIGFAEGFYAGWGNFGSAAAAMSLPAIAMPSFGGPEGWRWAIASSAIIMALYGVYYWFALTDGPAGTIHRKPHKASALEVSTWADMFKLIAWTIPMVGVLGILVWRIEGLGYLGSTGAMICYAAIVLVVVFQVVQILRVNVPILKKGVPEDDKYPFNTVAALNSTYFANFGAELAVVSMLPMFFEQTWGLTPTTAGIIAASFAFVNLVARPMGGLVSDRFGNRRFVMLAYMLGISVGFLLMGLMNSKWPLIVAVAITVLCSVFVQGAEGATFGIIPSIKRRVTGQISGMAGAYGNVGAVCYLTLYTFVTPSQFFMVIAAGAFVSFGLCLLWLKEPEGAFSDEYYVSSVDRELEARQKLAS

SEQ ID NO: 61021 - protein, 606 aa, Neisseria meningitidis
MPCMNHQSNSGEGVLVAKTYLLTALIMSMTISGCQVIHANQGKVNTHSAVITGADAHTPEHATGLIEQKQVIASDFMVASANPLATQAGYDILKQGGSAADAMVAVQTTLSLVEPQSSGLGGGAFVLYWDNTAKTLTTFDGRETAPMRATPELFLDKDGQPLKFMEAVVGGRSVGTPAIPKLMETIHQRYGVLPWGKLFDTPIRLAKQGFEVSPRLAISVEQNQQHLARYPKTAAYFLPNGVPLQAGSLLKNLEFADSVQALAAQGAKALHTGKYAQNIVSVVQNAKDNPGQLSLQDLSDYQVVERPPVCVTYRIYEVCGMGAPSSGGIAVGQILGILNEFSPNQVGYDAEGLRLLGDASRLAFADRDVYLGDPDFVPVPIRQLISKDYLKHRSQLLEQSDKALPSVSAGDFIHEWVSSQAIELPSTSHISIVDKAGNVLSMTTSIENAFGSTLMANGYLLNNELTDFSFEPIKQGKQVANRVEPGKRPRSSMAPTIVFKAGKPYMAIGSPGGSRIIGYVAKTIVAHSDWNMDIQDAISAPNLLNRFGSYELETGTTALQWQQALNDLGYKTDVRELNSGVQAIIIEPSRLVGGADPRREGRVMGD

SEQ ID NO: 61022 - protein, 249 aa, Triticum aestivum
YKKKQGCGPPPGIRGNFGTPQVSGLGRGDPDLGLNGGLPFHKAHGMTMYEYTKTDARLNRVFNEAMKSYTTIVTGKLVELYTGFQDVATLVDVGGGVGATIRAVTSKYPHIKGINFDLPHVIAEAPQSPGVEHVAGDMFKNVPSGDAIVLKWILHNWTDEHCTTLLRNCYNALPAHGKVVVVEGILPVEPEATSRGQQASLSDMIMLTHTAGGKERNQREFEQLAKAAGFTGVKTAYIYSNTWVIELTK

SEQ ID NO: 61023 - protein, 464 aa, Physcomitrella patens subsp. patens
MHFLGANPHISLWKLADKYGPLMSLRLGNKPYVVATSPETAKEFLKTLDANFGSRHYSSQSQYLLYGGQDVAFQESSPSWRNLKKIFTMELASPARLEASRHIREEEMIVLLRTIHSKGELELKSQLIDMISHVISRMVINKRFDDSVESDFPTLVQTHFRLAGAFVPGDYIPAVKWLDLGGFEAQMKKQKERMDAFIDDILVQHRERRAKGPVPMKEYDMVHVLLDRIETKDDQIQLTDTHVKALVLDAFLGASETIILTSEWAMAELLRHPSLMAKAQAELDAVVGRDRMVTESDLRHLTYLNTIIKETFRLHPAAALLLPRESAQPSQAFGYNFPAKTRVLINCYAIHRDPAIWHDPLVFNPDRFLQADLKDVDVKGRHFQLLPFGAGRRVCPGLSMGILTVQFILASLLHSFDWSLPGDMKPEDVDMTEIYGLTLPRAAPLPCAAKLRLPSHLLTTAQKP

SEQ ID NO: 61024 - protein, 326 aa, Rhizobium sp. NGR234
MQNNNILVVGGAGYIGSHTCLRLAEKGYNPIVYDNLSNGHEEFVRWGVLEKGDIRDRRRLDEVLARHKPRAVLHFAAMIEVGESVKDPVAFYDNNVIGTLTLLSATLAAGIEAFVFSSTCATYGLPDSVPMDETHKQAPINPYGRTKWVCEQALKDYGLYKGLRSVILRYFNAAGADLEGRIGEWHEPETHAIPLAIDAALGRRDGFKVFGTDYETRDGTCVRDYIHVLDLADAHVRAVDYLLEGGDSVELNLGTGTGTTVKELLTAIEKVSRRPFNVSYVGRRDGDSTTLVANNDKARQVLGWEPQYDLAAITESAWNWHSRRNG

SEQ ID NO: 61025 - protein, 332 aa, Caulobacter crescentus CB15
MSALPSVLDAIGNTPLIRLARASEATGCEILGKAEFMNPGQSVKDRAALAIIRDAEAKGLLRPGGRIVEGTAGNTGIGLAMVASALGYKTTIVIPRTQSQEKKDAIRLLGAELVEVDAVPYSNPDNYVRYSGRLAEELARTEPHGVIWANQFDNTANRDAHYHTTGPEIFDQTSGKVDGFICAVGSGGTLAGVAAALRERKPGVRIGLADPYGAALYAWYKDGELKSEGSSISEGIGQGRITANLEGLAIDDPFRVSDQEMLEVLYDLVQHEGLCLGGSAGINVAGAIKLATAMGPGHTIVTVLCDHGSRYQSKLFNPVFLKEKGLPTPPWM

SEQ ID NO: 61026 - protein, 537 aa, Phytophthora nicotianae
AQELVGMLNTAKIPADVEVVVAPSQVHAATVKASLRADVRVSGQDVWKQGNGAFTGETSAEMLKDLGAEYTLVGHSERREKGETNEIVAKKAAYALEKGLGVIACIGETKEHREANQTVTYITEQLDAYAAEIKDWTNVVIAYEPIWAIGTGLTASPEQAQEVHASIRAWLKEKVSPDAADKTRVIYGGSVGAKNAPELSQKEDIDGFLVGGASLKPDFLHIINAQNPTTNVGGAVNVAINGFGRIGRLVLRAAAKNPLINIVAINDPFISTTYMEYMLEYDTVHGRFDGSLSHDEKHIFVDGKPIRVFNEMDPANIKWGEEQVQYVVESTGAFTTLEKASAHMKNGVEKVVISAPSSDAPMFVMGVNHELYEKNMHVVSNASCTTNCLAPLAKVVNDKFGIKEGLMTTVHAVTATQKTVDGPSKKDWRGGRGACFNIIPSSTGAAKAVGKVIPSLNGKLTGMSFRVPTADVSVVDLTARLVNPASYDEIKAAIKSASENEMKGILGYTEKAVVSSDFIGDSHSSIFDAEAGIALTD

SEQ ID NO: 61027 - protein, 338 aa, Desulfovibrio vulgaris subsp. vulgaris str. Hildenborough
MRKTRIGINGFGRIGRQVFRAIHERYGDKAEVVAINDLFDAATNFHLLEYDTNYGRAPFTPEVDGNMARVGDWQVTCFAQRDPAQLIWGDVGVDVVIESTGIFRSAKQAHVHIENGAKKVIISAPAKEEDITIVMGVNHHAYDPQKHHVVSNASCTTNCLAPVALIIQEKYGIATGAMTTVHAYTNDQRILDLPHKDLRRARAAGLNIIPTSTGAAQAVAKVIPELKGKFTGYSLRVPIPTVSVVDFTAILERDATTEGLRADLKEAAQGRLSGILAFSEKPLVSSDFKGDPHSSIVEAEYTTVQDGRLAKVVAWYDNEWGYSCRLADLIMLMQEKGL

SEQ ID NO: 61028 - protein, 172 aa, Ehrlichia canis str. Jake
MNLDNLTSGDNVPKEINVVIEISQNSCPVKYEFDKKKNLFCVDRFLPTSMYYPCNYGFIPHTCAGDGDPVDVLVTTRFPVMPGAVLCARPVGVLVMCDEGGEDVKILAVPTSKIDQHYANIKNYSDFPVSFLNSITHFFSFYKKLEEDKFVSVDGWRDIKAAEDFILSALTK

SEQ ID NO: 61029 - protein, 547 aa, Phytophthora psychrophila
QELVGMLNTARIPANVEVVVAPSQVHAATVKAALRADVRVSGQDVWQQGNGAFTGETSAEMLKDLGAEFTLVGHSERREKGETNEVVAKKAAYALEKGLGVIACIGETKELREANQTVAYITEQLDAYAAEIKDWTDVVIAYEPIWAIGTGLTASPEQAQEVHASIRAWLKAKVSPEDAEKTRVIYGGSVGAKNAPELSQKEDIDGFLVGGASLKPDFLQIINAQNPTTNVGGAVNVAINGFGRIGRLVLRAAATNPLINVVAINDPFISTTYMEYMLEYDTVHGKFAGSLSHDEQNIYVNGKPIRVHNEMNPANIKWGEQQVQYVVESTGAFTAIETASAHMKNGVEKVVISAPSNDAPMFVMGVNHELYEKNMHVVSNASCTTNCLAPLAKVVNDKFGIKEGLMTTVHAVTATQKTVDGPSKKDWRGGRGACFNIIPSSTGAAKAVGKVIPSLNGKLTGMSFRVPTADVSVVDLTARLVNPASYDEIKAAIKSASENEMKGILGYTEKAVVSSDFIGDSHSSIFDASAGIALTDDFVKLVSWYDN

SEQ ID NO: 61030 - protein, 298 aa, Arabidopsis thaliana
MDSPFKPDVVRGQVALITGGGSGIGFEISSQFGKHGASIAIMGRRKQVLDDAVSALRSLGIQAIGLEGDVRKQEDARRVVEATFQHFGKLDILVNAAAGNFLAAAEDLSPNGFRTVLDIDAVGTFNMCHAALKYLKKGAPGRDSSSGGGSIINISATLHYTASWYQIHVSAAKAAVDATTRNLALEWGTDYDIRVNGIAPGPIGGTPGMSKLVPEEIENKTREYMPLYKVGEKWDIAMAALYLSCDSGKYVSGLTMVVDGGLWLSKPRHLPKEAVKQLSRAVEKRSRAKPVGLPTSKL

SEQ ID NO: 61031 - protein, 227 aa, Arabidopsis thaliana
MADSLLMEVNYRRPEKIPKLDEDCEGSESSSKQRVVKWGTAEDDEYLRQYLLFHYQFQKTQGFSIKWEQFDYNFRSRSMDKSPNEISERKSNAVLIREMTLTAIDKHNEAHGTKLVFVEHVEANYQLTRGLTCWLTFWATDMASSPPQSKIYQAHVWRRGQNFHTFIFRLKPTDEEIEAVEVQPPSPMLYELDKPPIVFSRPGPEDEALPGVPFVFNRTGAGLDPDW

SEQ ID NO: 61032 - protein, 126 aa, Magnetospirillum magnetotacticum MS-1
MAYSDKVIDHYEHPRNVGALDKDDSAVGTGLVGAPACGDVMKLQIKVSAEGIIEDAKFKTFGCGSAIASSSLVTEWVKGKTLDEAASIKNTDIAQELALPPVKIHCSVLAEDAIKAAIADYKKKSG

SEQ ID NO: 61033 - protein, 533 aa, Phytophthora brassicae
ELVGMLNTAKIPANVEVVVAPSQVHAATVKAALRADVRVSGQDVWQQGNGAFTGETSAEMLKDLGAEYTLVGHSERRENGETNEVVAKKAAYALEKGLAVIACIGESKETREANKTVAYITEQLDAYAAEIKDWTNVVIAYEPIWAIGTGLTASPEQAQDVHASIRAWLKEKVSSDAAEKTRVIYGGSVGAKNAPELSQKEDIDGFLVGGASLKPDFLHIINAQNPTENVGGPVNVAINGFGRIGRLVLRAAAKNPLINIVAINDPFISTTYMEYMLEYDTVHGTFDGSLSHDEKHIFVNGKPIRVFNEMNPANIKWGEEQVQYVVESTGAFTTLEKASTHLQNGVEKVVISAPSSDAPMFVMGVNHELYEKNMHVVSNASCTTNCLAPLAKVVNDKFGIKEGLMTTVHAVTATQKTVDGPSNKDWRGGRGACFNIIPSSTGAAKAVGKVIPSLNGKLTGMSFRVPTADVSVVDLTARLVNPASYDEIKAAIKDASENEMKGILGYTEKAVVSSDFIGDSRSSIFDASAGIAL

SEQ ID NO: 61034 - protein, 538 aa, Phytophthora gonapodyides
ELVGMLNTAKIPTNVEVVVAPSQVHAATVKASLRADVRVSGQDVWTQGNGAFTGETSAEMLKDLGAEYTLVGHSERRGKGESNADVAKKAAYALEKGLGVIACIGESKETREANETVAYITKQLDAYAAEINDWTNVVIAYEPIWAIGTGLTASPEQAQEVHASIRAWLKEKVSPEAAEKTRVIYGGSVGAKNAPELSQKEDIDGFLVGGASLKPDFLQIINAQNPTTNVGGAVNVAINGFGRIGRLVLRAAATNPLINIVAINDPFISTTYMEYMLEYDTVHGKFGGSLSHDEKHIFVNGKPIRVFNEMNPENIKWGEEQVQYVVESTGAFKTIETASAHMKNGVEKVVISAPSSDAPMFVMGVNHELYEKNMHVVSNASCTTNCLAPLAKVVNDKFGIKEGLMTTVHAVTATQKTVDGPSKKDWRGGRGACFNIIPSSTGAAKAVGKVIPSLNGKLTGMSFRVPTADVSVVDLTARLVNPASYDEIKAAIKSASENEMKGILGYTEKAVVSSDFIGDSHSSIFDASAGIALTDDFV

SEQ ID NO: 61035 - protein, 318 aa, Ehrlichia canis str. Jake
MLISSGTSSINLARCISKTTGIKLINTCITRFSDQELNVEVQENQDDKNKHVIVINSLCFPAHDNLIELLLLIDATNRALCPSKITLIVPYLCYTRQDRVMYRNLDSSSLMVSALSAKVIINTLETANINNIIFIDLHSNQLTGFFDTSITNLSSHAIFIEDIAGKYDMDNLVIVSPDYGALNRTRVFANALSRQYKLNNEIQVAVIDKYRAKPGVSEVMNIAGNVENKDCIIIDDIVDSAGTLCNAASALKDKGALKVSAYVTHGILSGNAIEKVTNSKLDNLTTTNTINHSSFNTPKIQILSIDKFLSNYILYNLV

SEQ ID NO: 61036 - protein, 127 aa, Symbiobacterium thermophilum IAM 14863
MSKAAEVIEIIKGMTALELKELKELFEETFGVTAAAPVAVAAAPAAGAAAAAPAAEEKTEFDVILKNPGANKIAVIKVVRELTGLGLKEAKDLVDGAPKPVKEKVSKADADAAAEKLKEAGAEVEVK

SEQ ID NO: 61037 - protein, 367 aa, Arabidopsis thaliana
MSRRSLTLLKNLARNANGSGIQTRSVTYMPRPGDGAPRAVTLIPGDGIGPLVTNAVEQVMEAMHAPIFFEKYDVHGEMSRVPPEVMESIRKNKVCLKGGLKTPVGGGVSSLNVQLRKELDLFASLVNCFNLPGLPTRHENVDIVVIRENTEGEYAGLEHEVVPGVVESLKVITKFCSERIAKYAFEYAYLNNRKKVTAVHKANIMKLADGLFLESCREVAKKYPSITYNEIIVDNCCMQLVAKPEQFDVMVTPNLYGNLVANTAAGIAGGTGVMPGGNVGADHAVFEQGASAGNVGKDKIVLENKANPVALLLSSAMMLRHLQFPSFADRPETAVKKVTAEGKCRTKDLGGTSTTQEVVDAGIAKLD

SEQ ID NO: 61038 - protein, 1136 aa, Physcomitrella patens subsp. patens
MAVLLHPSCARALLSFFRELTTGPSEEGEPCTLHAMVAFPWITPLRDWWPPGTIFPALLPLQIVSPEVAVRANLALRTSVQACDCHCLMPRGRESQRRAPGFVQRGRCTEVPGFVRVMECSEMWRGLSLLIPASVVALLILVSASASSWSVVCAGPRVCRIFSSRMRTPALSDSLQWKVVFEATKYEPYARKFLQNVMYMTHRKAGSGAVDCNHKQGIYCTISGGFMERWKISAIEFQTLQWCERISLMSSGFSLENASLSCEEHNNGIHYIPLRVKSWKNTGKVAFVNIVCRIGSVNEIKFGRAITSSGTSKYSVNNTPVTVSDLGAHFTSNCVHFCEDMRDVEEGMKMDFNGKMESLSADIKKTASECEGFDQFESLRGRGRLRSLAAVRITEESDAARKAAIEAADSWKFVDKSSFQPDSPVSIVEDGDVPSHTLNMAQVGDRTISKPCSNFEAVERKRLGFPSIDMSSVYTYNDQRIAELNREYREILEKQTPFTGGGAENFVESGSEDVELNESHRRNRYLQRNNSLDGTQSPGLEERKQAHESHRRAERSSWPGATNSDGHTLRTLEDYDDKLYWSDSAEDHMDLSQDTLSKAEELAEELYRDAMEMHERLSAEADMQAAFTALKVSGKGSHNLIAETKETCGTIMFSNSHVQNGSYGMLPSVLIQTDKSESRSISFSQTSQCSSDAPGSALGPTESAQLEKMVAAALNSRSKANQSAGSPQLNVEKGENIIIGDHMIKTFDYQDSGKDGDIRTVQQEMNKLRESNARKQLKIDSLQKWRTYYKLELEDRDRKLEQIEKGYAKELKKKHKSIKQMVKAHAKGIADLDAKRDELEDKLRGEIKGLNLVIEELSGQLYDMEEHLAAGGIPYKLHMSENTGPSSKTLLSAVIGVKEAAHTFSRTFMSYLKQHLSKARDLDEQICLESEVIVARPSDYKFLVQSFILRRMFLDFDSECYNIDSCMTEIFDLEEQSKACFQEYNTYTNVADSVTLLTDNRPHNVFLREFCFKKFLHIVSESTEEAFFGDFSHSDEICAGRHPSSRFYESYCKLAVSVWLLHRLAFSFQPPARMISVRKGAQFNPTYMESAVPGISSDADTDQSALPFEALVGLMVHPGFRVGSSIIRAQVYLVTT

SEQ ID NO: 61039 - protein, 367 aa, Arabidopsis thaliana
MSRQSSSLLKNLRSIASRSKIQTRSVTYMPRPGDGKPRPVTLIPGDGVGPLVTNAVQQVMEAMHAPVYFEPFEVHGDMKSLPEGLLESIKKNKVCLKGGLKTPVGGGVSSLNVNLRKELDLFASLVNCFNLPGLASRHENVDIVVIRENTEGEYAGLEHEVVPGVVESLKVITKFCSERIAKYAFEYAYLNNRKKVTAVHKANIMKLADGLFLESCQEVAKKYPSIAYNEIIVDNCCMQLVARPEQFDVMVTPNLYGNLVANTAAGIAGGSGVMPGGNVGAEYAVFEQGASAGNVGKDTTEEQKNANPVALLLSSAMMLRHLQFPSFADRLETAVKRVIAEGNCRTEDLGGNSTTQEVVDAVIANLD

SEQ ID NO: 61040 - protein, 156 aa, Thermobifida fusca YX
MPIEVGQNAPDFELADQHGQTVRLSDFRGRSRVAVVFYPLAFSGICDKELRQLHECMSEFTARSVQPLAISVDSMFAHRVWADREGVDFPLLSDFWPHGAVAQRYGVFDETKGVALRGSFLIDTEGVVRWKVVNPTFQGRDMDDYRQAFADLGWNP

SEQ ID NO: 61041 - protein, 257 aa, Zea mays
SCVSCPKHRLEGKVALVTGGATGIGEAIVRLFMEHGAKVCIADIQDEAGQQLRDALGGDAQGAMFVHCDVTSEEDVSRAVDAAAERFGALDVMVNNAGVTGTKVTDIRNVDFAEARRVLDVNVHGVFLGMKHAARAMIPRKRGSIVSLASVASAIGGTGPHVYTASKHAVVGLTKSVAAELGRHGVRVNCVSPYAVPTALSMPHLPQGARADDALKDFLAFVGGEANLKGVDAMPEDVAQAVLYRYFFCCCDKCVQD

SEQ ID NO: 61042 - protein, 759 aa, Shigella flexneri 2a str. 301
MDDQLKQSALDFHEFPVPGKIQVSPTKPLATQRDLALAYSPGVAAPCLEIEKDPLKAYKYTARGNLVAVISNGTAVLGLGNIGALAGKPVMEGKGVLFKKFAGIDVFDIEVDELDPDKFIEVVAALEPTFGGINLEDIKAPECFYIEQKLRERMNIPVFHDDQHGTAIISTAAILNGLRVVEKNISDVRMVVSGAGAAAIACMNLLVALGLQKHNIVVCDSKGVIYQGREPNMAETKAAYAVVDDGKRTLDDVIEGADIFLGCSGPKVLTQEMVKKMARAPMILALANPEPEILPPLAKEVRPDAIICTGRSDYPNQVNNVLCFPFIFRGALDVGATAINEEMKLAAVRAIAELAHAEQSEVVASAYGVQDLSFGPEYIIPKPFDPRLIVKIAPAVAKAAMESGVATRPIADFDVYIDKLTEFVYKTNLFMKPIFSQARKAPKRVVLPEGEEARVLHATQELVTLGLAKPILIGRPNVIEMRIQKLGLQIKAGVDFEIVNNESDPRFKEYWTEYFQIMKRRGVTQEQAQRALISNPTVIGAIMVQRGEADAMICGTVGDYHEHFSVVKNVFGYRDGVHTAGAMNALLLPSGNTFIADTYVNDEPDAEELAEITLMAAETVRRFGIEPRVALLSHSNFGSSDCPSSSKMRQALELVRDRAPDLMIDGEMHGDAALVEAIRNDRMPDSPLKGSANILVMPNMEAARISYNLLRVSSSEGVTVGPVLMGVAKPVHVLTPIASVRRIVNMVALAVVEAQTQPL

SEQ ID NO: 61043 - protein, 153 aa, Chorispora bungeana
MNSVSAFSEMFGSDYEPQGGDYCPTLATSCPKEPAGRKKFRETRHPIYRGVRQRNSGKWVSEVREPNKKTRIWLGTFRTAEMAARAHDVAALALRGRSACLNFADSAWRLRIPESTCAKDIQKAAAEAALAFQDETCDTTTTNHGLDMEGRCG

SEQ ID NO: 61044 - protein, 354 aa, Cochliobolus miyabeanus
MAEFVRAQIFGTTFEITSRYTDLQLVGMGAFGLVCSAKDQLTNQAVAVKKIMKPFSTPVLSKRTYRELKLLKHLRHENIISLSDIFISPLEDIYFVTELLGTDLHRLLTSRPLEKQFIQYFLYQILRGLKYVHSAGVVHRDLKPSNILVNENCDLKICDFGLARIQDPQMTGYVSTRYYRAPEIMLTWQKYDVEVDIWSAGCIFAEMLEGKPLFPGKDHVNQFSIITELLGTPPDDVIQTICSENTLRFVQSLPKRERQPLANKFKNAEPDAVDLLENMLVFDPRKRVRAEQALAHAYLAPYHDPTDEPVADEKFDWSFNDADLPVDTWKIMMYSEILDYHNVDAAVQEQENGS

SEQ ID NO: 61045 - protein, 153 aa, Chorispora bungeana
MTSVSTFSEMLGSEYESPTLSGEYCPALAASCPKKPAGRKKFRETRHPIYRGIRLRNSSKWVCEVREPNKKSRIWLGTFLTAEIAARAHDVAAIALRGKSACLNFADSAWRLRIPETTCPKDIQKAAAEAAVAFQAEINDTTTDHGLDRGDVG

SEQ ID NO: 61046 - protein, 387 aa, Exiguobacterium undae
GDGTGPDIWNAAVRVFDAAVEKAYNGEKKIEWKEVYAGEKAFNKTGNWLPEETLDLIREHIIAIKGPLTTPVGGGIRSLNVALRQELDLYTCLRPVRYFTGVPSPVKRPEDTDMVIFRENTEDIYAGIEYASGSEEAQKLLNFLQTETGVNKIRFPETSGLGIKPISKEGTERLVRAAIEYALENKRASLTLVHKGNIMKFTEGAFKNWGYELAEREYAEHVFTWNQYDRIKEEEGTDAANKAQSEAEAAGKLIVKDSIADIFLQQILTRPKEFDVVATMNLNGDYISDALAAQVGGIGIAPGANINYMTGHAIFEATHGTAPKYAGLDKVNPSSVILSGEMMFRHLGWNEAADLIIQSMEKSIEEKVVTYDFARLMDGATEVKCSE

SEQ ID NO: 61047 - protein, 659 aa, Shigella flexneri 2a str. 301
MNRFIMANSQQCLGCHACEIACVMAHNDEQHVLSQHHFHPRITVIKHQQQRSAVTCHHCEDAPCARSCPNGAISHVDDSIQVNQQKCIGCKSCVVACPFGTMQIVLTPVAAGKVKATAHKCDLCAGRENGPACVENCPADALQLVTDVALSGMAKSRRLRTARQEHQPWHASTAAQEMPVMSKVEQMQATPARGEPDKLAIEARKTGFDEIYLPFRADQAQREASRCLKFGEHSVCEWTCPLHNHIPQWIELVKAGNIDAAVELSHQTNTLPEITGRVCPQDRLCEGACTIRDEHGAVTIGNIERYISDQALAKGWRPDLSHVTKVDKRVAIIGAGPAGLACADVLTRNGVAVTVYDRHPEIGGLLTFGIPSFKLDKSLLARRREIFSAMGIHFELNCEVGKDVSLDLLLEQYDAVFVGVGTYRSMKAGLPNEDAPGVYDALPFLIANTKQVMGLEELPEEPFINTAGLNVVVLGGGDTAMDCVRTALRHGASNVTCAYRRDEANMPGSKKEVKNAREEGANFEFNVQPVALELNEQGHVCGIRFLRTRLGEPDAQGRRRPVPIEGSEFVMPADAVIMAFGFNPHGMPWLESHGVTVDKWGRIIADVESQYRYQTTNPKIFAGGDAVRGADLVVTAMAEGRHAAQGIIDWLGVKSVKSH

SEQ ID NO: 61048 - protein, 154 aa, Chorispora bungeana
MTSFSAFSEMLGSEYESPTLSGEYCPALAASCPKKPAGRKKFRETRHPIYRGVRLRNSGKWVCEVRGPNKKSRIWLGTFLTAEIAARAHDVAAIALRGKSACLNFADSAWRLRIPETTCPKDIQKAAAEAAVAFQAEINDTTTDHGLDMERRWW

SEQ ID NO: 61049 - protein, 387 aa, Exiguobacterium acetylicum
GDGTGPDIWNAAVRVFDAAVEKAYNGEKKIEWKEVYAGEKAFNKTGNWLPEETLDLIREHIIAIKGPLTTPVGGGIRSLNVALRQELDLYTCLRPVRYFTGVPSPVKRPEDTDMVIFRENTEDIYAGIEYAEGSEGAAKLLEFLQNEMGVNKIRFPETSGLGIKPISKEGTERLVRAAIEYALENKRASLTLVHKGNIMKFTEGAFKNWGYELAEREYAEHVFTWNQYDRIKEEEGTDAANKAQADAEAAGKLIVKDSIADIFLQQILTRPKEFDVVATMNLNGDYISDALAAQVGGIGIAPGANINYMTGHAIFEATHGTAPKYAGLDKVNPSSVILSGEMMFRHLGWNEAADLIIKSMETSIETKVVTYDFARLMDGATEVKCSE

SEQ ID NO: 61050 - protein, 175 aa, Chorispora bungeana
KKFRETRHPIYRGVRLRNSGKWVCEVREPNKKSRIWLGTFLTAEIAARAHDVAAIALRGKSACLNFADSAWRLRIPETTCPKDIQKAAAEAAVAFQAEINDTTKGHGLDVEETIVEAIFTEENSDGSYMDEEESMFGVPTLLASMAEGVLLPPPSVQFEYNYDFDGDTDVSLWSY

SEQ ID NO: 61051 - protein, 294 aa, Bordetella petrii
MPAGMPGVSACYSFTFGGLMAKVPILKLNDGNSIPQLGLGVWQVPDNEAAGCVKEALAAGYRLVDTAAIYGNEVGVGAGLRAAGVARKDLFITTKLWNDQHDYDAAQRAMDDSLHKLGLAYVDLYLIHWPVAGSDKYLDAWRALVAIKEDGRARSIGVSNFPQAQLQRLIDETGVVPAVNQVELHPGFAQKPLRAFHAAQGIATEAWSPLGQGTVMRDKALAALAEKYGKSAAQVTLRWHLQNGVIAIPKSVTPARIRANIDVLDFELSADDMAAIDGLPEGARLGPDPERFSG

SEQ ID NO: 61052 - protein, 392 aa, Haemophilus somnus 2336
MNDTVIQNQEHQSARKEWLKKIGIPLALIVLLVLMFMPTPDGLTVQGQKAIAIFCSALILWVCGSIPIYLTSLLVIILLPLTQTVAKDKVVFATLGYDVIWLMVSAFVLTSAMIKSNIARRFALWMITHFGQTPRKAMFVLILINFILVFFVPSTTARASLIVPICLILLEIYRAVPGESNFGKLMMLQGVQADAIATSGVMTGTAGNIIAVGFINNQAGGDIGYLDWLLASFPIAFVTMIISFLIGFKLFSMKKETHFFEALSRLQAEYKKLGSLTLDEKKAMAIFLLTVLLWATESYQKAWFGFKISVYMTAVIAAVLCLMPRIGLLTWSEAKIKWDLMLFAAGAYAAGNTLESTKGAQWIMDKVVHGLGLETMSHTAVYVVVIFVCMYV

SEQ ID NO: 61053 - protein, 356 aa, Hypocrea lixii
MAEFVRAQIFGTTFEITSRYSDLQPVGMGAFGLVCSARDQLTNQNVAVKKIMKPFSTPVLAKRTYRELKLLKHLRHENVISLSDIFISPLEDIYFVTELLGTDLHRLLTSRPLEKQFIQYFLYQIMRGLKYVHSAGVVHRDLKPSNILVNENCDLKICDFGLARIQDPQMTGYVSTRYYRAPEIMLTWQKYDVEVDIWSAGCIFAEMLEGKPLFPGKDHVNQFSIITELLGTPPDDVINTIASENTLRFVKSLPKRERQPLRNKFKNADDSAIDLLERMLVFDPKKRVTATQALAHEYLQPYHDPTDEPVADEKFDWSFNDADLPVDTWKIMMYSEILDYHNVEGAPNMEEQFPPQ

SEQ ID NO: 61054 - protein, 251 aa, Oryza sativa Japonica Group
RRARGEATEPKRAMAGGVVIGVAPPAAAEEPEPHVERLPADLLAHVLSLLPSFHDLSMAGGVSRRWRRAVERSLAGRRRMSFAGQRTGDDSTARFVRAAVNLRDLDISRSCWGCQITDQGLIRISTADCVKNLTSISLWGLAGITDNGVIQLVSRAHSLQHLNIGGTFITDESLYAVAKSCINLKSIIVWSCRHVTEAGLVALVGGCRRLECINVGGMRVPPESFAGLLAIRPALQIRSIPQILNANVQVS

SEQ ID NO: 61055 - protein, 333 aa, Vibrio cholerae O1 biovar eltor str. N16961
MAIKVGINGFGRIGRLALRASFDWPEIEFVQINDVAGDAATLAHLLEFDSVQGRWHHAVGSEADAILINGKRIRTTQEKSIDAVDWSGCDVVIEATGKHRKGEFLNQYLAQGVKRVVVSAPVKEEGIANIVVGVNDHIFNPEQHRIVTAASCTTNCIAPVVKVIHEKLGIAQASFTTIHNLTNTQTILDAPHKDLRRARACGMSLIPTTTGSAKAIIEIFPDLKGKIDGHAVRVPLANASLTDIIFDVQRDTTVEEINQLLKQASENELKGILGFEERPLVSIDYQGDQRSTIVDALSTMVVGKRMVKIYTWYDNEMGYATRTAELVRKVGLA

SEQ ID NO: 61056 - protein, 484 aa, Haemophilus somnus 2336
MSQKGDIGVIGLAVMGQNLILNMNDNGFKVVAYNRTTSKVDEFLAGATKGTNIIGAYSLEELAGKLEKPRKVMLMVRAGEVVDQFIEALLPHLEQGDIIIDGGNSNYPDTNRRVKALAEKGIRFIGSGVSGGEEGARHGPSIMPGGNEEAWQYVKPILQAISAKTDKGEPCCDWVGKEGSGHFVKMVHNGIEYGDMQLICEAYQFLKDGLGLSYDEMQQIFAEWKKTELDSYLIDITTDILGYKDADGEPLVEKILDTAGQKGTGKWTGINALDFGIPLTLITESVFARCVSSFKDQRVAASKLFNKTIGKVEGDKNVWIEAVRKALLASKIISYAQGFMLIREASENFGWNINYGATALLWREGCIIRSRFLGNIRDAYEANPDLIFLGSDPYFKGILENALSDWRKVVAKSIEVGIPMPCMASAVTFLDGYTSERVPANLLQAQRDYFGAHTYERTDKPRGEFFHTNWTGRGGNTASTTYDV

SEQ ID NO: 61057 - protein, 520 aa, Haemophilus somnus 2336
MRTIGNLADFRILFTSFNIGLKQNMNVNAENNCIVIFGASGDLTHRKLIPALYNLYKIGRLTENFSVLGVSRTDLSDEEFREKMRNALRKTEDITEEHLEKFCSHLYYQAIDTSNASDYGKLVPRLDELHDTYQTGGNTLYYMSTPPSLYGVIPECLATHGLNTEECGWKRLIVEKPFGYDIKTAKELDVQIHRFFEEHQIYRIDHYLGKETVQNLLVLRFSNGLFEPLWNRNFIDYVEITGAEEIGVEERGGYYNDSGAMRDMFQNHLLQVLAMVAMEPPAIINADSMRDEVAKVLHCLHPLSEDDIKNNLVLGQYTSSTIDGEVVNGYLQEKGVPADSNTETYIALRCEIDNWRWAGVPFYVRSGKRLPTRVTEIVIHFKTTPHPVFSQNAPENKLIIRIQPDEGISMRFGLKKPGAGFEAKEVSMDFRYADLATPSLLSAYDRLLLDAIKGDATLFARTDAVHACWKFVQPILNYKKDQGRVYEYEAGTWGPTEADKLIAKTGRVWRKPSGMMKKKV

SEQ ID NO: 61058 - protein, 627 aa, Ustilago maydis 521
MRLSVSACSSAVTRALPLSRASQIRSIATAPATSSALPKQATTAPRTTAAKSTATLPVPLSVASPQPLISHNSALARFVSSSAIATAPVASSVSSSSEASPYASPLPTSSLINVTTLPNRVRVATEATPGHFSAVGVYIDAGSRYERPWVAGESGSSHLLDRLAFKSTTNRSSQQMTSEIEALGGNVMCSSSRETIMYQSSVFNKDVSAVLSILADTILNPLLSPEELDVQREAAAYEIQEIWSKPEMILPELLHTTAYQSNTLGNPLLCPIESLEQMTAENLRNFMSTWYKPERIVVAGSGMPHEQLVELSQKLFGDLKPSSDPGRLSSGSSSLSSSPASSTSTSSSSRSSSLSSLFSRSSSNFSTSSSSSATPSPAELADLVSTPSHYTGGELYIPQSDLEFTHVYVAFEGLSIHDKDIYALATLQILLGGGGSFSAGGPGKGMYSRLYTNVLNQHHSVDYCAAFHHCYSDSGLFGISASVHPSFNASIVHVIARELELCTSSIYQGSVTQAELNRAKNQLKSSLVMALESRLVEVEDLGRQIQAHGKKVSVEEMCQKIDQVDLSTLNRVATRVLRPQKMSVSAAKSPRGSGQATVVAQGQLEGLGDVRDLLARRGLGVSPKHAA

SEQ ID NO: 61059 - protein, 531 aa, Phytophthora citrophthora
  misc_feature (359)..(359): Xaa can be any naturally occurring amino acid
VEVVVAPSQVHAATVKASLRSDVRVSGQDVWKQGNGAFTGETSAEMLKDLGAEYTLVGHSERREKGETNEVVAKKAAYALEKGLGVIACIGETKELREANKTVAYITEQLDAYAAEIKDWTNVVIAYEPIWAIGTGLTASPEQAQEVHASIRAWLKEKVSPEAAEKTRVIYGGSVGAKNAPELSQKEDIDGFLVGGASLKPDFLQIINAQNPTDNVGGAVNVAINGFGRIGRLVLRAAATNPLINIVAINDPFISTTYMEYMLEYDTVHGKFAGSLSHDEKHIFVNGKPIRVFNEMNPANIKWGEEQVQYVVESTGAFTTTEKASAHLQNGVEKVVISAPSSDAPMFVMGVNHELYEKXMHVVSNASCTTNCLAPLAKVVNDKFGIKEGLMTTVHAVTATQKTVDGPSKKDWRGGRGACFNIIPSSTGAAKAVGKVIPSLNGKLTGMSFRVPTADVSVVDLTARLVNPASYDEIKAAIKSASENEMKGILGYTEKAVVSSDFIGDSHSSIFDAEAGIALTDDFVKLVSWYD

SEQ ID NO: 61060 - protein, 486 aa, Pseudomonas sp. M1
MIPVPVEAIYCRIAAPVENDQSADIRRVFAAQRDTALQLRSYTAEERIHKLKRLRKDIEARREQNYSQRVRWNFGKPAIEVEMTEILTVIMEISHTCKHLKKWLKPKKIPSTALMLGTSASVRYEPRGRCLIISPRKYPLTMTFGPLVPAIASGNTVIIKTSELTPNLSAVMVDIIRDTFEESEVAIFEGDASVATELLSLPFDHSFFTGSPAIGKVVMRAAAEHLTSVTLELGGKSPTIIDESADLEMAVKTITWGKFLNAGQTCIAPDHLYVAASVKERFVQLLKQHLDKVYGEGEKARTAPLARIVNQRHAGRIAGLIKDAVERGAKPIYGASVDAQERFISPTLLEEVPADAKIMEEEIFGPVLPIITFEYLDDVIQRINNAPKPLALYIWSKNRQNIEHILQNTSAGASCINHIAGHFLHNNLPFGGVNNSGIGSYHAEWGIRAFSHERSVLESKIMLSSLFFPPYTQTTRRVLSWLFKFF

SEQ ID NO: 61061 - protein, 450 aa, Gloeobacter violaceus PCC 7421
MQKHYDLVVLGTGVAGSSVAKRCREAGWKVAVVDSRPFGGTCALRGCTPKKVLVQAGELLDRWRHLAGKGLRAEEARIDWPELMRFKRSLIEPLPAAREAEYAEAGIESYHGVARFVGATALEVEGAHLQGEKVLIATGSRPATLGIEGEEHLASSDDFLELGTLPRRIVFVGGGYISMEFAHLAARAGSQVHVLHQDERPLAPFDPDLVDRLIEATRELGALCLCHKVKAIEKTAQGLLVHTDGDGGPYAADLVVHGASRVPNVEALDLDGAGVEAGKKGIKVNAHLQSVSNPAVYAAGDVADAPGPQLTPVAGLHAETVAENLLKGNTRSLEQAVFASTVFTVPALAGVGLLEEQAQAQGLHYRVLQADHRDRLAVRSLAAPYAAHKILVEEPGGRILGAHLLGPFATEIINVFALAIQAQVDIDQLRATHFAYPTGSSEIFAMLSKG

SEQ ID NO: 61062 - protein, 462 aa, Porphyromonas gingivalis W83
MSRPRAEMPELDPLYRSSKINEEVNRGLSREAAMAEASRCLDCPQPSCMEGCPVSINIPTFIKQIEVGDILAAASTLRETSSLPAVCGRVCPQEKQCESRCIYTKMNKPAVAIGFLERFAADYEREQGALKVPEMAPRNGIKVAVIGSGPAGLSFSGDMAKLGYDVTVFEALHEIGGVLKYGIPEFRLPNSIVDSEINLLEEMGVRFETNTIVGRTIAYDDLHEAGFRGVFVGSGAGLPNFMNIPGENLVGVMSSNEYLTRVNLMHASQADSDTPVFKGKNVAVIGGGNTAMDSVRTAKRLGAERAMIVYRRSEEEMPARLEEVKHAKEEGIEFLTLHNPIEYIGNERGRVTAMRLQKMELGEPDAGGRRRPVAITGAIEEIPVDEVIVSIGVSPNPLVPRTISGLEVTSKGTIVVNESNQTALPDVFAGGDIVRGGATVILAMGDGRKAAAAMHEYLKAES

SEQ ID NO: 61063 - protein, 367 aa, Pseudomonas sp. M1
MKITAAVTRANSNGFSIENLELDEPRDDEVLVRIVGVGICHTDLVAAAGVLPIQPPAVFGHEGAGVVIKTGSKVTGVQSGDHVALSFHSCGECPRCRVDDPSYCHSFGLLNFTGIRQGGSNLHDATGAAVAGNFFGQSSFASHCVANQRNVVKVSKDIPLELVGPLGCGIQTGFGGVARALACEADSSILILGGGAVGLSAVMAAVIRGCQQIILTEPHAARRALALELGATAVIDQISEDVEQLFKGFLPAGVNYAFDTSGIGAALETAYRCLAPRATFGLVGVPQDWEQKLPGTLAEMVQSGIIFKGIIEGDSDPQQSIPELIALYQAGRLPIDKLVTTFPLAQINKAIAAQHAGTCVKHVLLAG

SEQ ID NO: 61064 - protein, 546 aa, Phytophthora cambivora
QELVGMLNTAKIPADVEVVVAPSQVHAATVKAALRPDVRVSGQDVWKQGNGAFTGETSAEMLKDLGAEYTLVGHSERREKGETNEVVAKKAAYALEKGLAVIACIGETKELREANQTVAYITEQLDAYAAEISDWTNVVIAYEPIWAIGTGLTASPDQAQEVHASIRAWLKEKVSVEAAEKTRVIYGGSVGAKNAPELSQKADIDGFLVGGASLKPDFLQIINAQNPTTNVGGAVNVAINGFGRIGRLVLRAAAKNPLINVVAINDPFISTTYMEYMLEYDTVHGKFDGTLSHDEQHIFVNGKPIRVFNEMNPANIKWAEEQVRYVVESTGAFTTTEKASTHLQNGVEKVVISAPSSDAPMFVMGVNHELYEKNMHVVSNASCTTNCLAPLAKVVNDKFGIKEGLMTTVHAVTATQKTVDGPSKKDWRGGRGACFNIIPSSTGAAKAVGKVIPSLNGKLTGMSFRVPTADVSVVDLTARLVNPASYDEIKAAIKSASENEMKGILGYTEKAVVSSDFIGDSHSSIFDASAGIALTDDFVKLVSWYD
